US007250289B2

(12) United States Patent
Zhou

(10) Patent No.: US 7,250,289 B2
(45) Date of Patent: Jul. 31, 2007

(54) METHODS OF GENETIC ANALYSIS OF MOUSE

(75) Inventor: Xue Mei Zhou, San Jose, CA (US)

(73) Assignee: Affymetrix, Inc., Santa Clara, CA (US)

(*) Notice: Subject to any disclaimer, the term of this patent is extended or adjusted under 35 U.S.C. 154(b) by 275 days.

(21) Appl. No.: 10/719,900

(22) Filed: Nov. 20, 2003

(65) Prior Publication Data

US 2005/0026164 A1 Feb. 3, 2005

Related U.S. Application Data

(60) Provisional application No. 60/427,808, filed on Nov. 20, 2002.

(51) Int. Cl.
*C12M 1/34* (2006.01)
*C12M 3/00* (2006.01)
*C07H 21/04* (2006.01)
*C12Q 1/68* (2006.01)

(52) U.S. Cl. .................. 435/287.2; 536/23.1; 536/24.3; 435/91.1

(58) Field of Classification Search ...................... None
See application file for complete search history.

(56) References Cited

U.S. PATENT DOCUMENTS

| | | | |
|---|---|---|---|
| 4,275,149 A | 6/1981 | Litman et al. | |
| 4,277,437 A | 7/1981 | Maggio | |
| 4,366,241 A | 12/1982 | Tom et al. | |
| 5,143,854 A | 9/1992 | Pirrung et al. | |
| 5,324,633 A | 6/1994 | Fodor et al. | |
| 5,679,523 A | 10/1997 | Li et al. | |
| 5,723,594 A | 3/1998 | Janjic et al. | |
| 5,800,992 A | 9/1998 | Fodor et al. | |
| 6,077,873 A | 6/2000 | Chanchik et al. | |
| 6,309,822 B1 * | 10/2001 | Fodor et al. | 435/6 |
| 6,344,339 B1 | 2/2002 | Menrad et al. | |
| 6,461,807 B1 | 10/2002 | Friend et al. | |
| 6,821,724 B1 | 11/2004 | Mittman et al. | |

FOREIGN PATENT DOCUMENTS

| | | |
|---|---|---|
| WO | WO 90/15070 | 12/1990 |
| WO | WO 92/10092 | 6/1992 |
| WO | WO 92/10588 | 6/1992 |

OTHER PUBLICATIONS

Marshall, Science, vol. 292, May 4, 2001; p. 822.*
Marshall, Science, vol. 296, May 10, 2002; p. 1005.*
Affymetrix Murine Genome U74 Set, version 2 (Mar. 2001).*
Affymetrix, Inc.; Product Information; GENECHIP Mu6500 Set; (1998).
Affymetrix, Inc.; Product Information; GENECHIP Mouse Expression Set 430; (2004).
Affymetrix, Inc.; Product Information; GENECHIP Murine Genome U74 Set; (2001).
Affymetrix, Inc.; Product Information; GENECHIP Murine 11K Set (2001).
Affymetrix, Inc.; Product Information; Murine 19K Set (1998).
Tanaka, et al; Genome-wide Expression Profiling of mid-gestation placenta and embryo using a 15,000 mouse developmental cDNA microarray; PNAS; Aug. 1, 2000; vol. 97; No. 16; pp. 9127-9132.
Wigle et al; Mining Mouse Microarray Data; Genome Biology; vol. 2; No. 7.
Fodor et al. "Light-directed, spatially addressable parallel chemical synthesis." Science. Feb. 15, 1991;251(4995):767-73.
Wodicka et al. "Genome-wide expression monitoring in *Saccharomyces cerevisiae*." Nat Biotechnol. Dec. 1997;15(13):1359-67.
Zhang et al. "Gene expression profiles in normal and cancer cells."Science. May 23, 1997;276(5316):1268-72.
Fox et al. "The serine/threonine kinase Pim-2 is a transcriptionally regulated apoptotic inhibitor." Genes Dev. Aug. 1, 2003;17(15):1841-54. Epub Jul. 17, 2003.
Devireddy and Green. "Transcriptional program of apoptosis induction following interleukin 2 deprivation: identification of RC3, a calcium/calmodulin binding protein, as a novel proapoptotic factor." Mol Cell Biol. Jul. 2003;23(13):4532-41.
Tietjen et al. "Single-cell transcriptional analysis of neuronal progenitors." Neuron. Apr. 24, 2003;38(2):161-75.
Mong et al. "Estradiol differentially regulates lipocalin-type prostaglandin D synthase transcript levels in the rodent brain: Evidence from high-density oligonucleotide arrays and in situ hybridization." Neuron. Apr. 24, 2003;38(2):161-75.
Oliver et al. "Transcriptional profiling of the Sonic hedgehog response: a critical role for N-myc in proliferation of neuronal precursors." Proc Natl Acad Sci U S A. Jun. 10, 2003;100(12):7331-6.
Black et al. "Distinct gene expression phenotypes of cells lacking Rb and Rb family members." Cancer Res. Jul. 1, 2003;63(13):3716-23.
Roberts and Szostak. "RNA-peptide fusions for the in vitro selection of peptides and proteins." Proc Natl Acad Sci U S A. Nov. 11, 1997;94(23):12297-302.
Cho et al. "Parallel analysis of genetic selections using whole genome oligonucleotide arrays." Proc Natl Acad Sci U S A. Mar. 31, 1998;95(7):3752-7.
Winzeler et al. "Direct allelic variation scanning of the yeast genome." Science. Aug. 21, 1998;281(5380):1194-7.
Andersson et al. "Comparative genome organization of vertebrates. The First International Workshop on Comparative Genome Organization." Mamm Genome. Oct. 1996;7(10):717-34.
Shoemaker et al. "Quantitative phenotypic analysis of yeast deletion mutants using a highly parallel molecular bar-coding strategy." Nat Genet. Dec. 1996;14(4):450-6.

* cited by examiner

*Primary Examiner*—Jehanne Sitton
(74) *Attorney, Agent, or Firm*—Sandra E. Wells

(57) ABSTRACT

The invention provides nucleic acid sequences which are complementary, in one embodiment, to a wide variety of mouse genes. The invention provides the sequences in such a way as to make them available for a variety of analyses. In one embodiment the nucleic acid sequences provided are present as an array of probes that may be used to measure gene expression of at least 30,000 mouse genes. As such, the invention relates to diverse fields impacted by the nature of molecular interaction, including chemistry, biology, medicine, and medical diagnostics.

6 Claims, No Drawings

METHODS OF GENETIC ANALYSIS OF MOUSE

RELATED APPLICATIONS

The present application claims priority to U.S. Provisional Application No. 60/427,808, filed Nov. 20, 2002, the disclosure of which is incorporated herein by reference in its entirety.

FIELD OF THE INVENTION

The present invention provides a unique pool of nucleic acid sequences useful for analyzing molecular interactions of biological interest. The invention therefore relates to diverse fields impacted by the nature of molecular interaction, including chemistry, biology, medicine, and medical diagnostics.

REFERENCE TO SEQUENCE LISTING

The Sequence Listing submitted on compact disk is hereby incorporated by reference. The file on the disk is named 3528.1seq.txt, the file is 137 MB and the date of creation is Nov. 20, 2003.

BACKGROUND OF THE INVENTION

Many biological functions are carried out by regulating the expression levels of various genes, either through changes in levels of transcription (e.g. through control of initiation, provision of RNA precursors, RNA processing, etc.) of particular genes, through changes in the copy number of the genetic DNA, through changes in RNA processing such as polyadenylation and splicing or RNA stability or through changes in protein synthesis. For example, control of the cell cycle and cell differentiation, as well as diseases, are characterized by the variations in the transcription levels of a group of genes. Gene expression is not only responsible for physiological functions, but also associated with pathogenesis. For example, the lack of sufficient functional tumor suppressor genes and/or the over expression of oncogene/protooncogenes leads to tumorgenesis. (See, e.g., Marshall, *Cell*, 64: 313-326 (1991) and Weinberg, *Science*, 254: 1138-1146 (1991)). Thus, changes in the expression levels of particular genes (e.g. oncogenes or tumor suppressors), serve as signposts for the presence and progression of various diseases. As a consequence, novel techniques and apparatus are needed to study gene expression in specific biological systems.

SUMMARY OF THE INVENTION

The invention provides nucleic acid sequences which are complementary to particular mouse genes and ESTs and makes them available for a variety of analyses, including, for example, gene expression analysis. In a preferred embodiment an array comprising nucleic acid probes where each probe is one of the sequences listed in SEQ ID Nos. 1-982,914 is disclosed. Each probe sequence may be present in a feature of known location that can be distinguished from other features that comprise probes of different sequence. For example, in one embodiment the invention comprises an array comprising any 10 or more, 100 or more, 1000 or more, 10,000 or more or 100,000 or more nucleic acid probes containing 9 or more consecutive nucleotides from the sequences listed in SEQ ID NOS: 1-982,914, or the perfect match, perfect mismatch, antisense match or antisense mismatch thereof. In a further embodiment, the invention comprises the use of any of the above arrays or fragments disclosed in SEQ ID Nos. 1-982,914 to: monitor gene expression levels by hybridization of the array to a DNA library; monitor gene expression levels by hybridization to an mRNA-protein fusion compound; identify polymorphisms; identify biallelic markers; produce genetic maps; analyze genetic variation; comparatively analyze gene expression between different species; analyze gene knockouts; or, to hybridize tag-labeled compounds. In a further embodiment the invention comprises a method of analysis comprising of hybridizing one or more pools of nucleic acids to two or more of the fragments disclosed in SEQ ID Nos. 1-982,914 and detecting said hybridization. In a further embodiment the invention comprises the use of any one or more of the fragments disclosed in SEQ ID Nos. 1-982,914 as a primer for PCR. In a further embodiment the invention comprises the use of any one or more of the fragments disclosed in SEQ ID Nos. 1-982,914 as a ligand. In another embodiment each of the sequences in SEQ ID Nos. 1-982,914 is synthesized on an array as a probe and the array is used to monitor gene expression from a biological sample isolated from mouse.

DETAILED DESCRIPTION OF THE INVENTION

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being or a mouse but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below.

However, other equivalent conventional procedures can, of course, also be used. Such conventional techniques and descriptions can be found in standard laboratory manuals such as *Genome Analysis: A Laboratory Manual Series (Vols. I-IV), Using Antibodies: A Laboratory Manual, Cells: A Laboratory Manual, PCR Primer: A Laboratory Manual,* and Molecular *Cloning: A Laboratory Manual* (all from Cold Spring Harbor Laboratory Press), Stryer, L. (1995) *Biochemistry* (4th Ed.) Freeman, New York, Gait, "*Oligonucleotide Synthesis: A Practical Approach*" 1984, IRL Press, London, Nelson and Cox (2000), *Lehninger, Principles of Biochemistry* 3$^{rd}$ Ed., W. H. Freeman Pub., New York, N.Y. and Berg et al. (2002) *Biochemistry*, 5$^{th}$ Ed., W. H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication Number WO 99/36760) and PCT/US01/04285, which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods are shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 60/319,253, 10/013,598, and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506. Genotyping arrays are described in U.S. patent application Ser. No. 10/681,773.

The present invention also contemplates sample preparation methods in certain preferred embodiments. Prior to or concurrent with hybridization to an array the nucleic acid sample may be amplified by a variety of mechanisms, some of which may employ PCR. See, e.g., *PCR Technology: Principles and Applications for DNA Amplification* (Ed. H.A. Erlich, Freeman Press, NY, N.Y., 1992); PCR Protocols: *A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. patent application Ser. No. 09/513,300, which are incorporated herein by reference.

Other suitable amplification methods include the ligase chain reaction (LCR) (e.g., Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and 6,582,938, each of which is incorporated herein by reference.

Additional methods of sample preparation techniques are described in Dong et al., *Genome Research* 11, 1418 (2001), in U.S. Pat. Nos. 6,361,947, 6,391,592, U.S. patent application Ser. No. 09/916,135, and U.S. Patent Publication Nos. 20030096235, 20030082543, and 20030036069.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* (2$^{nd}$ Ed. Cold Spring Harbor, N.Y., 1989); Berger and Kimmel *Methods in Enzymology*, Vol. 152, *Guide to Molecular Cloning Techniques* (Academic Press, Inc., San Diego, Calif., 1987); Young and Davism, *P.N.A.S*, 80: 1194 (1983). Methods and apparatus for carrying out repeated and controlled hybridization reactions have been described in U.S. Pat. Nos. 5,871,928, 5,874,219, 6,045,996 and 6,386,749, 6,391,623.

The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. patent application Ser. No. 60/364,731 and in PCT Application PCT/US99/06097 (published as WO99/47964).

Methods and apparatus for signal detection and processing of intensity data are disclosed in, for example, U.S. Pat. Nos. 5,143,854, 5,547,839, 5,578,832, 5,631,734, 5,800, 992, 5,834,758; 5,856,092, 5,902,723, 5,936,324, 5,981, 956, 6,025,601, 6,090,555, 6,141,096, 6,185,030, 6,201, 639; 6,218,803; and 6,225,625, in U.S. patent application Ser. No. 60/364,731 and in PCT Application PCT/US99/06097 (published as WO99/47964).

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, e.g. Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., $2^{nd}$ ed., 2001).

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170 and U.S. patent application Ser. No. 10/607,108.

Additionally, the present invention may have preferred embodiments that include methods for providing genetic information over networks such as the Internet as shown in U.S. patent applications Ser. Nos. 10/063,559, 60/349,546, 60/376,003, 60/394,574, 60/403,381.

I. Definitions

Massive Parallel Screening: The phrase "massively parallel screening" refers to the simultaneous screening of at least about 100, about 1000, about 10,000, about 100,000 or about 500,000 different nucleic acid hybridizations.

Nucleic Acid: The terms "nucleic acid" or "nucleic acid molecule" refer to a deoxyribonucleotide or ribonucleotide polymer in either single-or double-stranded form, and unless otherwise limited, would encompass analogs of natural nucleotides that can function in a similar manner as naturally occurring nucleotides. Nucleic acids may be derived from a variety or sources including, but not limited to, naturally occurring nucleic acids, clones, synthesis in solution or solid phase synthesis. A nucleic acid refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides, incorporation of phosphorothioate linkages, halogenated nucleosides and other nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

Nucleic acids according to the present invention may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

An "oligonucleotide" or "polynucleotide" is a nucleic acid ranging from at least 2, preferably at least 8, 15 or 20 nucleotides in length, but may be up to 50, 100, 1000, or 5000 nucleotides long or a compound that specifically hybridizes to a polynucleotide. Polynucleotides of the present invention include sequences of deoxyribonucleic acid (DNA) or ribonucleic acid (RNA) or mimetics thereof which may be isolated from natural sources, recombinantly produced or artificially synthesized. A further example of a polynucleotide of the present invention may be a peptide nucleic acid (PNA). (See U.S. Pat. No. 6,156,501 which is hereby incorporated by reference in its entirety.) The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application- .Probe: As used herein a "probe" is defined as a nucleic acid capable of binding to a target nucleic acid of complementary sequence through one or more types of chemical bonds, usually through complementary base pairing, usually through hydrogen bond formation. As used herein, a probe may include natural (i.e. A, G, U, C, or T) or modified bases (7-deazaguanosine, inosine, etc.). In addition, a linkage other than a phosphodiester bond may join the bases in probes. Modifications in probes may be used to improve or alter hybridization properties. Thus, probes may be peptide nucleic acids in which the constituent bases are joined by peptide bonds rather than phosphodiester linkages. Other modifications may also be used, for example, methylation or inclusion of a label or dye.

Target nucleic acid: The term "target nucleic acid" or "target sequence" refers to a nucleic acid or nucleic acid sequence which is to be analyzed. A target can be a nucleic acid to which a probe will hybridize. The probe may or may not be specifically designed to hybridize to the target. It is either the presence or absence of the target nucleic acid that is to be detected, or the amount of the target nucleic acid that is to be quantified. The term target nucleic acid may refer to the specific subsequence of a larger nucleic acid to which the probe is directed or to the overall sequence (e.g., gene or mRNA) whose expression level it is desired to detect. The difference in usage will be apparent from context.

The terms "mRNA or mRNA transcripts" as used herein, include, but are not limited to pre-mRNA transcript(s), transcript processing intermediates which may include introns, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

Primer is a single-stranded oligonucleotide capable of acting as a point of initiation for template-directed DNA synthesis under suitable conditions e.g., buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

Subsequence: "Subsequence" refers to a sequence of nucleic acids that comprise a part of a longer sequence of nucleic acids.

Perfect match: The term "match," "perfect match," "perfect match probe" or "perfect match control" refers to a nucleic acid that has a sequence that is designed to be perfectly complementary to a particular target sequence or portion thereof. For example, if the target sequence is 5'-GATTGCATA-3' the perfect complement is 5'-TATG-CAATC-3'. Where the target sequence is longer than the probe the probe is typically perfectly complementary to a portion (subsequence) of the target sequence. For example, if the target sequence is a fragment that is 800 bases, the perfect match probe may be perfectly complementary to a 25 base region of the target. A perfect match (PM) probe can be a "test probe", a "normalization control" probe, an expression level control probe and the like. A perfect match control or perfect match is, however, distinguished from a "mismatch" or "mismatch probe."

Mismatch: The term "mismatch," "mismatch control" or "mismatch probe" refers to a nucleic acid whose sequence is deliberately designed not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at the center of the probe, for example if the probe is 25 bases the mismatch position is position 13, also termed the central position, such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: 5'-AGGTCCA-3', a probe designed with a single homo-mismatch at the central, or fourth position, would result in the following sequence: 3'-TCCTGGT-5', the PM probe would be 3'-TCCAGGT-5'.

Array: An "array" is a solid support with at least a first surface having a plurality of different nucleic acid sequences attached to the first surface. An array is an intentionally created collection of molecules which can be prepared either synthetically or biosynthetically. The molecules in the array can be identical or different from each other. The array can assume a variety of formats, e.g., libraries of soluble molecules; libraries of compounds tethered to resin beads, silica chips, or other solid supports. Additionally, the term "array" is meant to include those libraries of nucleic acids which can be prepared by spotting nucleic acids of essentially any length (e.g., from 1 to about 1000 nucleotide monomers in length) onto a substrate.

An array is an intentionally created collection of nucleic acids which can be prepared either synthetically or biosynthetically and screened for biological activity in a variety of different formats (e.g., libraries of soluble molecules; and libraries of oligos tethered to resin beads, silica chips, or other solid supports). Additionally, the term "array" is meant to include those libraries of nucleic acids which can be prepared by spotting nucleic acids of essentially any length (e.g., from 1 to about 1000 nucleotide monomers in length) onto a substrate.

"Solid support", "support", and "substrate" are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations.

Gene Knockout: the term "gene knockout," as defined in Lodish et al. *Molecular Cell Biology* $3^{rd}$ *Edition*, Scientific American Books pub., which is hereby incorporated in its entirety for all purposes is, is a technique for selectively inactivating a gene by replacing it with a mutant allele in an otherwise normal organism.

DNA Library—as used herein the term "genomic library" or "genomic DNA library" refers to a collection of cloned DNA molecules consisting of fragments of the entire genome (genomic library) or of DNA copies of all the mRNA produced by a cell type (cDNA library) inserted into a suitable cloning vector.

A genome is all the genetic material of an organism. In some instances, the term genome may refer to the chromosomal DNA. Genome may be multichromosomal such that the DNA is cellularly distributed among a plurality of individual chromosomes. For example, in human there are 22 pairs of chromosomes plus a gender associated XX or XY pair. DNA derived from the genetic material in the chromosomes of a particular organism is genomic DNA. The term genome may also refer to genetic materials from organisms that do not have chromosomal structure. In addition, the term genome may refer to mitochondria DNA. A genomic library is a collection of DNA fragments representing the whole or a portion of a genome. Frequently, a genomic library is a collection of clones made from a set of randomly generated, sometimes overlapping DNA fragments representing the entire genome or a portion of the genome of an organism.

The term "chromosome" refers to the heredity-bearing gene carrier of a cell which is derived from chromatin and which comprises DNA and protein components (especially histones). The conventional internationally recognized individual human genome chromosome numbering system is employed herein. The size of an individual chromosome can vary from one type to another within a given multi-chromosomal genome and from one genome to another. In the case of the human genome, the entire DNA mass of a given chromosome is usually greater than about 100,000,000 bp. For example, the size of the entire human genome is about $3 \times 10^9$ bp. The largest chromosome, chromosome no. 1, contains about $2.4 \times 10^8$ bp while the smallest chromosome, chromosome no. 22, contains about $5.3 \times 10^7$ bp.

A "chromosomal region" is a portion of a chromosome. The actual physical size or extent of any individual chromosomal region can vary greatly. The term "region" is not necessarily definitive of a particular one or more genes because a region need not take into specific account the particular coding segments (exons) of an individual gene.

An allele refers to one specific form of a genetic sequence (such as a gene) within a cell, an individual or within a population, the specific form differing from other forms of the same gene in the sequence of at least one, and frequently more than one, variant sites within the sequence of the gene. The sequences at these variant sites that differ between different alleles are termed "variances", "polymorphisms", or "mutations". At each autosomal specific chromosomal location or "locus" an individual possesses two alleles, one inherited from one parent and one from the other parent, for example one from the mother and one from the father. An individual is "heterozygous" at a locus if it has two different alleles at that locus. An individual is "homozygous" at a locus if it has two identical alleles at that locus.

Polymorphism refers to the occurrence of two or more genetically determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic polymorphism has two forms. A triallelic polymorphism has three forms. Single nucleotide polymorphisms (SNPs) are included in polymorphisms.

A genetic map is a map that presents the order of specific sequences on a chromosome. A genetic map expresses the positions of genes relative to each othere without a physical anchor on the chromosome. The distance between markers is typically determined by the frequency of recombination, which is related to the relative distance between markers. Genetic map distances are typically expressed as recombination units or centimorgans (cM). The physical map gives the position of a marker and its distance from other genes or markers on the same chromosome in base pairs and related to given positions along the chromosome. See, *Color Atlas of Genetics*, Ed. Passarge, Thieme, New York, N.Y. (2001), which is incorporated by reference. Genetic variation refers to variation in the sequence of the same region between two or more individuals.

Hybridization is the association of two complementary nucleic acid strands or their derivatives (such as PNA) to form double stranded molecules. Hybrids may contain, for example, two DNA strands, two RNA strands, or one DNA and one RNA strand. Hybridization probes are oligonucleotides capable of binding in a base-specific manner to a complementary strand of nucleic acid. Such probes include peptide nucleic acids, as described in Nielsen et al., *Science* 254, 1497-1500 (1991), and other nucleic acid analogs and nucleic acid mimetics. See U.S. patent application Ser. No. 08/630,427.

Hybridizations are usually performed under stringent conditions, for example, at a salt concentration of no more than 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations. For stringent conditions, see, for example, Sambrook et al. which is hereby incorporated by reference in its entirety for all purposes above.

mRNA-protein fusion—a compound whereby an mRNA is directly attached to the peptide or protein it incodes by a stable covalent linkage.

Ligand—any molecule, other than an enzyme substrate, that binds tightly and specifically to a macromolecule, for example, a protein, forming a macromolecule-ligand complex.

Complementary or substantially complementary: Refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be substantially complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, substantial complementary exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. S. ee, M. Kanehisa Nucleic Acids Res. 12:203 (1984), incorporated herein by reference.

Combinatorial Synthesis Strategy: A combinatorial synthesis strategy is an ordered strategy for parallel synthesis of diverse polymer sequences by sequential addition of reagents which may be represented by a reactant matrix and a switch matrix, the product of which is a product matrix. A reactant matrix is a 1 column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

II. Mouse Array

An array is disclosed that allows for simultaneous measurement of relative gene expression levels for at least 30,000 mouse genes. Probes of the array are designed to be complementary to 25 contiguous bases of a selected gene. Mismatch probes may be included on the array for use as controls to measure discrimination and specificity. Antisense probes that are derived from the opposite strand of the gene may also be included. Other control sequence probes may also be included. Control probes may be included to assay for manufacturing defects, problems with sample preparation and problems with hybridization. In a preferred embodiment the array is a single solid support so that the expression levels for at least 30,000 mouse genes may be simultaneously analyzed in a single experiment using a single hybridization and a single chip. See, for example the U133 Plus 2.0 Array available from Affymetrix. This array allows analysis of over 47,000 human transcripts on a single chip. In another embodiment the probes are divided so that they are on two or more solid supports. The arrays may also be attached to pegs for high throughput analysis.

SEQ ID Nos. 1-982,914, encompassed in the Sequence listing, present target sequences included in the invention. Each target sequence corresponds to and represents at least four nucleic acid sequences included in the invention. For example, if the nucleic acid to be hybridized to the array has the sequence 5'-gatgctacc-3' the additional sequences included in the invention which are represented by this nucleic acid sequence are, for example:

5'-ggtagcatc-3'=(perfect) sense match
5'-ggtaccatc-3'=sense mismatch
5'-gatgctacc-3'=(perfect) antisense match
5'-gatggtacc-3'=antisense mismatch Accordingly, for each nucleic acid sequence listed in SEQ ID Nos. 1-982,914, this disclosure includes the corresponding sense match, sense mismatch, antisense match and antisense mismatch. The position of the mismatch is not limited to the above example, it may be located anywhere in the nucleic acid sequence and may comprise one or more bases. In a preferred embodiment the mismatch is located at the central position of the probe, for example, position 13 of a 25 mer probe.

When measuring expression one of skill in the art will recognize that the probes of the array should be designed to be complementary to the sequence to be detected. This may vary depending on which amplification method is used. For example, one method of amplification calls for reverse transcription of the mRNA using an oligo-dt-T7 primer. Double stranded cDNA with an RNA polymerase promoter is then generated and antisense RNA is transcribed and labeled. The antisense RNA is then hybridized to the array. The antisense RNA is complementary to the mRNA so the sense probe on the array that is designed to hybridize to the antisense RNA is identical in sequence to a portion of the starting mRNA. In another method the amplified RNA to be hybridized to the array is sense, meaning that it has the same sequence as the starting mRNA. In other embodiments the amplification product that is hybridized to the array may be cDNA that may be of the sense (same as) or antisense (complement of) orientation relative to the starting mRNA.

Consequently, the present invention includes: a) the target sequences listed in SEQ ID Nos. 1-982,914, or the sense-match, sense mismatch, antisense match or antisense mismatch thereof; b) clones which comprise the target nucleic acid sequences listed in SEQ ID Nos. 1-982,914, or the sense-match, sense mismatch, antisense match or antisense mismatch thereof; c) longer nucleotide sequences which include the nucleic acid sequences listed in SEQ ID Nos. 1-982,914, or the sense-match, sense mismatch, antisense match or antisense mismatch thereof and d) subsequences greater than 9 nucleotides in length of the target nucleic acid sequences listed in SEQ ID Nos. 1-982,914, or the sense match, sense mismatch, antisense match or antisense mismatch.

Target sequences were chosen to include more than 36,000 full-length mouse genes and EST clusters. These sequences were chosen as predicted coding sequences from genomic BAC entries. The EST clusters share homology with the predicted coding sequences from BAC cones. Target sequences were selected using the computer based methods described in U.S. Pat. No. 6,309,822 incorporated herein by reference for all purposes.

Each target sequence listed in SEQ ID NOS 1-982,914 corresponds to a GenBank database accession number. These accession numbers allow for the identification of sequences located in the GenBank sequence database through the use of computer programs such as BLAST. Access to BLAST is available to the public through the internet. One of skill in the art will be familiar with the use of the BLAST program to obtain information about particular sequences in order to, for example, determine the Gen-Bank accession number for a given sequence, determine the species from which the sequence is derived, determine the gene from which the sequence is derived, to determine other genes and species which contain similar sequences and to determine the degree of similarity between one sequence and another. All information relating to the target sequences available through the GenBank database is hereby incorporated by reference for all purposes.

The present invention provides a pool of unique nucleotide sequences complementary to Mouse sequences in particular embodiments which alone, or in combinations of 2 or more, 10 or more, 100 or more, 1,000 or more, 10,000 or more, or 100,000 or more, can be used for a variety of applications.

In one embodiment, the present invention provides for a pool of unique nucleotide sequences which are complementary to approximately 36,000 Mouse genes and ESTs formed into a high density array of probes suitable for array based massive parallel gene expression. Array based methods for monitoring gene expression are disclosed and discussed in detail in U.S. Pat. No. 5,800,992, U.S. Pat. No. 6,309,822, and PCT Application WO 92/10588 (published on Jun. 25, 1992), all of which are incorporated herein by reference for all purposes. Generally those methods of monitoring gene expression involve (1) providing a pool of target nucleic acids comprising RNA transcript(s) of one or more target gene(s), or nucleic acids derived from the RNA transcript(s);

(2) hybridizing the nucleic acid sample to a high density array of probes and (3) detecting the hybridized nucleic acids and calculating a relative expression (transcription, RNA processing or degradation) level.

The development of Very Large Scale Immobilized Polymer Synthesis or VLSIPS™ technology has provided methods for making very large arrays of nucleic acid probes in very small arrays. See U.S. Pat. No. 5,143,854 and PCT Patent Publication Nos. WO 90/15070 and WO 92/10092, and Fodor et al., *Science*, 251, 767-77 (1991), each of which is incorporated herein by reference. U.S. Pat. No. 5,800,992, describes methods for making arrays of nucleic acid probes that can be used to detect the presence of a nucleic acid containing a specific nucleotide sequence. Methods of forming high density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In a preferred detection method, the array of immobilized nucleic acids, or probes, is contacted with a sample containing target nucleic acids, to which a flourescent label is attached. Target nucleic acids hybridize to the probes on the array and any non-hybridized nucleic acids are removed. The array containing the hybridized target nucleic acids are exposed to light which excites the flourescent label. The resulting flourescent intensity, or brightness, is detected. Relative brightness is used to determine which probe is the best candidate for the perfect match to the hybridized target nucleic acid because flourescent intensity (brightness) corresponds to binding affinity. Once the position of the perfect match probe is known, the sequence of the hybridized target nucleic is known because the sequence and position of the probe is known.

In the array of the present invention the probes are presented in pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether a hybridization is or is not specific. For example, if the target is present, the perfect match probes should be consistently brighter than the mismatch probes because fluorescence intensity, or brightness, corresponds to binding affinity. (See, for example U.S. Pat. No. 5,324,633, which is incorporated herein for all purposes.) In addition, if all central mismatches are present, the mismatch probes can be used to detect a mutation. Finally the difference in intensity between the perfect match and the mismatch probe (I(PM)-I(MM)) provides a good measure of the concentration of the hybridized material. See pending PCT Application No. 98/11223, which is incorporated herein by reference for all purposes. The probe pairs are presented in both sense and antisense orientation, thereby eliciting a total of four probes per target sequence: sense match, sense mismatch, antisense match and antisense mismatch.

In another embodiment, the current invention provides a pool of sequences which may be used as probes for their complementary genes listed in the genbank database. Methods for making probes are well known. See for example Sambrook, Fritsche and Maniatis. "Molecular Cloning A laboratory Manual" 2$^{nd}$ Ed. Cold Spring Harbor Press (1989) ("Maniatis et al.") which is hereby incorporated in its entirety by reference for all purposes. Maniatis et al. describes a number of uses for nucleic acid probes of defined sequence. Some of the uses described by Maniatis et al. include: to screen cDNA or genomic DNA libraries, or subclones derived from them, for additional clones containing segments of DNA that have been isolated and previously sequenced; in Southern, northern, or dot-blot hybridization to identify or detect the sequences of specific genes; in Southern, or dot-blot hybridization of genomic DNA to detect specific mutations in genes of known sequence; to detect specific mutations generated by site-directed mutagenesis of cloned genes; and to map the 5' termini of mRNA molecules by primer extensions. Maniatis et al. describes other uses for probes throughout. See also Alberts et al. *Molecular Biology of the Cell* 3$^{rd}$ *edition*, Garland Publishing Inc. (1994) p. 307 and Lodish et al. *Molecular Cell Biology*, 3$^{rd}$ *edition*, Scientific American Books (1995) p. 285-286, each of which is hereby incorporated by reference in its entirety for all purposes, for a brief discussion of the use of nucleic acid probes in in situ hybridization. Other uses for probes derived from the sequences disclosed in this invention will be readily apparent to those of skill in the art. See, for example, Lodish et al. *Molecular Cell Biology*, 3$^{rd}$ *edition*, Scientific American Books (1995) p. 229-233, incorporated above, for a description of the construction of genomic libraries.

In another embodiment, the current invention may be combined with known methods to monitor expression levels of genes in a wide variety of contexts. For example, where the effects of a drug on gene expression are to be determined, the drug will be administered to an organism, a tissue sample, or a cell and the gene expression levels will be analyzed. For example, nucleic acids are isolated from the treated tissue sample, cell, or a biological sample from the organism and from an untreated organism tissue sample or cell, hybridized to a high density probe array containing probes directed to the gene of interest and the expression levels of that gene are determined. The types of drugs that may be used in these types of experiments include, but are not limited to, antibiotics, antivirals, narcotics, anti-cancer drugs, tumor suppressing drugs, and any chemical composition which may affect the expression of genes in vivo or in vitro. The current invention is particularly suited to be used in the types of analyses described by, for example, U.S. Pat. No. 6,309,822 and PCT Application No. 98/11223, each of which is incorporated by reference in its entirety for all purposes. As described in Wodicka et al., Nature Biotechnology 15 (1997), hereby incorporated by reference in its entirety for all purposes, because mRNA hybridization correlates to gene expression level, hybridization patterns can be compared to determine differential gene expression. As non-limiting examples: hybridization patterns from samples treated with certain types of drugs may be compared to hybridization patterns from samples which have not been treated or which have been treated with a different drug; hybridization patterns for samples infected with a specific virus may be compared against hybridization patterns from non-infected samples; hybridization patterns for samples with cancer may be compared against hybridization patterns for samples without cancer; hybridization patterns of samples from cancerous cells which have been treated with a tumor suppressing drug may be compared against untreated cancerous cells, etc. Zhang et al., Science 276 1268-1272, hereby incorporated by reference in its entirety for all purposes, provides an example of how gene expression data can provide a great deal of insight into cancer research. One skilled in the art will appreciate that a wide range of applications will be available using 2 or more, 10 or more, 100 or more, 1000 or more, 10,000 or more or 100,000 or more of the SEQ ID Nos. 1-982,914 sequences as probes for gene expression analysis. The combination of the nucleic acid array technology and the Mouse specific probes in this disclosure is a powerful tool for studying gene expression. Mouse arrays have been used by researchers in a variety of studies. See, for example, Fox, C. J. et al. Genes & Development 17, 1841-54, 2003, Black, E. P. et al. Cancer Research 63, 3716-23, 2003, Devireddy, L. R. et al. Molecular and Cellular Biology 23, 4532-41, 2003, Tietjen, I. et al. Neuron 38(2), 161-75, 2003, Mong, J. A. et al. Proceedings of the National Academy of Sciences of the United States of America 100(1), 318-23, 2003, and Oliver, T. G. et al. Proceedings of the National Academy of Sciences of the United States of America 100(12), 7331-6, 2003.

In another embodiment, the invention may be used in conjunction with the techniques which link specific proteins to the mRNA which encodes the protein. (See for example Roberts and Szostak Proc. Natl, Acad. Sci. 94 12297-12302 (1997), which is incorporated herein in its entirety for all purposes.) Hybridization of these mRNA-protein fusion compounds to arrays comprised of 2 or more, 10 or more, 100 or more, 1000 or more, 10,000 or more, or 100,000 or more the sequences disclosed in the present invention provides a powerful tool for monitoring expression levels.

In one embodiment, the current invention provides a pool of unique nucleic acid sequences which can be used for parallel analysis of gene expression under selective conditions. Without wishing to be limited, genetic selection under selective conditions could include: variation in the temperature of the organism's environment; variation in pH levels in the organism's environment; variation in an organism's food (type, texture, amount etc.); variation in an organism's surroundings; etc. Arrays, such as those in the present invention, can be used to determine whether gene expression is altered when an organism is exposed to selective conditions.

Methods for using nucleic acid arrays to analyze genetic selections under selective conditions are known. (See for example, R. Cho et al., Proc. Natl. Acad. Sci. 95 3752-3757 (1998), incorporated herein in its entirety for all purposes.) Cho et al. describes the use of a high-density array containing oligonucleotides complementary to every gene in the yeast *Saccharomyces cerevisiae* to perform two-hybrid protein-protein interaction screens for *S. cerevisiae* genes implicated in mRNA splicing and microtubule assembly. Cho et al. was able to characterize the results of a screen in a single experiment by hybridization of labeled DNA derived from positive clones. Briefly, as described by Cho et al., two proteins are expressed in yeast as fusions to either the DNA-binding domain or the activation domain of a transcription factor. Physical interaction of the two proteins reconstitutes transcriptional activity, turning on a gene essential for survival under selective conditions. In screening for novel protein-protein interactions, yeast cells are first transformed with a plasmid encoding a specific DNA-binding fusion protein. A plasmid library of activation domain fusions derived from genomic DNA is then introduced into these cells. Transcriptional activation fusions found in cells that survive selective conditions are considered to encode peptide domains that may interact with the DNA-binding domain fusion protein. Clones are then isolated from the two-hybrid screen and mixed into a single pool. Plasmid DNA is purified from the pooled clones and the gene inserts are amplified using PCR. The DNA products are then hybridized to yeast whole genome arrays for characterization. The methods employed by Cho et al. are applicable to the analysis of a range of genetic selections. High density arrays created using two or more, 10 or more, 100 or more, 1000 or more, 10,000 or more, or 100,000 or more of the sequences disclosed in the current invention can be used to analyze genetic selections in the mouse system using the methods described in Cho et al.

In another embodiment, the current invention provides a pool of unique nucleic acid sequences which can be used to identify biallelic markers, providing a novel and efficient approach to the study of genetic variation. For example, methods for using high density arrays comprised of probes which are complementary to the genomic DNA of a particular species to interrogate polymorphisms are well known. (See for example, U.S. Pat. No. 6,300,063 which is hereby incorporated by reference herein for all purposes.) Pools of 2 or more, 10 or more, 100 or more, 1000 or more, 10,000 or more, or 100,000 or more of the sequences disclosed in this invention combined with the methods described in the above patent provides a tool for studying genetic variation in the Mouse system.

In another embodiment of the invention, genetic variation can be used to produce genetic maps of various strains of Mouse. Winzeler et al., "Direct Allelic Variation Scanning of the Yeast Genome" Science. 281(5380):1194-7. (1998), which is hereby incorporated for all purposes describes methods for conducting this type of screening with arrays containing probes complementary to the yeast genome. Briefly, genomic DNA from strains which are phenotypically different are isolated, fragmented, and labeled. Each strain is then hybridized to identical arrays comprised of the nucleic acid sequences complementary to the system being studied. Comparison of hybridization patterns between the various strains then serve as genetic markers. As described by Winzler et al, these markers can then be used for linkage analysis. High density arrays created from 2 or more, 10 or more, 100 or more, 1000 or more, 10,000 or more, or 100,000 or more of the sequences disclosed in this invention can be used to study genetic variation using the methods described by Winzler et al.

In another embodiment genetic variation may be correlated with variation in gene expression pattern. Much of the genetic variation between individuals is the result of single nucleotide polymorphisms (SNPs). The presence of SNPs in or near a gene may result in differences in gene expression, which may result, for example, from changes in the rate of transcription, the stability of the mRNA, splicing of the mRNA, or translation of the mRNA. In one embodiment an array comprising SEQ ID Nos. 1-982,914 and probes to genotype selected SNPs in the mouse genome may be used to monitor genotype and expression changes that correlate with differences in genotype.

In another embodiment, the present invention may be used for cross-species comparisons. One skilled in the art will appreciate that it is often useful to determine whether a gene present in one species, for example mouse, is present in a conserved format in another species, including, without limitation, *Drosophila*, human, chicken, zebrafish, *Escherichia coli*, or yeast. See, for example, Andersson et al., Mamm. Genome 7(10):717-734 (1996), which is hereby incorporated by reference for all purposes, which describes the utility of cross-species comparisons. The use of 2 or more, 10 or more, 100 or more, 1000 or more, 10,000 or more or 100,000 or more of the sequences disclosed in this invention in an array can be used to determine whether any of the sequence from one or more of the mouse genes represented by the sequences disclosed in this invention is conserved in another species by, for example, hybridizing genomic nucleic acid samples from another species to an array comprised of the sequences disclosed in this invention. Areas of hybridization will yield genomic regions where the nucleotide sequence is highly conserved between the interrogation species and the mouse.

In another embodiment, the present invention may be used to characterize the genotype of knockouts. Methods for using gene knockouts to identify a gene are well known. See for example, Lodish et al. *Molecular Cell Biology*, 3rd Edition, Scientific American Books pub pp. 292-296 and U.S. Pat. No. 5,679,523, which are hereby incorporated by reference for all purposes. By isolating genomic nucleic acid samples from knockout species with a known phenotype and hybridizing the samples to an array comprised of 2 or more, 10 or more, 100 or more, 1000 or more, 10,000 or more, or 100,000 or more of the sequences disclosed in this invention, candidates genes which contribute to the phenotype will be identified and made accessible for further characterization.

In another embodiment, the present invention may be used to identify new gene family members. Methods of screening libraries with probes are well known. (See, for example, Maniatis et al, incorporated by reference above.) Because the present invention is comprised of nucleic acid sequences from specific known genes, 2 or more, 10 or more, 100 or more, 1000 or more, 10,000 or more, or 100,000 or more of sequences disclosed in this invention may be used as probes to screen genomic libraries to look for additional family members of those genes from which the target sequences are derived.

In another embodiment, the present invention may be used to provide nucleic acid sequences to be used as tag sequences. Tag sequences are a type of genetic "bar code" which can be used to label compounds of interest. The analysis of deletion mutants using tag sequences is described in, for example, Shoemaker et al., Nature Genetics 14 450-456 (1996), which is hereby incorporated by reference in its entirety for all purposes. Shoemaker et al. describes the use of PCR to generate large numbers of deletion strains. Each deletion strain is labeled with a unique 20-base tag sequence that can be hybridized to a high-density oligonucleotide array. The tags serve as unique identifiers (molecular bar codes) that allow analysis of large numbers of deletion strains simultaneously through selective growth conditions. The use of tag sequences need not be limited to this example however. The utility of using unique known short oligonucleotide sequences capable of hybridizing to a nucleic acid array to label various compounds will be apparent to one skilled in the art. One or more, 10 or more, 100 or more, 1000 or more, 10,000 or more, or 100,000 or more of the SEQ ID Nos. 1-982,914 sequences are excellent candidates to be used as tag sequences.

In another embodiment of the invention, the sequences of this invention may be used to generate primers directed to their corresponding genes as disclosed in the Genbank or any other public database. These primers may be used in such basic techniques as sequencing or PCR, see for example Maniatis et al., incorporated by reference above.

In another embodiment, the invention provides a pool of nucleic acid sequences to be used as ligands for specific genes. The sequences disclosed in this invention may be used as ligands to their corresponding genes as disclosed in the Genbank or any other public database. Compounds which specifically bind known genes are of interest for a variety of uses. One particular clinical use is to act as an antisense protein which specifically binds and disables a gene which has been, for example, linked to a disease. Methods and uses for ligands to specific genes are known. See for example, U.S. Pat. No. 5,723,594, which is hereby incorporated by reference in its entirety for all purposes.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In another embodiment, transcription amplification, as described above, using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example nick translation or end-labeling (e.g. with a labeled RNA) by kinasing of the nucleic acid and subsequent attachment (ligation) of a nucleic acid linker joining the sample nucleic acid to a label (e.g., a fluorophore).

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), phosphorescent labels, enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and calorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an aviden-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology, Vol. 24: Hybridization With Nucleic Acid Probes*, P. Tijssen, ed. Elsevier, N.Y., (1993), which is hereby incorporated by reference in its entirety for all purposes.

Fluorescent labels are preferred and easily added during an in vitro transcription reaction. In a preferred embodiment, fluorescein labeled UTP and CTP are incorporated into the RNA produced in an in vitro transcription reaction as described above.

EXAMPLE

The following example serves to illustrate the type of experiment that could be conducted using the invention.

Expression Monitoring by Hybridization to High Density Oligonucleotide Arrays

Arrays containing the desired number of probes can be synthesized using the method described in U.S. Pat. No. 5,143,854, incorporated by reference above. Extracted poly $(A)^+$ RNA can then be coverted to cDNA using the methods described below. The cDNA is then transcribed in the presence of labeled ribonucleotide triphosphates. The label may be biotin or a dye such as fluorescein. RNA is then fragmented with heat in the presence of magnesium ions. Hybridizations are carried out in a flow cell that contains the two-dimensional DNA probe arrays. Following a brief washing step to remove unhybridized RNA, the arrays are scanned using a scanning confocal microscope.

1. A Method of RNA Preparation:

Labeled RNA is prepared from clones containing a T7 RNA polymerase promoter site by incorporating labeled ribonucleotides in an IVT reaction. Either biotin-labeled or fluorescein-labeled UTP and CTP (1:3 labeled to unlabeled) plus unlabeled ATP and GTP is used for the reaction with 2500 U of T7 RNA polymerase. Following the reaction unincorporated nucleotide triphosphates are removed using size-selective membrane such as Microcon—100, (Amicon, Beverly, Mass.). The total molar concentration of RNA is based on a measurement of the absorbance at 260 nm. Following quantitation of RNA amounts, RNA is fragmented randomly to an average length of approximately 50 bases by heating at 94° in 40 mM Tris-acetate pH 8.1, 100 mM potassium acetate, 30 mM magnesium acetate, for 30 to 40 min. Fragmentation reduces possible interference from RNA secondary structure, and minimizes the effects of multiple interactions with closely spaced probe molecules. For material made directly from cellular RNA, cytoplasmic RNA is extracted from cells by the method of Favaloro et al. Methods Enzymol. 65:718-749 (1980) hereby incorporated by reference for all purposes, and poly $(A)^+$ RNA is isolated with an oligo dT selection step using, for example, Poly Atract, (Promega, Madison, Wis.). RNA can be amplified using a modification of the procedure described by Eberwine et al. Proc. Natl. Acad. Sci. USA 89:3010-3014 (1992), hereby incorporated by reference for all purposes. Microgram amounts of poly $(A)^+$ RNA are converted into double stranded cDNA using a cDNA synthesis kit (kits may be obtained from Life Technologies, Gaithersburg, Md.) with an oligo dT primer incorporating a T7 RNA polymerase promoter site. After second-strand synthesis, the reaction mixture is extracted with phenol/chloroform, and the double-stranded DNA isolated using a membrane filtration step using, for example, Microcon—100, (Amicon).

Labeled cRNA can be made directly from the cDNA pool with an IVT step as described above. The total molar concentration of labeled cRNA is determined from the absorbance at 260 nm and assuming an average RNA size of 1000 ribonucleotides. The commonly used convention is that 1 OD is equivalent to 40 ug of RNA, and that 1 ug of cellular mRNA consists of 3 pmol of RNA molecules. Cellular mRNA may also be labeled directly without any intermediate cDNA synthesis steps. In this case, Poly $(A)^+$ RNA is fragmented as described, and the 5' ends of the fragments are kinased and then incubated overnight with a biotinylated oligoribonucleotide (5'-biotin-AAAAAA-3') in the presence of T4 RNA ligase (available from Epicentre Technologies, Madison, Wis.). Alternatively, mRNA has been labeled directly by UV-induced cross-linking to a psoralen derivative linked to biotin (available from Schleicher & Schuell, Keene, N.H.).

2. Array Hybridization and Scanning:

Array hybridization solutions can be made containing 0.9 M NaCl, 60 mM EDTA, and 0.005% Triton X-100, adjusted to pH 7.6 (referred to as 6×SSPE-T). In addition, the solutions should contain 0.5 mg/ml unlabeled, degraded herring sperm DNA (available from Sigma, St. Louis, Mo.). Prior to hybridization, RNA samples are heated in the hybridization solution to 99° C. for 10 min, placed on ice for 5 min, and allowed to equilibrate at room temperature before being placed in the hybridization flow cell. Following hybridization, the solutions are removed, the arrays washed with 6×SSPE-T at 22° C. for 7 min, and then washed with 0.5×SSPE-T at 40° C. for 15 min. When biotin labeled RNA is used the hybridized RNA should be stained with a streptavidin-phycoerythrin in 6×SSPE-T at 40° C. for 5 min. The arrays are read using a scanning confocal microscope made by Molecular Dynamics (commercially available through Affymetrix, Santa Clara, Calif.). The scanner uses an argon ion laser as the excitation source, with the emission detected by a photomultiplier tube through either a 530 nm bandpass filter (flourescein) or a 560 nm longpass filter (phycoerythrin). Nucleic acids of either sense or antisense orientations may be used in hybridization experiments. Arrays for probes with either orientation (reverse complements of each other) are made using the same set of photolithgraphic masks by reversing the order of the photochemical steps and incorporating the complementary nucleotide.

3. Quantitative Analysis of Hybridization Patterns and Intensities:

Following a quantitative scan of an array, a grid is aligned to the image using the known dimensions of the array and the corner control regions as markers. The image is then reduced to a simple text file containing position and intensity information using software developed at Affymetrix (available with the confocal scanner). This information is merged with another text file that contains information relating physical position on the array to probe sequence and the identity of the RNA (and the specific part of the RNA) for which the oligonucleotide probe is designed. The quantitative analysis of the hybridization results involves a simple form of pattern recognition based on the assumption that, in the presence of a specific RNA, the perfect match (PM) probes will hybridize more strongly on average than their mismatch (MM) partners. The number of instances in which the PM hybridization is larger than the MM signal is computed along with the average of the logarithm of the PM/MM ratios for each probe set. These values are used to make a decision (using a predefined decision matrix) concerning the presence or absence of an RNA. To determine the quantitative RNA abundance, the average of the difference (PM-MM) for each probe family is calculated. The advantage of the difference method is that signals from random cross-hybridization contribute equally, on average, to the PM and MM probes, while specific hybridization contributes more to the PM probes. By averaging the pairwise differences, the real signals add constructively while the contributions from cross-hybridization tend to cancel. When assessing the differences between two different RNA samples, the hybridization signals from side-by-side experiments on identically synthesized arrays are compared directly. The magnitude of the changes in the average of the difference (PM-MM) values is interpreted by comparison with the results of spiking experiments as well as the signals observed for the internal standard bacterial and phase RNAs spiked into each sample at a known amount. Data analysis programs, such as those described in U.S. Pat. No. 6,600,996 perform these operations automatically. For additional methods of expression analysis see the GeneChip® Expression Analysis Technical Manual (2002), available from Affymetrix, Inc. which is hereby incorporated by reference for all purposes.

CONCLUSION

The inventions herein provide a pool of unique nucleic acid sequences which are complementary to approximately 36,000 full-length mouse genes and EST clusters from Unigene database (build 107). These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (982914 sequences)

SEQ ID NO: 1 - DNA, 25 bp, Mus musculus
aaaaaaaaatcacggccaggcatgg

SEQ ID NO: 2 - DNA, 25 bp, Mus musculus
aaaaaaaaatcagggccaggcatgg

SEQ ID NO: 3 - DNA, 25 bp, Mus musculus
aaaaaacaaccaccactgagctggg

SEQ ID NO: 4 - DNA, 25 bp, Mus musculus
aaaaaacaaccagcactgagctggg

SEQ ID NO: 5 - DNA, 25 bp, Mus musculus
aaaaaacaatgaccaactgggctgt

SEQ ID NO: 6 - DNA, 25 bp, Mus musculus
aaaaaacaatgagcaactgggctgt

SEQ ID NO: 7 - DNA, 25 bp, Mus musculus
aaaaaacactatcccacctgcttgt

SEQ ID NO: 8 - DNA, 25 bp, Mus musculus
aaaaaacactatgccacctgcttgt

SEQ ID NO: 9 - DNA, 25 bp, Mus musculus
aaaaaacacttgcaagggagactca

SEQ ID NO: 10 - DNA, 25 bp, Mus musculus
aaaaaacacttggaagggagactca

SEQ ID NO: 11 - DNA, 25 bp, Mus musculus
aaaaaacatcatatcgcctccatgg

SEQ ID NO: 12 - DNA, 25 bp, Mus musculus
aaaaaacatcatttcgcctccatgg

SEQ ID NO: 13 - DNA, 25 bp, Mus musculus
aaaaaacatgctcattctgtgaatt

SEQ ID NO: 14 - DNA, 25 bp, Mus musculus
aaaaaacatgctgattctgtgaatt

SEQ ID NO: 15 - DNA, 25 bp, Mus musculus
aaaaaacgacacagcgagccctcgg

SEQ ID NO: 16 - DNA, 25 bp, Mus musculus
aaaaaacgacactgcgagccctcgg

SEQ ID NO: 17 - DNA, 25 bp, Mus musculus
aaaaaacgctccaacctgagctgca

SEQ ID NO: 18 - DNA, 25 bp, Mus musculus
aaaaaacgctcctacctgagctgca

SEQ ID NO: 19 - DNA, 25 bp, Mus musculus
aaaaaactcctgaaggctttcagtg

SEQ ID NO: 20 - DNA, 25 bp, Mus musculus
aaaaaactcctgtaggctttcagtg

SEQ ID NO: 21 - DNA, 25 bp, Mus musculus
aaaaaactcggaactgccctgcagg

SEQ ID NO: 22 - DNA, 25 bp, Mus musculus
aaaaaactcggatctgccctgcagg

SEQ ID NO: 23 - DNA, 25 bp, Mus musculus
aaaaaactctttcgctgagtgctca

SEQ ID NO: 24 - DNA, 25 bp, Mus musculus
aaaaaactctttggctgagtgctca

SEQ ID NO: 25 - DNA, 25 bp, Mus musculus
aaaaaactgcatccccaatgttatg

SEQ ID NO: 26 - DNA, 25 bp, Mus musculus
aaaaaactgcatgcccaatgttatg

SEQ ID NO: 27 - DNA, 25 bp, Mus musculus
aaaaaactgcttactgctgctctct

SEQ ID NO: 28 - DNA, 25 bp, Mus musculus
aaaaaactgctttctgctgctctct

SEQ ID NO: 29 - DNA, 25 bp, Mus musculus
aaaaaactggaaactcaggctgaga

SEQ ID NO: 30 - DNA, 25 bp, Mus musculus
aaaaaactggaatctcaggctgaga

SEQ ID NO: 31 - DNA, 25 bp, Mus musculus
aaaaaactggtcatgatgtaagtcc

SEQ ID NO: 32 - DNA, 25 bp, Mus musculus
aaaaaactggtcttgatgtaagtcc

SEQ ID NO: 33 - DNA, 25 bp, Mus musculus
aaaaaagaccccagattctagcaca

SEQ ID NO: 34 - DNA, 25 bp, Mus musculus
aaaaaagacccctgattctagcaca

SEQ ID NO: 35 - DNA, 25 bp, Mus musculus
aaaaaagagcgcagactggtcttcc

SEQ ID NO: 36 - DNA, 25 bp, Mus musculus
aaaaaagagcgctgactggtcttcc

SEQ ID NO: 37 - DNA, 25 bp, Mus musculus
aaaaaagagctacacgtgcgttcaa

SEQ ID NO: 38 - DNA, 25 bp, Mus musculus
aaaaaagagctagacgtgcgttcaa

SEQ ID NO: 39 - DNA, 25 bp, Mus musculus
aaaaaagattccatatccatccatc

SEQ ID NO: 40 - DNA, 25 bp, Mus musculus
aaaaaagattccttatccatccatc

SEQ ID NO: 41 - DNA, 25 bp, Mus musculus
aaaaaagcaacacgcgtccatctct

SEQ ID NO: 42 - DNA, 25 bp, Mus musculus
aaaaaagcaacaggcgtccatctct

SEQ ID NO: 43 - DNA, 25 bp, Mus musculus
aaaaaagccacaactggtcaatcaa

SEQ ID NO: 44 - DNA, 25 bp, Mus musculus
aaaaaagccacatctggtcaatcaa

SEQ ID NO: 45 - DNA, 25 bp, Mus musculus
aaaaaagccagccaggccacctctg

SEQ ID NO: 46 - DNA, 25 bp, Mus musculus
aaaaaagccagcgaggccacctctg

SEQ ID NO: 47 - DNA, 25 bp, Mus musculus
aaaaaagcctcaaccatacacaaag

SEQ ID NO: 48 - DNA, 25 bp, Mus musculus
aaaaaagcctcatccatacacaaag

SEQ ID NO: 49 - DNA, 25 bp, Mus musculus
aaaaaagctcagaccttcttccact

SEQ ID NO: 50 - DNA, 25 bp, Mus musculus
aaaaaagctcagtccttcttccact

SEQ ID NO: 51 - DNA, 25 bp, Mus musculus
aaaaaagcttatcacttggtctcca

SEQ ID NO: 52 - DNA, 25 bp, Mus musculus
aaaaaagcttatgacttggtctcca

SEQ ID NO: 53 - DNA, 25 bp, Mus musculus
aaaaaagcttgcagaacttcacaga

SEQ ID NO: 54 - DNA, 25 bp, Mus musculus
aaaaaagcttgctgaacttcacaga

SEQ ID NO: 55 - DNA, 25 bp, Mus musculus
aaaaaaggctatcacttctttgaca

SEQ ID NO: 56 - DNA, 25 bp, Mus musculus
aaaaaaggctatgacttctttgaca

SEQ ID NO: 57 - DNA, 25 bp, Mus musculus
aaaaaaggtcccattccatgctagc

SEQ ID NO: 58 - DNA, 25 bp, Mus musculus
aaaaaaggtccctttccatgctagc

SEQ ID NO: 59 - DNA, 25 bp, Mus musculus
aaaaaaggttgtcgcctggcaatgt

SEQ ID NO: 60 - DNA, 25 bp, Mus musculus
aaaaaaggttgtggcctggcaatgt

SEQ ID NO: 61 - DNA, 25 bp, Mus musculus
aaaaaaggtttaaatctctacagat

SEQ ID NO: 62 - DNA, 25 bp, Mus musculus
aaaaaaggtttatatctctacagat

SEQ ID NO: 63 - DNA, 25 bp, Mus musculus
aaaaaagtcatcctgaccattgctg

SEQ ID NO: 64 - DNA, 25 bp, Mus musculus
aaaaaagtcatcgtgaccattgctg

SEQ ID NO: 65 - DNA, 25 bp, Mus musculus
aaaaaagtccttcagagatagctct

SEQ ID NO: 66 - DNA, 25 bp, Mus musculus
aaaaaagtccttgagagatagctct

SEQ ID NO: 67 - DNA, 25 bp, Mus musculus
aaaaaagtctcgcttacattgatct

SEQ ID NO: 68 - DNA, 25 bp, Mus musculus
aaaaaagtctcggttacattgatct

SEQ ID NO: 69 - DNA, 25 bp, Mus musculus
aaaaaagtgatcctagcatggtgga

SEQ ID NO: 70 - DNA, 25 bp, Mus musculus
aaaaaagtgatcgtagcatggtgga

SEQ ID NO: 71 - DNA, 25 bp, Mus musculus
aaaaaagtggccagtcacgcaccat

SEQ ID NO: 72 - DNA, 25 bp, Mus musculus
aaaaaagtggcctgtcacgcaccat

SEQ ID NO: 73 - DNA, 25 bp, Mus musculus
aaaaaatcaaatctggcccggcgtg

SEQ ID NO: 74 - DNA, 25 bp, Mus musculus
aaaaaatcaaatgtggcccggcgtg

SEQ ID NO: 75 - DNA, 25 bp, Mus musculus
aaaaaatcacaacgaattgcccaat

SEQ ID NO: 76 - DNA, 25 bp, Mus musculus
aaaaaatcacaaggaattgcccaat

SEQ ID NO: 77 - DNA, 25 bp, Mus musculus
aaaaaatcagagaggcttctttcaa

SEQ ID NO: 78 - DNA, 25 bp, Mus musculus
aaaaaatcagagtggcttctttcaa

SEQ ID NO: 79 - DNA, 25 bp, Mus musculus
aaaaaatcccctcagaagaactgtg

SEQ ID NO: 80 - DNA, 25 bp, Mus musculus
aaaaaatcccctgagaagaactgtg

SEQ ID NO: 81 - DNA, 25 bp, Mus musculus
aaaaaatccgaaaaggccgcctgtg

SEQ ID NO: 82 - DNA, 25 bp, Mus musculus
aaaaaatccgaataggccgcctgtg

SEQ ID NO: 83 - DNA, 25 bp, Mus musculus
aaaaaatcttgcctgacccaccatt

SEQ ID NO: 84 - DNA, 25 bp, Mus musculus
aaaaaatcttgcgtgacccaccatt

SEQ ID NO: 85 - DNA, 25 bp, Mus musculus
aaaaaatggcacaatgattccgcgt

SEQ ID NO: 86 - DNA, 25 bp, Mus musculus
aaaaaatggcactatgattccgcgt

SEQ ID NO: 87 - DNA, 25 bp, Mus musculus
aaaaaatggcctccctgttcaggag

SEQ ID NO: 88 - DNA, 25 bp, Mus musculus
aaaaaatggcctgcctgttcaggag

SEQ ID NO: 89 - DNA, 25 bp, Mus musculus
aaaaaatgggctatgtcctctcctg

SEQ ID NO: 90 - DNA, 25 bp, Mus musculus
aaaaaatgggctttgtcctctcctg

SEQ ID NO: 91 - DNA, 25 bp, Mus musculus
aaaaaatggtgacgctctgtcagaa

SEQ ID NO: 92 - DNA, 25 bp, Mus musculus
aaaaaatggtgaggctctgtcagaa

SEQ ID NO: 93 - DNA, 25 bp, Mus musculus
aaaaaatggtgtagccgcgccatct

SEQ ID NO: 94 - DNA, 25 bp, Mus musculus
aaaaaatggtgttgccgcgccatct

SEQ ID NO: 95 - DNA, 25 bp, Mus musculus
aaaaaatgtcacctatcagctcaaa

SEQ ID NO: 96 - DNA, 25 bp, Mus musculus
aaaaaatgtcacgtatcagctcaaa

SEQ ID NO: 97 - DNA, 25 bp, Mus musculus
aaaaaatgtcctcttgcctcttaga

SEQ ID NO: 98 - DNA, 25 bp, Mus musculus
aaaaaatgtcctgttgcctcttaga

SEQ ID NO: 99 - DNA, 25 bp, Mus musculus
aaaaaatgtctcaggtgcgggtgga

SEQ ID NO: 100 - DNA, 25 bp, Mus musculus
aaaaaatgtctctggtgcgggtgga

SEQ ID NO: 101 - DNA, 25 bp, Mus musculus
aaaaaattatttcgccgagatcttg

SEQ ID NO: 102 - DNA, 25 bp, Mus musculus
aaaaaattatttggccgagatcttg

SEQ ID NO: 103 - DNA, 25 bp, Mus musculus
aaaaaattcctgatgctggctgcag

SEQ ID NO: 104 - DNA, 25 bp, Mus musculus
aaaaaattcctgttgctggctgcag

SEQ ID NO: 105 - DNA, 25 bp, Mus musculus
aaaaaattctgtccgctggcctgtg

SEQ ID NO: 106 - DNA, 25 bp, Mus musculus
aaaaaattctgtgcgctggcctgtg

SEQ ID NO: 107 - DNA, 25 bp, Mus musculus
aaaaaatttctgcttctggacacaa

SEQ ID NO: 108 - DNA, 25 bp, Mus musculus
aaaaaatttctggttctggacacaa

SEQ ID NO: 109 - DNA, 25 bp, Mus musculus
aaaaacaaaacgagctaggcatggt

SEQ ID NO: 110 - DNA, 25 bp, Mus musculus
aaaaacaaaacgtgctaggcatggt

SEQ ID NO: 111 - DNA, 25 bp, Mus musculus
aaaaacaaagtgaggccaggcatgg

SEQ ID NO: 112 - DNA, 25 bp, Mus musculus
aaaaacaaagtgtggccaggcatgg

SEQ ID NO: 113 - DNA, 25 bp, Mus musculus
aaaaacaacagcatcggtatgtgat

SEQ ID NO: 114 - DNA, 25 bp, Mus musculus
aaaaacaacagcttcggtatgtgat

SEQ ID NO: 115 - DNA, 25 bp, Mus musculus
aaaaacaacctgagtctggccagac

SEQ ID NO: 116 - DNA, 25 bp, Mus musculus
aaaaacaacctgtgtctggccagac

SEQ ID NO: 117 - DNA, 25 bp, Mus musculus
aaaaacaacgcaaagggcctccaga

SEQ ID NO: 118 - DNA, 25 bp, Mus musculus
aaaaacaacgcatagggcctccaga

SEQ ID NO: 119 - DNA, 25 bp, Mus musculus
aaaaacaactgaatgtgcacttcaa

SEQ ID NO: 120 - DNA, 25 bp, Mus musculus
aaaaacaactgattgtgcacttcaa

SEQ ID NO: 121 - DNA, 25 bp, Mus musculus
aaaaacaactgtcagagatgtctgg

SEQ ID NO: 122 - DNA, 25 bp, Mus musculus
aaaaacaactgtcagctgcctagca

SEQ ID NO: 123 - DNA, 25 bp, Mus musculus
aaaaacaactgtgagagatgtctgg

SEQ ID NO: 124 - DNA, 25 bp, Mus musculus
aaaaacaactgtgagctgcctagca

SEQ ID NO: 125 - DNA, 25 bp, Mus musculus
aaaaacaagagtccccttttcagca

SEQ ID NO: 126 - DNA, 25 bp, Mus musculus
aaaaacaagagtgcccttttcagca

SEQ ID NO: 127 - DNA, 25 bp, Mus musculus
aaaaacaagcttcatcgggcaatgg

SEQ ID NO: 128 - DNA, 25 bp, Mus musculus
aaaaacaagcttgatcgggcaatgg

SEQ ID NO: 129 - DNA, 25 bp, Mus musculus
aaaaacaaggctcgcctcatttgct

SEQ ID NO: 130 - DNA, 25 bp, Mus musculus
aaaaacaaggctggcctcatttgct

SEQ ID NO: 131 - DNA, 25 bp, Mus musculus
aaaaacaattgtctttcctgatttg

SEQ ID NO: 132 - DNA, 25 bp, Mus musculus
aaaaacaattgtgtttcctgatttg

SEQ ID NO: 133 - DNA, 25 bp, Mus musculus
aaaaacacacttcgaagctggagag

SEQ ID NO: 134 - DNA, 25 bp, Mus musculus
aaaaacacacttggaagctggagag

SEQ ID NO: 135 - DNA, 25 bp, Mus musculus
aaaaacacatctacattgcagaggc

SEQ ID NO: 136 - DNA, 25 bp, Mus musculus
aaaaacacatcttcattgcagaggc

SEQ ID NO: 137 - DNA, 25 bp, Mus musculus
aaaaacaccaggatactatgcattt

SEQ ID NO: 138 - DNA, 25 bp, Mus musculus
aaaaacaccaggttactatgcattt

SEQ ID NO: 139 - DNA, 25 bp, Mus musculus
aaaaacaccatcacgcagggcaaga

SEQ ID NO: 140 - DNA, 25 bp, Mus musculus
aaaaacaccatctcgcagggcaaga

SEQ ID NO: 141 - DNA, 25 bp, Mus musculus
aaaaacactaccatgcagaaagatg

SEQ ID NO: 142 - DNA, 25 bp, Mus musculus
aaaaacactaccttgcagaaagatg

SEQ ID NO: 143 - DNA, 25 bp, Mus musculus
aaaaacactattcctctgttgagtt

SEQ ID NO: 144 - DNA, 25 bp, Mus musculus
aaaaacactattgctctgttgagtt

SEQ ID NO: 145 - DNA, 25 bp, Mus musculus
aaaaacactgagatgctttgggcaa

SEQ ID NO: 146 - DNA, 25 bp, Mus musculus
aaaaacactgagttgctttgggcaa

SEQ ID NO: 147 - DNA, 25 bp, Mus musculus
aaaaacagacgcagtctgcttccca

SEQ ID NO: 148 - DNA, 25 bp, Mus musculus
aaaaacagacgctgtctgcttccca

SEQ ID NO: 149 - DNA, 25 bp, Mus musculus
aaaaacagatctatgtgtgtcacat

SEQ ID NO: 150 - DNA, 25 bp, Mus musculus
aaaaacagatctttgtgtgtcacat

SEQ ID NO: 151 - DNA, 25 bp, Mus musculus
aaaaacagcccaatttcttcctatg

SEQ ID NO: 152 - DNA, 25 bp, Mus musculus
aaaaacagcccattttcttcctatg

SEQ ID NO: 153 - DNA, 25 bp, Mus musculus
aaaaacagcgcaagatggtccgggc

SEQ ID NO: 154 - DNA, 25 bp, Mus musculus
aaaaacagcgcatgatggtccgggc

SEQ ID NO: 155 - DNA, 25 bp, Mus musculus
aaaaacaggagcctgctaaggaaca

SEQ ID NO: 156 - DNA, 25 bp, Mus musculus
aaaaacaggagcgtgctaaggaaca

SEQ ID NO: 157 - DNA, 25 bp, Mus musculus
aaaaacaggcatactccacccgcag

SEQ ID NO: 158 - DNA, 25 bp, Mus musculus
aaaaacaggcattctccacccgcag

SEQ ID NO: 159 - DNA, 25 bp, Mus musculus
aaaaacagtagtcaggagccatgct

SEQ ID NO: 160 - DNA, 25 bp, Mus musculus
aaaaacagtagtgaggagccatgct

SEQ ID NO: 161 - DNA, 25 bp, Mus musculus
aaaaacagtgtcctagcctggcgat

SEQ ID NO: 162 - DNA, 25 bp, Mus musculus
aaaaacagtgtcgtagcctggcgat

SEQ ID NO: 163 - DNA, 25 bp, Mus musculus
aaaaacagttatcggctggagacat

SEQ ID NO: 164 - DNA, 25 bp, Mus musculus
aaaaacagttatgggctggagacat

SEQ ID NO: 165 - DNA, 25 bp, Mus musculus
aaaaacataggtagatgggtgaggc

SEQ ID NO: 166 - DNA, 25 bp, Mus musculus
aaaaacataggttgatgggtgaggc

SEQ ID NO: 167 - DNA, 25 bp, Mus musculus
aaaaacatatggaccgcgcttgtat

SEQ ID NO: 168 - DNA, 25 bp, Mus musculus
aaaaacatatggtccgcgcttgtat

SEQ ID NO: 169 - DNA, 25 bp, Mus musculus
aaaaacatcactaagcacgcctggc

SEQ ID NO: 170 - DNA, 25 bp, Mus musculus
aaaaacatcacttagcacgcctggc

SEQ ID NO: 171 - DNA, 25 bp, Mus musculus
aaaaacatcagaccacattcctaga

SEQ ID NO: 172 - DNA, 25 bp, Mus musculus
aaaaacatcagagcacattcctaga

SEQ ID NO: 173 - DNA, 25 bp, Mus musculus
aaaaacatccaccattgcatgaaaa

SEQ ID NO: 174 - DNA, 25 bp, Mus musculus
aaaaacatccacgattgcatgaaaa

SEQ ID NO: 175 - DNA, 25 bp, Mus musculus
aaaaacatccctcctatgactccaa

SEQ ID NO: 176 - DNA, 25 bp, Mus musculus
aaaaacatccctgctatgactccaa

SEQ ID NO: 177 - DNA, 25 bp, Mus musculus
aaaaacatggcccatctccagctca

SEQ ID NO: 178 - DNA, 25 bp, Mus musculus
aaaaacatggccgatctccagctca

SEQ ID NO: 179 - DNA, 25 bp, Mus musculus
aaaaacatgtacaaacagactggct

SEQ ID NO: 180 - DNA, 25 bp, Mus musculus
aaaaacatgtactaacagactggct

SEQ ID NO: 181 - DNA, 25 bp, Mus musculus
aaaaacatgtctctcctaccaaaag

SEQ ID NO: 182 - DNA, 25 bp, Mus musculus
aaaaacatgtctgtcctaccaaaag

SEQ ID NO: 183 - DNA, 25 bp, Mus musculus
aaaaacattatgagacgatatgagc

SEQ ID NO: 184 - DNA, 25 bp, Mus musculus
aaaaacattatgtgacgatatgagc

SEQ ID NO: 185 - DNA, 25 bp, Mus musculus
aaaaacattctgcaaacagttgaat

SEQ ID NO: 186 - DNA, 25 bp, Mus musculus
aaaaacattctggaaacagttgaat

SEQ ID NO: 187 - DNA, 25 bp, Mus musculus
aaaaaccacaatctgtgtcccctcg

SEQ ID NO: 188 - DNA, 25 bp, Mus musculus
aaaaaccacaatgtgtgtcccctcg

SEQ ID NO: 189 - DNA, 25 bp, Mus musculus
aaaaaccactaactggagttcagat

SEQ ID NO: 190 - DNA, 25 bp, Mus musculus
aaaaaccactaagtggagttcagat

SEQ ID NO: 191 - DNA, 25 bp, Mus musculus
aaaaaccaggccacagcacattgct

SEQ ID NO: 192 - DNA, 25 bp, Mus musculus
aaaaaccaggcctcagcacattgct

SEQ ID NO: 193 - DNA, 25 bp, Mus musculus
aaaaaccatccaattgagtggaaat

SEQ ID NO: 194 - DNA, 25 bp, Mus musculus
aaaaaccatccatttgagtggaaat

SEQ ID NO: 195 - DNA, 25 bp, Mus musculus
aaaaaccatgaacttctctctctct

SEQ ID NO: 196 - DNA, 25 bp, Mus musculus
aaaaaccatgaagttctctctctct

SEQ ID NO: 197 - DNA, 25 bp, Mus musculus
aaaaaccatgtcaactcttcagagc

SEQ ID NO: 198 - DNA, 25 bp, Mus musculus
aaaaaccatgtcaatttgtgtgaat

SEQ ID NO: 199 - DNA, 25 bp, Mus musculus
aaaaaccatgtctactcttcagagc

SEQ ID NO: 200 - DNA, 25 bp, Mus musculus
aaaaaccatgtctatttgtgtgaat

SEQ ID NO: 201 - DNA, 25 bp, Mus musculus
aaaaaccattagagctcataagcaa

SEQ ID NO: 202 - DNA, 25 bp, Mus musculus
aaaaaccattagtgctcataagcaa

SEQ ID NO: 203 - DNA, 25 bp, Mus musculus
aaaaacccaactcaagcctgtgtgt

SEQ ID NO: 204 - DNA, 25 bp, Mus musculus
aaaaacccaactgaagcctgtgtgt

SEQ ID NO: 205 - DNA, 25 bp, Mus musculus
aaaaacccaattctctgtgccagct

SEQ ID NO: 206 - DNA, 25 bp, Mus musculus
aaaaacccaattgtctgtgccagct

SEQ ID NO: 207 - DNA, 25 bp, Mus musculus
aaaaaccccaagattgctgtctcca

SEQ ID NO: 208 - DNA, 25 bp, Mus musculus
aaaaaccccaagtttgctgtctcca

SEQ ID NO: 209 - DNA, 25 bp, Mus musculus
aaaaaccctcatattatctcagtag

SEQ ID NO: 210 - DNA, 25 bp, Mus musculus
aaaaaccctcattttatctcagtag

SEQ ID NO: 211 - DNA, 25 bp, Mus musculus
aaaaaccctgtgagatcccattggc

SEQ ID NO: 212 - DNA, 25 bp, Mus musculus
aaaaaccctgtgctattctagttgg

SEQ ID NO: 213 - DNA, 25 bp, Mus musculus
aaaaaccctgtggtattctagttgg

SEQ ID NO: 214 - DNA, 25 bp, Mus musculus
aaaaaccctgtgtgatcccattggc

SEQ ID NO: 215 - DNA, 25 bp, Mus musculus
aaaaacccttgtcaggagcacctgc

SEQ ID NO: 216 - DNA, 25 bp, Mus musculus
aaaaacccttgtgaggagcacctgc

SEQ ID NO: 217 - DNA, 25 bp, Mus musculus
aaaaaccgttgtacagcctcaggat

SEQ ID NO: 218 - DNA, 25 bp, Mus musculus
aaaaaccgttgttcagcctcaggat

SEQ ID NO: 219 - DNA, 25 bp, Mus musculus
aaaaacctctcacaatctgataaag

SEQ ID NO: 220 - DNA, 25 bp, Mus musculus
aaaaacctctcagaatctgataaag

SEQ ID NO: 221 - DNA, 25 bp, Mus musculus
aaaaacctctttaactgatcacaga

SEQ ID NO: 222 - DNA, 25 bp, Mus musculus
aaaaacctcttttactgatcacaga

SEQ ID NO: 223 - DNA, 25 bp, Mus musculus
aaaaacctgactagtctctgcatct

SEQ ID NO: 224 - DNA, 25 bp, Mus musculus
aaaaacctgacttgtctctgcatct

SEQ ID NO: 225 - DNA, 25 bp, Mus musculus
aaaaacctggcactgctagcacatg

SEQ ID NO: 226 - DNA, 25 bp, Mus musculus
aaaaacctggcagtgctagcacatg

SEQ ID NO: 227 - DNA, 25 bp, Mus musculus
aaaaaccttctcaatcacaccatat

SEQ ID NO: 228 - DNA, 25 bp, Mus musculus
aaaaaccttctctatcacaccatat

SEQ ID NO: 229 - DNA, 25 bp, Mus musculus
aaaaaccttgtgctatgtgaatcag

SEQ ID NO: 230 - DNA, 25 bp, Mus musculus
aaaaaccttgtggtatgtgaatcag

SEQ ID NO: 231 - DNA, 25 bp, Mus musculus
aaaaacctttggctcatctatgtgg

SEQ ID NO: 232 - DNA, 25 bp, Mus musculus
aaaaacctttgggtcatctatgtgg

SEQ ID NO: 233 - DNA, 25 bp, Mus musculus
aaaaacgactgcaggaagatcccaa

SEQ ID NO: 234 - DNA, 25 bp, Mus musculus
aaaaacgactgctggaagatcccaa

SEQ ID NO: 235 - DNA, 25 bp, Mus musculus
aaaaacgcagaacgcacatgtttgc

SEQ ID NO: 236 - DNA, 25 bp, Mus musculus
aaaaacgcagaaggcacatgtttgc

SEQ ID NO: 237 - DNA, 25 bp, Mus musculus
aaaaacgcatctctgatgggccatg

SEQ ID NO: 238 - DNA, 25 bp, Mus musculus
aaaaacgcatctgtgatgggccatg

SEQ ID NO: 239 - DNA, 25 bp, Mus musculus
aaaaacgcggatcaattgtggactc

SEQ ID NO: 240 - DNA, 25 bp, Mus musculus
aaaaacgcggatgaattgtggactc

SEQ ID NO: 241 - DNA, 25 bp, Mus musculus
aaaaacgctactcggcatgctgaaa

SEQ ID NO: 242 - DNA, 25 bp, Mus musculus
aaaaacgctactgggcatgctgaaa

SEQ ID NO: 243 - DNA, 25 bp, Mus musculus
aaaaacggctacacgcgctatagag

SEQ ID NO: 244 - DNA, 25 bp, Mus musculus
aaaaacggctactcgcgctatagag

SEQ ID NO: 245 - DNA, 25 bp, Mus musculus
aaaaacgggcagaccatcgcctctt

SEQ ID NO: 246 - DNA, 25 bp, Mus musculus
aaaaacgggcagtccatcgcctctt

SEQ ID NO: 247 - DNA, 25 bp, Mus musculus
aaaaacggtggtccggcagactctg

SEQ ID NO: 248 - DNA, 25 bp, Mus musculus
aaaaacggtggtgcggcagactctg

SEQ ID NO: 249 - DNA, 25 bp, Mus musculus
aaaaacgtccgacatgaggctgggc

SEQ ID NO: 250 - DNA, 25 bp, Mus musculus
aaaaacgtccgagatgaggctgggc

SEQ ID NO: 251 - DNA, 25 bp, Mus musculus
aaaaacgtcgtcctcaacatgtatt

SEQ ID NO: 252 - DNA, 25 bp, Mus musculus
aaaaacgtcgtcgtcaacatgtatt

SEQ ID NO: 253 - DNA, 25 bp, Mus musculus
aaaaacgtctataccgctgactaga

SEQ ID NO: 254 - DNA, 25 bp, Mus musculus
aaaaacgtctattccgctgactaga

SEQ ID NO: 255 - DNA, 25 bp, Mus musculus
aaaaacgtggccatcagagagctca

SEQ ID NO: 256 - DNA, 25 bp, Mus musculus
aaaaacgtggccttcagagagctca

SEQ ID NO: 257 - DNA, 25 bp, Mus musculus
aaaaacgttgtaccacttcactgct

SEQ ID NO: 258 - DNA, 25 bp, Mus musculus
aaaaacgttgtagcacttcactgct

SEQ ID NO: 259 - DNA, 25 bp, Mus musculus
aaaaactaaactccgctttccatca

SEQ ID NO: 260 - DNA, 25 bp, Mus musculus
aaaaactaaactgcgctttccatca

SEQ ID NO: 261 - DNA, 25 bp, Mus musculus
aaaaactacccaaacagccccagat

SEQ ID NO: 262 - DNA, 25 bp, Mus musculus
aaaaactacccatacagccccagat

SEQ ID NO: 263 - DNA, 25 bp, Mus musculus
aaaaactacgatcatccacccttca

SEQ ID NO: 264 - DNA, 25 bp, Mus musculus
aaaaactacgatgatccacccttca

SEQ ID NO: 265 - DNA, 25 bp, Mus musculus
aaaaactagattagctccagccagg

SEQ ID NO: 266 - DNA, 25 bp, Mus musculus
aaaaactagatttgctccagccagg

SEQ ID NO: 267 - DNA, 25 bp, Mus musculus
aaaaactagctaacacttcctgagt

SEQ ID NO: 268 - DNA, 25 bp, Mus musculus
aaaaactagctatcacttcctgagt

SEQ ID NO: 269 - DNA, 25 bp, Mus musculus
aaaaactatcacacgacactcatca

SEQ ID NO: 270 - DNA, 25 bp, Mus musculus
aaaaactatcactcgacactcatca

SEQ ID NO: 271 - DNA, 25 bp, Mus musculus
aaaaactattacaacatgtgcgagt

SEQ ID NO: 272 - DNA, 25 bp, Mus musculus
aaaaactattactacatgtgcgagt

SEQ ID NO: 273 - DNA, 25 bp, Mus musculus
aaaaactattccctctactcacaga

SEQ ID NO: 274 - DNA, 25 bp, Mus musculus
aaaaactattccgtctactcacaga

SEQ ID NO: 275 - DNA, 25 bp, Mus musculus
aaaaactcacagcagaatcacccag

SEQ ID NO: 276 - DNA, 25 bp, Mus musculus
aaaaactcacaggagaatcacccag

SEQ ID NO: 277 - DNA, 25 bp, Mus musculus
aaaaactctgtcaattcatgggtgt

SEQ ID NO: 278 - DNA, 25 bp, Mus musculus
aaaaactctgtctattcatgggtgt

SEQ ID NO: 279 - DNA, 25 bp, Mus musculus
aaaaactcttcgatgactgcactca

SEQ ID NO: 280 - DNA, 25 bp, Mus musculus
aaaaactcttcgttgactgcactca

SEQ ID NO: 281 - DNA, 25 bp, Mus musculus
aaaaactgaaagacacagcaccttc

SEQ ID NO: 282 - DNA, 25 bp, Mus musculus
aaaaactgaaagtcacagcaccttc

SEQ ID NO: 283 - DNA, 25 bp, Mus musculus
aaaaactgacccacggatgaattca

SEQ ID NO: 284 - DNA, 25 bp, Mus musculus
aaaaactgaccctcggatgaattca

SEQ ID NO: 285 - DNA, 25 bp, Mus musculus
aaaaactgaggcactgtgcaggtag

SEQ ID NO: 286 - DNA, 25 bp, Mus musculus
aaaaactgaggctctgtgcaggtag

SEQ ID NO: 287 - DNA, 25 bp, Mus musculus
aaaaactgatgcactcctatttctc

SEQ ID NO: 288 - DNA, 25 bp, Mus musculus
aaaaactgatgctctcctatttctc

SEQ ID NO: 289 - DNA, 25 bp, Mus musculus
aaaaactgccttaagaatgaactgg

SEQ ID NO: 290 - DNA, 25 bp, Mus musculus
aaaaactgcctttagaatgaactgg

SEQ ID NO: 291 - DNA, 25 bp, Mus musculus
aaaaactgctacagcttctgtgctc

SEQ ID NO: 292 - DNA, 25 bp, Mus musculus
aaaaactgctactgcttctgtgctc

SEQ ID NO: 293 - DNA, 25 bp, Mus musculus
aaaaactggccaaggcagcacactg

SEQ ID NO: 294 - DNA, 25 bp, Mus musculus
aaaaactggccatggcagcacactg

SEQ ID NO: 295 - DNA, 25 bp, Mus musculus
aaaaactggcctactgataccttca

SEQ ID NO: 296 - DNA, 25 bp, Mus musculus
aaaaactggccttctgataccttca

SEQ ID NO: 297 - DNA, 25 bp, Mus musculus
aaaaactgggctcagttctccagtc

SEQ ID NO: 298 - DNA, 25 bp, Mus musculus
aaaaactgggctgagttctccagtc

SEQ ID NO: 299 - DNA, 25 bp, Mus musculus
aaaaactgtcaaatgaccctccctg

SEQ ID NO: 300 - DNA, 25 bp, Mus musculus
aaaaactgtcaattgaccctccctg

SEQ ID NO: 301 - DNA, 25 bp, Mus musculus
aaaaactgtcatagtcatcccagcc

SEQ ID NO: 302 - DNA, 25 bp, Mus musculus
aaaaactgtcattgtcatcccagcc

SEQ ID NO: 303 - DNA, 25 bp, Mus musculus
aaaaactgtgagctggtccattggt

SEQ ID NO: 304 - DNA, 25 bp, Mus musculus
aaaaactgtgaggtggtccattggt

SEQ ID NO: 305 - DNA, 25 bp, Mus musculus
aaaaactgtgttctgaatctctctc

SEQ ID NO: 306 - DNA, 25 bp, Mus musculus
aaaaactgtgttgtgaatctctctc

SEQ ID NO: 307 - DNA, 25 bp, Mus musculus
aaaaacttccatccagccctgagaa

SEQ ID NO: 308 - DNA, 25 bp, Mus musculus
aaaaacttccatgcagccctgagaa

SEQ ID NO: 309 - DNA, 25 bp, Mus musculus
aaaaacttgtatatcatctctgtga

SEQ ID NO: 310 - DNA, 25 bp, Mus musculus
aaaaacttgtatttcatctctgtga

SEQ ID NO: 311 - DNA, 25 bp, Mus musculus
aaaaactttcagctagcctgggcta

SEQ ID NO: 312 - DNA, 25 bp, Mus musculus
aaaaactttcaggtagcctgggcta

SEQ ID NO: 313 - DNA, 25 bp, Mus musculus
aaaaactttcataacccatctcagc

SEQ ID NO: 314 - DNA, 25 bp, Mus musculus
aaaaactttcattacccatctcagc

SEQ ID NO: 315 - DNA, 25 bp, Mus musculus
aaaaactttcgaaaccttccagcag

SEQ ID NO: 316 - DNA, 25 bp, Mus musculus
aaaaactttcgataccttccagcag

SEQ ID NO: 317 - DNA, 25 bp, Mus musculus
aaaaacttttcacggctgtgtggat

SEQ ID NO: 318 - DNA, 25 bp, Mus musculus
aaaaacttttcagggctgtgtggat

SEQ ID NO: 319 - DNA, 25 bp, Mus musculus
aaaaagaagcctaccgctgctctgg

SEQ ID NO: 320 - DNA, 25 bp, Mus musculus
aaaaagaagccttccgctgctctgg

SEQ ID NO: 321 - DNA, 25 bp, Mus musculus
aaaaagaatccaattgtgacctaat

SEQ ID NO: 322 - DNA, 25 bp, Mus musculus
aaaaagaatccatttgtgacctaat

SEQ ID NO: 323 - DNA, 25 bp, Mus musculus
aaaaagacatttccccagatcaaga

SEQ ID NO: 324 - DNA, 25 bp, Mus musculus
aaaaagacatttgcccagatcaaga

SEQ ID NO: 325 - DNA, 25 bp, Mus musculus
aaaaagaccagcacacacactttgc

SEQ ID NO: 326 - DNA, 25 bp, Mus musculus
aaaaagaccagctcacacactttgc

SEQ ID NO: 327 - DNA, 25 bp, Mus musculus
aaaaagacccagactatcagccacc

SEQ ID NO: 328 - DNA, 25 bp, Mus musculus
aaaaagacccagtctatcagccacc

SEQ ID NO: 329 - DNA, 25 bp, Mus musculus
aaaaagacctccagatgacagacag

SEQ ID NO: 330 - DNA, 25 bp, Mus musculus
aaaaagacctcctgatgacagacag

SEQ ID NO: 331 - DNA, 25 bp, Mus musculus
aaaaagactacaccaaggaccccag

SEQ ID NO: 332 - DNA, 25 bp, Mus musculus
aaaaagactacagcaaggaccccag

SEQ ID NO: 333 - DNA, 25 bp, Mus musculus
aaaaagactccaccagatgcacgct

SEQ ID NO: 334 - DNA, 25 bp, Mus musculus
aaaaagactccagcagatgcacgct

SEQ ID NO: 335 - DNA, 25 bp, Mus musculus
aaaaagagcacaccctccacactcg

SEQ ID NO: 336 - DNA, 25 bp, Mus musculus
aaaaagagcacagcctccacactcg

SEQ ID NO: 337 - DNA, 25 bp, Mus musculus
aaaaagagcactccggcctgtggtg

SEQ ID NO: 338 - DNA, 25 bp, Mus musculus
aaaaagagcactgcggcctgtggtg

SEQ ID NO: 339 - DNA, 25 bp, Mus musculus
aaaaagagccccagctggaatcctt

SEQ ID NO: 340 - DNA, 25 bp, Mus musculus
aaaaagagcccctgctggaatcctt

SEQ ID NO: 341 - DNA, 25 bp, Mus musculus
aaaaagagcgctcactggtcttccg

SEQ ID NO: 342 - DNA, 25 bp, Mus musculus
aaaaagagcgctgactggtcttccg

SEQ ID NO: 343 - DNA, 25 bp, Mus musculus
aaaaagaggcagacctttgccagaa

SEQ ID NO: 344 - DNA, 25 bp, Mus musculus
aaaaagaggcagtcctttgccagaa

SEQ ID NO: 345 - DNA, 25 bp, Mus musculus
aaaaagagtaccaggcaaactgagc

SEQ ID NO: 346 - DNA, 25 bp, Mus musculus
aaaaagagtacctggcaaactgagc

SEQ ID NO: 347 - DNA, 25 bp, Mus musculus
aaaaagagtccaaccctgcagaaag

SEQ ID NO: 348 - DNA, 25 bp, Mus musculus
aaaaagagtccatccctgcagaaag

SEQ ID NO: 349 - DNA, 25 bp, Mus musculus
aaaaagagtcctagtccacttctct

SEQ ID NO: 350 - DNA, 25 bp, Mus musculus
aaaaagagtccttgtccacttctct

SEQ ID NO: 351 - DNA, 25 bp, Mus musculus
aaaaagagtcgaaccagttagcagt

SEQ ID NO: 352 - DNA, 25 bp, Mus musculus
aaaaagagtcgatccagttagcagt

SEQ ID NO: 353 - DNA, 25 bp, Mus musculus
aaaaagagttctcgcgaccgagacg

SEQ ID NO: 354 - DNA, 25 bp, Mus musculus
aaaaagagttctggcgaccgagacg

SEQ ID NO: 355 - DNA, 25 bp, Mus musculus
aaaaagatcaacagactcctcccag

SEQ ID NO: 356 - DNA, 25 bp, Mus musculus
aaaaagatcaactgactcctcccag

SEQ ID NO: 357 - DNA, 25 bp, Mus musculus
aaaaagatcacccatcaccacattt

SEQ ID NO: 358 - DNA, 25 bp, Mus musculus
aaaaagatcaccgatcaccacattt

SEQ ID NO: 359 - DNA, 25 bp, Mus musculus
aaaaagatggccagatctcctcagc

SEQ ID NO: 360 - DNA, 25 bp, Mus musculus
aaaaagatggcctgatctcctcagc

SEQ ID NO: 361 - DNA, 25 bp, Mus musculus
aaaaagattctacgcctcttcctct

SEQ ID NO: 362 - DNA, 25 bp, Mus musculus
aaaaagattctaggcctcttcctct

SEQ ID NO: 363 - DNA, 25 bp, Mus musculus
aaaaagattgacctgcagcctctca

SEQ ID NO: 364 - DNA, 25 bp, Mus musculus
aaaaagattgacgtgcagcctctca

SEQ ID NO: 365 - DNA, 25 bp, Mus musculus
aaaaagattgtgactggaccaggag

SEQ ID NO: 366 - DNA, 25 bp, Mus musculus
aaaaagattgtgtctggaccaggag

SEQ ID NO: 367 - DNA, 25 bp, Mus musculus
aaaaagcaacacatatttccatcag

SEQ ID NO: 368 - DNA, 25 bp, Mus musculus
aaaaagcaacacttatttccatcag

SEQ ID NO: 369 - DNA, 25 bp, Mus musculus
aaaaagcaagaacactcccaagagt

SEQ ID NO: 370 - DNA, 25 bp, Mus musculus
aaaaagcaagaagactcccaagagt

SEQ ID NO: 371 - DNA, 25 bp, Mus musculus
aaaaagcacagcacctacgggaaat

SEQ ID NO: 372 - DNA, 25 bp, Mus musculus
aaaaagcacagctcctacgggaaat

SEQ ID NO: 373 - DNA, 25 bp, Mus musculus
aaaaagcagccacccagttctacca

SEQ ID NO: 374 - DNA, 25 bp, Mus musculus
aaaaagcagccagccagttctacca

SEQ ID NO: 375 - DNA, 25 bp, Mus musculus
aaaaagcagcttctaactgcccggc

SEQ ID NO: 376 - DNA, 25 bp, Mus musculus
aaaaagcagcttgtaactgcccggc

SEQ ID NO: 377 - DNA, 25 bp, Mus musculus
aaaaagcagggaatggcgccacatg

SEQ ID NO: 378 - DNA, 25 bp, Mus musculus
aaaaagcagggattggcgccacatg

SEQ ID NO: 379 - DNA, 25 bp, Mus musculus
aaaaagcagtcacggcaatggcagc

SEQ ID NO: 380 - DNA, 25 bp, Mus musculus
aaaaagcagtcagggcaatggcagc

SEQ ID NO: 381 - DNA, 25 bp, Mus musculus
aaaaagcagtctcgtgcctcctgat

SEQ ID NO: 382 - DNA, 25 bp, Mus musculus
aaaaagcagtctggtgcctcctgat

SEQ ID NO: 383 - DNA, 25 bp, Mus musculus
aaaaagcatcctacgagggagttga

SEQ ID NO: 384 - DNA, 25 bp, Mus musculus
aaaaagcatcctccgaggcttatag

SEQ ID NO: 385 - DNA, 25 bp, Mus musculus
aaaaagcatcctgcgaggcttatag

SEQ ID NO: 386 - DNA, 25 bp, Mus musculus
aaaaagcatccttcgagggagttga

SEQ ID NO: 387 - DNA, 25 bp, Mus musculus
aaaaagcatgtcattggcactcaat

SEQ ID NO: 388 - DNA, 25 bp, Mus musculus
aaaaagcatgtctttggcactcaat

SEQ ID NO: 389 - DNA, 25 bp, Mus musculus
aaaaagccaagccacttcccgatga

SEQ ID NO: 390 - DNA, 25 bp, Mus musculus
aaaaagccaagcgacttcccgatga

SEQ ID NO: 391 - DNA, 25 bp, Mus musculus
aaaaagccacagatcaccacggagc

SEQ ID NO: 392 - DNA, 25 bp, Mus musculus
aaaaagccacagttcaccacggagc

SEQ ID NO: 393 - DNA, 25 bp, Mus musculus
aaaaagccacccagctttttatcag

SEQ ID NO: 394 - DNA, 25 bp, Mus musculus
aaaaagccaccctgctttttatcag

SEQ ID NO: 395 - DNA, 25 bp, Mus musculus
aaaaagccacctcttttcagattgc

SEQ ID NO: 396 - DNA, 25 bp, Mus musculus
aaaaagccacctgttttcagattgc

SEQ ID NO: 397 - DNA, 25 bp, Mus musculus
aaaaagccacggaagccaggctcac

SEQ ID NO: 398 - DNA, 25 bp, Mus musculus
aaaaagccacggtagccaggctcac

SEQ ID NO: 399 - DNA, 25 bp, Mus musculus
aaaaagccagcaagcaatcccagtg

SEQ ID NO: 400 - DNA, 25 bp, Mus musculus
aaaaagccagcaccctcaggagtaa

SEQ ID NO: 401 - DNA, 25 bp, Mus musculus
aaaaagccagcagcctcaggagtaa

SEQ ID NO: 402 - DNA, 25 bp, Mus musculus
aaaaagccagcatgcaatcccagtg

SEQ ID NO: 403 - DNA, 25 bp, Mus musculus
aaaaagccagttcgcaagggcggca

SEQ ID NO: 404 - DNA, 25 bp, Mus musculus
aaaaagccagttggcaagggcggca

SEQ ID NO: 405 - DNA, 25 bp, Mus musculus
aaaaagccatacaccccatgaaata

SEQ ID NO: 406 - DNA, 25 bp, Mus musculus
aaaaagccatactccccatgaaata

SEQ ID NO: 407 - DNA, 25 bp, Mus musculus
aaaaagcccatcacagtttctcttg

SEQ ID NO: 408 - DNA, 25 bp, Mus musculus
aaaaagcccatctcagtttctcttg

SEQ ID NO: 409 - DNA, 25 bp, Mus musculus
aaaaagcccattcagcatgtgctgt

SEQ ID NO: 410 - DNA, 25 bp, Mus musculus
aaaaagcccattgagcatgtgctgt

SEQ ID NO: 411 - DNA, 25 bp, Mus musculus
aaaaagcccctgatcgaatttcctg

SEQ ID NO: 412 - DNA, 25 bp, Mus musculus
aaaaagcccctgttcgaatttcctg

SEQ ID NO: 413 - DNA, 25 bp, Mus musculus
aaaaagccctacactcacagagaaa

SEQ ID NO: 414 - DNA, 25 bp, Mus musculus
aaaaagccctactctcacagagaaa

SEQ ID NO: 415 - DNA, 25 bp, Mus musculus
aaaaagccgtctcatagggtatgta

SEQ ID NO: 416 - DNA, 25 bp, Mus musculus
aaaaagccgtctgatagggtatgta

SEQ ID NO: 417 - DNA, 25 bp, Mus musculus
aaaaagcctatgacagtgtcccaga

SEQ ID NO: 418 - DNA, 25 bp, Mus musculus
aaaaagcctatgtcagtgtcccaga

SEQ ID NO: 419 - DNA, 25 bp, Mus musculus
aaaaagcctccaaacacatgaaggg

SEQ ID NO: 420 - DNA, 25 bp, Mus musculus
aaaaagcctccatacacatgaaggg

SEQ ID NO: 421 - DNA, 25 bp, Mus musculus
aaaaagcctcgtcgaaatgttatgc

SEQ ID NO: 422 - DNA, 25 bp, Mus musculus
aaaaagcctcgtggaaatgttatgc

SEQ ID NO: 423 - DNA, 25 bp, Mus musculus
aaaaagcctgaaatctgtctggtag

SEQ ID NO: 424 - DNA, 25 bp, Mus musculus
aaaaagcctgaattctgtctggtag

SEQ ID NO: 425 - DNA, 25 bp, Mus musculus
aaaaagcctgctactgtcctggaac

SEQ ID NO: 426 - DNA, 25 bp, Mus musculus
aaaaagcctgcttctgtcctggaac

SEQ ID NO: 427 - DNA, 25 bp, Mus musculus
aaaaagcctggcaaccgtcactcag

SEQ ID NO: 428 - DNA, 25 bp, Mus musculus
aaaaagcctggccatggcgactctt

SEQ ID NO: 429 - DNA, 25 bp, Mus musculus
aaaaagcctggcgatggcgactctt

SEQ ID NO: 430 - DNA, 25 bp, Mus musculus
aaaaagcctggctaccgtcactcag

SEQ ID NO: 431 - DNA, 25 bp, Mus musculus
aaaaagccttgtcctgcctgcaggg

SEQ ID NO: 432 - DNA, 25 bp, Mus musculus
aaaaagccttgtgctgcctgcaggg

SEQ ID NO: 433 - DNA, 25 bp, Mus musculus
aaaaagcgctgcaataggagataga

SEQ ID NO: 434 - DNA, 25 bp, Mus musculus
aaaaagcgctgctataggagataga

SEQ ID NO: 435 - DNA, 25 bp, Mus musculus
aaaaagcgttagctgcagcccttgc

SEQ ID NO: 436 - DNA, 25 bp, Mus musculus
aaaaagcgttaggtgcagcccttgc

SEQ ID NO: 437 - DNA, 25 bp, Mus musculus
aaaaagctccaaaaatcttcacagg

SEQ ID NO: 438 - DNA, 25 bp, Mus musculus
aaaaagctccaaacactacgagaag

SEQ ID NO: 439 - DNA, 25 bp, Mus musculus
aaaaagctccaataatcttcacagg

SEQ ID NO: 440 - DNA, 25 bp, Mus musculus
aaaaagctccaatcactacgagaag

SEQ ID NO: 441 - DNA, 25 bp, Mus musculus
aaaaagctgacaccgcactgctaac

SEQ ID NO: 442 - DNA, 25 bp, Mus musculus
aaaaagctgacagcgcactgctaac

SEQ ID NO: 443 - DNA, 25 bp, Mus musculus
aaaaagctgagcatcttcgcgcttc

SEQ ID NO: 444 - DNA, 25 bp, Mus musculus
aaaaagctgagcttcttcgcgcttc

SEQ ID NO: 445 - DNA, 25 bp, Mus musculus
aaaaagctgcgtctgtttccttaca

SEQ ID NO: 446 - DNA, 25 bp, Mus musculus
aaaaagctgcgtgtgtttccttaca

SEQ ID NO: 447 - DNA, 25 bp, Mus musculus
aaaaagctgctaaccaatgatgttg

SEQ ID NO: 448 - DNA, 25 bp, Mus musculus
aaaaagctgctatccaatgatgttg

SEQ ID NO: 449 - DNA, 25 bp, Mus musculus
aaaaagctggacctggcctgagcac

SEQ ID NO: 450 - DNA, 25 bp, Mus musculus
aaaaagctggacgtggcctgagcac

SEQ ID NO: 451 - DNA, 25 bp, Mus musculus
aaaaagctgtcgcatcttgcagaaa

SEQ ID NO: 452 - DNA, 25 bp, Mus musculus
aaaaagctgtcggatcttgcagaaa

SEQ ID NO: 453 - DNA, 25 bp, Mus musculus
aaaaagcttaatagattggcatcag

SEQ ID NO: 454 - DNA, 25 bp, Mus musculus
aaaaagcttaattgattggcatcag

SEQ ID NO: 455 - DNA, 25 bp, Mus musculus
aaaaagcttcaactatggctggcag

SEQ ID NO: 456 - DNA, 25 bp, Mus musculus
aaaaagcttcaagtatggctggcag

SEQ ID NO: 457 - DNA, 25 bp, Mus musculus
aaaaagcttctcatcgcatagtcac

SEQ ID NO: 458 - DNA, 25 bp, Mus musculus
aaaaagcttctcttcgcatagtcac

SEQ ID NO: 459 - DNA, 25 bp, Mus musculus
aaaaagctttgactcactgacaggt

SEQ ID NO: 460 - DNA, 25 bp, Mus musculus
aaaaagctttgagtcactgacaggt

SEQ ID NO: 461 - DNA, 25 bp, Mus musculus
aaaaaggacatcagagcaggccctg

SEQ ID NO: 462 - DNA, 25 bp, Mus musculus
aaaaaggacatctgagcaggccctg

SEQ ID NO: 463 - DNA, 25 bp, Mus musculus
aaaaaggagacaacctcccaccaga

SEQ ID NO: 464 - DNA, 25 bp, Mus musculus
aaaaaggagacatcctcccaccaga

SEQ ID NO: 465 - DNA, 25 bp, Mus musculus
aaaaaggaggctccggctgtagtac

SEQ ID NO: 466 - DNA, 25 bp, Mus musculus
aaaaaggaggctgcggctgtagtac

SEQ ID NO: 467 - DNA, 25 bp, Mus musculus
aaaaaggatcacattccacagccca

SEQ ID NO: 468 - DNA, 25 bp, Mus musculus
aaaaaggatcactttccacagccca

SEQ ID NO: 469 - DNA, 25 bp, Mus musculus
aaaaaggatgctaccttgaccgtag

SEQ ID NO: 470 - DNA, 25 bp, Mus musculus
aaaaaggatgcttccttgaccgtag

SEQ ID NO: 471 - DNA, 25 bp, Mus musculus
aaaaaggcaataattccagggatgg

SEQ ID NO: 472 - DNA, 25 bp, Mus musculus
aaaaaggcaatatttccagggatgg

SEQ ID NO: 473 - DNA, 25 bp, Mus musculus
aaaaaggcacgtccaatctgtccac

SEQ ID NO: 474 - DNA, 25 bp, Mus musculus
aaaaaggcacgtgcaatctgtccac

SEQ ID NO: 475 - DNA, 25 bp, Mus musculus
aaaaaggcccctctgaccaaggcag

SEQ ID NO: 476 - DNA, 25 bp, Mus musculus
aaaaaggcccctctgtcatgggagt

SEQ ID NO: 477 - DNA, 25 bp, Mus musculus
aaaaaggcccctgtgaccaaggcag

SEQ ID NO: 478 - DNA, 25 bp, Mus musculus
aaaaaggcccctgtgtcatgggagt

SEQ ID NO: 479 - DNA, 25 bp, Mus musculus
aaaaaggccgcaactactcccacag

SEQ ID NO: 480 - DNA, 25 bp, Mus musculus
aaaaaggccgcatctactcccacag

SEQ ID NO: 481 - DNA, 25 bp, Mus musculus
aaaaaggcgctcacagaacatggaa

SEQ ID NO: 482 - DNA, 25 bp, Mus musculus
aaaaaggcgctctcagaacatggaa

SEQ ID NO: 483 - DNA, 25 bp, Mus musculus
aaaaaggcttgtcgtctggacgtgc

SEQ ID NO: 484 - DNA, 25 bp, Mus musculus
aaaaaggcttgtggtctggacgtgc

SEQ ID NO: 485 - DNA, 25 bp, Mus musculus
aaaaagggaccacgctggcagccag

SEQ ID NO: 486 - DNA, 25 bp, Mus musculus
aaaaagggaccaggctggcagccag

SEQ ID NO: 487 - DNA, 25 bp, Mus musculus
aaaaagggcaggaacatggctctgg

SEQ ID NO: 488 - DNA, 25 bp, Mus musculus
aaaaagggcaggtacatggctctgg

SEQ ID NO: 489 - DNA, 25 bp, Mus musculus
aaaaagggcttgctcttcctgtact

SEQ ID NO: 490 - DNA, 25 bp, Mus musculus
aaaaagggcttggtcttcctgtact

SEQ ID NO: 491 - DNA, 25 bp, Mus musculus
aaaaaggggataactgccactgtct

SEQ ID NO: 492 - DNA, 25 bp, Mus musculus
aaaaaggggatatctgccactgtct

SEQ ID NO: 493 - DNA, 25 bp, Mus musculus
aaaaagggtgaacgccatgcacaac

SEQ ID NO: 494 - DNA, 25 bp, Mus musculus
aaaaagggtgaaggccatgcacaac

SEQ ID NO: 495 - DNA, 25 bp, Mus musculus
aaaaaggtcaccactgtgtacctct

SEQ ID NO: 496 - DNA, 25 bp, Mus musculus
aaaaaggtcacctctgtgtacctct

SEQ ID NO: 497 - DNA, 25 bp, Mus musculus
aaaaaggtctttcgcactcatctca

SEQ ID NO: 498 - DNA, 25 bp, Mus musculus
aaaaaggtctttggcactcatctca

SEQ ID NO: 499 - DNA, 25 bp, Mus musculus
aaaaaggtgcccaagtgatccccat

SEQ ID NO: 500 - DNA, 25 bp, Mus musculus
aaaaaggtgccctagtgatccccat

SEQ ID NO: 501 - DNA, 25 bp, Mus musculus
aaaaagtaacacctctgcttcacac

SEQ ID NO: 502 - DNA, 25 bp, Mus musculus
aaaaagtaacacgtctgcttcacac

SEQ ID NO: 503 - DNA, 25 bp, Mus musculus
aaaaagtactggactctcctcagct

SEQ ID NO: 504 - DNA, 25 bp, Mus musculus
aaaaagtactggtctctcctcagct

SEQ ID NO: 505 - DNA, 25 bp, Mus musculus
aaaaagtaggcccacttcatccaca

SEQ ID NO: 506 - DNA, 25 bp, Mus musculus
aaaaagtaggccgacttcatccaca

SEQ ID NO: 507 - DNA, 25 bp, Mus musculus
aaaaagtatggaacgacacctcggg

SEQ ID NO: 508 - DNA, 25 bp, Mus musculus
aaaaagtatggatcgacacctcggg

SEQ ID NO: 509 - DNA, 25 bp, Mus musculus
aaaaagtcaacaagtaggaaggtct

SEQ ID NO: 510 - DNA, 25 bp, Mus musculus
aaaaagtcaacatgtaggaaggtct

SEQ ID NO: 511 - DNA, 25 bp, Mus musculus
aaaaagtcagagcaggtgagcccag

SEQ ID NO: 512 - DNA, 25 bp, Mus musculus
aaaaagtcagaggaggtgagcccag

SEQ ID NO: 513 - DNA, 25 bp, Mus musculus
aaaaagtcatccagaccattgctgg

SEQ ID NO: 514 - DNA, 25 bp, Mus musculus
aaaaagtcatcctgaccattgctgg

SEQ ID NO: 515 - DNA, 25 bp, Mus musculus
aaaaagtcggacagcctataggaat

SEQ ID NO: 516 - DNA, 25 bp, Mus musculus
aaaaagtcggactgcctataggaat

SEQ ID NO: 517 - DNA, 25 bp, Mus musculus
aaaaagtctcatatcctggagccct

SEQ ID NO: 518 - DNA, 25 bp, Mus musculus
aaaaagtctcatttcctggagccct

SEQ ID NO: 519 - DNA, 25 bp, Mus musculus
aaaaagtctctgctggaagccacag

SEQ ID NO: 520 - DNA, 25 bp, Mus musculus
aaaaagtctctggtggaagccacag

SEQ ID NO: 521 - DNA, 25 bp, Mus musculus
aaaaagtctgcaatgtcccacgaat

SEQ ID NO: 522 - DNA, 25 bp, Mus musculus
aaaaagtctgcattgtcccacgaat

SEQ ID NO: 523 - DNA, 25 bp, Mus musculus
aaaaagtgcatactgtttgagggac

SEQ ID NO: 524 - DNA, 25 bp, Mus musculus
aaaaagtgcatagtgtttgagggac

SEQ ID NO: 525 - DNA, 25 bp, Mus musculus
aaaaagtgctttcccttctgagtct

SEQ ID NO: 526 - DNA, 25 bp, Mus musculus
aaaaagtgctttgccttctgagtct

SEQ ID NO: 527 - DNA, 25 bp, Mus musculus
aaaaagtggcgacctttcgactcat

SEQ ID NO: 528 - DNA, 25 bp, Mus musculus
aaaaagtggcgagctttcgactcat

SEQ ID NO: 529 - DNA, 25 bp, Mus musculus
aaaaagtgtaccagagcacatagct

SEQ ID NO: 530 - DNA, 25 bp, Mus musculus
aaaaagtgtaccagtcgagacaaat

SEQ ID NO: 531 - DNA, 25 bp, Mus musculus
aaaaagtgtacctgagcacatagct

SEQ ID NO: 532 - DNA, 25 bp, Mus musculus
aaaaagtgtacctgtcgagacaaat

SEQ ID NO: 533 - DNA, 25 bp, Mus musculus
aaaaagtgtcctctgaatgcctgaa

SEQ ID NO: 534 - DNA, 25 bp, Mus musculus
aaaaagtgtcctgtgaatgcctgaa

SEQ ID NO: 535 - DNA, 25 bp, Mus musculus
aaaaagtgtctacgccacactgtga

SEQ ID NO: 536 - DNA, 25 bp, Mus musculus
aaaaagtgtctaggccacactgtga

SEQ ID NO: 537 - DNA, 25 bp, Mus musculus
aaaaagtgtgcgctcactggccaga

SEQ ID NO: 538 - DNA, 25 bp, Mus musculus
aaaaagtgtgcggtcactggccaga

SEQ ID NO: 539 - DNA, 25 bp, Mus musculus
aaaaagtgtgctagctgtccttttc

SEQ ID NO: 540 - DNA, 25 bp, Mus musculus
aaaaagtgtgcttgctgtccttttc

SEQ ID NO: 541 - DNA, 25 bp, Mus musculus
aaaaagttatgtaagagccaggcag

SEQ ID NO: 542 - DNA, 25 bp, Mus musculus
aaaaagttatgttagagccaggcag

SEQ ID NO: 543 - DNA, 25 bp, Mus musculus
aaaaagttccaaaccagccagagct

SEQ ID NO: 544 - DNA, 25 bp, Mus musculus
aaaaagttccaatccagccagagct

SEQ ID NO: 545 - DNA, 25 bp, Mus musculus
aaaaagttccgactgccagaccaca

SEQ ID NO: 546 - DNA, 25 bp, Mus musculus
aaaaagttccgagtgccagaccaca

SEQ ID NO: 547 - DNA, 25 bp, Mus musculus
aaaaagttctttaaggctgatgtga

SEQ ID NO: 548 - DNA, 25 bp, Mus musculus
aaaaagttcttttaggctgatgtga

SEQ ID NO: 549 - DNA, 25 bp, Mus musculus
aaaaagtttctacgctgcctgccca

SEQ ID NO: 550 - DNA, 25 bp, Mus musculus
aaaaagtttctaggctgcctgccca

SEQ ID NO: 551 - DNA, 25 bp, Mus musculus
aaaaagtttcttaggcatgcaggcc

SEQ ID NO: 552 - DNA, 25 bp, Mus musculus
aaaaagtttctttggcatgcaggcc

SEQ ID NO: 553 - DNA, 25 bp, Mus musculus
aaaaagtttgagattatcctaggct

SEQ ID NO: 554 - DNA, 25 bp, Mus musculus
aaaaagtttgagtttatcctaggct

SEQ ID NO: 555 - DNA, 25 bp, Mus musculus
aaaaagtttgttaggcctggcattg

SEQ ID NO: 556 - DNA, 25 bp, Mus musculus
aaaaagtttgtttggcctggcattg

SEQ ID NO: 557 - DNA, 25 bp, Mus musculus
aaaaataaaatgcatgcctataacc

SEQ ID NO: 558 - DNA, 25 bp, Mus musculus
aaaaataaaatggatgcctataacc

SEQ ID NO: 559 - DNA, 25 bp, Mus musculus
aaaaataagcccacctattggccat

SEQ ID NO: 560 - DNA, 25 bp, Mus musculus
aaaaataagccctcctattggccat

SEQ ID NO: 561 - DNA, 25 bp, Mus musculus
aaaaataataagcatgcctcttggt

SEQ ID NO: 562 - DNA, 25 bp, Mus musculus
aaaaataataaggatgcctcttggt

SEQ ID NO: 563 - DNA, 25 bp, Mus musculus
aaaaataccaatactagcatgggac

SEQ ID NO: 564 - DNA, 25 bp, Mus musculus
aaaaataccaattctagcatgggac

SEQ ID NO: 565 - DNA, 25 bp, Mus musculus
aaaaatacgtgaatcacttcagtct

SEQ ID NO: 566 - DNA, 25 bp, Mus musculus
aaaaatacgtgattcacttcagtct

SEQ ID NO: 567 - DNA, 25 bp, Mus musculus
aaaaatactaccaagcactcctgac

SEQ ID NO: 568 - DNA, 25 bp, Mus musculus
aaaaatactacctagcactcctgac

SEQ ID NO: 569 - DNA, 25 bp, Mus musculus
aaaaatactccaagctgtcccaaga

SEQ ID NO: 570 - DNA, 25 bp, Mus musculus
aaaaatactccatgctgtcccaaga

SEQ ID NO: 571 - DNA, 25 bp, Mus musculus
aaaaatactgcacatctctgtcctc

SEQ ID NO: 572 - DNA, 25 bp, Mus musculus
aaaaatactgcagatctctgtcctc

SEQ ID NO: 573 - DNA, 25 bp, Mus musculus
aaaaatacttctcctctgtctggaa

SEQ ID NO: 574 - DNA, 25 bp, Mus musculus
aaaaatacttctgctctgtctggaa

SEQ ID NO: 575 - DNA, 25 bp, Mus musculus
aaaaatacttggcatctcacatgaa

SEQ ID NO: 576 - DNA, 25 bp, Mus musculus
aaaaatacttgggatctcacatgaa

SEQ ID NO: 577 - DNA, 25 bp, Mus musculus
aaaaatagagccataaaatcccttg

SEQ ID NO: 578 - DNA, 25 bp, Mus musculus
aaaaatagagccttaaaatcccttg

SEQ ID NO: 579 - DNA, 25 bp, Mus musculus
aaaaatagccatccgttcacgtgtg

SEQ ID NO: 580 - DNA, 25 bp, Mus musculus
aaaaatagccatgcgttcacgtgtg

SEQ ID NO: 581 - DNA, 25 bp, Mus musculus
aaaaatagccccatgttccacctgg

SEQ ID NO: 582 - DNA, 25 bp, Mus musculus
aaaaatagccccttgttccacctgg

SEQ ID NO: 583 - DNA, 25 bp, Mus musculus
aaaaatagctaccaacttctgagtt

SEQ ID NO: 584 - DNA, 25 bp, Mus musculus
aaaaatagctacgaacttctgagtt

SEQ ID NO: 585 - DNA, 25 bp, Mus musculus
aaaaatagtctgctgcttctactgc

SEQ ID NO: 586 - DNA, 25 bp, Mus musculus
aaaaatagtctggtgcttctactgc

SEQ ID NO: 587 - DNA, 25 bp, Mus musculus
aaaaatatatatacccaagatgggc

SEQ ID NO: 588 - DNA, 25 bp, Mus musculus
aaaaatatatattcccaagatgggc

SEQ ID NO: 589 - DNA, 25 bp, Mus musculus
aaaaatatatctcattttgggctca

SEQ ID NO: 590 - DNA, 25 bp, Mus musculus
aaaaatatatctgattttgggctca

SEQ ID NO: 591 - DNA, 25 bp, Mus musculus
aaaaatatgtgtcttcatgactgta

SEQ ID NO: 592 - DNA, 25 bp, Mus musculus
aaaaatatgtgtgttcatgactgta

SEQ ID NO: 593 - DNA, 25 bp, Mus musculus
aaaaatattaccagccatcctgctc

SEQ ID NO: 594 - DNA, 25 bp, Mus musculus
aaaaatattacctgccatcctgctc

SEQ ID NO: 595 - DNA, 25 bp, Mus musculus
aaaaatattatcagtcggccaaggc

SEQ ID NO: 596 - DNA, 25 bp, Mus musculus
aaaaatattatctgtcggccaaggc

SEQ ID NO: 597 - DNA, 25 bp, Mus musculus
aaaaatattctcaggcacttggtct

SEQ ID NO: 598 - DNA, 25 bp, Mus musculus
aaaaatattctctggcacttggtct

SEQ ID NO: 599 - DNA, 25 bp, Mus musculus
aaaaatattcttcccaatgcttatt

SEQ ID NO: 600 - DNA, 25 bp, Mus musculus
aaaaatattcttgccaatgcttatt

SEQ ID NO: 601 - DNA, 25 bp, Mus musculus
aaaaatcaagacactgctcaccaga

SEQ ID NO: 602 - DNA, 25 bp, Mus musculus
aaaaatcaagactctgctcaccaga

SEQ ID NO: 603 - DNA, 25 bp, Mus musculus
aaaaatcactggagatagccgggca

SEQ ID NO: 604 - DNA, 25 bp, Mus musculus
aaaaatcactggtgatagccgggca

SEQ ID NO: 605 - DNA, 25 bp, Mus musculus
aaaaatcacttaagtgcttccaaag

SEQ ID NO: 606 - DNA, 25 bp, Mus musculus
aaaaatcacttatgtgcttccaaag

SEQ ID NO: 607 - DNA, 25 bp, Mus musculus
aaaaatcagacaacatactaacttt

SEQ ID NO: 608 - DNA, 25 bp, Mus musculus
aaaaatcagacatcatactaacttt

SEQ ID NO: 609 - DNA, 25 bp, Mus musculus
aaaaatcaggacactccttctctga

SEQ ID NO: 610 - DNA, 25 bp, Mus musculus
aaaaatcaggactctccttctctga

SEQ ID NO: 611 - DNA, 25 bp, Mus musculus
aaaaatcaggctattcctctcttca

SEQ ID NO: 612 - DNA, 25 bp, Mus musculus
aaaaatcaggcttttcctctcttca

SEQ ID NO: 613 - DNA, 25 bp, Mus musculus
aaaaatcagtacacgtggccatcct

SEQ ID NO: 614 - DNA, 25 bp, Mus musculus
aaaaatcagtactcgtggccatcct

SEQ ID NO: 615 - DNA, 25 bp, Mus musculus
aaaaatcagtgcacagtattgtaac

SEQ ID NO: 616 - DNA, 25 bp, Mus musculus
aaaaatcagtgctcagtattgtaac

SEQ ID NO: 617 - DNA, 25 bp, Mus musculus
aaaaatcagtgtctacgctttccct

SEQ ID NO: 618 - DNA, 25 bp, Mus musculus
aaaaatcagtgtgtacgctttccct

SEQ ID NO: 619 - DNA, 25 bp, Mus musculus
aaaaatcatgacagcgtggcctcct

SEQ ID NO: 620 - DNA, 25 bp, Mus musculus
aaaaatcatgactgcgtggcctcct

SEQ ID NO: 621 - DNA, 25 bp, Mus musculus
aaaaatcatttcaatcccaaagaat

SEQ ID NO: 622 - DNA, 25 bp, Mus musculus
aaaaatcatttctatcccaaagaat

SEQ ID NO: 623 - DNA, 25 bp, Mus musculus
aaaaatccaagcagctcatttccct

SEQ ID NO: 624 - DNA, 25 bp, Mus musculus
aaaaatccaagctgctcatttccct

SEQ ID NO: 625 - DNA, 25 bp, Mus musculus
aaaaatccaagtcgcagctgctaag

SEQ ID NO: 626 - DNA, 25 bp, Mus musculus
aaaaatccaagtggcagctgctaag

SEQ ID NO: 627 - DNA, 25 bp, Mus musculus
aaaaatccacttcacatatgatgat

SEQ ID NO: 628 - DNA, 25 bp, Mus musculus
aaaaatccacttcgttccatgtcgt

SEQ ID NO: 629 - DNA, 25 bp, Mus musculus
aaaaatccacttgacatatgatgat

SEQ ID NO: 630 - DNA, 25 bp, Mus musculus
aaaaatccacttggttccatgtcgt

SEQ ID NO: 631 - DNA, 25 bp, Mus musculus
aaaaatccaggtatggcaatttgag

SEQ ID NO: 632 - DNA, 25 bp, Mus musculus
aaaaatccaggtttggcaatttgag

SEQ ID NO: 633 - DNA, 25 bp, Mus musculus
aaaaatcccttgatgctcatcatgt

SEQ ID NO: 634 - DNA, 25 bp, Mus musculus
aaaaatcccttgttgctcatcatgt

SEQ ID NO: 635 - DNA, 25 bp, Mus musculus
aaaaatccgagccagcatcagtacg

SEQ ID NO: 636 - DNA, 25 bp, Mus musculus
aaaaatccgagcgagcatcagtacg

SEQ ID NO: 637 - DNA, 25 bp, Mus musculus
aaaaatccgggcagcttctctccag

SEQ ID NO: 638 - DNA, 25 bp, Mus musculus
aaaaatccgggctgcttctctccag

SEQ ID NO: 639 - DNA, 25 bp, Mus musculus
aaaaatcctattcaccctctcttct

SEQ ID NO: 640 - DNA, 25 bp, Mus musculus
aaaaatcctattgaccctctcttct

SEQ ID NO: 641 - DNA, 25 bp, Mus musculus
aaaaatcctctaacagtttcacaaa

SEQ ID NO: 642 - DNA, 25 bp, Mus musculus
aaaaatcctctatcagtttcacaaa

SEQ ID NO: 643 - DNA, 25 bp, Mus musculus
aaaaatccttcgactggcgcatgta

SEQ ID NO: 644 - DNA, 25 bp, Mus musculus
aaaaatccttcgtctggcgcatgta

SEQ ID NO: 645 - DNA, 25 bp, Mus musculus
aaaaatcctttgagcgacgcttgga

SEQ ID NO: 646 - DNA, 25 bp, Mus musculus
aaaaatcctttgtgcgacgcttgga

SEQ ID NO: 647 - DNA, 25 bp, Mus musculus
aaaaatcgcataatctcactttcac

SEQ ID NO: 648 - DNA, 25 bp, Mus musculus
aaaaatcgcatattctcactttcac

SEQ ID NO: 649 - DNA, 25 bp, Mus musculus
aaaaatcgcttcaggctgcagcttt

SEQ ID NO: 650 - DNA, 25 bp, Mus musculus
aaaaatcgcttctggctgcagcttt

SEQ ID NO: 651 - DNA, 25 bp, Mus musculus
aaaaatctaagcacttggtcccaca

SEQ ID NO: 652 - DNA, 25 bp, Mus musculus
aaaaatctaagctcttggtcccaca

SEQ ID NO: 653 - DNA, 25 bp, Mus musculus
aaaaatctaccacggctcagcactc

SEQ ID NO: 654 - DNA, 25 bp, Mus musculus
aaaaatctaccagggctcagcactc

SEQ ID NO: 655 - DNA, 25 bp, Mus musculus
aaaaatctacctctttcagactgta

SEQ ID NO: 656 - DNA, 25 bp, Mus musculus
aaaaatctacctgtttcagactgta

SEQ ID NO: 657 - DNA, 25 bp, Mus musculus
aaaaatctatccctgcaaaatgata

SEQ ID NO: 658 - DNA, 25 bp, Mus musculus
aaaaatctatccgtgcaaaatgata

SEQ ID NO: 659 - DNA, 25 bp, Mus musculus
aaaaatctatgcagggcagttatct

SEQ ID NO: 660 - DNA, 25 bp, Mus musculus
aaaaatctatgctgggcagttatct

SEQ ID NO: 661 - DNA, 25 bp, Mus musculus
aaaaatctcacaacattctcacacc

SEQ ID NO: 662 - DNA, 25 bp, Mus musculus
aaaaatctcacatcattctcacacc

SEQ ID NO: 663 - DNA, 25 bp, Mus musculus
aaaaatctcatacccatgtcacagc

SEQ ID NO: 664 - DNA, 25 bp, Mus musculus
aaaaatctcatacctggagagctgg

SEQ ID NO: 665 - DNA, 25 bp, Mus musculus
aaaaatctcatagccatgtcacagc

SEQ ID NO: 666 - DNA, 25 bp, Mus musculus
aaaaatctcatagctggagagctgg

SEQ ID NO: 667 - DNA, 25 bp, Mus musculus
aaaaatctccttatgattctttgtg

SEQ ID NO: 668 - DNA, 25 bp, Mus musculus
aaaaatctccttttgattctttgtg

SEQ ID NO: 669 - DNA, 25 bp, Mus musculus
aaaaatctctccctgaacgtggagc

SEQ ID NO: 670 - DNA, 25 bp, Mus musculus
aaaaatctctccgtgaacgtggagc

SEQ ID NO: 671 - DNA, 25 bp, Mus musculus
aaaaatctctgtaccaagccagaag

SEQ ID NO: 672 - DNA, 25 bp, Mus musculus
aaaaatctctgttccaagccagaag

SEQ ID NO: 673 - DNA, 25 bp, Mus musculus
aaaaatctgatgctcgttttgagaa

SEQ ID NO: 674 - DNA, 25 bp, Mus musculus
aaaaatctgatggtcgttttgagaa

SEQ ID NO: 675 - DNA, 25 bp, Mus musculus
aaaaatctgctccagagacgctcac

SEQ ID NO: 676 - DNA, 25 bp, Mus musculus
aaaaatctgctcgagagacgctcac

SEQ ID NO: 677 - DNA, 25 bp, Mus musculus
aaaaatctgtcaaagcacctgctga

SEQ ID NO: 678 - DNA, 25 bp, Mus musculus
aaaaatctgtcatagcacctgctga

SEQ ID NO: 679 - DNA, 25 bp, Mus musculus
aaaaatctgtgacctgtatgagaac

SEQ ID NO: 680 - DNA, 25 bp, Mus musculus
aaaaatctgtgagctgtatgagaac

SEQ ID NO: 681 - DNA, 25 bp, Mus musculus
aaaaatctgttccttcaatatgtaa

SEQ ID NO: 682 - DNA, 25 bp, Mus musculus
aaaaatctgttcgttcaatatgtaa

SEQ ID NO: 683 - DNA, 25 bp, Mus musculus
aaaaatctgttgatggtgactttgc

SEQ ID NO: 684 - DNA, 25 bp, Mus musculus
aaaaatctgttgttggtgactttgc

SEQ ID NO: 685 - DNA, 25 bp, Mus musculus
aaaaatcttagtcaccacgcaggga

SEQ ID NO: 686 - DNA, 25 bp, Mus musculus
aaaaatcttagtgaccacgcaggga

SEQ ID NO: 687 - DNA, 25 bp, Mus musculus
aaaaatcttgtacagtccagtgtaa

SEQ ID NO: 688 - DNA, 25 bp, Mus musculus
aaaaatcttgtagagtccagtgtaa

SEQ ID NO: 689 - DNA, 25 bp, Mus musculus
aaaaatcttttgatcgcatggtcac

SEQ ID NO: 690 - DNA, 25 bp, Mus musculus
aaaaatcttttgttcgcatggtcac

SEQ ID NO: 691 - DNA, 25 bp, Mus musculus
aaaaatgaacagagacgtcagcgtc

SEQ ID NO: 692 - DNA, 25 bp, Mus musculus
aaaaatgaacagtgacgtcagcgtc

SEQ ID NO: 693 - DNA, 25 bp, Mus musculus
aaaaatgaagacacctctgcctcct

SEQ ID NO: 694 - DNA, 25 bp, Mus musculus
aaaaatgaagactcctctgcctcct

SEQ ID NO: 695 - DNA, 25 bp, Mus musculus
aaaaatgaagctacaacatgcccaa

SEQ ID NO: 696 - DNA, 25 bp, Mus musculus
aaaaatgaagcttcaacatgcccaa

SEQ ID NO: 697 - DNA, 25 bp, Mus musculus
aaaaatgacagcaccagactccagt

SEQ ID NO: 698 - DNA, 25 bp, Mus musculus
aaaaatgacagctccagactccagt

SEQ ID NO: 699 - DNA, 25 bp, Mus musculus
aaaaatgaccggacctcgttgcatc

SEQ ID NO: 700 - DNA, 25 bp, Mus musculus
aaaaatgaccggtcctcgttgcatc

SEQ ID NO: 701 - DNA, 25 bp, Mus musculus
aaaaatgacggtatgccacgtgctt

SEQ ID NO: 702 - DNA, 25 bp, Mus musculus
aaaaatgacggtttgccacgtgctt

SEQ ID NO: 703 - DNA, 25 bp, Mus musculus
aaaaatgactcccaacgctcaggtg

SEQ ID NO: 704 - DNA, 25 bp, Mus musculus
aaaaatgactccgaacgctcaggtg

SEQ ID NO: 705 - DNA, 25 bp, Mus musculus
aaaaatgactgacctatctccactg

SEQ ID NO: 706 - DNA, 25 bp, Mus musculus
aaaaatgactgagctatctccactg

SEQ ID NO: 707 - DNA, 25 bp, Mus musculus
aaaaatgactgcattggaggccaaa

SEQ ID NO: 708 - DNA, 25 bp, Mus musculus
aaaaatgactgctttggaggccaaa

SEQ ID NO: 709 - DNA, 25 bp, Mus musculus
aaaaatgacttcagcctggcctttg

SEQ ID NO: 710 - DNA, 25 bp, Mus musculus
aaaaatgacttctgcctggcctttg

SEQ ID NO: 711 - DNA, 25 bp, Mus musculus
aaaaatgacttgacttggacagggc

SEQ ID NO: 712 - DNA, 25 bp, Mus musculus
aaaaatgacttgtcttggacagggc

SEQ ID NO: 713 - DNA, 25 bp, Mus musculus
aaaaatgagattccctgctgttctt

SEQ ID NO: 714 - DNA, 25 bp, Mus musculus
aaaaatgagattgcctgctgttctt

SEQ ID NO: 715 - DNA, 25 bp, Mus musculus
aaaaatgatactagtctatgacgtt

SEQ ID NO: 716 - DNA, 25 bp, Mus musculus
aaaaatgatacttgtctatgacgtt

SEQ ID NO: 717 - DNA, 25 bp, Mus musculus
aaaaatgatcaaccatttccttctg

SEQ ID NO: 718 - DNA, 25 bp, Mus musculus
aaaaatgatcaagcatttccttctg

SEQ ID NO: 719 - DNA, 25 bp, Mus musculus
aaaaatgatggtagcccactgccct

SEQ ID NO: 720 - DNA, 25 bp, Mus musculus
aaaaatgatggttgcccactgccct

SEQ ID NO: 721 - DNA, 25 bp, Mus musculus
aaaaatgcagctacatgcctaccgt

SEQ ID NO: 722 - DNA, 25 bp, Mus musculus
aaaaatgcagcttcatgcctaccgt

SEQ ID NO: 723 - DNA, 25 bp, Mus musculus
aaaaatgcatgcaactggtgaagtt

SEQ ID NO: 724 - DNA, 25 bp, Mus musculus
aaaaatgcatgctactggtgaagtt

SEQ ID NO: 725 - DNA, 25 bp, Mus musculus
aaaaatgccaatcccttgacctagg

SEQ ID NO: 726 - DNA, 25 bp, Mus musculus
aaaaatgccaatgccttgacctagg

SEQ ID NO: 727 - DNA, 25 bp, Mus musculus
aaaaatgccaggattcctgtgcctc

SEQ ID NO: 728 - DNA, 25 bp, Mus musculus
aaaaatgccaggtttcctgtgcctc

SEQ ID NO: 729 - DNA, 25 bp, Mus musculus
aaaaatgcccttcactttagcccag

SEQ ID NO: 730 - DNA, 25 bp, Mus musculus
aaaaatgcccttgactttagcccag

SEQ ID NO: 731 - DNA, 25 bp, Mus musculus
aaaaatgcctatcttttattctaga

SEQ ID NO: 732 - DNA, 25 bp, Mus musculus
aaaaatgcctatgttttattctaga

SEQ ID NO: 733 - DNA, 25 bp, Mus musculus
aaaaatgcctctctttccctcgata

SEQ ID NO: 734 - DNA, 25 bp, Mus musculus
aaaaatgcctctgtttccctcgata

SEQ ID NO: 735 - DNA, 25 bp, Mus musculus
aaaaatgcctgaatatcacattgtc

SEQ ID NO: 736 - DNA, 25 bp, Mus musculus
aaaaatgcctgattatcacattgtc

SEQ ID NO: 737 - DNA, 25 bp, Mus musculus
aaaaatgcgacacagcccggaattc

SEQ ID NO: 738 - DNA, 25 bp, Mus musculus
aaaaatgcgacagagcccggaattc

SEQ ID NO: 739 - DNA, 25 bp, Mus musculus
aaaaatgctatcactcttcgtcaac

SEQ ID NO: 740 - DNA, 25 bp, Mus musculus
aaaaatgctatctctcttcgtcaac

SEQ ID NO: 741 - DNA, 25 bp, Mus musculus
aaaaatgctattcaccttggtttga

SEQ ID NO: 742 - DNA, 25 bp, Mus musculus
aaaaatgctattgaccttggtttga

SEQ ID NO: 743 - DNA, 25 bp, Mus musculus
aaaaatgctcttcatctgtcagctt

SEQ ID NO: 744 - DNA, 25 bp, Mus musculus
aaaaatgctcttgatctgtcagctt

SEQ ID NO: 745 - DNA, 25 bp, Mus musculus
aaaaatgctgatagtcttcgtttaa

SEQ ID NO: 746 - DNA, 25 bp, Mus musculus
aaaaatgctgattgtcttcgtttaa

SEQ ID NO: 747 - DNA, 25 bp, Mus musculus
aaaaatgcttatcgtggccctcttc

SEQ ID NO: 748 - DNA, 25 bp, Mus musculus
aaaaatgcttatggtggccctcttc

SEQ ID NO: 749 - DNA, 25 bp, Mus musculus
aaaaatgcttctattgtgctcaaag

SEQ ID NO: 750 - DNA, 25 bp, Mus musculus
aaaaatgcttcttttgtgctcaaag

SEQ ID NO: 751 - DNA, 25 bp, Mus musculus
aaaaatggaacgcagctgtttgttt

SEQ ID NO: 752 - DNA, 25 bp, Mus musculus
aaaaatggaacggagctgtttgttt

SEQ ID NO: 753 - DNA, 25 bp, Mus musculus
aaaaatggcaacactctctgtgtcc

SEQ ID NO: 754 - DNA, 25 bp, Mus musculus
aaaaatggcaactctctctgtgtcc

SEQ ID NO: 755 - DNA, 25 bp, Mus musculus
aaaaatggccatcttttcaccacat

SEQ ID NO: 756 - DNA, 25 bp, Mus musculus
aaaaatggccatgttttcaccacat

SEQ ID NO: 757 - DNA, 25 bp, Mus musculus
aaaaatggccttccactacagcctt

SEQ ID NO: 758 - DNA, 25 bp, Mus musculus
aaaaatggccttgcactacagcctt

SEQ ID NO: 759 - DNA, 25 bp, Mus musculus
aaaaatggctagatcttagctttgt

SEQ ID NO: 760 - DNA, 25 bp, Mus musculus
aaaaatggctagttcttagctttgt

SEQ ID NO: 761 - DNA, 25 bp, Mus musculus
aaaaatggcttgagtgtgatgccgt

SEQ ID NO: 762 - DNA, 25 bp, Mus musculus
aaaaatggcttgtgtgtgatgccgt

SEQ ID NO: 763 - DNA, 25 bp, Mus musculus
aaaaatgggaagcaccccgagcacg

SEQ ID NO: 764 - DNA, 25 bp, Mus musculus
aaaaatgggaaggaccccgagcacg

SEQ ID NO: 765 - DNA, 25 bp, Mus musculus
aaaaatgggtcccatggcctcactt

SEQ ID NO: 766 - DNA, 25 bp, Mus musculus
aaaaatgggtccgatggcctcactt

SEQ ID NO: 767 - DNA, 25 bp, Mus musculus
aaaaatggtttgagagccaggcatg

SEQ ID NO: 768 - DNA, 25 bp, Mus musculus
aaaaatggtttgtgagccaggcatg

SEQ ID NO: 769 - DNA, 25 bp, Mus musculus
aaaaatgtattgaagctgttgccac

SEQ ID NO: 770 - DNA, 25 bp, Mus musculus
aaaaatgtattgtagctgttgccac

SEQ ID NO: 771 - DNA, 25 bp, Mus musculus
aaaaatgtccgtattgagacacaga

SEQ ID NO: 772 - DNA, 25 bp, Mus musculus
aaaaatgtccgttttgagacacaga

SEQ ID NO: 773 - DNA, 25 bp, Mus musculus
aaaaatgtgaccattggtccccatg

SEQ ID NO: 774 - DNA, 25 bp, Mus musculus
aaaaatgtgacctttggtccccatg

SEQ ID NO: 775 - DNA, 25 bp, Mus musculus
aaaaatgtgcgcagcctgaaggaca

SEQ ID NO: 776 - DNA, 25 bp, Mus musculus
aaaaatgtgcgctgcctgaaggaca

SEQ ID NO: 777 - DNA, 25 bp, Mus musculus
aaaaatgtgggtctgtgaacaactg

SEQ ID NO: 778 - DNA, 25 bp, Mus musculus
aaaaatgtgggtgtgtgaacaactg

SEQ ID NO: 779 - DNA, 25 bp, Mus musculus
aaaaatgttcacctttctgccagat

SEQ ID NO: 780 - DNA, 25 bp, Mus musculus
aaaaatgttcacgtttctgccagat

SEQ ID NO: 781 - DNA, 25 bp, Mus musculus
aaaaatgttcgcatggcaggtccaa

SEQ ID NO: 782 - DNA, 25 bp, Mus musculus
aaaaatgttcgcttggcaggtccaa

SEQ ID NO: 783 - DNA, 25 bp, Mus musculus
aaaaatgttgtcagacctcattgga

SEQ ID NO: 784 - DNA, 25 bp, Mus musculus
aaaaatgttgtctgacctcattgga

SEQ ID NO: 785 - DNA, 25 bp, Mus musculus
aaaaatgtttccagtcgccaaatgc

SEQ ID NO: 786 - DNA, 25 bp, Mus musculus
aaaaatgtttcctgtcgccaaatgc

SEQ ID NO: 787 - DNA, 25 bp, Mus musculus
aaaaattagatcctgggctaccaag

SEQ ID NO: 788 - DNA, 25 bp, Mus musculus
aaaaattagatcgtgggctaccaag

SEQ ID NO: 789 - DNA, 25 bp, Mus musculus
aaaaattagctgagccgtgtttccg

SEQ ID NO: 790 - DNA, 25 bp, Mus musculus
aaaaattagctgtgccgtgtttccg

SEQ ID NO: 791 - DNA, 25 bp, Mus musculus
aaaaattccaacacactccagagtc

SEQ ID NO: 792 - DNA, 25 bp, Mus musculus
aaaaattccaactcactccagagtc

SEQ ID NO: 793 - DNA, 25 bp, Mus musculus
aaaaattccagaacgcttccctgag

SEQ ID NO: 794 - DNA, 25 bp, Mus musculus
aaaaattccagatcgcttccctgag

SEQ ID NO: 795 - DNA, 25 bp, Mus musculus
aaaaattcctcgcagttctttcaga

SEQ ID NO: 796 - DNA, 25 bp, Mus musculus
aaaaattcctcggagttctttcaga

SEQ ID NO: 797 - DNA, 25 bp, Mus musculus
aaaaattccttcacaactgtctctc

SEQ ID NO: 798 - DNA, 25 bp, Mus musculus
aaaaattccttctcaactgtctctc

SEQ ID NO: 799 - DNA, 25 bp, Mus musculus
aaaaattcgaatctctcaagatgca

SEQ ID NO: 800 - DNA, 25 bp, Mus musculus
aaaaattcgaatgtctcaagatgca

SEQ ID NO: 801 - DNA, 25 bp, Mus musculus
aaaaattctcgtccggtgcctcagt

SEQ ID NO: 802 - DNA, 25 bp, Mus musculus
aaaaattctcgtgcggtgcctcagt

SEQ ID NO: 803 - DNA, 25 bp, Mus musculus
aaaaattctctgatgtccctcttct

SEQ ID NO: 804 - DNA, 25 bp, Mus musculus
aaaaattctctgttgtccctcttct

SEQ ID NO: 805 - DNA, 25 bp, Mus musculus
aaaaattctgcacatagggctcaag

SEQ ID NO: 806 - DNA, 25 bp, Mus musculus
aaaaattctgcagatagggctcaag

SEQ ID NO: 807 - DNA, 25 bp, Mus musculus
aaaaattgcagacccgttccagcgt

SEQ ID NO: 808 - DNA, 25 bp, Mus musculus
aaaaattgcagagccgttccagcgt

SEQ ID NO: 809 - DNA, 25 bp, Mus musculus
aaaaattgcatgctgctggtacagc

SEQ ID NO: 810 - DNA, 25 bp, Mus musculus
aaaaattgcatggtgctggtacagc

SEQ ID NO: 811 - DNA, 25 bp, Mus musculus
aaaaattgcattagagcacggagtc

SEQ ID NO: 812 - DNA, 25 bp, Mus musculus
aaaaattgcatttgagcacggagtc

SEQ ID NO: 813 - DNA, 25 bp, Mus musculus
aaaaattgggcgcacccttggcaga

SEQ ID NO: 814 - DNA, 25 bp, Mus musculus
aaaaattgggcggacccttggcaga

SEQ ID NO: 815 - DNA, 25 bp, Mus musculus
aaaaattggtagctgttttccagag

SEQ ID NO: 816 - DNA, 25 bp, Mus musculus
aaaaattggtaggtgttttccagag

SEQ ID NO: 817 - DNA, 25 bp, Mus musculus
aaaaattggtgcaccgaggtccctg

SEQ ID NO: 818 - DNA, 25 bp, Mus musculus
aaaaattggtgctccgaggtccctg

SEQ ID NO: 819 - DNA, 25 bp, Mus musculus
aaaaattgtattcctggagatgatg

SEQ ID NO: 820 - DNA, 25 bp, Mus musculus
aaaaattgtattgctggagatgatg

SEQ ID NO: 821 - DNA, 25 bp, Mus musculus
aaaaattgtgaacgctcttctggta

SEQ ID NO: 822 - DNA, 25 bp, Mus musculus
aaaaattgtgaaggctcttctggta

SEQ ID NO: 823 - DNA, 25 bp, Mus musculus
aaaaattgtgccctccaccagtgtg

SEQ ID NO: 824 - DNA, 25 bp, Mus musculus
aaaaattgtgccgtccaccagtgtg

SEQ ID NO: 825 - DNA, 25 bp, Mus musculus
aaaaattgttagaagctggccgtgg

SEQ ID NO: 826 - DNA, 25 bp, Mus musculus
aaaaattgttagtagctggccgtgg

SEQ ID NO: 827 - DNA, 25 bp, Mus musculus
aaaaatttagatccttccccagaag

SEQ ID NO: 828 - DNA, 25 bp, Mus musculus
aaaaatttagatgcttccccagaag

SEQ ID NO: 829 - DNA, 25 bp, Mus musculus
aaaaatttatgcacctgtcctacct

SEQ ID NO: 830 - DNA, 25 bp, Mus musculus
aaaaatttatgctcctgtcctacct

SEQ ID NO: 831 - DNA, 25 bp, Mus musculus
aaaaatttcctcatgaccctacgag

SEQ ID NO: 832 - DNA, 25 bp, Mus musculus
aaaaatttcctcttgaccctacgag

SEQ ID NO: 833 - DNA, 25 bp, Mus musculus
aaaaattttacacagtcactgtaca

SEQ ID NO: 834 - DNA, 25 bp, Mus musculus
aaaaattttacagagtcactgtaca

SEQ ID NO: 835 - DNA, 25 bp, Mus musculus
aaaaattttctcatcctgattggag

SEQ ID NO: 836 - DNA, 25 bp, Mus musculus
aaaaattttctcttcctgattggag

SEQ ID NO: 837 - DNA, 25 bp, Mus musculus
aaaaattttgcaacacctccagaga

SEQ ID NO: 838 - DNA, 25 bp, Mus musculus
aaaaattttgcatcacctccagaga

SEQ ID NO: 839 - DNA, 25 bp, Mus musculus
aaaacaaaaattactgacccagcat

SEQ ID NO: 840 - DNA, 25 bp, Mus musculus
aaaacaaaaatttctgacccagcat

SEQ ID NO: 841 - DNA, 25 bp, Mus musculus
aaaacaaacaagctgccgggcagtg

SEQ ID NO: 842 - DNA, 25 bp, Mus musculus
aaaacaaacaaggtgccgggcagtg

SEQ ID NO: 843 - DNA, 25 bp, Mus musculus
aaaacaaacacacactaggcagtgg

SEQ ID NO: 844 - DNA, 25 bp, Mus musculus
aaaacaaacacagactaggcagtgg

SEQ ID NO: 845 - DNA, 25 bp, Mus musculus
aaaacaaagctacccgtcatctcaa

SEQ ID NO: 846 - DNA, 25 bp, Mus musculus
aaaacaaagctagccgtcatctcaa

SEQ ID NO: 847 - DNA, 25 bp, Mus musculus
aaaacaaattcacatctcaagccgg

SEQ ID NO: 848 - DNA, 25 bp, Mus musculus
aaaacaaattcagatctcaagccgg

SEQ ID NO: 849 - DNA, 25 bp, Mus musculus
aaaacaaattctccccacacatata

SEQ ID NO: 850 - DNA, 25 bp, Mus musculus
aaaacaaattctgcccacacatata

SEQ ID NO: 851 - DNA, 25 bp, Mus musculus
aaaacaacagctacggtatgtgatg

SEQ ID NO: 852 - DNA, 25 bp, Mus musculus
aaaacaacagcttcggtatgtgatg

SEQ ID NO: 853 - DNA, 25 bp, Mus musculus
aaaacaacatcccagagcctttgac

SEQ ID NO: 854 - DNA, 25 bp, Mus musculus
aaaacaacatccgagagcctttgac

SEQ ID NO: 855 - DNA, 25 bp, Mus musculus
aaaacaacatggaaggcctgtcata

SEQ ID NO: 856 - DNA, 25 bp, Mus musculus
aaaacaacatggatggccccacttc

SEQ ID NO: 857 - DNA, 25 bp, Mus musculus
aaaacaacatggtaggcctgtcata

SEQ ID NO: 858 - DNA, 25 bp, Mus musculus
aaaacaacatggttggccccacttc

SEQ ID NO: 859 - DNA, 25 bp, Mus musculus
aaaacaaccagcatttcaggtgatt

SEQ ID NO: 860 - DNA, 25 bp, Mus musculus
aaaacaaccagcttttcaggtgatt

SEQ ID NO: 861 - DNA, 25 bp, Mus musculus
aaaacaaccatccactcaaactgag

SEQ ID NO: 862 - DNA, 25 bp, Mus musculus
aaaacaaccatcgactcaaactgag

SEQ ID NO: 863 - DNA, 25 bp, Mus musculus
aaaacaaccattccatgtttgcttt

SEQ ID NO: 864 - DNA, 25 bp, Mus musculus
aaaacaaccattgcatgtttgcttt

SEQ ID NO: 865 - DNA, 25 bp, Mus musculus
aaaacaacccacacttacagctgtt

SEQ ID NO: 866 - DNA, 25 bp, Mus musculus
aaaacaacccactcttacagctgtt

SEQ ID NO: 867 - DNA, 25 bp, Mus musculus
aaaacaacccggcttcagtctatgg

SEQ ID NO: 868 - DNA, 25 bp, Mus musculus
aaaacaacccgggttcagtctatgg

SEQ ID NO: 869 - DNA, 25 bp, Mus musculus
aaaacaaccggcatctagcttctgg

SEQ ID NO: 870 - DNA, 25 bp, Mus musculus
aaaacaaccggcttctagcttctgg

SEQ ID NO: 871 - DNA, 25 bp, Mus musculus
aaaacaaccttgaactctcatccta

SEQ ID NO: 872 - DNA, 25 bp, Mus musculus
aaaacaaccttgtactctcatccta

SEQ ID NO: 873 - DNA, 25 bp, Mus musculus
aaaacaactacgatctatgaggaag

SEQ ID NO: 874 - DNA, 25 bp, Mus musculus
aaaacaactacgttctatgaggaag

SEQ ID NO: 875 - DNA, 25 bp, Mus musculus
aaaacaactgggacggatcatgcta

SEQ ID NO: 876 - DNA, 25 bp, Mus musculus
aaaacaactgggtcggatcatgcta

SEQ ID NO: 877 - DNA, 25 bp, Mus musculus
aaaacaactgtgaggactaccttat

SEQ ID NO: 878 - DNA, 25 bp, Mus musculus
aaaacaactgtgtggactaccttat

SEQ ID NO: 879 - DNA, 25 bp, Mus musculus
aaaacaacttacctcacagggcctg

SEQ ID NO: 880 - DNA, 25 bp, Mus musculus
aaaacaacttacgtcacagggcctg

SEQ ID NO: 881 - DNA, 25 bp, Mus musculus
aaaacaagaacacccacacgctgct

SEQ ID NO: 882 - DNA, 25 bp, Mus musculus
aaaacaagaacagccacacgctgct

SEQ ID NO: 883 - DNA, 25 bp, Mus musculus
aaaacaagacacagtccgctgcatt

SEQ ID NO: 884 - DNA, 25 bp, Mus musculus
aaaacaagacactgtccgctgcatt

SEQ ID NO: 885 - DNA, 25 bp, Mus musculus
aaaacaagacgtctgcttccttctc

SEQ ID NO: 886 - DNA, 25 bp, Mus musculus
aaaacaagacgtgtgcttccttctc

SEQ ID NO: 887 - DNA, 25 bp, Mus musculus
aaaacaagagccagtggtgtattta

SEQ ID NO: 888 - DNA, 25 bp, Mus musculus
aaaacaagagcctgtggtgtattta

SEQ ID NO: 889 - DNA, 25 bp, Mus musculus
aaaacaagagttatagcctagtggc

SEQ ID NO: 890 - DNA, 25 bp, Mus musculus
aaaacaagagttcccattctgtagc

SEQ ID NO: 891 - DNA, 25 bp, Mus musculus
aaaacaagagttgccattctgtagc

SEQ ID NO: 892 - DNA, 25 bp, Mus musculus
aaaacaagagttttagcctagtggc

SEQ ID NO: 893 - DNA, 25 bp, Mus musculus
aaaacaagcaacaccctgggctatc

SEQ ID NO: 894 - DNA, 25 bp, Mus musculus
aaaacaagcaactccctgggctatc

SEQ ID NO: 895 - DNA, 25 bp, Mus musculus
aaaacaagccccagtggaaactcag

SEQ ID NO: 896 - DNA, 25 bp, Mus musculus
aaaacaagcccctgtggaaactcag

SEQ ID NO: 897 - DNA, 25 bp, Mus musculus
aaaacaagcccgctgtctacacgag

SEQ ID NO: 898 - DNA, 25 bp, Mus musculus
aaaacaagcccggtgtctacacgag

SEQ ID NO: 899 - DNA, 25 bp, Mus musculus
aaaacaagctctaaatcatgtttga

SEQ ID NO: 900 - DNA, 25 bp, Mus musculus
aaaacaagctcttaatcatgtttga

SEQ ID NO: 901 - DNA, 25 bp, Mus musculus
aaaacaagcttgcagtcgcctgtat

SEQ ID NO: 902 - DNA, 25 bp, Mus musculus
aaaacaagcttggagtcgcctgtat

SEQ ID NO: 903 - DNA, 25 bp, Mus musculus
aaaacaagctttcagattgcggagc

SEQ ID NO: 904 - DNA, 25 bp, Mus musculus
aaaacaagctttgagattgcggagc

SEQ ID NO: 905 - DNA, 25 bp, Mus musculus
aaaacaagtgttctgctccaagcag

SEQ ID NO: 906 - DNA, 25 bp, Mus musculus
aaaacaagtgttgtgctccaagcag

SEQ ID NO: 907 - DNA, 25 bp, Mus musculus
aaaacaatactcaccacggctactg

SEQ ID NO: 908 - DNA, 25 bp, Mus musculus
aaaacaatactctccacggctactg

SEQ ID NO: 909 - DNA, 25 bp, Mus musculus
aaaacaatccctcactccacgtggg

SEQ ID NO: 910 - DNA, 25 bp, Mus musculus
aaaacaatccctgactccacgtggg

SEQ ID NO: 911 - DNA, 25 bp, Mus musculus
aaaacaatcggcagacactgtctaa

SEQ ID NO: 912 - DNA, 25 bp, Mus musculus
aaaacaatcggctgacactgtctaa

SEQ ID NO: 913 - DNA, 25 bp, Mus musculus
aaaacaatgatccagggcccctgca

SEQ ID NO: 914 - DNA, 25 bp, Mus musculus
aaaacaatgatcgagggcccctgca

SEQ ID NO: 915 - DNA, 25 bp, Mus musculus
aaaacaatgcgcaggtggtcggact

SEQ ID NO: 916 - DNA, 25 bp, Mus musculus
aaaacaatgcgctggtggtcggact

SEQ ID NO: 917 - DNA, 25 bp, Mus musculus
aaaacaatgctcctgtcctaagctg

SEQ ID NO: 918 - DNA, 25 bp, Mus musculus
aaaacaatgctcgtgtcctaagctg

SEQ ID NO: 919 - DNA, 25 bp, Mus musculus
aaaacaatggccagctgttcctgga

SEQ ID NO: 920 - DNA, 25 bp, Mus musculus
aaaacaatggcctgctgttcctgga

SEQ ID NO: 921 - DNA, 25 bp, Mus musculus
aaaacaatgtggaccccagctgacc

SEQ ID NO: 922 - DNA, 25 bp, Mus musculus
aaaacaatgtggtccccagctgacc

SEQ ID NO: 923 - DNA, 25 bp, Mus musculus
aaaacaattgtgattcctgatttga

SEQ ID NO: 924 - DNA, 25 bp, Mus musculus
aaaacaattgtgtttcctgatttga

SEQ ID NO: 925 - DNA, 25 bp, Mus musculus
aaaacacaacaacgctaagctccag

SEQ ID NO: 926 - DNA, 25 bp, Mus musculus
aaaacacaacaaggctaagctccag

SEQ ID NO: 927 - DNA, 25 bp, Mus musculus
aaaacacaactcagattttcttttg

SEQ ID NO: 928 - DNA, 25 bp, Mus musculus
aaaacacaactctgattttcttttg

SEQ ID NO: 929 - DNA, 25 bp, Mus musculus
aaaacacaaggcatgtcgggctggt

SEQ ID NO: 930 - DNA, 25 bp, Mus musculus
aaaacacaaggcttgtcgggctggt

SEQ ID NO: 931 - DNA, 25 bp, Mus musculus
aaaacacaagtaatcatattcagat

SEQ ID NO: 932 - DNA, 25 bp, Mus musculus
aaaacacaagtattcatattcagat

SEQ ID NO: 933 - DNA, 25 bp, Mus musculus
aaaacacacaccatagggactatca

SEQ ID NO: 934 - DNA, 25 bp, Mus musculus
aaaacacacaccttagggactatca

SEQ ID NO: 935 - DNA, 25 bp, Mus musculus
aaaacacacattctctttgcttctg

SEQ ID NO: 936 - DNA, 25 bp, Mus musculus
aaaacacacattgtctttgcttctg

SEQ ID NO: 937 - DNA, 25 bp, Mus musculus
aaaacacacttccaagctggagaga

SEQ ID NO: 938 - DNA, 25 bp, Mus musculus
aaaacacacttcgaagctggagaga

SEQ ID NO: 939 - DNA, 25 bp, Mus musculus
aaaacacagagccactatcactcca

SEQ ID NO: 940 - DNA, 25 bp, Mus musculus
aaaacacagagcgactatcactcca

SEQ ID NO: 941 - DNA, 25 bp, Mus musculus
aaaacacagctgacctatgccttgg

SEQ ID NO: 942 - DNA, 25 bp, Mus musculus
aaaacacagctgagttcttagagtt

SEQ ID NO: 943 - DNA, 25 bp, Mus musculus
aaaacacagctgtcctatgccttgg

SEQ ID NO: 944 - DNA, 25 bp, Mus musculus
aaaacacagctgtgttcttagagtt

SEQ ID NO: 945 - DNA, 25 bp, Mus musculus
aaaacacatagtactgcagcgacca

SEQ ID NO: 946 - DNA, 25 bp, Mus musculus
aaaacacatagttctgcagcgacca

SEQ ID NO: 947 - DNA, 25 bp, Mus musculus
aaaacacatgcaaccgttggttcat

SEQ ID NO: 948 - DNA, 25 bp, Mus musculus
aaaacacatgcatccgttggttcat

SEQ ID NO: 949 - DNA, 25 bp, Mus musculus
aaaacacattagacgcttaaaggag

SEQ ID NO: 950 - DNA, 25 bp, Mus musculus
aaaacacattagtcgcttaaaggag

SEQ ID NO: 951 - DNA, 25 bp, Mus musculus
aaaacaccaagccaaagtagctgtt

SEQ ID NO: 952 - DNA, 25 bp, Mus musculus
aaaacaccaagcgaaagtagctgtt

SEQ ID NO: 953 - DNA, 25 bp, Mus musculus
aaaacaccaatgacgccaactcctg

SEQ ID NO: 954 - DNA, 25 bp, Mus musculus
aaaacaccaatgtcgccaactcctg

SEQ ID NO: 955 - DNA, 25 bp, Mus musculus
aaaacaccacccaccaggtcatgtt

SEQ ID NO: 956 - DNA, 25 bp, Mus musculus
aaaacaccaccctccaggtcatgtt

SEQ ID NO: 957 - DNA, 25 bp, Mus musculus
aaaacaccagctatcttatggctca

SEQ ID NO: 958 - DNA, 25 bp, Mus musculus
aaaacaccagctttcttatggctca

SEQ ID NO: 959 - DNA, 25 bp, Mus musculus
aaaacaccagtgaaccaggattcct

SEQ ID NO: 960 - DNA, 25 bp, Mus musculus
aaaacaccagtgtaccaggattcct

SEQ ID NO: 961 - DNA, 25 bp, Mus musculus
aaaacaccattaacaatcacttagt

SEQ ID NO: 962 - DNA, 25 bp, Mus musculus
aaaacaccattatcaatcacttagt

SEQ ID NO: 963 - DNA, 25 bp, Mus musculus
aaaacacccgatacccagaagatga

SEQ ID NO: 964 - DNA, 25 bp, Mus musculus
aaaacacccgattcccagaagatga

SEQ ID NO: 965 - DNA, 25 bp, Mus musculus
aaaacaccctgaagtattcattggt

SEQ ID NO: 966 - DNA, 25 bp, Mus musculus
aaaacaccctgatgtattcattggt

SEQ ID NO: 967 - DNA, 25 bp, Mus musculus
aaaacacccttcaacattaagccat

SEQ ID NO: 968 - DNA, 25 bp, Mus musculus
aaaacacccttctacattaagccat

SEQ ID NO: 969 - DNA, 25 bp, Mus musculus
aaaacaccgacaacgccaaggagct

SEQ ID NO: 970 - DNA, 25 bp, Mus musculus
aaaacaccgacatcgccaaggagct

SEQ ID NO: 971 - DNA, 25 bp, Mus musculus
aaaacacctgccataggtgtgatgt

SEQ ID NO: 972 - DNA, 25 bp, Mus musculus
aaaacacctgccttaggtgtgatgt

SEQ ID NO: 973 - DNA, 25 bp, Mus musculus
aaaacaccttgtatccatgcatgaa

SEQ ID NO: 974 - DNA, 25 bp, Mus musculus
aaaacaccttgtttccatgcatgaa

SEQ ID NO: 975 - DNA, 25 bp, Mus musculus
aaaacacgcaatcggaggcacagtt

SEQ ID NO: 976 - DNA, 25 bp, Mus musculus
aaaacacgcaatgggaggcacagtt

SEQ ID NO: 977 - DNA, 25 bp, Mus musculus
aaaacacgcgtgcagagatatatac

SEQ ID NO: 978 - DNA, 25 bp, Mus musculus
aaaacacgcgtggagagatatatac

SEQ ID NO: 979 - DNA, 25 bp, Mus musculus
aaaacacggctgagggcgctgcgaa

SEQ ID NO: 980 - DNA, 25 bp, Mus musculus
aaaacacggctgtgggcgctgcgaa

SEQ ID NO: 981 - DNA, 25 bp, Mus musculus
aaaacacgtcacaggttcaacaaca

SEQ ID NO: 982 - DNA, 25 bp, Mus musculus
aaaacacgtcactggttcaacaaca

SEQ ID NO: 983 - DNA, 25 bp, Mus musculus
aaaacactaagcagaagctggccat

SEQ ID NO: 984 - DNA, 25 bp, Mus musculus
aaaacactaagctgaagctggccat

SEQ ID NO: 985 - DNA, 25 bp, Mus musculus
aaaacactaccaccgctgggcggtg

SEQ ID NO: 986 - DNA, 25 bp, Mus musculus
aaaacactaccagcgctgggcggtg

SEQ ID NO: 987 - DNA, 25 bp, Mus musculus
aaaacactaccccataagatatata

SEQ ID NO: 988 - DNA, 25 bp, Mus musculus
aaaacactacccgataagatatata

SEQ ID NO: 989 - DNA, 25 bp, Mus musculus
aaaacactagaacttctctctgccc

SEQ ID NO: 990 - DNA, 25 bp, Mus musculus
aaaacactagaagttctctctgccc

SEQ ID NO: 991 - DNA, 25 bp, Mus musculus
aaaacactatgcactatgcttggct

SEQ ID NO: 992 - DNA, 25 bp, Mus musculus
aaaacactatgccacctgcttgtcc

SEQ ID NO: 993 - DNA, 25 bp, Mus musculus
aaaacactatgcgacctgcttgtcc

SEQ ID NO: 994 - DNA, 25 bp, Mus musculus
aaaacactatgctctatgcttggct

SEQ ID NO: 995 - DNA, 25 bp, Mus musculus
aaaacactccccaaagctgagtcta

SEQ ID NO: 996 - DNA, 25 bp, Mus musculus
aaaacactcccctaagctgagtcta

SEQ ID NO: 997 - DNA, 25 bp, Mus musculus
aaaacactctccctttccatattca

SEQ ID NO: 998 - DNA, 25 bp, Mus musculus
aaaacactctccgtttccatattca

SEQ ID NO: 999 - DNA, 25 bp, Mus musculus
aaaacactctctatgtattccttat

SEQ ID NO: 1000 - DNA, 25 bp, Mus musculus
aaaacactctctttgtattccttat

SEQ ID NO: 1001 - DNA, 25 bp, Mus musculus
aaaacactgcaaagaggatgggtaa

SEQ ID NO: 1002 - DNA, 25 bp, Mus musculus
aaaacactgcaatgaggatgggtaa

SEQ ID NO: 1003 - DNA, 25 bp, Mus musculus
aaaacactgcatcatttccaagttg

SEQ ID NO: 1004 - DNA, 25 bp, Mus musculus
aaaacactgcatgatttccaagttg

SEQ ID NO: 1005 - DNA, 25 bp, Mus musculus
aaaacactggcaccttttggcattg

SEQ ID NO: 1006 - DNA, 25 bp, Mus musculus
aaaacactggcagcttttggcattg

SEQ ID NO: 1007 - DNA, 25 bp, Mus musculus
aaaacactgggtctgttaccgcgat

SEQ ID NO: 1008 - DNA, 25 bp, Mus musculus
aaaacactgggtgtgttaccgcgat

SEQ ID NO: 1009 - DNA, 25 bp, Mus musculus
aaaacactgtctcctacagctgaaa

SEQ ID NO: 1010 - DNA, 25 bp, Mus musculus
aaaacactgtctgctacagctgaaa

SEQ ID NO: 1011 - DNA, 25 bp, Mus musculus
aaaacactgtttatcagcctagaat

SEQ ID NO: 1012 - DNA, 25 bp, Mus musculus
aaaacactgtttttcagcctagaat

SEQ ID NO: 1013 - DNA, 25 bp, Mus musculus
aaaacacttaacacgggctgcaggc

SEQ ID NO: 1014 - DNA, 25 bp, Mus musculus
aaaacacttaacaggcaaagctgaa

SEQ ID NO: 1015 - DNA, 25 bp, Mus musculus
aaaacacttaactcgggctgcaggc

SEQ ID NO: 1016 - DNA, 25 bp, Mus musculus
aaaacacttaactggcaaagctgaa

SEQ ID NO: 1017 - DNA, 25 bp, Mus musculus
aaaacacttccgaacaaatcttgct

SEQ ID NO: 1018 - DNA, 25 bp, Mus musculus
aaaacacttccgtacaaatcttgct

SEQ ID NO: 1019 - DNA, 25 bp, Mus musculus
aaaacacttgtaagtattatctgta

SEQ ID NO: 1020 - DNA, 25 bp, Mus musculus
aaaacacttgtatgtattatctgta

SEQ ID NO: 1021 - DNA, 25 bp, Mus musculus
aaaacagaacctcagtcatcactcc

SEQ ID NO: 1022 - DNA, 25 bp, Mus musculus
aaaacagaacctgagtcatcactcc

SEQ ID NO: 1023 - DNA, 25 bp, Mus musculus
aaaacagaagcccaccattatcact

SEQ ID NO: 1024 - DNA, 25 bp, Mus musculus
aaaacagaagccgaccattatcact

SEQ ID NO: 1025 - DNA, 25 bp, Mus musculus
aaaacagaatttccctgaaggtata

SEQ ID NO: 1026 - DNA, 25 bp, Mus musculus
aaaacagaatttgcctgaaggtata

SEQ ID NO: 1027 - DNA, 25 bp, Mus musculus
aaaacagacagacgctgcgggatga

SEQ ID NO: 1028 - DNA, 25 bp, Mus musculus
aaaacagacagaggctgcgggatga

SEQ ID NO: 1029 - DNA, 25 bp, Mus musculus
aaaacagacctgatctccagctcgt

SEQ ID NO: 1030 - DNA, 25 bp, Mus musculus
aaaacagacctgttctccagctcgt

SEQ ID NO: 1031 - DNA, 25 bp, Mus musculus
aaaacagagattccccgattgcagc

SEQ ID NO: 1032 - DNA, 25 bp, Mus musculus
aaaacagagattgcccgattgcagc

SEQ ID NO: 1033 - DNA, 25 bp, Mus musculus
aaaacagataagaccatgttcaggg

SEQ ID NO: 1034 - DNA, 25 bp, Mus musculus
aaaacagataagtccatgttcaggg

SEQ ID NO: 1035 - DNA, 25 bp, Mus musculus
aaaacagataccacatgcactggcc

SEQ ID NO: 1036 - DNA, 25 bp, Mus musculus
aaaacagatacctcatgcactggcc

SEQ ID NO: 1037 - DNA, 25 bp, Mus musculus
aaaacagatcttagtgtgtcacata

SEQ ID NO: 1038 - DNA, 25 bp, Mus musculus
aaaacagatctttgtgtgtcacata

SEQ ID NO: 1039 - DNA, 25 bp, Mus musculus
aaaacagatgctctcccagtagaag

SEQ ID NO: 1040 - DNA, 25 bp, Mus musculus
aaaacagatgctgtcccagtagaag

SEQ ID NO: 1041 - DNA, 25 bp, Mus musculus
aaaacagatgttaccgatgtataaa

SEQ ID NO: 1042 - DNA, 25 bp, Mus musculus
aaaacagatgtttccgatgtataaa

SEQ ID NO: 1043 - DNA, 25 bp, Mus musculus
aaaacagattagaccatgccatggg

SEQ ID NO: 1044 - DNA, 25 bp, Mus musculus
aaaacagattagtccatgccatggg

SEQ ID NO: 1045 - DNA, 25 bp, Mus musculus
aaaacagcaattacttatggctcat

SEQ ID NO: 1046 - DNA, 25 bp, Mus musculus
aaaacagcaatttcttatggctcat

SEQ ID NO: 1047 - DNA, 25 bp, Mus musculus
aaaacagcaccacggcagtgttcat

SEQ ID NO: 1048 - DNA, 25 bp, Mus musculus
aaaacagcaccagggcagtgttcat

SEQ ID NO: 1049 - DNA, 25 bp, Mus musculus
aaaacagcagcaatctacccacagt

SEQ ID NO: 1050 - DNA, 25 bp, Mus musculus
aaaacagcagcacgtcactcggttc

SEQ ID NO: 1051 - DNA, 25 bp, Mus musculus
aaaacagcagcaggtcactcggttc

SEQ ID NO: 1052 - DNA, 25 bp, Mus musculus
aaaacagcagcattctacccacagt

SEQ ID NO: 1053 - DNA, 25 bp, Mus musculus
aaaacagccatgacgctatggattc

SEQ ID NO: 1054 - DNA, 25 bp, Mus musculus
aaaacagccatgtcgctatggattc

SEQ ID NO: 1055 - DNA, 25 bp, Mus musculus
aaaacagcccacactttcgagcagg

SEQ ID NO: 1056 - DNA, 25 bp, Mus musculus
aaaacagcccactctttcgagcagg

SEQ ID NO: 1057 - DNA, 25 bp, Mus musculus
aaaacagcccatcccctgagacatt

SEQ ID NO: 1058 - DNA, 25 bp, Mus musculus
aaaacagcccatgccctgagacatt

SEQ ID NO: 1059 - DNA, 25 bp, Mus musculus
aaaacagccctgattgagaccagtg

SEQ ID NO: 1060 - DNA, 25 bp, Mus musculus
aaaacagccctgtttgagaccagtg

SEQ ID NO: 1061 - DNA, 25 bp, Mus musculus
aaaacagcctcacatgttcctcagg

SEQ ID NO: 1062 - DNA, 25 bp, Mus musculus
aaaacagcctcagatgttcctcagg

SEQ ID NO: 1063 - DNA, 25 bp, Mus musculus
aaaacagcctgtcatggtccttgat

SEQ ID NO: 1064 - DNA, 25 bp, Mus musculus
aaaacagcctgtgatggtccttgat

SEQ ID NO: 1065 - DNA, 25 bp, Mus musculus
aaaacagcctttcttccggtctctg

SEQ ID NO: 1066 - DNA, 25 bp, Mus musculus
aaaacagcctttgttccggtctctg

SEQ ID NO: 1067 - DNA, 25 bp, Mus musculus
aaaacagcgagcagataccaccttc

SEQ ID NO: 1068 - DNA, 25 bp, Mus musculus
aaaacagcgagctgataccaccttc

SEQ ID NO: 1069 - DNA, 25 bp, Mus musculus
aaaacagcgtctcgcaggcatggca

SEQ ID NO: 1070 - DNA, 25 bp, Mus musculus
aaaacagcgtctggcaggcatggca

SEQ ID NO: 1071 - DNA, 25 bp, Mus musculus
aaaacagctactaaccctgaagata

SEQ ID NO: 1072 - DNA, 25 bp, Mus musculus
aaaacagctacttaccctgaagata

SEQ ID NO: 1073 - DNA, 25 bp, Mus musculus
aaaacagctcatcccaatctggtgt

SEQ ID NO: 1074 - DNA, 25 bp, Mus musculus
aaaacagctcatgccaatctggtgt

SEQ ID NO: 1075 - DNA, 25 bp, Mus musculus
aaaacagctccgatttctcttcact

SEQ ID NO: 1076 - DNA, 25 bp, Mus musculus
aaaacagctccgttttctcttcact

SEQ ID NO: 1077 - DNA, 25 bp, Mus musculus
aaaacagctgaaaatgggccaaaca

SEQ ID NO: 1078 - DNA, 25 bp, Mus musculus
aaaacagctgaatatgggccaaaca

SEQ ID NO: 1079 - DNA, 25 bp, Mus musculus
aaaacagctgacacgtgaggtggaa

SEQ ID NO: 1080 - DNA, 25 bp, Mus musculus
aaaacagctgactcgtgaggtggaa

SEQ ID NO: 1081 - DNA, 25 bp, Mus musculus
aaaacagcttcgctggtgagcctct

SEQ ID NO: 1082 - DNA, 25 bp, Mus musculus
aaaacagcttcggtggtgagcctct

SEQ ID NO: 1083 - DNA, 25 bp, Mus musculus
aaaacagcttggagacttgagtgat

SEQ ID NO: 1084 - DNA, 25 bp, Mus musculus
aaaacagcttggtgacttgagtgat

SEQ ID NO: 1085 - DNA, 25 bp, Mus musculus
aaaacagctttaatgacaggcctca

SEQ ID NO: 1086 - DNA, 25 bp, Mus musculus
aaaacagctttattgacaggcctca

SEQ ID NO: 1087 - DNA, 25 bp, Mus musculus
aaaacagctttcaacttggccttgc

SEQ ID NO: 1088 - DNA, 25 bp, Mus musculus
aaaacagctttctacttggccttgc

SEQ ID NO: 1089 - DNA, 25 bp, Mus musculus
aaaacaggatgcactctctgagttc

SEQ ID NO: 1090 - DNA, 25 bp, Mus musculus
aaaacaggatgctctctctgagttc

SEQ ID NO: 1091 - DNA, 25 bp, Mus musculus
aaaacaggcaacatccgcccagtgg

SEQ ID NO: 1092 - DNA, 25 bp, Mus musculus
aaaacaggcaacttccgcccagtgg

SEQ ID NO: 1093 - DNA, 25 bp, Mus musculus
aaaacaggccagcatgattccccag

SEQ ID NO: 1094 - DNA, 25 bp, Mus musculus
aaaacaggccaggatgattccccag

SEQ ID NO: 1095 - DNA, 25 bp, Mus musculus
aaaacaggccccacgtgctagaaag

SEQ ID NO: 1096 - DNA, 25 bp, Mus musculus
aaaacaggcccctcgtgctagaaag

SEQ ID NO: 1097 - DNA, 25 bp, Mus musculus
aaaacaggcctcaccttagtggcgt

SEQ ID NO: 1098 - DNA, 25 bp, Mus musculus
aaaacaggcctctccttagtggcgt

SEQ ID NO: 1099 - DNA, 25 bp, Mus musculus
aaaacaggctggcacccgatgccta

SEQ ID NO: 1100 - DNA, 25 bp, Mus musculus
aaaacaggctgggacccgatgccta

SEQ ID NO: 1101 - DNA, 25 bp, Mus musculus
aaaacagggactctctggccctgga

SEQ ID NO: 1102 - DNA, 25 bp, Mus musculus
aaaacagggactgtctggccctgga

SEQ ID NO: 1103 - DNA, 25 bp, Mus musculus
aaaacagggcatcgatatttggaat

SEQ ID NO: 1104 - DNA, 25 bp, Mus musculus
aaaacagggcatggatatttggaat

SEQ ID NO: 1105 - DNA, 25 bp, Mus musculus
aaaacagggcgcatgcctaggcctt

SEQ ID NO: 1106 - DNA, 25 bp, Mus musculus
aaaacagggcgcttgcctaggcctt

SEQ ID NO: 1107 - DNA, 25 bp, Mus musculus
aaaacagggctcaagagttagctca

SEQ ID NO: 1108 - DNA, 25 bp, Mus musculus
aaaacagggctctagagttagctca

SEQ ID NO: 1109 - DNA, 25 bp, Mus musculus
aaaacagggtatcagctttaactct

SEQ ID NO: 1110 - DNA, 25 bp, Mus musculus
aaaacagggtatgagctttaactct

SEQ ID NO: 1111 - DNA, 25 bp, Mus musculus
aaaacagggtgcacttcttggtctc

SEQ ID NO: 1112 - DNA, 25 bp, Mus musculus
aaaacagggtgctcttcttggtctc

SEQ ID NO: 1113 - DNA, 25 bp, Mus musculus
aaaacaggtacgactgcctcggatc

SEQ ID NO: 1114 - DNA, 25 bp, Mus musculus
aaaacaggtacgtctgcctcggatc

SEQ ID NO: 1115 - DNA, 25 bp, Mus musculus
aaaacaggtctgctgtacatacata

SEQ ID NO: 1116 - DNA, 25 bp, Mus musculus
aaaacaggtctggtgtacatacata

SEQ ID NO: 1117 - DNA, 25 bp, Mus musculus
aaaacaggtgatacttcttcagatt

SEQ ID NO: 1118 - DNA, 25 bp, Mus musculus
aaaacaggtgattcttcttcagatt

SEQ ID NO: 1119 - DNA, 25 bp, Mus musculus
aaaacaggtgcaccagtggcccgtg

SEQ ID NO: 1120 - DNA, 25 bp, Mus musculus
aaaacaggtgcacgaggccttcggt

SEQ ID NO: 1121 - DNA, 25 bp, Mus musculus
aaaacaggtgcagcagtggcccgtg

SEQ ID NO: 1122 - DNA, 25 bp, Mus musculus
aaaacaggtgcaggaggccttcggt

SEQ ID NO: 1123 - DNA, 25 bp, Mus musculus
aaaacaggtggcatcggtgctgctc

SEQ ID NO: 1124 - DNA, 25 bp, Mus musculus
aaaacaggtggcttcggtgctgctc

SEQ ID NO: 1125 - DNA, 25 bp, Mus musculus
aaaacagtaggccaggcacagtatc

SEQ ID NO: 1126 - DNA, 25 bp, Mus musculus
aaaacagtaggcgaggcacagtatc

SEQ ID NO: 1127 - DNA, 25 bp, Mus musculus
aaaacagtcacaacgggccggcaga

SEQ ID NO: 1128 - DNA, 25 bp, Mus musculus
aaaacagtcacatcgggccggcaga

SEQ ID NO: 1129 - DNA, 25 bp, Mus musculus
aaaacagtcactattgccaacaaga

SEQ ID NO: 1130 - DNA, 25 bp, Mus musculus
aaaacagtcacttttgccaacaaga

SEQ ID NO: 1131 - DNA, 25 bp, Mus musculus
aaaacagtcatgaagcccatgcaga

SEQ ID NO: 1132 - DNA, 25 bp, Mus musculus
aaaacagtcatgtagcccatgcaga

SEQ ID NO: 1133 - DNA, 25 bp, Mus musculus
aaaacagtccttccctacttagtgg

SEQ ID NO: 1134 - DNA, 25 bp, Mus musculus
aaaacagtccttcgcactgcctgga

SEQ ID NO: 1135 - DNA, 25 bp, Mus musculus
aaaacagtccttgcctacttagtgg

SEQ ID NO: 1136 - DNA, 25 bp, Mus musculus
aaaacagtccttggcactgcctgga

SEQ ID NO: 1137 - DNA, 25 bp, Mus musculus
aaaacagtcgatcttgcctgctgct

SEQ ID NO: 1138 - DNA, 25 bp, Mus musculus
aaaacagtcgatgttgcctgctgct

SEQ ID NO: 1139 - DNA, 25 bp, Mus musculus
aaaacagtctcgattcagaagcatc

SEQ ID NO: 1140 - DNA, 25 bp, Mus musculus
aaaacagtctcgtttcagaagcatc

SEQ ID NO: 1141 - DNA, 25 bp, Mus musculus
aaaacagtcttgctcctggaacttt

SEQ ID NO: 1142 - DNA, 25 bp, Mus musculus
aaaacagtcttggtcctggaacttt

SEQ ID NO: 1143 - DNA, 25 bp, Mus musculus
aaaacagtgcccctcagtgagctgc

SEQ ID NO: 1144 - DNA, 25 bp, Mus musculus
aaaacagtgcccgtcagtgagctgc

SEQ ID NO: 1145 - DNA, 25 bp, Mus musculus
aaaacagtgcggagtgacccggtga

SEQ ID NO: 1146 - DNA, 25 bp, Mus musculus
aaaacagtgcggtgtgacccggtga

SEQ ID NO: 1147 - DNA, 25 bp, Mus musculus
aaaacagtgctgacttacaaagaat

SEQ ID NO: 1148 - DNA, 25 bp, Mus musculus
aaaacagtgctgtcttacaaagaat

SEQ ID NO: 1149 - DNA, 25 bp, Mus musculus
aaaacagtggcacgctcatttcaac

SEQ ID NO: 1150 - DNA, 25 bp, Mus musculus
aaaacagtggcaggctcatttcaac

SEQ ID NO: 1151 - DNA, 25 bp, Mus musculus
aaaacagtggctcttaccctgtggg

SEQ ID NO: 1152 - DNA, 25 bp, Mus musculus
aaaacagtggctgttaccctgtggg

SEQ ID NO: 1153 - DNA, 25 bp, Mus musculus
aaaacagtggttaggctctgcacag

SEQ ID NO: 1154 - DNA, 25 bp, Mus musculus
aaaacagtggttcccatcttcgtgg

SEQ ID NO: 1155 - DNA, 25 bp, Mus musculus
aaaacagtggttgccatcttcgtgg

SEQ ID NO: 1156 - DNA, 25 bp, Mus musculus
aaaacagtggtttggctctgcacag

SEQ ID NO: 1157 - DNA, 25 bp, Mus musculus
aaaacagtgtaaccgaatcccagag

SEQ ID NO: 1158 - DNA, 25 bp, Mus musculus
aaaacagtgtaagcgaatcccagag

SEQ ID NO: 1159 - DNA, 25 bp, Mus musculus
aaaacagttcttctgcttgtctttt

SEQ ID NO: 1160 - DNA, 25 bp, Mus musculus
aaaacagttcttgtgcttgtctttt

SEQ ID NO: 1161 - DNA, 25 bp, Mus musculus
aaaacagttggacaagccctgaact

SEQ ID NO: 1162 - DNA, 25 bp, Mus musculus
aaaacagttggagaagccctgaact

SEQ ID NO: 1163 - DNA, 25 bp, Mus musculus
aaaacagtttgcattgtactggcat

SEQ ID NO: 1164 - DNA, 25 bp, Mus musculus
aaaacagtttgctttgtactggcat

SEQ ID NO: 1165 - DNA, 25 bp, Mus musculus
aaaacataacttcgcctccatgatt

SEQ ID NO: 1166 - DNA, 25 bp, Mus musculus
aaaacataacttggcctccatgatt

SEQ ID NO: 1167 - DNA, 25 bp, Mus musculus
aaaacataatcaatccctgggcaat

SEQ ID NO: 1168 - DNA, 25 bp, Mus musculus
aaaacataatcattccctgggcaat

SEQ ID NO: 1169 - DNA, 25 bp, Mus musculus
aaaacatacagtactctgcgtccca

SEQ ID NO: 1170 - DNA, 25 bp, Mus musculus
aaaacatacagttctctgcgtccca

SEQ ID NO: 1171 - DNA, 25 bp, Mus musculus
aaaacatacctgcttccagataccc

SEQ ID NO: 1172 - DNA, 25 bp, Mus musculus
aaaacatacctggttccagataccc

SEQ ID NO: 1173 - DNA, 25 bp, Mus musculus
aaaacatactaactggctgggttca

SEQ ID NO: 1174 - DNA, 25 bp, Mus musculus
aaaacatactaagtggctgggttca

SEQ ID NO: 1175 - DNA, 25 bp, Mus musculus
aaaacatagatgatcataagactgc

SEQ ID NO: 1176 - DNA, 25 bp, Mus musculus
aaaacatagatgttcataagactgc

SEQ ID NO: 1177 - DNA, 25 bp, Mus musculus
aaaacataggccacacctgcagagt

SEQ ID NO: 1178 - DNA, 25 bp, Mus musculus
aaaacataggcctcacctgcagagt

SEQ ID NO: 1179 - DNA, 25 bp, Mus musculus
aaaacatagtctcgtccattttcat

SEQ ID NO: 1180 - DNA, 25 bp, Mus musculus
aaaacatagtctggtccattttcat

SEQ ID NO: 1181 - DNA, 25 bp, Mus musculus
aaaacatatggcaccacttcttctg

SEQ ID NO: 1182 - DNA, 25 bp, Mus musculus
aaaacatatggctccacttcttctg

SEQ ID NO: 1183 - DNA, 25 bp, Mus musculus
aaaacatcagaccacattcctagaa

SEQ ID NO: 1184 - DNA, 25 bp, Mus musculus
aaaacatcagacgacattcctagaa

SEQ ID NO: 1185 - DNA, 25 bp, Mus musculus
aaaacatcagttaactcatgaagct

SEQ ID NO: 1186 - DNA, 25 bp, Mus musculus
aaaacatcagtttactcatgaagct

SEQ ID NO: 1187 - DNA, 25 bp, Mus musculus
aaaacatcatcccagctgtagaaca

SEQ ID NO: 1188 - DNA, 25 bp, Mus musculus
aaaacatcatccgagctgtagaaca

SEQ ID NO: 1189 - DNA, 25 bp, Mus musculus
aaaacatcatcgaaaggttgcgtgt

SEQ ID NO: 1190 - DNA, 25 bp, Mus musculus
aaaacatcatcgtaaggttgcgtgt

SEQ ID NO: 1191 - DNA, 25 bp, Mus musculus
aaaacatcatctcgtccaacctcaa

SEQ ID NO: 1192 - DNA, 25 bp, Mus musculus
aaaacatcatctggtccaacctcaa

SEQ ID NO: 1193 - DNA, 25 bp, Mus musculus
aaaacatccaacacagctgactttc

SEQ ID NO: 1194 - DNA, 25 bp, Mus musculus
aaaacatccaactcagctgactttc

SEQ ID NO: 1195 - DNA, 25 bp, Mus musculus
aaaacatccagactcacttctgtga

SEQ ID NO: 1196 - DNA, 25 bp, Mus musculus
aaaacatccagagtcacttctgtga

SEQ ID NO: 1197 - DNA, 25 bp, Mus musculus
aaaacatccccgcgctctgcagtga

SEQ ID NO: 1198 - DNA, 25 bp, Mus musculus
aaaacatccccgggctctgcagtga

SEQ ID NO: 1199 - DNA, 25 bp, Mus musculus
aaaacatcccctagccatctaagaa

SEQ ID NO: 1200 - DNA, 25 bp, Mus musculus
aaaacatcccctcaccagcaagatg

SEQ ID NO: 1201 - DNA, 25 bp, Mus musculus
aaaacatcccctgaccagcaagatg

SEQ ID NO: 1202 - DNA, 25 bp, Mus musculus
aaaacatccccttgccatctaagaa

SEQ ID NO: 1203 - DNA, 25 bp, Mus musculus
aaaacatccctcatacatagaagtg

SEQ ID NO: 1204 - DNA, 25 bp, Mus musculus
aaaacatccctcttacatagaagtg

SEQ ID NO: 1205 - DNA, 25 bp, Mus musculus
aaaacatccctgctcttttagaggc

SEQ ID NO: 1206 - DNA, 25 bp, Mus musculus
aaaacatccctggtcttttagaggc

SEQ ID NO: 1207 - DNA, 25 bp, Mus musculus
aaaacatcctgaaaaaccccagcct

SEQ ID NO: 1208 - DNA, 25 bp, Mus musculus
aaaacatcctgataaaccccagcct

SEQ ID NO: 1209 - DNA, 25 bp, Mus musculus
aaaacatcctgcacttactgttcca

SEQ ID NO: 1210 - DNA, 25 bp, Mus musculus
aaaacatcctgctcttactgttcca

SEQ ID NO: 1211 - DNA, 25 bp, Mus musculus
aaaacatctgcgatcacagtgctgc

SEQ ID NO: 1212 - DNA, 25 bp, Mus musculus
aaaacatctgcgttcacagtgctgc

SEQ ID NO: 1213 - DNA, 25 bp, Mus musculus
aaaacatctgtgaggcatgaaaact

SEQ ID NO: 1214 - DNA, 25 bp, Mus musculus
aaaacatctgtgtggcatgaaaact

SEQ ID NO: 1215 - DNA, 25 bp, Mus musculus
aaaacatctttcaccatgggtgtct

SEQ ID NO: 1216 - DNA, 25 bp, Mus musculus
aaaacatctttctccatgggtgtct

SEQ ID NO: 1217 - DNA, 25 bp, Mus musculus
aaaacatgaagtaattgtgctggta

SEQ ID NO: 1218 - DNA, 25 bp, Mus musculus
aaaacatgaagtctgagtgctgtgt

SEQ ID NO: 1219 - DNA, 25 bp, Mus musculus
aaaacatgaagtgtgagtgctgtgt

SEQ ID NO: 1220 - DNA, 25 bp, Mus musculus
aaaacatgaagttattgtgctggta

SEQ ID NO: 1221 - DNA, 25 bp, Mus musculus
aaaacatgaattccccatgcaagct

SEQ ID NO: 1222 - DNA, 25 bp, Mus musculus
aaaacatgaattgcccatgcaagct

SEQ ID NO: 1223 - DNA, 25 bp, Mus musculus
aaaacatgacagacggcccagggct

SEQ ID NO: 1224 - DNA, 25 bp, Mus musculus
aaaacatgacagtcggcccagggct

SEQ ID NO: 1225 - DNA, 25 bp, Mus musculus
aaaacatgcaggactccgtttcctt

SEQ ID NO: 1226 - DNA, 25 bp, Mus musculus
aaaacatgcaggtctccgtttcctt

SEQ ID NO: 1227 - DNA, 25 bp, Mus musculus
aaaacatgcgagacccacatttcct

SEQ ID NO: 1228 - DNA, 25 bp, Mus musculus
aaaacatgcgagtcccacatttcct

SEQ ID NO: 1229 - DNA, 25 bp, Mus musculus
aaaacatgcgttcctgtcctgtgtc

SEQ ID NO: 1230 - DNA, 25 bp, Mus musculus
aaaacatgcgttgctgtcctgtgtc

SEQ ID NO: 1231 - DNA, 25 bp, Mus musculus
aaaacatgctctactggatggcctg

SEQ ID NO: 1232 - DNA, 25 bp, Mus musculus
aaaacatgctcttctggatggcctg

SEQ ID NO: 1233 - DNA, 25 bp, Mus musculus
aaaacatgctttctgagatctataa

SEQ ID NO: 1234 - DNA, 25 bp, Mus musculus
aaaacatgctttgtgagatctataa

SEQ ID NO: 1235 - DNA, 25 bp, Mus musculus
aaaacatggccactctgcagtccag

SEQ ID NO: 1236 - DNA, 25 bp, Mus musculus
aaaacatggccagtctgcagtccag

SEQ ID NO: 1237 - DNA, 25 bp, Mus musculus
aaaacatgggcccttctcttcagtc

SEQ ID NO: 1238 - DNA, 25 bp, Mus musculus
aaaacatgggccgttctcttcagtc

SEQ ID NO: 1239 - DNA, 25 bp, Mus musculus
aaaacatgggcgagctgatacgaaa

SEQ ID NO: 1240 - DNA, 25 bp, Mus musculus
aaaacatgggcgtgctgatacgaaa

SEQ ID NO: 1241 - DNA, 25 bp, Mus musculus
aaaacatgggctctattttgggcta

SEQ ID NO: 1242 - DNA, 25 bp, Mus musculus
aaaacatgggctgtattttgggcta

SEQ ID NO: 1243 - DNA, 25 bp, Mus musculus
aaaacatggtttcgtacctgagtca

SEQ ID NO: 1244 - DNA, 25 bp, Mus musculus
aaaacatggtttggtacctgagtca

SEQ ID NO: 1245 - DNA, 25 bp, Mus musculus
aaaacatgtctgactttgcaaagga

SEQ ID NO: 1246 - DNA, 25 bp, Mus musculus
aaaacatgtctgtctttgcaaagga

SEQ ID NO: 1247 - DNA, 25 bp, Mus musculus
aaaacattaaaaactggtttcatgg

SEQ ID NO: 1248 - DNA, 25 bp, Mus musculus
aaaacattaaaatctggtttcatgg

SEQ ID NO: 1249 - DNA, 25 bp, Mus musculus
aaaacattatgccaacaccagagtc

SEQ ID NO: 1250 - DNA, 25 bp, Mus musculus
aaaacattatgcgaacaccagagtc

SEQ ID NO: 1251 - DNA, 25 bp, Mus musculus
aaaacattcaatcccagtcacaaag

SEQ ID NO: 1252 - DNA, 25 bp, Mus musculus
aaaacattcaatgccagtcacaaag

SEQ ID NO: 1253 - DNA, 25 bp, Mus musculus
aaaacattcagacgccaggccagac

SEQ ID NO: 1254 - DNA, 25 bp, Mus musculus
aaaacattcagaggccaggccagac

SEQ ID NO: 1255 - DNA, 25 bp, Mus musculus
aaaacattctacagttcctttccat

SEQ ID NO: 1256 - DNA, 25 bp, Mus musculus
aaaacattctactgttcctttccat

SEQ ID NO: 1257 - DNA, 25 bp, Mus musculus
aaaacattctctcattgtacaagga

SEQ ID NO: 1258 - DNA, 25 bp, Mus musculus
aaaacattctctgattgtacaagga

SEQ ID NO: 1259 - DNA, 25 bp, Mus musculus
aaaacattctgcatatatccacgag

SEQ ID NO: 1260 - DNA, 25 bp, Mus musculus
aaaacattctgcttatatccacgag

SEQ ID NO: 1261 - DNA, 25 bp, Mus musculus
aaaacattctgtcactcgatctggc

SEQ ID NO: 1262 - DNA, 25 bp, Mus musculus
aaaacattctgtgactcgatctggc

SEQ ID NO: 1263 - DNA, 25 bp, Mus musculus
aaaacattgtgcatcaccttctacc

SEQ ID NO: 1264 - DNA, 25 bp, Mus musculus
aaaacattgtgcttcaccttctacc

SEQ ID NO: 1265 - DNA, 25 bp, Mus musculus
aaaacattgtgtccggggtgctctc

SEQ ID NO: 1266 - DNA, 25 bp, Mus musculus
aaaacattgtgtgcggggtgctctc

SEQ ID NO: 1267 - DNA, 25 bp, Mus musculus
aaaacatttattaactgcatggtta

SEQ ID NO: 1268 - DNA, 25 bp, Mus musculus
aaaacatttatttactgcatggtta

SEQ ID NO: 1269 - DNA, 25 bp, Mus musculus
aaaacatttccacgtttcctcatgg

SEQ ID NO: 1270 - DNA, 25 bp, Mus musculus
aaaacatttccaggtttcctcatgg

SEQ ID NO: 1271 - DNA, 25 bp, Mus musculus
aaaacatttgctccctacctcacag

SEQ ID NO: 1272 - DNA, 25 bp, Mus musculus
aaaacatttgctgcctacctcacag

SEQ ID NO: 1273 - DNA, 25 bp, Mus musculus
aaaacattttgtaggccagctctgg

SEQ ID NO: 1274 - DNA, 25 bp, Mus musculus
aaaacattttgttggccagctctgg

SEQ ID NO: 1275 - DNA, 25 bp, Mus musculus
aaaaccaaatgcagtcgtcgacaag

SEQ ID NO: 1276 - DNA, 25 bp, Mus musculus
aaaaccaaatgctgtcgtcgacaag

SEQ ID NO: 1277 - DNA, 25 bp, Mus musculus
aaaaccaaccatatgccagtgccaa

SEQ ID NO: 1278 - DNA, 25 bp, Mus musculus
aaaaccaaccatttgccagtgccaa

SEQ ID NO: 1279 - DNA, 25 bp, Mus musculus
aaaaccaaccggcaatgacgcgcga

SEQ ID NO: 1280 - DNA, 25 bp, Mus musculus
aaaaccaaccgggaatgacgcgcga

SEQ ID NO: 1281 - DNA, 25 bp, Mus musculus
aaaaccaactgaaagccttccatcc

SEQ ID NO: 1282 - DNA, 25 bp, Mus musculus
aaaaccaactgatagccttccatcc

SEQ ID NO: 1283 - DNA, 25 bp, Mus musculus
aaaaccaactgcatcctatcataaa

SEQ ID NO: 1284 - DNA, 25 bp, Mus musculus
aaaaccaactgcttcctatcataaa

SEQ ID NO: 1285 - DNA, 25 bp, Mus musculus
aaaaccaagatgacattgccaagat

SEQ ID NO: 1286 - DNA, 25 bp, Mus musculus
aaaaccaagatgtcattgccaagat

SEQ ID NO: 1287 - DNA, 25 bp, Mus musculus
aaaaccaagcagcatacacgggctt

SEQ ID NO: 1288 - DNA, 25 bp, Mus musculus
aaaaccaagcagcatccagggactg

SEQ ID NO: 1289 - DNA, 25 bp, Mus musculus
aaaaccaagcaggatacacgggctt

SEQ ID NO: 1290 - DNA, 25 bp, Mus musculus
aaaaccaagcaggatccagggactg

SEQ ID NO: 1291 - DNA, 25 bp, Mus musculus
aaaaccaagcatcctttgtatgtat

SEQ ID NO: 1292 - DNA, 25 bp, Mus musculus
aaaaccaagcatgctttgtatgtat

SEQ ID NO: 1293 - DNA, 25 bp, Mus musculus
aaaaccaagctgagctcctttcgag

SEQ ID NO: 1294 - DNA, 25 bp, Mus musculus
aaaaccaagctgtgctcctttcgag

SEQ ID NO: 1295 - DNA, 25 bp, Mus musculus
aaaaccaaggtgagacgcagcacaa

SEQ ID NO: 1296 - DNA, 25 bp, Mus musculus
aaaaccaaggtgtgacgcagcacaa

SEQ ID NO: 1297 - DNA, 25 bp, Mus musculus
aaaaccaatgcaaagtttaacatat

SEQ ID NO: 1298 - DNA, 25 bp, Mus musculus
aaaaccaatgcatagtttaacatat

SEQ ID NO: 1299 - DNA, 25 bp, Mus musculus
aaaaccaatgtgagtggaggcgcca

SEQ ID NO: 1300 - DNA, 25 bp, Mus musculus
aaaaccaatgtgtgtggaggcgcca

SEQ ID NO: 1301 - DNA, 25 bp, Mus musculus
aaaaccaattctcatctccggcttt

SEQ ID NO: 1302 - DNA, 25 bp, Mus musculus
aaaaccaattctgatctccggcttt

SEQ ID NO: 1303 - DNA, 25 bp, Mus musculus
aaaaccaatttcacattagcataac

SEQ ID NO: 1304 - DNA, 25 bp, Mus musculus
aaaaccaatttcatcatgtctcaaa

SEQ ID NO: 1305 - DNA, 25 bp, Mus musculus
aaaaccaatttctcattagcataac

SEQ ID NO: 1306 - DNA, 25 bp, Mus musculus
aaaaccaatttcttcatgtctcaaa

SEQ ID NO: 1307 - DNA, 25 bp, Mus musculus
aaaaccacaaacagccagtcaggga

SEQ ID NO: 1308 - DNA, 25 bp, Mus musculus
aaaaccacaaactgccagtcaggga

SEQ ID NO: 1309 - DNA, 25 bp, Mus musculus
aaaaccacaataattacctcttgat

SEQ ID NO: 1310 - DNA, 25 bp, Mus musculus
aaaaccacaatatttacctcttgat

SEQ ID NO: 1311 - DNA, 25 bp, Mus musculus
aaaaccacaatgagaaggtgacaga

SEQ ID NO: 1312 - DNA, 25 bp, Mus musculus
aaaaccacaatgcatatcctattaa

SEQ ID NO: 1313 - DNA, 25 bp, Mus musculus
aaaaccacaatgctggacccattcc

SEQ ID NO: 1314 - DNA, 25 bp, Mus musculus
aaaaccacaatggatatcctattaa

SEQ ID NO: 1315 - DNA, 25 bp, Mus musculus
aaaaccacaatggtggacccattcc

SEQ ID NO: 1316 - DNA, 25 bp, Mus musculus
aaaaccacaatgtgaaggtgacaga

SEQ ID NO: 1317 - DNA, 25 bp, Mus musculus
aaaaccacaccacatgtcatctttg

SEQ ID NO: 1318 - DNA, 25 bp, Mus musculus
aaaaccacaccagatgtcatctttg

SEQ ID NO: 1319 - DNA, 25 bp, Mus musculus
aaaaccacacttaccaatcgagaag

SEQ ID NO: 1320 - DNA, 25 bp, Mus musculus
aaaaccacacttcatgggctagaga

SEQ ID NO: 1321 - DNA, 25 bp, Mus musculus
aaaaccacacttgatgggctagaga

SEQ ID NO: 1322 - DNA, 25 bp, Mus musculus
aaaaccacactttccaatcgagaag

SEQ ID NO: 1323 - DNA, 25 bp, Mus musculus
aaaaccacaggtctgtcgaggcaga

SEQ ID NO: 1324 - DNA, 25 bp, Mus musculus
aaaaccacaggtgtgtcgaggcaga

SEQ ID NO: 1325 - DNA, 25 bp, Mus musculus
aaaaccaccagacctctcattctgt

SEQ ID NO: 1326 - DNA, 25 bp, Mus musculus
aaaaccaccagagctctcattctgt

SEQ ID NO: 1327 - DNA, 25 bp, Mus musculus
aaaaccaccatgattcgtgccagta

SEQ ID NO: 1328 - DNA, 25 bp, Mus musculus
aaaaccaccatgtttcgtgccagta

SEQ ID NO: 1329 - DNA, 25 bp, Mus musculus
aaaaccaccttcaagcagctcagaa

SEQ ID NO: 1330 - DNA, 25 bp, Mus musculus
aaaaccaccttctagcagctcagaa

SEQ ID NO: 1331 - DNA, 25 bp, Mus musculus
aaaaccaccttgatggcgctgaaat

SEQ ID NO: 1332 - DNA, 25 bp, Mus musculus
aaaaccaccttgttggcgctgaaat

SEQ ID NO: 1333 - DNA, 25 bp, Mus musculus
aaaaccacgttaaagcttactgctg

SEQ ID NO: 1334 - DNA, 25 bp, Mus musculus
aaaaccacgttatagcttactgctg

SEQ ID NO: 1335 - DNA, 25 bp, Mus musculus
aaaaccactcgtctttctcttgtga

SEQ ID NO: 1336 - DNA, 25 bp, Mus musculus
aaaaccactcgtgtttctcttgtga

SEQ ID NO: 1337 - DNA, 25 bp, Mus musculus
aaaaccactctcatctgcagaaagc

SEQ ID NO: 1338 - DNA, 25 bp, Mus musculus
aaaaccactctcttctgcagaaagc

SEQ ID NO: 1339 - DNA, 25 bp, Mus musculus
aaaaccactctgacagcatgcaaga

SEQ ID NO: 1340 - DNA, 25 bp, Mus musculus
aaaaccactctgtcagcatgcaaga

SEQ ID NO: 1341 - DNA, 25 bp, Mus musculus
aaaaccactgtgacgaacaagaatt

SEQ ID NO: 1342 - DNA, 25 bp, Mus musculus
aaaaccactgtgtcgaacaagaatt

SEQ ID NO: 1343 - DNA, 25 bp, Mus musculus
aaaaccagaagcaattcctccctga

SEQ ID NO: 1344 - DNA, 25 bp, Mus musculus
aaaaccagaagctattcctccctga

SEQ ID NO: 1345 - DNA, 25 bp, Mus musculus
aaaaccagacccacattggaacagt

SEQ ID NO: 1346 - DNA, 25 bp, Mus musculus
aaaaccagaccctcattggaacagt

SEQ ID NO: 1347 - DNA, 25 bp, Mus musculus
aaaaccagactcagtggaaaagcaa

SEQ ID NO: 1348 - DNA, 25 bp, Mus musculus
aaaaccagactctgtggaaaagcaa

SEQ ID NO: 1349 - DNA, 25 bp, Mus musculus
aaaaccagagatctgaccttcccca

SEQ ID NO: 1350 - DNA, 25 bp, Mus musculus
aaaaccagagatgtgaccttcccca

SEQ ID NO: 1351 - DNA, 25 bp, Mus musculus
aaaaccagatttcaggctgtgtgat

SEQ ID NO: 1352 - DNA, 25 bp, Mus musculus
aaaaccagatttccatgggccaaat

SEQ ID NO: 1353 - DNA, 25 bp, Mus musculus
aaaaccagatttgaggctgtgtgat

SEQ ID NO: 1354 - DNA, 25 bp, Mus musculus
aaaaccagatttgcatgggccaaat

SEQ ID NO: 1355 - DNA, 25 bp, Mus musculus
aaaaccagcaagaagcctgtgccaa

SEQ ID NO: 1356 - DNA, 25 bp, Mus musculus
aaaaccagcaagtagcctgtgccaa

SEQ ID NO: 1357 - DNA, 25 bp, Mus musculus
aaaaccagccctatgtcaggacaca

SEQ ID NO: 1358 - DNA, 25 bp, Mus musculus
aaaaccagccctttgtcaggacaca

SEQ ID NO: 1359 - DNA, 25 bp, Mus musculus
aaaaccagctccaaggtcacatttt

SEQ ID NO: 1360 - DNA, 25 bp, Mus musculus
aaaaccagctcctaggtcacatttt

SEQ ID NO: 1361 - DNA, 25 bp, Mus musculus
aaaaccagctttcagatccgtcttt

SEQ ID NO: 1362 - DNA, 25 bp, Mus musculus
aaaaccagctttgagatccgtcttt

SEQ ID NO: 1363 - DNA, 25 bp, Mus musculus
aaaaccaggcctataccgagctgca

SEQ ID NO: 1364 - DNA, 25 bp, Mus musculus
aaaaccaggcctttaccgagctgca

SEQ ID NO: 1365 - DNA, 25 bp, Mus musculus
aaaaccagtcagaacactcacctac

SEQ ID NO: 1366 - DNA, 25 bp, Mus musculus
aaaaccagtcagtacactcacctac

SEQ ID NO: 1367 - DNA, 25 bp, Mus musculus
aaaaccagtgacacatacgtgttga

SEQ ID NO: 1368 - DNA, 25 bp, Mus musculus
aaaaccagtgactcatacgtgttga

SEQ ID NO: 1369 - DNA, 25 bp, Mus musculus
aaaaccagtgttcgccttatatata

SEQ ID NO: 1370 - DNA, 25 bp, Mus musculus
aaaaccagtgttggccttatatata

SEQ ID NO: 1371 - DNA, 25 bp, Mus musculus
aaaaccagttttacaggatgcatag

SEQ ID NO: 1372 - DNA, 25 bp, Mus musculus
aaaaccagtttttcaggatgcatag

SEQ ID NO: 1373 - DNA, 25 bp, Mus musculus
aaaaccataaacaaatccatgctat

SEQ ID NO: 1374 - DNA, 25 bp, Mus musculus
aaaaccataaactaatccatgctat

SEQ ID NO: 1375 - DNA, 25 bp, Mus musculus
aaaaccatacctatcatttgatagt

SEQ ID NO: 1376 - DNA, 25 bp, Mus musculus
aaaaccatacctttcatttgatagt

SEQ ID NO: 1377 - DNA, 25 bp, Mus musculus
aaaaccatcgagcaaacaccttgag

SEQ ID NO: 1378 - DNA, 25 bp, Mus musculus
aaaaccatcgaggaaacaccttgag

SEQ ID NO: 1379 - DNA, 25 bp, Mus musculus
aaaaccatctctatagagctgcctt

SEQ ID NO: 1380 - DNA, 25 bp, Mus musculus
aaaaccatctctcgaagtgcttctg

SEQ ID NO: 1381 - DNA, 25 bp, Mus musculus
aaaaccatctctggaagtgcttctg

SEQ ID NO: 1382 - DNA, 25 bp, Mus musculus
aaaaccatctctttagagctgcctt

SEQ ID NO: 1383 - DNA, 25 bp, Mus musculus
aaaaccatcttcagcaaactccaat

SEQ ID NO: 1384 - DNA, 25 bp, Mus musculus
aaaaccatcttctgcaaactccaat

SEQ ID NO: 1385 - DNA, 25 bp, Mus musculus
aaaaccatcttgatcatctctctga

SEQ ID NO: 1386 - DNA, 25 bp, Mus musculus
aaaaccatcttgttcatctctctga

SEQ ID NO: 1387 - DNA, 25 bp, Mus musculus
aaaaccatgcatccacagatccctg

SEQ ID NO: 1388 - DNA, 25 bp, Mus musculus
aaaaccatgcatgcacagatccctg

SEQ ID NO: 1389 - DNA, 25 bp, Mus musculus
aaaaccatgccaatttctggaactt

SEQ ID NO: 1390 - DNA, 25 bp, Mus musculus
aaaaccatgccattttctggaactt

SEQ ID NO: 1391 - DNA, 25 bp, Mus musculus
aaaaccatgttaatagagctgaagt

SEQ ID NO: 1392 - DNA, 25 bp, Mus musculus
aaaaccatgttattagagctgaagt

SEQ ID NO: 1393 - DNA, 25 bp, Mus musculus
aaaaccattatcattttctccaagt

SEQ ID NO: 1394 - DNA, 25 bp, Mus musculus
aaaaccattatctttttctccaagt

SEQ ID NO: 1395 - DNA, 25 bp, Mus musculus
aaaaccattcttactcttcagtctg

SEQ ID NO: 1396 - DNA, 25 bp, Mus musculus
aaaaccattctttctcttcagtctg

SEQ ID NO: 1397 - DNA, 25 bp, Mus musculus
aaaaccatttgactgccaggagtgt

SEQ ID NO: 1398 - DNA, 25 bp, Mus musculus
aaaaccatttgagtgccaggagtgt

SEQ ID NO: 1399 - DNA, 25 bp, Mus musculus
aaaaccatttggctacttgtattct

SEQ ID NO: 1400 - DNA, 25 bp, Mus musculus
aaaaccatttgggtacttgtattct

SEQ ID NO: 1401 - DNA, 25 bp, Mus musculus
aaaaccatttgtcgcctgtatgtgt

SEQ ID NO: 1402 - DNA, 25 bp, Mus musculus
aaaaccatttgtggcctgtatgtgt

SEQ ID NO: 1403 - DNA, 25 bp, Mus musculus
aaaaccattttactgtgttcaacat

SEQ ID NO: 1404 - DNA, 25 bp, Mus musculus
aaaaccattttagtgtgttcaacat

SEQ ID NO: 1405 - DNA, 25 bp, Mus musculus
aaaacccaaagtctctgagagtctg

SEQ ID NO: 1406 - DNA, 25 bp, Mus musculus
aaaacccaaagtgtctgagagtctg

SEQ ID NO: 1407 - DNA, 25 bp, Mus musculus
aaaacccaactaaacactgtaccag

SEQ ID NO: 1408 - DNA, 25 bp, Mus musculus
aaaacccaactatacactgtaccag

SEQ ID NO: 1409 - DNA, 25 bp, Mus musculus
aaaacccaacttccacttggaacag

SEQ ID NO: 1410 - DNA, 25 bp, Mus musculus
aaaacccaacttgcacttggaacag

SEQ ID NO: 1411 - DNA, 25 bp, Mus musculus
aaaacccaagcccttgtctggatat

SEQ ID NO: 1412 - DNA, 25 bp, Mus musculus
aaaacccaagccgttgtctggatat

SEQ ID NO: 1413 - DNA, 25 bp, Mus musculus
aaaacccaaggtcattcagatgtga

SEQ ID NO: 1414 - DNA, 25 bp, Mus musculus
aaaacccaaggtgattcagatgtga

SEQ ID NO: 1415 - DNA, 25 bp, Mus musculus
aaaacccaatggacttgtcaaccat

SEQ ID NO: 1416 - DNA, 25 bp, Mus musculus
aaaacccaatggtcttgtcaaccat

SEQ ID NO: 1417 - DNA, 25 bp, Mus musculus
aaaacccacagaactgcaagcgcta

SEQ ID NO: 1418 - DNA, 25 bp, Mus musculus
aaaacccacagatctgcaagcgcta

SEQ ID NO: 1419 - DNA, 25 bp, Mus musculus
aaaacccaccataacttgtggcaga

SEQ ID NO: 1420 - DNA, 25 bp, Mus musculus
aaaacccaccattacttgtggcaga

SEQ ID NO: 1421 - DNA, 25 bp, Mus musculus
aaaacccactccagagacagtgagc

SEQ ID NO: 1422 - DNA, 25 bp, Mus musculus
aaaacccactcctgagacagtgagc

SEQ ID NO: 1423 - DNA, 25 bp, Mus musculus
aaaacccacttcaagcaaggctagt

SEQ ID NO: 1424 - DNA, 25 bp, Mus musculus
aaaacccacttctagcaaggctagt

SEQ ID NO: 1425 - DNA, 25 bp, Mus musculus
aaaacccacttgcatctttaagaag

SEQ ID NO: 1426 - DNA, 25 bp, Mus musculus
aaaacccacttggatctttaagaag

SEQ ID NO: 1427 - DNA, 25 bp, Mus musculus
aaaacccagaaaaaccagccacact

SEQ ID NO: 1428 - DNA, 25 bp, Mus musculus
aaaacccagaaataccagccacact

SEQ ID NO: 1429 - DNA, 25 bp, Mus musculus
aaaacccagaacaagcgtggtctct

SEQ ID NO: 1430 - DNA, 25 bp, Mus musculus
aaaacccagaaccatgagaccccag

SEQ ID NO: 1431 - DNA, 25 bp, Mus musculus
aaaacccagaacgatgagaccccag

SEQ ID NO: 1432 - DNA, 25 bp, Mus musculus
aaaacccagaactagcgtggtctct

SEQ ID NO: 1433 - DNA, 25 bp, Mus musculus
aaaacccagagcctataggcctgaa

SEQ ID NO: 1434 - DNA, 25 bp, Mus musculus
aaaacccagagcgtataggcctgaa

SEQ ID NO: 1435 - DNA, 25 bp, Mus musculus
aaaacccagagtaaacatccgatgc

SEQ ID NO: 1436 - DNA, 25 bp, Mus musculus
aaaacccagagttaacatccgatgc

SEQ ID NO: 1437 - DNA, 25 bp, Mus musculus
aaaacccagatgatctgcagcagat

SEQ ID NO: 1438 - DNA, 25 bp, Mus musculus
aaaacccagatgttctgcagcagat

SEQ ID NO: 1439 - DNA, 25 bp, Mus musculus
aaaacccagattatcagtactgcac

SEQ ID NO: 1440 - DNA, 25 bp, Mus musculus
aaaacccagattttcagtactgcac

SEQ ID NO: 1441 - DNA, 25 bp, Mus musculus
aaaacccagcaaacctgtctgtagt

SEQ ID NO: 1442 - DNA, 25 bp, Mus musculus
aaaacccagcaatcctgtctgtagt

SEQ ID NO: 1443 - DNA, 25 bp, Mus musculus
aaaacccagcttacatcctttgtat

SEQ ID NO: 1444 - DNA, 25 bp, Mus musculus
aaaacccagctttcatcctttgtat

SEQ ID NO: 1445 - DNA, 25 bp, Mus musculus
aaaacccaggataatccagtggata

SEQ ID NO: 1446 - DNA, 25 bp, Mus musculus
aaaacccaggattatccagtggata

SEQ ID NO: 1447 - DNA, 25 bp, Mus musculus
aaaacccaggcacatttgtagttga

SEQ ID NO: 1448 - DNA, 25 bp, Mus musculus
aaaacccaggcagatttgtagttga

SEQ ID NO: 1449 - DNA, 25 bp, Mus musculus
aaaacccagtgaagtgatttcaggg

SEQ ID NO: 1450 - DNA, 25 bp, Mus musculus
aaaacccagtgatgtgatttcaggg

SEQ ID NO: 1451 - DNA, 25 bp, Mus musculus
aaaacccatgctattctagttagtg

SEQ ID NO: 1452 - DNA, 25 bp, Mus musculus
aaaacccatgcttttctagttagtg

SEQ ID NO: 1453 - DNA, 25 bp, Mus musculus
aaaacccattatattcctggatgag

SEQ ID NO: 1454 - DNA, 25 bp, Mus musculus
aaaacccattattttcctggatgag

SEQ ID NO: 1455 - DNA, 25 bp, Mus musculus
aaaaccccacagatctccaaatgag

SEQ ID NO: 1456 - DNA, 25 bp, Mus musculus
aaaaccccacagttctccaaatgag

SEQ ID NO: 1457 - DNA, 25 bp, Mus musculus
aaaaccccactgaggagagacggct

SEQ ID NO: 1458 - DNA, 25 bp, Mus musculus
aaaaccccactgtggagagacggct

SEQ ID NO: 1459 - DNA, 25 bp, Mus musculus
aaaaccccaggaccagaagctgatg

SEQ ID NO: 1460 - DNA, 25 bp, Mus musculus
aaaaccccaggagcagaagctgatg

SEQ ID NO: 1461 - DNA, 25 bp, Mus musculus
aaaacccctcatacagctagagctt

SEQ ID NO: 1462 - DNA, 25 bp, Mus musculus
aaaacccctcattcagctagagctt

SEQ ID NO: 1463 - DNA, 25 bp, Mus musculus
aaaacccctgagagacacactgtct

SEQ ID NO: 1464 - DNA, 25 bp, Mus musculus
aaaacccctgagtgacacactgtct

SEQ ID NO: 1465 - DNA, 25 bp, Mus musculus
aaaacccctggacctttgagcacat

SEQ ID NO: 1466 - DNA, 25 bp, Mus musculus
aaaacccctggagctttgagcacat

SEQ ID NO: 1467 - DNA, 25 bp, Mus musculus
aaaacccgaaaaccagcgctcattg

SEQ ID NO: 1468 - DNA, 25 bp, Mus musculus
aaaacccgaaaagcagcgctcattg

SEQ ID NO: 1469 - DNA, 25 bp, Mus musculus
aaaacccgagatacggctgctgatc

SEQ ID NO: 1470 - DNA, 25 bp, Mus musculus
aaaacccgagattcggctgctgatc

SEQ ID NO: 1471 - DNA, 25 bp, Mus musculus
aaaacccgcctgcattttcctgaat

SEQ ID NO: 1472 - DNA, 25 bp, Mus musculus
aaaacccgcctggattttcctgaat

SEQ ID NO: 1473 - DNA, 25 bp, Mus musculus
aaaacccgcggacaaggctgccatg

SEQ ID NO: 1474 - DNA, 25 bp, Mus musculus
aaaacccgcggagaaggctgccatg

SEQ ID NO: 1475 - DNA, 25 bp, Mus musculus
aaaacccggataatgcagtgaatgt

SEQ ID NO: 1476 - DNA, 25 bp, Mus musculus
aaaacccggatattgcagtgaatgt

SEQ ID NO: 1477 - DNA, 25 bp, Mus musculus
aaaacccgtatacctttcagtcaga

SEQ ID NO: 1478 - DNA, 25 bp, Mus musculus
aaaacccgtatagctttcagtcaga

SEQ ID NO: 1479 - DNA, 25 bp, Mus musculus
aaaaccctaaccacatttcatgtgt

SEQ ID NO: 1480 - DNA, 25 bp, Mus musculus
aaaaccctaacctcatttcatgtgt

SEQ ID NO: 1481 - DNA, 25 bp, Mus musculus
aaaaccctaagtccttgcatggtga

SEQ ID NO: 1482 - DNA, 25 bp, Mus musculus
aaaaccctaagtgcttgcatggtga

SEQ ID NO: 1483 - DNA, 25 bp, Mus musculus
aaaaccctatgtcttgacctgcagc

SEQ ID NO: 1484 - DNA, 25 bp, Mus musculus
aaaaccctatgtgttgacctgcagc

SEQ ID NO: 1485 - DNA, 25 bp, Mus musculus
aaaaccctcaatccagtcttcaatg

SEQ ID NO: 1486 - DNA, 25 bp, Mus musculus
aaaaccctcaatgcagtcttcaatg

SEQ ID NO: 1487 - DNA, 25 bp, Mus musculus
aaaaccctccagatttagacagaca

SEQ ID NO: 1488 - DNA, 25 bp, Mus musculus
aaaaccctccagttttagacagaca

SEQ ID NO: 1489 - DNA, 25 bp, Mus musculus
aaaaccctcctaatgaacacagctt

SEQ ID NO: 1490 - DNA, 25 bp, Mus musculus
aaaaccctcctattgaacacagctt

SEQ ID NO: 1491 - DNA, 25 bp, Mus musculus
aaaaccctcctgcaggaaggaacag

SEQ ID NO: 1492 - DNA, 25 bp, Mus musculus
aaaaccctcctggaggaaggaacag

SEQ ID NO: 1493 - DNA, 25 bp, Mus musculus
aaaaccctcgggacgctgaagagtg

SEQ ID NO: 1494 - DNA, 25 bp, Mus musculus
aaaaccctcgggtcgctgaagagtg

SEQ ID NO: 1495 - DNA, 25 bp, Mus musculus
aaaaccctctgtaccttcaagagca

SEQ ID NO: 1496 - DNA, 25 bp, Mus musculus
aaaaccctctgttccttcaagagca

SEQ ID NO: 1497 - DNA, 25 bp, Mus musculus
aaaaccctgaccactagatgtcgct

SEQ ID NO: 1498 - DNA, 25 bp, Mus musculus
aaaaccctgacctctagatgtcgct

SEQ ID NO: 1499 - DNA, 25 bp, Mus musculus
aaaaccctgactagctcttatcttg

SEQ ID NO: 1500 - DNA, 25 bp, Mus musculus
aaaaccctgacttgctcttatcttg

SEQ ID NO: 1501 - DNA, 25 bp, Mus musculus
aaaaccctgattctggtctctactc

SEQ ID NO: 1502 - DNA, 25 bp, Mus musculus
aaaaccctgattgtggtctctactc

SEQ ID NO: 1503 - DNA, 25 bp, Mus musculus
aaaaccctgcttaataagctgctgg

SEQ ID NO: 1504 - DNA, 25 bp, Mus musculus
aaaaccctgctttataagctgctgg

SEQ ID NO: 1505 - DNA, 25 bp, Mus musculus
aaaaccctgtctagtgtgtgtgcgt

SEQ ID NO: 1506 - DNA, 25 bp, Mus musculus
aaaaccctgtcttgtgtgtgtgcgt

SEQ ID NO: 1507 - DNA, 25 bp, Mus musculus
aaaacccttcaacccagatcttctg

SEQ ID NO: 1508 - DNA, 25 bp, Mus musculus
aaaacccttcaagccagatcttctg

SEQ ID NO: 1509 - DNA, 25 bp, Mus musculus
aaaacccttctcatattgatgactt

SEQ ID NO: 1510 - DNA, 25 bp, Mus musculus
aaaacccttctcttattgatgactt

SEQ ID NO: 1511 - DNA, 25 bp, Mus musculus
aaaaccctttggatgctaagctcgt

SEQ ID NO: 1512 - DNA, 25 bp, Mus musculus
aaaaccctttggttgctaagctcgt

SEQ ID NO: 1513 - DNA, 25 bp, Mus musculus
aaaaccgaagccaggcgcgatggat

SEQ ID NO: 1514 - DNA, 25 bp, Mus musculus
aaaaccgaagcctggcgcgatggat

SEQ ID NO: 1515 - DNA, 25 bp, Mus musculus
aaaaccgaatgtcccaacactaatg

SEQ ID NO: 1516 - DNA, 25 bp, Mus musculus
aaaaccgaatgtgccaacactaatg

SEQ ID NO: 1517 - DNA, 25 bp, Mus musculus
aaaaccgatcctcggccacaatagc

SEQ ID NO: 1518 - DNA, 25 bp, Mus musculus
aaaaccgatcctgggccacaatagc

SEQ ID NO: 1519 - DNA, 25 bp, Mus musculus
aaaaccgatttcagaggcatcttgc

SEQ ID NO: 1520 - DNA, 25 bp, Mus musculus
aaaaccgatttctgaggcatcttgc

SEQ ID NO: 1521 - DNA, 25 bp, Mus musculus
aaaaccgcatttcgcatttctttgg

SEQ ID NO: 1522 - DNA, 25 bp, Mus musculus
aaaaccgcatttggcatttctttgg

SEQ ID NO: 1523 - DNA, 25 bp, Mus musculus
aaaaccgccgacattataaacacag

SEQ ID NO: 1524 - DNA, 25 bp, Mus musculus
aaaaccgccgactttataaacacag

SEQ ID NO: 1525 - DNA, 25 bp, Mus musculus
aaaaccgctattagtgtcctttgtg

SEQ ID NO: 1526 - DNA, 25 bp, Mus musculus
aaaaccgctatttgtgtcctttgtg

SEQ ID NO: 1527 - DNA, 25 bp, Mus musculus
aaaaccggaaggcacctgaggactg

SEQ ID NO: 1528 - DNA, 25 bp, Mus musculus
aaaaccggaagggacctgaggactg

SEQ ID NO: 1529 - DNA, 25 bp, Mus musculus
aaaaccggagcacgctaacacccag

SEQ ID NO: 1530 - DNA, 25 bp, Mus musculus
aaaaccggagcaggctaacacccag

SEQ ID NO: 1531 - DNA, 25 bp, Mus musculus
aaaaccgggcaaaaaatgctacagc

SEQ ID NO: 1532 - DNA, 25 bp, Mus musculus
aaaaccgggcaataaatgctacagc

SEQ ID NO: 1533 - DNA, 25 bp, Mus musculus
aaaaccgtaccaataattccagctg

SEQ ID NO: 1534 - DNA, 25 bp, Mus musculus
aaaaccgtaccattaattccagctg

SEQ ID NO: 1535 - DNA, 25 bp, Mus musculus
aaaaccgtatctaagcatgcgaatc

SEQ ID NO: 1536 - DNA, 25 bp, Mus musculus
aaaaccgtatcttagcatgcgaatc

SEQ ID NO: 1537 - DNA, 25 bp, Mus musculus
aaaaccgtgctactgtggcttgtgc

SEQ ID NO: 1538 - DNA, 25 bp, Mus musculus
aaaaccgtgctagtgtggcttgtgc

SEQ ID NO: 1539 - DNA, 25 bp, Mus musculus
aaaaccgtgtatccgctgtagggcg

SEQ ID NO: 1540 - DNA, 25 bp, Mus musculus
aaaaccgtgtatgcgctgtagggcg

SEQ ID NO: 1541 - DNA, 25 bp, Mus musculus
aaaaccgtgtcaagctggacgatga

SEQ ID NO: 1542 - DNA, 25 bp, Mus musculus
aaaaccgtgtcatgctggacgatga

SEQ ID NO: 1543 - DNA, 25 bp, Mus musculus
aaaaccgtgtggcagagaagcagaa

SEQ ID NO: 1544 - DNA, 25 bp, Mus musculus
aaaaccgtgtgggagagaagcagaa

SEQ ID NO: 1545 - DNA, 25 bp, Mus musculus
aaaacctaacgacgaggagcgagag

SEQ ID NO: 1546 - DNA, 25 bp, Mus musculus
aaaacctaacgaggaggagcgagag

SEQ ID NO: 1547 - DNA, 25 bp, Mus musculus
aaaacctacaccacagggcacttgg

SEQ ID NO: 1548 - DNA, 25 bp, Mus musculus
aaaacctacacctcagggcacttgg

SEQ ID NO: 1549 - DNA, 25 bp, Mus musculus
aaaacctacattctagacaatctag

SEQ ID NO: 1550 - DNA, 25 bp, Mus musculus
aaaacctacattgtagacaatctag

SEQ ID NO: 1551 - DNA, 25 bp, Mus musculus
aaaacctactgaccacaatctagtg

SEQ ID NO: 1552 - DNA, 25 bp, Mus musculus
aaaacctactgagcacaatctagtg

SEQ ID NO: 1553 - DNA, 25 bp, Mus musculus
aaaacctagcaaccagacccaagag

SEQ ID NO: 1554 - DNA, 25 bp, Mus musculus
aaaacctagcaagcagacccaagag

SEQ ID NO: 1555 - DNA, 25 bp, Mus musculus
aaaacctagctgcaactgaaagcag

SEQ ID NO: 1556 - DNA, 25 bp, Mus musculus
aaaacctagctggaactgaaagcag

SEQ ID NO: 1557 - DNA, 25 bp, Mus musculus
aaaacctaggcgaatcctgcgctca

SEQ ID NO: 1558 - DNA, 25 bp, Mus musculus
aaaacctaggcgtatcctgcgctca

SEQ ID NO: 1559 - DNA, 25 bp, Mus musculus
aaaacctaggctcaccgggagcact

SEQ ID NO: 1560 - DNA, 25 bp, Mus musculus
aaaacctaggctgaccgggagcact

SEQ ID NO: 1561 - DNA, 25 bp, Mus musculus
aaaacctagtgacaattccagacca

SEQ ID NO: 1562 - DNA, 25 bp, Mus musculus
aaaacctagtgagaattccagacca

SEQ ID NO: 1563 - DNA, 25 bp, Mus musculus
aaaacctatcaacagctcatctggg

SEQ ID NO: 1564 - DNA, 25 bp, Mus musculus
aaaacctatcaagagctcatctggg

SEQ ID NO: 1565 - DNA, 25 bp, Mus musculus
aaaacctatcaccaagcccacaaag

SEQ ID NO: 1566 - DNA, 25 bp, Mus musculus
aaaacctatcacgaagcccacaaag

SEQ ID NO: 1567 - DNA, 25 bp, Mus musculus
aaaacctatcctcaactatctagat

SEQ ID NO: 1568 - DNA, 25 bp, Mus musculus
aaaacctatcctgaactatctagat

SEQ ID NO: 1569 - DNA, 25 bp, Mus musculus
aaaacctattatcagcccatccatc

SEQ ID NO: 1570 - DNA, 25 bp, Mus musculus
aaaacctattatgagcccatccatc

SEQ ID NO: 1571 - DNA, 25 bp, Mus musculus
aaaacctcaaatctatcttctacat

SEQ ID NO: 1572 - DNA, 25 bp, Mus musculus
aaaacctcaaatgtatcttctacat

SEQ ID NO: 1573 - DNA, 25 bp, Mus musculus
aaaacctcaacaacagaaagcctgt

SEQ ID NO: 1574 - DNA, 25 bp, Mus musculus
aaaacctcaacatcagaaagcctgt

SEQ ID NO: 1575 - DNA, 25 bp, Mus musculus
aaaacctcaatcagccacttaactt

SEQ ID NO: 1576 - DNA, 25 bp, Mus musculus
aaaacctcaatctgccacttaactt

SEQ ID NO: 1577 - DNA, 25 bp, Mus musculus
aaaacctcagcccaggttctgattc

SEQ ID NO: 1578 - DNA, 25 bp, Mus musculus
aaaacctcagccgaggttctgattc

SEQ ID NO: 1579 - DNA, 25 bp, Mus musculus
aaaacctcaggcaggctaccaccga

SEQ ID NO: 1580 - DNA, 25 bp, Mus musculus
aaaacctcaggctggctaccaccga

SEQ ID NO: 1581 - DNA, 25 bp, Mus musculus
aaaacctcatgtacagtgactgctg

SEQ ID NO: 1582 - DNA, 25 bp, Mus musculus
aaaacctcatgttcagtgactgctg

SEQ ID NO: 1583 - DNA, 25 bp, Mus musculus
aaaacctccactctttagctttctg

SEQ ID NO: 1584 - DNA, 25 bp, Mus musculus
aaaacctccactgtttagctttctg

SEQ ID NO: 1585 - DNA, 25 bp, Mus musculus
aaaacctcctggcatctgatggtga

SEQ ID NO: 1586 - DNA, 25 bp, Mus musculus
aaaacctcctgggatctgatggtga

SEQ ID NO: 1587 - DNA, 25 bp, Mus musculus
aaaacctcgtgcatttcgaccaatg

SEQ ID NO: 1588 - DNA, 25 bp, Mus musculus
aaaacctcgtgcttttcgaccaatg

SEQ ID NO: 1589 - DNA, 25 bp, Mus musculus
aaaacctctcccaatacatctgtgt

SEQ ID NO: 1590 - DNA, 25 bp, Mus musculus
aaaacctctccctatacatctgtgt

SEQ ID NO: 1591 - DNA, 25 bp, Mus musculus
aaaacctctgacatgatcaaataca

SEQ ID NO: 1592 - DNA, 25 bp, Mus musculus
aaaacctctgacttgatcaaataca

SEQ ID NO: 1593 - DNA, 25 bp, Mus musculus
aaaacctctgccatatgaaagccat

SEQ ID NO: 1594 - DNA, 25 bp, Mus musculus
aaaacctctgcccttaaccatgtga

SEQ ID NO: 1595 - DNA, 25 bp, Mus musculus
aaaacctctgccgttaaccatgtga

SEQ ID NO: 1596 - DNA, 25 bp, Mus musculus
aaaacctctgccttatgaaagccat

SEQ ID NO: 1597 - DNA, 25 bp, Mus musculus
aaaacctctggaagccgcgattgaa

SEQ ID NO: 1598 - DNA, 25 bp, Mus musculus
aaaacctctggatgccgcgattgaa

SEQ ID NO: 1599 - DNA, 25 bp, Mus musculus
aaaacctctgtcaacatagtcctag

SEQ ID NO: 1600 - DNA, 25 bp, Mus musculus
aaaacctctgtctacatagtcctag

SEQ ID NO: 1601 - DNA, 25 bp, Mus musculus
aaaacctctgttcgctacttagtat

SEQ ID NO: 1602 - DNA, 25 bp, Mus musculus
aaaacctctgttggctacttagtat

SEQ ID NO: 1603 - DNA, 25 bp, Mus musculus
aaaacctcttctacatgttcttcct

SEQ ID NO: 1604 - DNA, 25 bp, Mus musculus
aaaacctcttcttcatgttcttcct

SEQ ID NO: 1605 - DNA, 25 bp, Mus musculus
aaaacctgaagtagcattgccacaa

SEQ ID NO: 1606 - DNA, 25 bp, Mus musculus
aaaacctgaagttgcattgccacaa

SEQ ID NO: 1607 - DNA, 25 bp, Mus musculus
aaaacctgaccaaggaccagctagc

SEQ ID NO: 1608 - DNA, 25 bp, Mus musculus
aaaacctgaccaaggttctggcgtc

SEQ ID NO: 1609 - DNA, 25 bp, Mus musculus
aaaacctgaccatggaccagctagc

SEQ ID NO: 1610 - DNA, 25 bp, Mus musculus
aaaacctgaccatggttctggcgtc

SEQ ID NO: 1611 - DNA, 25 bp, Mus musculus
aaaacctgaggaccacacctgcaaa

SEQ ID NO: 1612 - DNA, 25 bp, Mus musculus
aaaacctgaggagcacacctgcaaa

SEQ ID NO: 1613 - DNA, 25 bp, Mus musculus
aaaacctgatataactgcctccggc

SEQ ID NO: 1614 - DNA, 25 bp, Mus musculus
aaaacctgatattactgcctccggc

SEQ ID NO: 1615 - DNA, 25 bp, Mus musculus
aaaacctgctagaaggtgaaataca

SEQ ID NO: 1616 - DNA, 25 bp, Mus musculus
aaaacctgctagtaggtgaaataca

SEQ ID NO: 1617 - DNA, 25 bp, Mus musculus
aaaacctgctatactctctgtgctt

SEQ ID NO: 1618 - DNA, 25 bp, Mus musculus
aaaacctgctattctctctgtgctt

SEQ ID NO: 1619 - DNA, 25 bp, Mus musculus
aaaacctgctgcacctaggcgtcct

SEQ ID NO: 1620 - DNA, 25 bp, Mus musculus
aaaacctgctgctcctaggcgtcct

SEQ ID NO: 1621 - DNA, 25 bp, Mus musculus
aaaacctgctggagttgtcgcgtgc

SEQ ID NO: 1622 - DNA, 25 bp, Mus musculus
aaaacctgctggtgttgtcgcgtgc

SEQ ID NO: 1623 - DNA, 25 bp, Mus musculus
aaaacctgctttcaacagcacacat

SEQ ID NO: 1624 - DNA, 25 bp, Mus musculus
aaaacctgctttgaacagcacacat

SEQ ID NO: 1625 - DNA, 25 bp, Mus musculus
aaaacctggaccctggaatcagcac

SEQ ID NO: 1626 - DNA, 25 bp, Mus musculus
aaaacctggaccgtggaatcagcac

SEQ ID NO: 1627 - DNA, 25 bp, Mus musculus
aaaacctggcagcttgttcattgtg

SEQ ID NO: 1628 - DNA, 25 bp, Mus musculus
aaaacctggcaggttgttcattgtg

SEQ ID NO: 1629 - DNA, 25 bp, Mus musculus
aaaacctggcgcatgtcctaagccg

SEQ ID NO: 1630 - DNA, 25 bp, Mus musculus
aaaacctggcgcttgtcctaagccg

SEQ ID NO: 1631 - DNA, 25 bp, Mus musculus
aaaacctgggctcttggcacccatg

SEQ ID NO: 1632 - DNA, 25 bp, Mus musculus
aaaacctgggctgttggcacccatg

SEQ ID NO: 1633 - DNA, 25 bp, Mus musculus
aaaacctgggtactctttgccatat

SEQ ID NO: 1634 - DNA, 25 bp, Mus musculus
aaaacctgggtagtctttgccatat

SEQ ID NO: 1635 - DNA, 25 bp, Mus musculus
aaaacctgggtgctattgccagtgg

SEQ ID NO: 1636 - DNA, 25 bp, Mus musculus
aaaacctgggtggtattgccagtgg

SEQ ID NO: 1637 - DNA, 25 bp, Mus musculus
aaaacctgggttacatatatgctaa

SEQ ID NO: 1638 - DNA, 25 bp, Mus musculus
aaaacctgggtttcatatatgctaa

SEQ ID NO: 1639 - DNA, 25 bp, Mus musculus
aaaacctggtccattggcctgttct

SEQ ID NO: 1640 - DNA, 25 bp, Mus musculus
aaaacctggtcctttggcctgttct

SEQ ID NO: 1641 - DNA, 25 bp, Mus musculus
aaaacctgtaggaagcacttgctct

SEQ ID NO: 1642 - DNA, 25 bp, Mus musculus
aaaacctgtaggtagcacttgctct

SEQ ID NO: 1643 - DNA, 25 bp, Mus musculus
aaaacctgtatcatcagtcttgttt

SEQ ID NO: 1644 - DNA, 25 bp, Mus musculus
aaaacctgtatcttcagtcttgttt

SEQ ID NO: 1645 - DNA, 25 bp, Mus musculus
aaaacctgtcctctgtggatgaagc

SEQ ID NO: 1646 - DNA, 25 bp, Mus musculus
aaaacctgtcctgtgtggatgaagc

SEQ ID NO: 1647 - DNA, 25 bp, Mus musculus
aaaacctgtctcagtgtgcgctggg

SEQ ID NO: 1648 - DNA, 25 bp, Mus musculus
aaaacctgtctctgtgtgcgctggg

SEQ ID NO: 1649 - DNA, 25 bp, Mus musculus
aaaacctgtgcaaatagtgtggaat

SEQ ID NO: 1650 - DNA, 25 bp, Mus musculus
aaaacctgtgcatatagtgtggaat

SEQ ID NO: 1651 - DNA, 25 bp, Mus musculus
aaaacctgttcactgtatcctcaat

SEQ ID NO: 1652 - DNA, 25 bp, Mus musculus
aaaacctgttcagtgtatcctcaat

SEQ ID NO: 1653 - DNA, 25 bp, Mus musculus
aaaacctgttcgagatgtagcctcc

SEQ ID NO: 1654 - DNA, 25 bp, Mus musculus
aaaacctgttcgtgatgtagcctcc

SEQ ID NO: 1655 - DNA, 25 bp, Mus musculus
aaaacctgtttcctgatccaattca

SEQ ID NO: 1656 - DNA, 25 bp, Mus musculus
aaaacctgtttcgtgatccaattca

SEQ ID NO: 1657 - DNA, 25 bp, Mus musculus
aaaaccttaattctagagccatgct

SEQ ID NO: 1658 - DNA, 25 bp, Mus musculus
aaaaccttaattgtagagccatgct

SEQ ID NO: 1659 - DNA, 25 bp, Mus musculus
aaaaccttcccgatggctgaatact

SEQ ID NO: 1660 - DNA, 25 bp, Mus musculus
aaaaccttcccgttggctgaatact

SEQ ID NO: 1661 - DNA, 25 bp, Mus musculus
aaaaccttccgccaatcatgcactt

SEQ ID NO: 1662 - DNA, 25 bp, Mus musculus
aaaaccttccgcgaatcatgcactt

SEQ ID NO: 1663 - DNA, 25 bp, Mus musculus
aaaaccttcgtcactttgtgctttg

SEQ ID NO: 1664 - DNA, 25 bp, Mus musculus
aaaaccttcgtctctttgtgctttg

SEQ ID NO: 1665 - DNA, 25 bp, Mus musculus
aaaaccttgcatattctgactcagg

SEQ ID NO: 1666 - DNA, 25 bp, Mus musculus
aaaaccttgcattttctgactcagg

SEQ ID NO: 1667 - DNA, 25 bp, Mus musculus
aaaaccttgctgaacagtgagctga

SEQ ID NO: 1668 - DNA, 25 bp, Mus musculus
aaaaccttgctgtacagtgagctga

SEQ ID NO: 1669 - DNA, 25 bp, Mus musculus
aaaaccttggtgcagatggatccga

SEQ ID NO: 1670 - DNA, 25 bp, Mus musculus
aaaaccttggtggagatggatccga

SEQ ID NO: 1671 - DNA, 25 bp, Mus musculus
aaaaccttgtccagattgcttaaca

SEQ ID NO: 1672 - DNA, 25 bp, Mus musculus
aaaaccttgtcctgattgcttaaca

SEQ ID NO: 1673 - DNA, 25 bp, Mus musculus
aaaaccttgttcagagcatgctgcc

SEQ ID NO: 1674 - DNA, 25 bp, Mus musculus
aaaaccttgttctgagcatgctgcc

SEQ ID NO: 1675 - DNA, 25 bp, Mus musculus
aaaacctttcccagagcatacagct

SEQ ID NO: 1676 - DNA, 25 bp, Mus musculus
aaaacctttccccatctgatcttat

SEQ ID NO: 1677 - DNA, 25 bp, Mus musculus
aaaacctttcccgatctgatcttat

SEQ ID NO: 1678 - DNA, 25 bp, Mus musculus
aaaacctttccctgagcatacagct

SEQ ID NO: 1679 - DNA, 25 bp, Mus musculus
aaaacctttcggctggctgtggctg

SEQ ID NO: 1680 - DNA, 25 bp, Mus musculus
aaaacctttcgggtggctgtggctg

SEQ ID NO: 1681 - DNA, 25 bp, Mus musculus
aaaacctttctgactgatatcccct

SEQ ID NO: 1682 - DNA, 25 bp, Mus musculus
aaaacctttctgtctgatatcccct

SEQ ID NO: 1683 - DNA, 25 bp, Mus musculus
aaaacctttttgagatagggcatca

SEQ ID NO: 1684 - DNA, 25 bp, Mus musculus
aaaacctttttgtgatagggcatca

SEQ ID NO: 1685 - DNA, 25 bp, Mus musculus
aaaacgaaacatccctatgctcttc

SEQ ID NO: 1686 - DNA, 25 bp, Mus musculus
aaaacgaaacatgcctatgctcttc

SEQ ID NO: 1687 - DNA, 25 bp, Mus musculus
aaaacgaagaacagctccttcctgc

SEQ ID NO: 1688 - DNA, 25 bp, Mus musculus
aaaacgaagaactgctccttcctgc

SEQ ID NO: 1689 - DNA, 25 bp, Mus musculus
aaaacgaattccaggaggccctcag

SEQ ID NO: 1690 - DNA, 25 bp, Mus musculus
aaaacgaattcctggaggccctcag

SEQ ID NO: 1691 - DNA, 25 bp, Mus musculus
aaaacgaccctgaactgcagaggat

SEQ ID NO: 1692 - DNA, 25 bp, Mus musculus
aaaacgaccctgtactgcagaggat

SEQ ID NO: 1693 - DNA, 25 bp, Mus musculus
aaaacgacgttcagactctcttgag

SEQ ID NO: 1694 - DNA, 25 bp, Mus musculus
aaaacgacgttctgactctcttgag

SEQ ID NO: 1695 - DNA, 25 bp, Mus musculus
aaaacgactcttccaaccaagcaat

SEQ ID NO: 1696 - DNA, 25 bp, Mus musculus
aaaacgactcttgcaaccaagcaat

SEQ ID NO: 1697 - DNA, 25 bp, Mus musculus
aaaacgagatggagacaagctggtg

SEQ ID NO: 1698 - DNA, 25 bp, Mus musculus
aaaacgagatggtgacaagctggtg

SEQ ID NO: 1699 - DNA, 25 bp, Mus musculus
aaaacgagccagactcgggactctt

SEQ ID NO: 1700 - DNA, 25 bp, Mus musculus
aaaacgagccagtctcgggactctt

SEQ ID NO: 1701 - DNA, 25 bp, Mus musculus
aaaacgagcctcagctggcgaatgc

SEQ ID NO: 1702 - DNA, 25 bp, Mus musculus
aaaacgagcctctgctggcgaatgc

SEQ ID NO: 1703 - DNA, 25 bp, Mus musculus
aaaacgaggctcaggctatgcagaa

SEQ ID NO: 1704 - DNA, 25 bp, Mus musculus
aaaacgaggctctggctatgcagaa

SEQ ID NO: 1705 - DNA, 25 bp, Mus musculus
aaaacgattgccatgtctagtctct

SEQ ID NO: 1706 - DNA, 25 bp, Mus musculus
aaaacgattgccttgtctagtctct

SEQ ID NO: 1707 - DNA, 25 bp, Mus musculus
aaaacgcactacactaagccatctc

SEQ ID NO: 1708 - DNA, 25 bp, Mus musculus
aaaacgcactactctaagccatctc

SEQ ID NO: 1709 - DNA, 25 bp, Mus musculus
aaaacgcaggaaaggcgcggcctcg

SEQ ID NO: 1710 - DNA, 25 bp, Mus musculus
aaaacgcaggaatggcgcggcctcg

SEQ ID NO: 1711 - DNA, 25 bp, Mus musculus
aaaacgcagttaatagcacctgact

SEQ ID NO: 1712 - DNA, 25 bp, Mus musculus
aaaacgcagttattagcacctgact

SEQ ID NO: 1713 - DNA, 25 bp, Mus musculus
aaaacgcatgccagcatgggcctca

SEQ ID NO: 1714 - DNA, 25 bp, Mus musculus
aaaacgcatgcctgcatgggcctca

SEQ ID NO: 1715 - DNA, 25 bp, Mus musculus
aaaacgcccgacctatttgctctga

SEQ ID NO: 1716 - DNA, 25 bp, Mus musculus
aaaacgcccgacgtatttgctctga

SEQ ID NO: 1717 - DNA, 25 bp, Mus musculus
aaaacgccctgtagcggcaggaggt

SEQ ID NO: 1718 - DNA, 25 bp, Mus musculus
aaaacgccctgttgcggcaggaggt

SEQ ID NO: 1719 - DNA, 25 bp, Mus musculus
aaaacgcctcccaactatgatgtgt

SEQ ID NO: 1720 - DNA, 25 bp, Mus musculus
aaaacgcctccctactatgatgtgt

SEQ ID NO: 1721 - DNA, 25 bp, Mus musculus
aaaacgccttcacctttaattcaga

SEQ ID NO: 1722 - DNA, 25 bp, Mus musculus
aaaacgccttcagctttaattcaga

SEQ ID NO: 1723 - DNA, 25 bp, Mus musculus
aaaacgcgaaacactcatctgtctc

SEQ ID NO: 1724 - DNA, 25 bp, Mus musculus
aaaacgcgaaactctcatctgtctc

SEQ ID NO: 1725 - DNA, 25 bp, Mus musculus
aaaacgctatataacaccacatgtg

SEQ ID NO: 1726 - DNA, 25 bp, Mus musculus
aaaacgctatattacaccacatgtg

SEQ ID NO: 1727 - DNA, 25 bp, Mus musculus
aaaacgctccaaacctaagagttag

SEQ ID NO: 1728 - DNA, 25 bp, Mus musculus
aaaacgctccaatcctaagagttag

SEQ ID NO: 1729 - DNA, 25 bp, Mus musculus
aaaacgctccggagtgttctgcaga

SEQ ID NO: 1730 - DNA, 25 bp, Mus musculus
aaaacgctccggtgtgttctgcaga

SEQ ID NO: 1731 - DNA, 25 bp, Mus musculus
aaaacgctcctcctggtgcgcacgt

SEQ ID NO: 1732 - DNA, 25 bp, Mus musculus
aaaacgctcctcgtggtgcgcacgt

SEQ ID NO: 1733 - DNA, 25 bp, Mus musculus
aaaacgctgccacttgagaacgtct

SEQ ID NO: 1734 - DNA, 25 bp, Mus musculus
aaaacgctgccagttgagaacgtct

SEQ ID NO: 1735 - DNA, 25 bp, Mus musculus
aaaacgctgctaaatttgacttcca

SEQ ID NO: 1736 - DNA, 25 bp, Mus musculus
aaaacgctgctatatttgacttcca

SEQ ID NO: 1737 - DNA, 25 bp, Mus musculus
aaaacgctggagaacgtggtcctgg

SEQ ID NO: 1738 - DNA, 25 bp, Mus musculus
aaaacgctggagtacgtggtcctgg

SEQ ID NO: 1739 - DNA, 25 bp, Mus musculus
aaaacgctgtctaggcttacgtgca

SEQ ID NO: 1740 - DNA, 25 bp, Mus musculus
aaaacgctgtcttggcttacgtgca

SEQ ID NO: 1741 - DNA, 25 bp, Mus musculus
aaaacgcttaggctcttagcattat

SEQ ID NO: 1742 - DNA, 25 bp, Mus musculus
aaaacgcttagggtcttagcattat

SEQ ID NO: 1743 - DNA, 25 bp, Mus musculus
aaaacgcttggtcctgtcggtgaag

SEQ ID NO: 1744 - DNA, 25 bp, Mus musculus
aaaacgcttggtgctgtcggtgaag

SEQ ID NO: 1745 - DNA, 25 bp, Mus musculus
aaaacggagatgagccgagccccaa

SEQ ID NO: 1746 - DNA, 25 bp, Mus musculus
aaaacggagatgtgccgagccccaa

SEQ ID NO: 1747 - DNA, 25 bp, Mus musculus
aaaacggcaaagacgctgctctcca

SEQ ID NO: 1748 - DNA, 25 bp, Mus musculus
aaaacggcaaagtcgctgctctcca

SEQ ID NO: 1749 - DNA, 25 bp, Mus musculus
aaaacggcacttcacttggacactg

SEQ ID NO: 1750 - DNA, 25 bp, Mus musculus
aaaacggcacttgacttggacactg

SEQ ID NO: 1751 - DNA, 25 bp, Mus musculus
aaaacggcagtgatagcaaacagta

SEQ ID NO: 1752 - DNA, 25 bp, Mus musculus
aaaacggcagtgttagcaaacagta

SEQ ID NO: 1753 - DNA, 25 bp, Mus musculus
aaaacggccgagcttttcagcagtg

SEQ ID NO: 1754 - DNA, 25 bp, Mus musculus
aaaacggccgaggttttcagcagtg

SEQ ID NO: 1755 - DNA, 25 bp, Mus musculus
aaaacggcctttaatcctgatgtct

SEQ ID NO: 1756 - DNA, 25 bp, Mus musculus
aaaacggccttttatcctgatgtct

SEQ ID NO: 1757 - DNA, 25 bp, Mus musculus
aaaacggcgcatcggtggccttcga

SEQ ID NO: 1758 - DNA, 25 bp, Mus musculus
aaaacggcgcatgggtggccttcga

SEQ ID NO: 1759 - DNA, 25 bp, Mus musculus
aaaacggctctaaggttctattcaa

SEQ ID NO: 1760 - DNA, 25 bp, Mus musculus
aaaacggctctatggttctattcaa

SEQ ID NO: 1761 - DNA, 25 bp, Mus musculus
aaaacggcttctcggtagtgcagct

SEQ ID NO: 1762 - DNA, 25 bp, Mus musculus
aaaacggcttctgggtagtgcagct

SEQ ID NO: 1763 - DNA, 25 bp, Mus musculus
aaaacgggagacatctgccaccatt

SEQ ID NO: 1764 - DNA, 25 bp, Mus musculus
aaaacgggagacttctgccaccatt

SEQ ID NO: 1765 - DNA, 25 bp, Mus musculus
aaaacgggattgactctgtcctctg

SEQ ID NO: 1766 - DNA, 25 bp, Mus musculus
aaaacgggattgtctctgtcctctg

SEQ ID NO: 1767 - DNA, 25 bp, Mus musculus
aaaacgggcaagatcctctggaatg

SEQ ID NO: 1768 - DNA, 25 bp, Mus musculus
aaaacgggcaagttcctctggaatg

SEQ ID NO: 1769 - DNA, 25 bp, Mus musculus
aaaacgggctttcggatatggctca

SEQ ID NO: 1770 - DNA, 25 bp, Mus musculus
aaaacgggctttgggatatggctca

SEQ ID NO: 1771 - DNA, 25 bp, Mus musculus
aaaacgggttatagagcagcttggt

SEQ ID NO: 1772 - DNA, 25 bp, Mus musculus
aaaacgggttattgagcagcttggt

SEQ ID NO: 1773 - DNA, 25 bp, Mus musculus
aaaacggtgaagctactgacacaca

SEQ ID NO: 1774 - DNA, 25 bp, Mus musculus
aaaacggtgaaggtactgacacaca

SEQ ID NO: 1775 - DNA, 25 bp, Mus musculus
aaaacggtgcacatttgagaagaac

SEQ ID NO: 1776 - DNA, 25 bp, Mus musculus
aaaacggtgcacttttgagaagaac

SEQ ID NO: 1777 - DNA, 25 bp, Mus musculus
aaaacggtttgcaggcagacacgca

SEQ ID NO: 1778 - DNA, 25 bp, Mus musculus
aaaacggtttgctggcagacacgca

SEQ ID NO: 1779 - DNA, 25 bp, Mus musculus
aaaacgtactgcacgtccttatctg

SEQ ID NO: 1780 - DNA, 25 bp, Mus musculus
aaaacgtactgctcgtccttatctg

SEQ ID NO: 1781 - DNA, 25 bp, Mus musculus
aaaacgtatccaaaattcacaaggt

SEQ ID NO: 1782 - DNA, 25 bp, Mus musculus
aaaacgtatccataattcacaaggt

SEQ ID NO: 1783 - DNA, 25 bp, Mus musculus
aaaacgtcaacaccaagtcggtgga

SEQ ID NO: 1784 - DNA, 25 bp, Mus musculus
aaaacgtcaacagcaagtcggtgga

SEQ ID NO: 1785 - DNA, 25 bp, Mus musculus
aaaacgtcaatcacctgctgtacca

SEQ ID NO: 1786 - DNA, 25 bp, Mus musculus
aaaacgtcaatctcctgctgtacca

SEQ ID NO: 1787 - DNA, 25 bp, Mus musculus
aaaacgtccaacactgttctaccat

SEQ ID NO: 1788 - DNA, 25 bp, Mus musculus
aaaacgtccaactctgttctaccat

SEQ ID NO: 1789 - DNA, 25 bp, Mus musculus
aaaacgtccctgaaaggtgcatagt

SEQ ID NO: 1790 - DNA, 25 bp, Mus musculus
aaaacgtccctgtaaggtgcatagt

SEQ ID NO: 1791 - DNA, 25 bp, Mus musculus
aaaacgtccgcactgatgcagcttg

SEQ ID NO: 1792 - DNA, 25 bp, Mus musculus
aaaacgtccgcagtgatgcagcttg

SEQ ID NO: 1793 - DNA, 25 bp, Mus musculus
aaaacgtctcctagcctttttgctg

SEQ ID NO: 1794 - DNA, 25 bp, Mus musculus
aaaacgtctccttgcctttttgctg

SEQ ID NO: 1795 - DNA, 25 bp, Mus musculus
aaaacgtgctggactataggccttt

SEQ ID NO: 1796 - DNA, 25 bp, Mus musculus
aaaacgtgctggtctataggccttt

SEQ ID NO: 1797 - DNA, 25 bp, Mus musculus
aaaacgtgtcacatggtcaggtact

SEQ ID NO: 1798 - DNA, 25 bp, Mus musculus
aaaacgtgtcacttggtcaggtact

SEQ ID NO: 1799 - DNA, 25 bp, Mus musculus
aaaacgttagggatcatgtcttctt

SEQ ID NO: 1800 - DNA, 25 bp, Mus musculus
aaaacgttagggttcatgtcttctt

SEQ ID NO: 1801 - DNA, 25 bp, Mus musculus
aaaacgttggctactgaccacacac

SEQ ID NO: 1802 - DNA, 25 bp, Mus musculus
aaaacgttggcttctgaccacacac

SEQ ID NO: 1803 - DNA, 25 bp, Mus musculus
aaaacgtttcctcttgtaattgcag

SEQ ID NO: 1804 - DNA, 25 bp, Mus musculus
aaaacgtttcctgttgtaattgcag

SEQ ID NO: 1805 - DNA, 25 bp, Mus musculus
aaaacgtttgctaatctcttattgg

SEQ ID NO: 1806 - DNA, 25 bp, Mus musculus
aaaacgtttgcttatctcttattgg

SEQ ID NO: 1807 - DNA, 25 bp, Mus musculus
aaaactaaagctcgccaggcactgg

SEQ ID NO: 1808 - DNA, 25 bp, Mus musculus
aaaactaaagctcggctgttctccg

SEQ ID NO: 1809 - DNA, 25 bp, Mus musculus
aaaactaaagctggccaggcactgg

SEQ ID NO: 1810 - DNA, 25 bp, Mus musculus
aaaactaaagctgggctgttctccg

SEQ ID NO: 1811 - DNA, 25 bp, Mus musculus
aaaactaaccatatcaagctgggca

SEQ ID NO: 1812 - DNA, 25 bp, Mus musculus
aaaactaaccatttcaagctgggca

SEQ ID NO: 1813 - DNA, 25 bp, Mus musculus
aaaactaactagaacttgctgctgc

SEQ ID NO: 1814 - DNA, 25 bp, Mus musculus
aaaactaactagtacttgctgctgc

SEQ ID NO: 1815 - DNA, 25 bp, Mus musculus
aaaactaagctaatgtggagggcgg

SEQ ID NO: 1816 - DNA, 25 bp, Mus musculus
aaaactaagctattgtggagggcgg

SEQ ID NO: 1817 - DNA, 25 bp, Mus musculus
aaaactaaggccagtcatctcgctc

SEQ ID NO: 1818 - DNA, 25 bp, Mus musculus
aaaactaaggcctgtcatctcgctc

SEQ ID NO: 1819 - DNA, 25 bp, Mus musculus
aaaactaagtctaccgatggcggct

SEQ ID NO: 1820 - DNA, 25 bp, Mus musculus
aaaactaagtcttccgatggcggct

SEQ ID NO: 1821 - DNA, 25 bp, Mus musculus
aaaactaatctcacttactggccca

SEQ ID NO: 1822 - DNA, 25 bp, Mus musculus
aaaactaatctctcttactggccca

SEQ ID NO: 1823 - DNA, 25 bp, Mus musculus
aaaactaatcttcacatcctatcac

SEQ ID NO: 1824 - DNA, 25 bp, Mus musculus
aaaactaatcttgacatcctatcac

SEQ ID NO: 1825 - DNA, 25 bp, Mus musculus
aaaactaatggcaggatgggtgtcc

SEQ ID NO: 1826 - DNA, 25 bp, Mus musculus
aaaactaatggctggatgggtgtcc

SEQ ID NO: 1827 - DNA, 25 bp, Mus musculus
aaaactaatgttcgagctgtcccct

SEQ ID NO: 1828 - DNA, 25 bp, Mus musculus
aaaactaatgttggagctgtcccct

SEQ ID NO: 1829 - DNA, 25 bp, Mus musculus
aaaactaattggaaaatatgtctag

SEQ ID NO: 1830 - DNA, 25 bp, Mus musculus
aaaactaattggtaaatatgtctag

SEQ ID NO: 1831 - DNA, 25 bp, Mus musculus
aaaactacacccctgctagagcatg

SEQ ID NO: 1832 - DNA, 25 bp, Mus musculus
aaaactacacccgtgctagagcatg

SEQ ID NO: 1833 - DNA, 25 bp, Mus musculus
aaaactacactgctaagccctggac

SEQ ID NO: 1834 - DNA, 25 bp, Mus musculus
aaaactacactggtaagccctggac

SEQ ID NO: 1835 - DNA, 25 bp, Mus musculus
aaaactacatagatatccacaggat

SEQ ID NO: 1836 - DNA, 25 bp, Mus musculus
aaaactacatagttatccacaggat

SEQ ID NO: 1837 - DNA, 25 bp, Mus musculus
aaaactacatttcgatcatctgcag

SEQ ID NO: 1838 - DNA, 25 bp, Mus musculus
aaaactacatttggatcatctgcag

SEQ ID NO: 1839 - DNA, 25 bp, Mus musculus
aaaactacccacacacatagggata

SEQ ID NO: 1840 - DNA, 25 bp, Mus musculus
aaaactacccactcacatagggata

SEQ ID NO: 1841 - DNA, 25 bp, Mus musculus
aaaactacctaccatctagacagaa

SEQ ID NO: 1842 - DNA, 25 bp, Mus musculus
aaaactacctacgatctagacagaa

SEQ ID NO: 1843 - DNA, 25 bp, Mus musculus
aaaactactaggactgctatattca

SEQ ID NO: 1844 - DNA, 25 bp, Mus musculus
aaaactactaggtctgctatattca

SEQ ID NO: 1845 - DNA, 25 bp, Mus musculus
aaaactactcagcatgaactttggg

SEQ ID NO: 1846 - DNA, 25 bp, Mus musculus
aaaactactcaggatgaactttggg

SEQ ID NO: 1847 - DNA, 25 bp, Mus musculus
aaaactactgccagactctgtggtg

SEQ ID NO: 1848 - DNA, 25 bp, Mus musculus
aaaactactgcctgactctgtggtg

SEQ ID NO: 1849 - DNA, 25 bp, Mus musculus
aaaactactttaagcatcttcctga

SEQ ID NO: 1850 - DNA, 25 bp, Mus musculus
aaaactactttatgcatcttcctga

SEQ ID NO: 1851 - DNA, 25 bp, Mus musculus
aaaactagacctagttccatcgatt

SEQ ID NO: 1852 - DNA, 25 bp, Mus musculus
aaaactagaccttgttccatcgatt

SEQ ID NO: 1853 - DNA, 25 bp, Mus musculus
aaaactagatcgcttaactaccaag

SEQ ID NO: 1854 - DNA, 25 bp, Mus musculus
aaaactagatcggttaactaccaag

SEQ ID NO: 1855 - DNA, 25 bp, Mus musculus
aaaactagatggcatagctgggcat

SEQ ID NO: 1856 - DNA, 25 bp, Mus musculus
aaaactagatgggatagctgggcat

SEQ ID NO: 1857 - DNA, 25 bp, Mus musculus
aaaactagccatattgctgagctct

SEQ ID NO: 1858 - DNA, 25 bp, Mus musculus
aaaactagccattttgctgagctct

SEQ ID NO: 1859 - DNA, 25 bp, Mus musculus
aaaactagcttgagtccagtcgcca

SEQ ID NO: 1860 - DNA, 25 bp, Mus musculus
aaaactagcttgtgtccagtcgcca

SEQ ID NO: 1861 - DNA, 25 bp, Mus musculus
aaaactagctttaagtctggctcct

SEQ ID NO: 1862 - DNA, 25 bp, Mus musculus
aaaactagctttacttgagagaaca

SEQ ID NO: 1863 - DNA, 25 bp, Mus musculus
aaaactagcttttagtctggctcct

SEQ ID NO: 1864 - DNA, 25 bp, Mus musculus
aaaactagcttttcttgagagaaca

SEQ ID NO: 1865 - DNA, 25 bp, Mus musculus
aaaactagtaggcagctccatttaa

SEQ ID NO: 1866 - DNA, 25 bp, Mus musculus
aaaactagtagggagctccatttaa

SEQ ID NO: 1867 - DNA, 25 bp, Mus musculus
aaaactagtctgcaagcttgccttc

SEQ ID NO: 1868 - DNA, 25 bp, Mus musculus
aaaactagtctggaagcttgccttc

SEQ ID NO: 1869 - DNA, 25 bp, Mus musculus
aaaactatccttccagaggcttcac

SEQ ID NO: 1870 - DNA, 25 bp, Mus musculus
aaaactatccttgcagaggcttcac

SEQ ID NO: 1871 - DNA, 25 bp, Mus musculus
aaaactatgagccagtccacacact

SEQ ID NO: 1872 - DNA, 25 bp, Mus musculus
aaaactatgagcgagtccacacact

SEQ ID NO: 1873 - DNA, 25 bp, Mus musculus
aaaactatgatgagtgcgcgcgtgt

SEQ ID NO: 1874 - DNA, 25 bp, Mus musculus
aaaactatgatgtgtgcgcgcgtgt

SEQ ID NO: 1875 - DNA, 25 bp, Mus musculus
aaaactatgcttactgtcaggcggt

SEQ ID NO: 1876 - DNA, 25 bp, Mus musculus
aaaactatgctttctgtcaggcggt

SEQ ID NO: 1877 - DNA, 25 bp, Mus musculus
aaaactatgtacaaggtccatgcaa

SEQ ID NO: 1878 - DNA, 25 bp, Mus musculus
aaaactatgtactaggtccatgcaa

SEQ ID NO: 1879 - DNA, 25 bp, Mus musculus
aaaactattactcctaagaactggt

SEQ ID NO: 1880 - DNA, 25 bp, Mus musculus
aaaactattactgctaagaactggt

SEQ ID NO: 1881 - DNA, 25 bp, Mus musculus
aaaactattcttacatgatgctcat

SEQ ID NO: 1882 - DNA, 25 bp, Mus musculus
aaaactattcttcaaatcctctcgc

SEQ ID NO: 1883 - DNA, 25 bp, Mus musculus
aaaactattcttgaaatcctctcgc

SEQ ID NO: 1884 - DNA, 25 bp, Mus musculus
aaaactattctttcatgatgctcat

SEQ ID NO: 1885 - DNA, 25 bp, Mus musculus
aaaactattgatcacccactttggc

SEQ ID NO: 1886 - DNA, 25 bp, Mus musculus
aaaactattgatgacccactttggc

SEQ ID NO: 1887 - DNA, 25 bp, Mus musculus
aaaactattgctatatttctcaagt

SEQ ID NO: 1888 - DNA, 25 bp, Mus musculus
aaaactattgctttatttctcaagt

SEQ ID NO: 1889 - DNA, 25 bp, Mus musculus
aaaactattgtacgctccctcgcca

SEQ ID NO: 1890 - DNA, 25 bp, Mus musculus
aaaactattgtaggctccctcgcca

SEQ ID NO: 1891 - DNA, 25 bp, Mus musculus
aaaactattgtgagcctgggaccga

SEQ ID NO: 1892 - DNA, 25 bp, Mus musculus
aaaactattgtgtgcctgggaccga

SEQ ID NO: 1893 - DNA, 25 bp, Mus musculus
aaaactatttggctgcagaaagcat

SEQ ID NO: 1894 - DNA, 25 bp, Mus musculus
aaaactatttgggtgcagaaagcat

SEQ ID NO: 1895 - DNA, 25 bp, Mus musculus
aaaactcaagtaagaacaccacctt

SEQ ID NO: 1896 - DNA, 25 bp, Mus musculus
aaaactcaagtatgaacaccacctt

SEQ ID NO: 1897 - DNA, 25 bp, Mus musculus
aaaactcaagtcatctatgcatgga

SEQ ID NO: 1898 - DNA, 25 bp, Mus musculus
aaaactcaagtcttctatgcatgga

SEQ ID NO: 1899 - DNA, 25 bp, Mus musculus
aaaactcaagttctcgctggagtca

SEQ ID NO: 1900 - DNA, 25 bp, Mus musculus
aaaactcaagttgtcgctggagtca

SEQ ID NO: 1901 - DNA, 25 bp, Mus musculus
aaaactcaatccactgtactgtatt

SEQ ID NO: 1902 - DNA, 25 bp, Mus musculus
aaaactcaatcctctgtactgtatt

SEQ ID NO: 1903 - DNA, 25 bp, Mus musculus
aaaactcacaaaactagtgtactgt

SEQ ID NO: 1904 - DNA, 25 bp, Mus musculus
aaaactcacaaatctagtgtactgt

SEQ ID NO: 1905 - DNA, 25 bp, Mus musculus
aaaactcaccaaactatatatcgcg

SEQ ID NO: 1906 - DNA, 25 bp, Mus musculus
aaaactcaccaatctatatatcgcg

SEQ ID NO: 1907 - DNA, 25 bp, Mus musculus
aaaactcactgcactttggtggcaa

SEQ ID NO: 1908 - DNA, 25 bp, Mus musculus
aaaactcactgctctttggtggcaa

SEQ ID NO: 1909 - DNA, 25 bp, Mus musculus
aaaactcactgtacaagcctgaatt

SEQ ID NO: 1910 - DNA, 25 bp, Mus musculus
aaaactcactgttcaagcctgaatt

SEQ ID NO: 1911 - DNA, 25 bp, Mus musculus
aaaactcacttgaagctcagctggc

SEQ ID NO: 1912 - DNA, 25 bp, Mus musculus
aaaactcacttgtagctcagctggc

SEQ ID NO: 1913 - DNA, 25 bp, Mus musculus
aaaactcagagcacctgagcctttg

SEQ ID NO: 1914 - DNA, 25 bp, Mus musculus
aaaactcagagctcctgagcctttg

SEQ ID NO: 1915 - DNA, 25 bp, Mus musculus
aaaactcagaggctgaccagggtat

SEQ ID NO: 1916 - DNA, 25 bp, Mus musculus
aaaactcagagggtgaccagggtat

SEQ ID NO: 1917 - DNA, 25 bp, Mus musculus
aaaactcagatcctcatgcttgcaa

SEQ ID NO: 1918 - DNA, 25 bp, Mus musculus
aaaactcagatcgtcatgcttgcaa

SEQ ID NO: 1919 - DNA, 25 bp, Mus musculus
aaaactcagattcctatggaaaggg

SEQ ID NO: 1920 - DNA, 25 bp, Mus musculus
aaaactcagattgctatggaaaggg

SEQ ID NO: 1921 - DNA, 25 bp, Mus musculus
aaaactcagccgcattccagggctt

SEQ ID NO: 1922 - DNA, 25 bp, Mus musculus
aaaactcagccggattccagggctt

SEQ ID NO: 1923 - DNA, 25 bp, Mus musculus
aaaactcagcctagtttgggcagct

SEQ ID NO: 1924 - DNA, 25 bp, Mus musculus
aaaactcagccttgtttgggcagct

SEQ ID NO: 1925 - DNA, 25 bp, Mus musculus
aaaactcagctgagagaagcagagt

SEQ ID NO: 1926 - DNA, 25 bp, Mus musculus
aaaactcagctgagggttgcctaac

SEQ ID NO: 1927 - DNA, 25 bp, Mus musculus
aaaactcagctgtgagaagcagagt

SEQ ID NO: 1928 - DNA, 25 bp, Mus musculus
aaaactcagctgtgggttgcctaac

SEQ ID NO: 1929 - DNA, 25 bp, Mus musculus
aaaactcagggtaggtgccggtgct

SEQ ID NO: 1930 - DNA, 25 bp, Mus musculus
aaaactcagggttggtgccggtgct

SEQ ID NO: 1931 - DNA, 25 bp, Mus musculus
aaaactcagtagatgcaggctttgc

SEQ ID NO: 1932 - DNA, 25 bp, Mus musculus
aaaactcagtagttgcaggctttgc

SEQ ID NO: 1933 - DNA, 25 bp, Mus musculus
aaaactcatcggactgctgttcacg

SEQ ID NO: 1934 - DNA, 25 bp, Mus musculus
aaaactcatcggtctgctgttcacg

SEQ ID NO: 1935 - DNA, 25 bp, Mus musculus
aaaactcatgagactccttttctct

SEQ ID NO: 1936 - DNA, 25 bp, Mus musculus
aaaactcatgagtctccttttctct

SEQ ID NO: 1937 - DNA, 25 bp, Mus musculus
aaaactcatgtgctgcactcactca

SEQ ID NO: 1938 - DNA, 25 bp, Mus musculus
aaaactcatgtggtgcactcactca

SEQ ID NO: 1939 - DNA, 25 bp, Mus musculus
aaaactcatgttcccaccaaagtat

SEQ ID NO: 1940 - DNA, 25 bp, Mus musculus
aaaactcatgttctaccgcactgtg

SEQ ID NO: 1941 - DNA, 25 bp, Mus musculus
aaaactcatgttgccaccaaagtat

SEQ ID NO: 1942 - DNA, 25 bp, Mus musculus
aaaactcatgttgtaccgcactgtg

SEQ ID NO: 1943 - DNA, 25 bp, Mus musculus
aaaactcattccacatacacaggcc

SEQ ID NO: 1944 - DNA, 25 bp, Mus musculus
aaaactcattcctcatacacaggcc

SEQ ID NO: 1945 - DNA, 25 bp, Mus musculus
aaaactcattctatcattgcaactg

SEQ ID NO: 1946 - DNA, 25 bp, Mus musculus
aaaactcattctttcattgcaactg

SEQ ID NO: 1947 - DNA, 25 bp, Mus musculus
aaaactcattttatggccaggcagt

SEQ ID NO: 1948 - DNA, 25 bp, Mus musculus
aaaactcattttttggccaggcagt

SEQ ID NO: 1949 - DNA, 25 bp, Mus musculus
aaaactccaaaacctgtgctcaggg

SEQ ID NO: 1950 - DNA, 25 bp, Mus musculus
aaaactccaaaagctgtgctcaggg

SEQ ID NO: 1951 - DNA, 25 bp, Mus musculus
aaaactccaccaatgtcttccctct

SEQ ID NO: 1952 - DNA, 25 bp, Mus musculus
aaaactccaccattgtcttccctct

SEQ ID NO: 1953 - DNA, 25 bp, Mus musculus
aaaactccactgatgagatttgctt

SEQ ID NO: 1954 - DNA, 25 bp, Mus musculus
aaaactccactgttgagatttgctt

SEQ ID NO: 1955 - DNA, 25 bp, Mus musculus
aaaactccagccctctatggtaata

SEQ ID NO: 1956 - DNA, 25 bp, Mus musculus
aaaactccagccgtctatggtaata

SEQ ID NO: 1957 - DNA, 25 bp, Mus musculus
aaaactccaggtagagactctctag

SEQ ID NO: 1958 - DNA, 25 bp, Mus musculus
aaaactccaggttgagactctctag

SEQ ID NO: 1959 - DNA, 25 bp, Mus musculus
aaaactccagtaacctgtagggtgg

SEQ ID NO: 1960 - DNA, 25 bp, Mus musculus
aaaactccagtatcctgtagggtgg

SEQ ID NO: 1961 - DNA, 25 bp, Mus musculus
aaaactccatccattgagccctaat

SEQ ID NO: 1962 - DNA, 25 bp, Mus musculus
aaaactccatcctttgagccctaat

SEQ ID NO: 1963 - DNA, 25 bp, Mus musculus
aaaactccatctccgtttctggatg

SEQ ID NO: 1964 - DNA, 25 bp, Mus musculus
aaaactccatctgcgtttctggatg

SEQ ID NO: 1965 - DNA, 25 bp, Mus musculus
aaaactccattacaaggtgcccaga

SEQ ID NO: 1966 - DNA, 25 bp, Mus musculus
aaaactccattagaaggtgcccaga

SEQ ID NO: 1967 - DNA, 25 bp, Mus musculus
aaaactccattgagtgttgctggac

SEQ ID NO: 1968 - DNA, 25 bp, Mus musculus
aaaactccattgtgtgttgctggac

SEQ ID NO: 1969 - DNA, 25 bp, Mus musculus
aaaactcccaacaaaccagctgcag

SEQ ID NO: 1970 - DNA, 25 bp, Mus musculus
aaaactcccaactaaccagctgcag

SEQ ID NO: 1971 - DNA, 25 bp, Mus musculus
aaaactcccaatccagagatgacgg

SEQ ID NO: 1972 - DNA, 25 bp, Mus musculus
aaaactcccaatgcagagatgacgg

SEQ ID NO: 1973 - DNA, 25 bp, Mus musculus
aaaactccccaaatattcatgtatt

SEQ ID NO: 1974 - DNA, 25 bp, Mus musculus
aaaactccccaattattcatgtatt

SEQ ID NO: 1975 - DNA, 25 bp, Mus musculus
aaaactccctgcacagtaatagcct

SEQ ID NO: 1976 - DNA, 25 bp, Mus musculus
aaaactccctgctcagtaatagcct

SEQ ID NO: 1977 - DNA, 25 bp, Mus musculus
aaaactccgataatcagggcgcctt

SEQ ID NO: 1978 - DNA, 25 bp, Mus musculus
aaaactccgatattcagggcgcctt

SEQ ID NO: 1979 - DNA, 25 bp, Mus musculus
aaaactccggagatacaagctctgt

SEQ ID NO: 1980 - DNA, 25 bp, Mus musculus
aaaactccggagttacaagctctgt

SEQ ID NO: 1981 - DNA, 25 bp, Mus musculus
aaaactccgtttcataatctgcaaa

SEQ ID NO: 1982 - DNA, 25 bp, Mus musculus
aaaactccgtttgataatctgcaaa

SEQ ID NO: 1983 - DNA, 25 bp, Mus musculus
aaaactcctaagagctccgggatgg

SEQ ID NO: 1984 - DNA, 25 bp, Mus musculus
aaaactcctaagtgctccgggatgg

SEQ ID NO: 1985 - DNA, 25 bp, Mus musculus
aaaactcctgcacagcctttgtgtt

SEQ ID NO: 1986 - DNA, 25 bp, Mus musculus
aaaactcctgcagagcctttgtgtt

SEQ ID NO: 1987 - DNA, 25 bp, Mus musculus
aaaactcctggaagctatgcccggc

SEQ ID NO: 1988 - DNA, 25 bp, Mus musculus
aaaactcctggaatcttgcaaagat

SEQ ID NO: 1989 - DNA, 25 bp, Mus musculus
aaaactcctggatgctatgcccggc

SEQ ID NO: 1990 - DNA, 25 bp, Mus musculus
aaaactcctggattcttgcaaagat

SEQ ID NO: 1991 - DNA, 25 bp, Mus musculus
aaaactcctgtcacttaatagctga

SEQ ID NO: 1992 - DNA, 25 bp, Mus musculus
aaaactcctgtctcttaatagctga

SEQ ID NO: 1993 - DNA, 25 bp, Mus musculus
aaaactccttccaacgaaatctcag

SEQ ID NO: 1994 - DNA, 25 bp, Mus musculus
aaaactccttcctacgaaatctcag

SEQ ID NO: 1995 - DNA, 25 bp, Mus musculus
aaaactcgagtgaggtttcccactg

SEQ ID NO: 1996 - DNA, 25 bp, Mus musculus
aaaactcgagtgtggtttcccactg

SEQ ID NO: 1997 - DNA, 25 bp, Mus musculus
aaaactcgggatcacctggcaaggt

SEQ ID NO: 1998 - DNA, 25 bp, Mus musculus
aaaactcgggatgacctggcaaggt

SEQ ID NO: 1999 - DNA, 25 bp, Mus musculus
aaaactcgggtcagatcactggaaa

SEQ ID NO: 2000 - DNA, 25 bp, Mus musculus
aaaactcgggtctgatcactggaaa

SEQ ID NO: 2001 - DNA, 25 bp, Mus musculus
aaaactcgtgataagctattgaact

SEQ ID NO: 2002 - DNA, 25 bp, Mus musculus
aaaactcgtgattagctattgaact

SEQ ID NO: 2003 - DNA, 25 bp, Mus musculus
aaaactcgtggaagaatgattacag

SEQ ID NO: 2004 - DNA, 25 bp, Mus musculus
aaaactcgtggatgaatgattacag

SEQ ID NO: 2005 - DNA, 25 bp, Mus musculus
aaaactctaacaccggtgcatgccc

SEQ ID NO: 2006 - DNA, 25 bp, Mus musculus
aaaactctaacagcggtgcatgccc

SEQ ID NO: 2007 - DNA, 25 bp, Mus musculus
aaaactctaagaactgacagcctaa

SEQ ID NO: 2008 - DNA, 25 bp, Mus musculus
aaaactctaagatctgacagcctaa

SEQ ID NO: 2009 - DNA, 25 bp, Mus musculus
aaaactctacttacggcagtggaca

SEQ ID NO: 2010 - DNA, 25 bp, Mus musculus
aaaactctactttcggcagtggaca

SEQ ID NO: 2011 - DNA, 25 bp, Mus musculus
aaaactctcaaacctgtgcatcaga

SEQ ID NO: 2012 - DNA, 25 bp, Mus musculus
aaaactctcaaagctgtgcatcaga

SEQ ID NO: 2013 - DNA, 25 bp, Mus musculus
aaaactctctggacatgctctaatg

SEQ ID NO: 2014 - DNA, 25 bp, Mus musculus
aaaactctctggtcatgctctaatg

SEQ ID NO: 2015 - DNA, 25 bp, Mus musculus
aaaactctgactactgatgccattc

SEQ ID NO: 2016 - DNA, 25 bp, Mus musculus
aaaactctgacttctgatgccattc

SEQ ID NO: 2017 - DNA, 25 bp, Mus musculus
aaaactctgctccaatccgtcaaaa

SEQ ID NO: 2018 - DNA, 25 bp, Mus musculus
aaaactctgctcgaatccgtcaaaa

SEQ ID NO: 2019 - DNA, 25 bp, Mus musculus
aaaactctgctgctacagtcacggg

SEQ ID NO: 2020 - DNA, 25 bp, Mus musculus
aaaactctgctggtacagtcacggg

SEQ ID NO: 2021 - DNA, 25 bp, Mus musculus
aaaactctggtacacctattccaag

SEQ ID NO: 2022 - DNA, 25 bp, Mus musculus
aaaactctggtagacctattccaag

SEQ ID NO: 2023 - DNA, 25 bp, Mus musculus
aaaactctgtcactcaaacacacgt

SEQ ID NO: 2024 - DNA, 25 bp, Mus musculus
aaaactctgtcagtcaaacacacgt

SEQ ID NO: 2025 - DNA, 25 bp, Mus musculus
aaaactctgtgaccttaccaacttg

SEQ ID NO: 2026 - DNA, 25 bp, Mus musculus
aaaactctgtgagcttaccaacttg

SEQ ID NO: 2027 - DNA, 25 bp, Mus musculus
aaaactctgtggaggctcgtctgta

SEQ ID NO: 2028 - DNA, 25 bp, Mus musculus
aaaactctgtggtggctcgtctgta

SEQ ID NO: 2029 - DNA, 25 bp, Mus musculus
aaaactcttcatccacggaggattg

SEQ ID NO: 2030 - DNA, 25 bp, Mus musculus
aaaactcttcatgcacggaggattg

SEQ ID NO: 2031 - DNA, 25 bp, Mus musculus
aaaactcttctacagaccatgggaa

SEQ ID NO: 2032 - DNA, 25 bp, Mus musculus
aaaactcttctagagaccatgggaa

SEQ ID NO: 2033 - DNA, 25 bp, Mus musculus
aaaactcttgagagctgacctgttg

SEQ ID NO: 2034 - DNA, 25 bp, Mus musculus
aaaactcttgagtgctgacctgttg

SEQ ID NO: 2035 - DNA, 25 bp, Mus musculus
aaaactcttgttagatctcattatg

SEQ ID NO: 2036 - DNA, 25 bp, Mus musculus
aaaactcttgtttgatctcattatg

SEQ ID NO: 2037 - DNA, 25 bp, Mus musculus
aaaactctttctcacactgaaggaa

SEQ ID NO: 2038 - DNA, 25 bp, Mus musculus
aaaactctttctgacactgaaggaa

SEQ ID NO: 2039 - DNA, 25 bp, Mus musculus
aaaactgaactcaaggccattgccc

SEQ ID NO: 2040 - DNA, 25 bp, Mus musculus
aaaactgaactcattcactgtgaga

SEQ ID NO: 2041 - DNA, 25 bp, Mus musculus
aaaactgaactctaggccattgccc

SEQ ID NO: 2042 - DNA, 25 bp, Mus musculus
aaaactgaactctttcactgtgaga

SEQ ID NO: 2043 - DNA, 25 bp, Mus musculus
aaaactgaagtaattcgacaagcta

SEQ ID NO: 2044 - DNA, 25 bp, Mus musculus
aaaactgaagtatttcgacaagcta

SEQ ID NO: 2045 - DNA, 25 bp, Mus musculus
aaaactgaagttcgtggcactgcat

SEQ ID NO: 2046 - DNA, 25 bp, Mus musculus
aaaactgaagttggtggcactgcat

SEQ ID NO: 2047 - DNA, 25 bp, Mus musculus
aaaactgaatgtactgatctagaag

SEQ ID NO: 2048 - DNA, 25 bp, Mus musculus
aaaactgaatgttctgatctagaag

SEQ ID NO: 2049 - DNA, 25 bp, Mus musculus
aaaactgaccagcacaccatctgaa

SEQ ID NO: 2050 - DNA, 25 bp, Mus musculus
aaaactgaccaggacaccatctgaa

SEQ ID NO: 2051 - DNA, 25 bp, Mus musculus
aaaactgaccatcctgagccaggca

SEQ ID NO: 2052 - DNA, 25 bp, Mus musculus
aaaactgaccatgctgagccaggca

SEQ ID NO: 2053 - DNA, 25 bp, Mus musculus
aaaactgaccgtataatcagtcaca

SEQ ID NO: 2054 - DNA, 25 bp, Mus musculus
aaaactgaccgtttaatcagtcaca

SEQ ID NO: 2055 - DNA, 25 bp, Mus musculus
aaaactgactaaatctcttcctgcc

SEQ ID NO: 2056 - DNA, 25 bp, Mus musculus
aaaactgactaattctcttcctgcc

SEQ ID NO: 2057 - DNA, 25 bp, Mus musculus
aaaactgagacgctctgcaccttcc

SEQ ID NO: 2058 - DNA, 25 bp, Mus musculus
aaaactgagacggtctgcaccttcc

SEQ ID NO: 2059 - DNA, 25 bp, Mus musculus
aaaactgagatcagtgtagaacaca

SEQ ID NO: 2060 - DNA, 25 bp, Mus musculus
aaaactgagatctgtgtagaacaca

SEQ ID NO: 2061 - DNA, 25 bp, Mus musculus
aaaactgagcaaaccagcctagtgt

SEQ ID NO: 2062 - DNA, 25 bp, Mus musculus
aaaactgagcaacggcctcatgctg

SEQ ID NO: 2063 - DNA, 25 bp, Mus musculus
aaaactgagcaagggcctcatgctg

SEQ ID NO: 2064 - DNA, 25 bp, Mus musculus
aaaactgagcaatccagcctagtgt

SEQ ID NO: 2065 - DNA, 25 bp, Mus musculus
aaaactgagccacagtccagctgca

SEQ ID NO: 2066 - DNA, 25 bp, Mus musculus
aaaactgagccagagtccagctgca

SEQ ID NO: 2067 - DNA, 25 bp, Mus musculus
aaaactgaggctagtgcatgctggt

SEQ ID NO: 2068 - DNA, 25 bp, Mus musculus
aaaactgaggcttgtgcatgctggt

SEQ ID NO: 2069 - DNA, 25 bp, Mus musculus
aaaactgaggtgaaactggaaatgt

SEQ ID NO: 2070 - DNA, 25 bp, Mus musculus
aaaactgaggtgtaactggaaatgt

SEQ ID NO: 2071 - DNA, 25 bp, Mus musculus
aaaactgagtgtcttccagctgtct

SEQ ID NO: 2072 - DNA, 25 bp, Mus musculus
aaaactgagtgtgttccagctgtct

SEQ ID NO: 2073 - DNA, 25 bp, Mus musculus
aaaactgatcctactgtcatttgtc

SEQ ID NO: 2074 - DNA, 25 bp, Mus musculus
aaaactgatccttctgtcatttgtc

SEQ ID NO: 2075 - DNA, 25 bp, Mus musculus
aaaactgatgcacagttgcgcggag

SEQ ID NO: 2076 - DNA, 25 bp, Mus musculus
aaaactgatgcagagttgcgcggag

SEQ ID NO: 2077 - DNA, 25 bp, Mus musculus
aaaactgatgccctggaagctctca

SEQ ID NO: 2078 - DNA, 25 bp, Mus musculus
aaaactgatgccgtggaagctctca

SEQ ID NO: 2079 - DNA, 25 bp, Mus musculus
aaaactgcaaatcccgaaagcctaa

SEQ ID NO: 2080 - DNA, 25 bp, Mus musculus
aaaactgcaaatgccgaaagcctaa

SEQ ID NO: 2081 - DNA, 25 bp, Mus musculus
aaaactgcaagtcggttccctgttg

SEQ ID NO: 2082 - DNA, 25 bp, Mus musculus
aaaactgcaagtgggttccctgttg

SEQ ID NO: 2083 - DNA, 25 bp, Mus musculus
aaaactgcactactgaatggtcata

SEQ ID NO: 2084 - DNA, 25 bp, Mus musculus
aaaactgcactagtgaatggtcata

SEQ ID NO: 2085 - DNA, 25 bp, Mus musculus
aaaactgcactgaggtgtcccatca

SEQ ID NO: 2086 - DNA, 25 bp, Mus musculus
aaaactgcactgtggtgtcccatca

SEQ ID NO: 2087 - DNA, 25 bp, Mus musculus
aaaactgcatcaagcttctgtgtga

SEQ ID NO: 2088 - DNA, 25 bp, Mus musculus
aaaactgcatcatgcttctgtgtga

SEQ ID NO: 2089 - DNA, 25 bp, Mus musculus
aaaactgcatccaacagggaagctc

SEQ ID NO: 2090 - DNA, 25 bp, Mus musculus
aaaactgcatcctacagggaagctc

SEQ ID NO: 2091 - DNA, 25 bp, Mus musculus
aaaactgccaaccttgtcaatccag

SEQ ID NO: 2092 - DNA, 25 bp, Mus musculus
aaaactgccaacgttgtcaatccag

SEQ ID NO: 2093 - DNA, 25 bp, Mus musculus
aaaactgccaccagctgggtgccaa

SEQ ID NO: 2094 - DNA, 25 bp, Mus musculus
aaaactgccaccaggagactctgtg

SEQ ID NO: 2095 - DNA, 25 bp, Mus musculus
aaaactgccacctgctgggtgccaa

SEQ ID NO: 2096 - DNA, 25 bp, Mus musculus
aaaactgccacctggagactctgtg

SEQ ID NO: 2097 - DNA, 25 bp, Mus musculus
aaaactgcccacaagtgacctgtgt

SEQ ID NO: 2098 - DNA, 25 bp, Mus musculus
aaaactgcccactagtgacctgtgt

SEQ ID NO: 2099 - DNA, 25 bp, Mus musculus
aaaactgcccagagcctttgaggct

SEQ ID NO: 2100 - DNA, 25 bp, Mus musculus
aaaactgcccagtgcctttgaggct

SEQ ID NO: 2101 - DNA, 25 bp, Mus musculus
aaaactgccctcagtgagatcataa

SEQ ID NO: 2102 - DNA, 25 bp, Mus musculus
aaaactgccctctgtgagatcataa

SEQ ID NO: 2103 - DNA, 25 bp, Mus musculus
aaaactgcctgcacgagtgtctgca

SEQ ID NO: 2104 - DNA, 25 bp, Mus musculus
aaaactgcctgctcgagtgtctgca

SEQ ID NO: 2105 - DNA, 25 bp, Mus musculus
aaaactgcctggacctctcagtgag

SEQ ID NO: 2106 - DNA, 25 bp, Mus musculus
aaaactgcctggtcctctcagtgag

SEQ ID NO: 2107 - DNA, 25 bp, Mus musculus
aaaactgcctttaatggtgtggtct

SEQ ID NO: 2108 - DNA, 25 bp, Mus musculus
aaaactgccttttatggtgtggtct

SEQ ID NO: 2109 - DNA, 25 bp, Mus musculus
aaaactgctaaaatgtaacacattg

SEQ ID NO: 2110 - DNA, 25 bp, Mus musculus
aaaactgctaaattgtaacacattg

SEQ ID NO: 2111 - DNA, 25 bp, Mus musculus
aaaactgctagtcggtcacagctgt

SEQ ID NO: 2112 - DNA, 25 bp, Mus musculus
aaaactgctagtgggtcacagctgt

SEQ ID NO: 2113 - DNA, 25 bp, Mus musculus
aaaactgctcagacttcaaactgga

SEQ ID NO: 2114 - DNA, 25 bp, Mus musculus
aaaactgctcagtcttcaaactgga

SEQ ID NO: 2115 - DNA, 25 bp, Mus musculus
aaaactgctccacaaggccaggctt

SEQ ID NO: 2116 - DNA, 25 bp, Mus musculus
aaaactgctccagaaggccaggctt

SEQ ID NO: 2117 - DNA, 25 bp, Mus musculus
aaaactgctcttactggatcgtctt

SEQ ID NO: 2118 - DNA, 25 bp, Mus musculus
aaaactgctctttctggatcgtctt

SEQ ID NO: 2119 - DNA, 25 bp, Mus musculus
aaaactgctgacaaactatggctat

SEQ ID NO: 2120 - DNA, 25 bp, Mus musculus
aaaactgctgactaactatggctat

SEQ ID NO: 2121 - DNA, 25 bp, Mus musculus
aaaactgctgtgattcaatgtctcc

SEQ ID NO: 2122 - DNA, 25 bp, Mus musculus
aaaactgctgtgtttcaatgtctcc

SEQ ID NO: 2123 - DNA, 25 bp, Mus musculus
aaaactgctgttacgctcatgacat

SEQ ID NO: 2124 - DNA, 25 bp, Mus musculus
aaaactgctgtttcgctcatgacat

SEQ ID NO: 2125 - DNA, 25 bp, Mus musculus
aaaactgcttgaatggaccaaacgt

SEQ ID NO: 2126 - DNA, 25 bp, Mus musculus
aaaactgcttgattggaccaaacgt

SEQ ID NO: 2127 - DNA, 25 bp, Mus musculus
aaaactggaaatcgaggctgcccct

SEQ ID NO: 2128 - DNA, 25 bp, Mus musculus
aaaactggaaatggaggctgcccct

SEQ ID NO: 2129 - DNA, 25 bp, Mus musculus
aaaactggaacaaaggctgtccttg

SEQ ID NO: 2130 - DNA, 25 bp, Mus musculus
aaaactggaacataggctgtccttg

SEQ ID NO: 2131 - DNA, 25 bp, Mus musculus
aaaactggacaactgcatgtgctgc

SEQ ID NO: 2132 - DNA, 25 bp, Mus musculus
aaaactggacaagtgcatgtgctgc

SEQ ID NO: 2133 - DNA, 25 bp, Mus musculus
aaaactggactgatctttgaaaatc

SEQ ID NO: 2134 - DNA, 25 bp, Mus musculus
aaaactggactgttctttgaaaatc

SEQ ID NO: 2135 - DNA, 25 bp, Mus musculus
aaaactggagacattgccctctgag

SEQ ID NO: 2136 - DNA, 25 bp, Mus musculus
aaaactggagactttgccctctgag

SEQ ID NO: 2137 - DNA, 25 bp, Mus musculus
aaaactggattactgcttggtttca

SEQ ID NO: 2138 - DNA, 25 bp, Mus musculus
aaaactggattagtgcttggtttca

SEQ ID NO: 2139 - DNA, 25 bp, Mus musculus
aaaactggattcagcatgttcatga

SEQ ID NO: 2140 - DNA, 25 bp, Mus musculus
aaaactggattctgcatgttcatga

SEQ ID NO: 2141 - DNA, 25 bp, Mus musculus
aaaactggcaggaacatttgtggaa

SEQ ID NO: 2142 - DNA, 25 bp, Mus musculus
aaaactggcaggtacatttgtggaa

SEQ ID NO: 2143 - DNA, 25 bp, Mus musculus
aaaactggcattagctgtgcccggg

SEQ ID NO: 2144 - DNA, 25 bp, Mus musculus
aaaactggcatttgctgtgcccggg

SEQ ID NO: 2145 - DNA, 25 bp, Mus musculus
aaaactggccacattgtgcttgcag

SEQ ID NO: 2146 - DNA, 25 bp, Mus musculus
aaaactggccactttgtgcttgcag

SEQ ID NO: 2147 - DNA, 25 bp, Mus musculus
aaaactggccctaatgtgaaacaag

SEQ ID NO: 2148 - DNA, 25 bp, Mus musculus
aaaactggcccttatgtgaaacaag

SEQ ID NO: 2149 - DNA, 25 bp, Mus musculus
aaaactggcgctacacttgaaagag

SEQ ID NO: 2150 - DNA, 25 bp, Mus musculus
aaaactggcgcttcacttgaaagag

SEQ ID NO: 2151 - DNA, 25 bp, Mus musculus
aaaactggcttcatgattccccaag

SEQ ID NO: 2152 - DNA, 25 bp, Mus musculus
aaaactggcttcttgattccccaag

SEQ ID NO: 2153 - DNA, 25 bp, Mus musculus
aaaactgggagtcgcgtcaccattt

SEQ ID NO: 2154 - DNA, 25 bp, Mus musculus
aaaactgggagtggcgtcaccattt

SEQ ID NO: 2155 - DNA, 25 bp, Mus musculus
aaaactgggatgctgccttcttcaa

SEQ ID NO: 2156 - DNA, 25 bp, Mus musculus
aaaactgggatggtgccttcttcaa

SEQ ID NO: 2157 - DNA, 25 bp, Mus musculus
aaaactgggcctcttaacttgcagc

SEQ ID NO: 2158 - DNA, 25 bp, Mus musculus
aaaactgggcctgttaacttgcagc

SEQ ID NO: 2159 - DNA, 25 bp, Mus musculus
aaaactgggtgtcatcactgcctca

SEQ ID NO: 2160 - DNA, 25 bp, Mus musculus
aaaactgggtgtgatcactgcctca

SEQ ID NO: 2161 - DNA, 25 bp, Mus musculus
aaaactggtctgatgcttctgagct

SEQ ID NO: 2162 - DNA, 25 bp, Mus musculus
aaaactggtctgttgcttctgagct

SEQ ID NO: 2163 - DNA, 25 bp, Mus musculus
aaaactggtcttccgtgccagagca

SEQ ID NO: 2164 - DNA, 25 bp, Mus musculus
aaaactggtcttgcgtgccagagca

SEQ ID NO: 2165 - DNA, 25 bp, Mus musculus
aaaactggtgctatccaatggcctg

SEQ ID NO: 2166 - DNA, 25 bp, Mus musculus
aaaactggtgctttccaatggcctg

SEQ ID NO: 2167 - DNA, 25 bp, Mus musculus
aaaactggttgtcagtcatatctga

SEQ ID NO: 2168 - DNA, 25 bp, Mus musculus
aaaactggttgtgagtcatatctga

SEQ ID NO: 2169 - DNA, 25 bp, Mus musculus
aaaactgtaagcctgtgatttgaaa

SEQ ID NO: 2170 - DNA, 25 bp, Mus musculus
aaaactgtaagcgtgtgatttgaaa

SEQ ID NO: 2171 - DNA, 25 bp, Mus musculus
aaaactgtaatacctcctgaccatg

SEQ ID NO: 2172 - DNA, 25 bp, Mus musculus
aaaactgtaatagctcctgaccatg

SEQ ID NO: 2173 - DNA, 25 bp, Mus musculus
aaaactgtaccgctgagcgagactt

SEQ ID NO: 2174 - DNA, 25 bp, Mus musculus
aaaactgtaccggtgagcgagactt

SEQ ID NO: 2175 - DNA, 25 bp, Mus musculus
aaaactgtagcaaatgatctgtggg

SEQ ID NO: 2176 - DNA, 25 bp, Mus musculus
aaaactgtagcatatgatctgtggg

SEQ ID NO: 2177 - DNA, 25 bp, Mus musculus
aaaactgtcagcatttgggtaatct

SEQ ID NO: 2178 - DNA, 25 bp, Mus musculus
aaaactgtcagcttttgggtaatct

SEQ ID NO: 2179 - DNA, 25 bp, Mus musculus
aaaactgtcagtacggtgtacttca

SEQ ID NO: 2180 - DNA, 25 bp, Mus musculus
aaaactgtcagttcggtgtacttca

SEQ ID NO: 2181 - DNA, 25 bp, Mus musculus
aaaactgtcccaacagcagagcttt

SEQ ID NO: 2182 - DNA, 25 bp, Mus musculus
aaaactgtcccactctgtagaggat

SEQ ID NO: 2183 - DNA, 25 bp, Mus musculus
aaaactgtcccagtctgtagaggat

SEQ ID NO: 2184 - DNA, 25 bp, Mus musculus
aaaactgtcccatcagcagagcttt

SEQ ID NO: 2185 - DNA, 25 bp, Mus musculus
aaaactgtcctcagggtgtgtctat

SEQ ID NO: 2186 - DNA, 25 bp, Mus musculus
aaaactgtcctctgggtgtgtctat

SEQ ID NO: 2187 - DNA, 25 bp, Mus musculus
aaaactgtctagcaactttgtatgt

SEQ ID NO: 2188 - DNA, 25 bp, Mus musculus
aaaactgtctaggaactttgtatgt

SEQ ID NO: 2189 - DNA, 25 bp, Mus musculus
aaaactgtctcacaaggcatcaggc

SEQ ID NO: 2190 - DNA, 25 bp, Mus musculus
aaaactgtctcagaaggcatcaggc

SEQ ID NO: 2191 - DNA, 25 bp, Mus musculus
aaaactgtctccaaactaccaatgc

SEQ ID NO: 2192 - DNA, 25 bp, Mus musculus
aaaactgtctccagctggtggtttc

SEQ ID NO: 2193 - DNA, 25 bp, Mus musculus
aaaactgtctccagggtgtcacaca

SEQ ID NO: 2194 - DNA, 25 bp, Mus musculus
aaaactgtctcctaactaccaatgc

SEQ ID NO: 2195 - DNA, 25 bp, Mus musculus
aaaactgtctcctgctggtggtttc

SEQ ID NO: 2196 - DNA, 25 bp, Mus musculus
aaaactgtctcctgggtgtcacaca

SEQ ID NO: 2197 - DNA, 25 bp, Mus musculus
aaaactgtcttactgggtggtgtca

SEQ ID NO: 2198 - DNA, 25 bp, Mus musculus
aaaactgtcttagtgggtggtgtca

SEQ ID NO: 2199 - DNA, 25 bp, Mus musculus
aaaactgtgaacagtctgctggttg

SEQ ID NO: 2200 - DNA, 25 bp, Mus musculus
aaaactgtgaacatggcaagccgaa

SEQ ID NO: 2201 - DNA, 25 bp, Mus musculus
aaaactgtgaactgtctgctggttg

SEQ ID NO: 2202 - DNA, 25 bp, Mus musculus
aaaactgtgaacttggcaagccgaa

SEQ ID NO: 2203 - DNA, 25 bp, Mus musculus
aaaactgtgacacggcttcctcttt

SEQ ID NO: 2204 - DNA, 25 bp, Mus musculus
aaaactgtgacagggcttcctcttt

SEQ ID NO: 2205 - DNA, 25 bp, Mus musculus
aaaactgtgacgacctctcggagag

SEQ ID NO: 2206 - DNA, 25 bp, Mus musculus
aaaactgtgacgtcctctcggagag

SEQ ID NO: 2207 - DNA, 25 bp, Mus musculus
aaaactgtgactcccagcggtgtgt

SEQ ID NO: 2208 - DNA, 25 bp, Mus musculus
aaaactgtgactgccagcggtgtgt

SEQ ID NO: 2209 - DNA, 25 bp, Mus musculus
aaaactgtgagcctgtgattgggtt

SEQ ID NO: 2210 - DNA, 25 bp, Mus musculus
aaaactgtgagcgtgtgattgggtt

SEQ ID NO: 2211 - DNA, 25 bp, Mus musculus
aaaactgtgctgagactgtgcggta

SEQ ID NO: 2212 - DNA, 25 bp, Mus musculus
aaaactgtgctgtgactgtgcggta

SEQ ID NO: 2213 - DNA, 25 bp, Mus musculus
aaaactgtggccattcggtagtgat

SEQ ID NO: 2214 - DNA, 25 bp, Mus musculus
aaaactgtggcctttcggtagtgat

SEQ ID NO: 2215 - DNA, 25 bp, Mus musculus
aaaactgtgggcctcagatgggttt

SEQ ID NO: 2216 - DNA, 25 bp, Mus musculus
aaaactgtgggcgtcagatgggttt

SEQ ID NO: 2217 - DNA, 25 bp, Mus musculus
aaaactgtggtgatctgaggccctg

SEQ ID NO: 2218 - DNA, 25 bp, Mus musculus
aaaactgtggtgttctgaggccctg

SEQ ID NO: 2219 - DNA, 25 bp, Mus musculus
aaaactgtgtgaatccttggttcta

SEQ ID NO: 2220 - DNA, 25 bp, Mus musculus
aaaactgtgtgattccttggttcta

SEQ ID NO: 2221 - DNA, 25 bp, Mus musculus
aaaactgtgttacccactgtgcctg

SEQ ID NO: 2222 - DNA, 25 bp, Mus musculus
aaaactgtgttagccactgtgcctg

SEQ ID NO: 2223 - DNA, 25 bp, Mus musculus
aaaactgttcagctacttgcgacca

SEQ ID NO: 2224 - DNA, 25 bp, Mus musculus
aaaactgttcaggtacttgcgacca

SEQ ID NO: 2225 - DNA, 25 bp, Mus musculus
aaaactgttctcaggaccttgggct

SEQ ID NO: 2226 - DNA, 25 bp, Mus musculus
aaaactgttctctggaccttgggct

SEQ ID NO: 2227 - DNA, 25 bp, Mus musculus
aaaactgttcttcatctacccttga

SEQ ID NO: 2228 - DNA, 25 bp, Mus musculus
aaaactgttcttgatctacccttga

SEQ ID NO: 2229 - DNA, 25 bp, Mus musculus
aaaactgttgaccatccctggtagg

SEQ ID NO: 2230 - DNA, 25 bp, Mus musculus
aaaactgttgacgatccctggtagg

SEQ ID NO: 2231 - DNA, 25 bp, Mus musculus
aaaactgttggaaccacaccaatga

SEQ ID NO: 2232 - DNA, 25 bp, Mus musculus
aaaactgttggacacgaggccgatc

SEQ ID NO: 2233 - DNA, 25 bp, Mus musculus
aaaactgttggagacgaggccgatc

SEQ ID NO: 2234 - DNA, 25 bp, Mus musculus
aaaactgttggatccacaccaatga

SEQ ID NO: 2235 - DNA, 25 bp, Mus musculus
aaaactgtttctcctgaatctatat

SEQ ID NO: 2236 - DNA, 25 bp, Mus musculus
aaaactgtttctgctgaatctatat

SEQ ID NO: 2237 - DNA, 25 bp, Mus musculus
aaaactgtttgcctgttctctaggg

SEQ ID NO: 2238 - DNA, 25 bp, Mus musculus
aaaactgtttgcgtgttctctaggg

SEQ ID NO: 2239 - DNA, 25 bp, Mus musculus
aaaactgtttggagtgttctgggct

SEQ ID NO: 2240 - DNA, 25 bp, Mus musculus
aaaactgtttggtgtgttctgggct

SEQ ID NO: 2241 - DNA, 25 bp, Mus musculus
aaaacttaatgacgcccttcaccag

SEQ ID NO: 2242 - DNA, 25 bp, Mus musculus
aaaacttaatgaggcccttcaccag

SEQ ID NO: 2243 - DNA, 25 bp, Mus musculus
aaaacttacctgagaggcaggcgga

SEQ ID NO: 2244 - DNA, 25 bp, Mus musculus
aaaacttacctgtgaggcaggcgga

SEQ ID NO: 2245 - DNA, 25 bp, Mus musculus
aaaacttagctcagtcaggatcccc

SEQ ID NO: 2246 - DNA, 25 bp, Mus musculus
aaaacttagctctgtcaggatcccc

SEQ ID NO: 2247 - DNA, 25 bp, Mus musculus
aaaacttagtgtacagtctgtgaca

SEQ ID NO: 2248 - DNA, 25 bp, Mus musculus
aaaacttagtgttcagtctgtgaca

SEQ ID NO: 2249 - DNA, 25 bp, Mus musculus
aaaacttcagtgatcagttgagtgt

SEQ ID NO: 2250 - DNA, 25 bp, Mus musculus
aaaacttcagtgttcagttgagtgt

SEQ ID NO: 2251 - DNA, 25 bp, Mus musculus
aaaacttccattacctctgctaatt

SEQ ID NO: 2252 - DNA, 25 bp, Mus musculus
aaaacttccatttcctctgctaatt

SEQ ID NO: 2253 - DNA, 25 bp, Mus musculus
aaaacttcccagactagggctggca

SEQ ID NO: 2254 - DNA, 25 bp, Mus musculus
aaaacttcccagctcaggcaaaagg

SEQ ID NO: 2255 - DNA, 25 bp, Mus musculus
aaaacttcccaggtcaggcaaaagg

SEQ ID NO: 2256 - DNA, 25 bp, Mus musculus
aaaacttcccagtctagggctggca

SEQ ID NO: 2257 - DNA, 25 bp, Mus musculus
aaaacttccggcaggacctggtcat

SEQ ID NO: 2258 - DNA, 25 bp, Mus musculus
aaaacttccggctggacctggtcat

SEQ ID NO: 2259 - DNA, 25 bp, Mus musculus
aaaacttcctgaagtcttccagaga

SEQ ID NO: 2260 - DNA, 25 bp, Mus musculus
aaaacttcctgatgtcttccagaga

SEQ ID NO: 2261 - DNA, 25 bp, Mus musculus
aaaacttcgcaaaggtggctgctta

SEQ ID NO: 2262 - DNA, 25 bp, Mus musculus
aaaacttcgcaatggtggctgctta

SEQ ID NO: 2263 - DNA, 25 bp, Mus musculus
aaaacttcgccaccactgccttttg

SEQ ID NO: 2264 - DNA, 25 bp, Mus musculus
aaaacttcgccagcactgccttttg

SEQ ID NO: 2265 - DNA, 25 bp, Mus musculus
aaaacttctccaccatatctaaggc

SEQ ID NO: 2266 - DNA, 25 bp, Mus musculus
aaaacttctccagcatatctaaggc

SEQ ID NO: 2267 - DNA, 25 bp, Mus musculus
aaaacttctcgaatcctcacaataa

SEQ ID NO: 2268 - DNA, 25 bp, Mus musculus
aaaacttctcgacagcttgcatgat

SEQ ID NO: 2269 - DNA, 25 bp, Mus musculus
aaaacttctcgagagcttgcatgat

SEQ ID NO: 2270 - DNA, 25 bp, Mus musculus
aaaacttctcgattcctcacaataa

SEQ ID NO: 2271 - DNA, 25 bp, Mus musculus
aaaacttctgccactactatatagc

SEQ ID NO: 2272 - DNA, 25 bp, Mus musculus
aaaacttctgcctctactatatagc

SEQ ID NO: 2273 - DNA, 25 bp, Mus musculus
aaaacttctggaccgctgcaagtac

SEQ ID NO: 2274 - DNA, 25 bp, Mus musculus
aaaacttctggagcgctgcaagtac

SEQ ID NO: 2275 - DNA, 25 bp, Mus musculus
aaaacttctggccagggctttcagt

SEQ ID NO: 2276 - DNA, 25 bp, Mus musculus
aaaacttctggcgagggctttcagt

SEQ ID NO: 2277 - DNA, 25 bp, Mus musculus
aaaacttctgtgaccactccagcgt

SEQ ID NO: 2278 - DNA, 25 bp, Mus musculus
aaaacttctgtgtccactccagcgt

SEQ ID NO: 2279 - DNA, 25 bp, Mus musculus
aaaacttctgttaatgctctccttc

SEQ ID NO: 2280 - DNA, 25 bp, Mus musculus
aaaacttctgtttatgctctccttc

SEQ ID NO: 2281 - DNA, 25 bp, Mus musculus
aaaacttcttgactattgacagtca

SEQ ID NO: 2282 - DNA, 25 bp, Mus musculus
aaaacttcttgagtattgacagtca

SEQ ID NO: 2283 - DNA, 25 bp, Mus musculus
aaaacttcttttcagcaatgttgct

SEQ ID NO: 2284 - DNA, 25 bp, Mus musculus
aaaacttcttttgagcaatgttgct

SEQ ID NO: 2285 - DNA, 25 bp, Mus musculus
aaaacttgactcaggcccttgaggg

SEQ ID NO: 2286 - DNA, 25 bp, Mus musculus
aaaacttgactctggcccttgaggg

SEQ ID NO: 2287 - DNA, 25 bp, Mus musculus
aaaacttgactgctgcattgtgcta

SEQ ID NO: 2288 - DNA, 25 bp, Mus musculus
aaaacttgactggtgcattgtgcta

SEQ ID NO: 2289 - DNA, 25 bp, Mus musculus
aaaacttgagtcacgtgctgtcctc

SEQ ID NO: 2290 - DNA, 25 bp, Mus musculus
aaaacttgagtctcgtgctgtcctc

SEQ ID NO: 2291 - DNA, 25 bp, Mus musculus
aaaacttgatcaacaggactggaga

SEQ ID NO: 2292 - DNA, 25 bp, Mus musculus
aaaacttgatcatcaggactggaga

SEQ ID NO: 2293 - DNA, 25 bp, Mus musculus
aaaacttgcaatcaaagtgccaaca

SEQ ID NO: 2294 - DNA, 25 bp, Mus musculus
aaaacttgcaatgaaagtgccaaca

SEQ ID NO: 2295 - DNA, 25 bp, Mus musculus
aaaacttgccagctcccaaactatg

SEQ ID NO: 2296 - DNA, 25 bp, Mus musculus
aaaacttgccaggtcccaaactatg

SEQ ID NO: 2297 - DNA, 25 bp, Mus musculus
aaaacttgcctcatgctgaaagctg

SEQ ID NO: 2298 - DNA, 25 bp, Mus musculus
aaaacttgcctcttgctgaaagctg

SEQ ID NO: 2299 - DNA, 25 bp, Mus musculus
aaaacttgcttgattccttcagcat

SEQ ID NO: 2300 - DNA, 25 bp, Mus musculus
aaaacttgcttgtttccttcagcat

SEQ ID NO: 2301 - DNA, 25 bp, Mus musculus
aaaacttggcgtaatgcaacggcga

SEQ ID NO: 2302 - DNA, 25 bp, Mus musculus
aaaacttggcgttatgcaacggcga

SEQ ID NO: 2303 - DNA, 25 bp, Mus musculus
aaaacttggctacctcacttgagac

SEQ ID NO: 2304 - DNA, 25 bp, Mus musculus
aaaacttggctagctcacttgagac

SEQ ID NO: 2305 - DNA, 25 bp, Mus musculus
aaaacttggctcaacatgcctgggc

SEQ ID NO: 2306 - DNA, 25 bp, Mus musculus
aaaacttggctctacatgcctgggc

SEQ ID NO: 2307 - DNA, 25 bp, Mus musculus
aaaacttggctgatactccacagga

SEQ ID NO: 2308 - DNA, 25 bp, Mus musculus
aaaacttggctgttactccacagga

SEQ ID NO: 2309 - DNA, 25 bp, Mus musculus
aaaacttggtgcacttcgagctgaa

SEQ ID NO: 2310 - DNA, 25 bp, Mus musculus
aaaacttggtgctcttcgagctgaa

SEQ ID NO: 2311 - DNA, 25 bp, Mus musculus
aaaacttggttgatggatatcctcc

SEQ ID NO: 2312 - DNA, 25 bp, Mus musculus
aaaacttggttgttggatatcctcc

SEQ ID NO: 2313 - DNA, 25 bp, Mus musculus
aaaacttgtaatatggtgctaccat

SEQ ID NO: 2314 - DNA, 25 bp, Mus musculus
aaaacttgtaatttggtgctaccat

SEQ ID NO: 2315 - DNA, 25 bp, Mus musculus
aaaacttgtattatgctgcattgtt

SEQ ID NO: 2316 - DNA, 25 bp, Mus musculus
aaaacttgtattttgctgcattgtt

SEQ ID NO: 2317 - DNA, 25 bp, Mus musculus
aaaacttgtgtgaatcttttttatg

SEQ ID NO: 2318 - DNA, 25 bp, Mus musculus
aaaacttgtgtgtatcttttttatg

SEQ ID NO: 2319 - DNA, 25 bp, Mus musculus
aaaacttgttagaggcagtagctga

SEQ ID NO: 2320 - DNA, 25 bp, Mus musculus
aaaacttgttagtggcagtagctga

SEQ ID NO: 2321 - DNA, 25 bp, Mus musculus
aaaacttgttttcatctcaggtaga

SEQ ID NO: 2322 - DNA, 25 bp, Mus musculus
aaaacttgttttgatctcaggtaga

SEQ ID NO: 2323 - DNA, 25 bp, Mus musculus
aaaactttcataaaacttcttatgt

SEQ ID NO: 2324 - DNA, 25 bp, Mus musculus
aaaactttcatataacttcttatgt

SEQ ID NO: 2325 - DNA, 25 bp, Mus musculus
aaaactttccaaccttatctgccac

SEQ ID NO: 2326 - DNA, 25 bp, Mus musculus
aaaactttccaagcttatctgccac

SEQ ID NO: 2327 - DNA, 25 bp, Mus musculus
aaaactttgattccagctccaacta

SEQ ID NO: 2328 - DNA, 25 bp, Mus musculus
aaaactttgattgcagctccaacta

SEQ ID NO: 2329 - DNA, 25 bp, Mus musculus
aaaactttgcccagagatttcattg

SEQ ID NO: 2330 - DNA, 25 bp, Mus musculus
aaaactttgcccatagcatcccaag

SEQ ID NO: 2331 - DNA, 25 bp, Mus musculus
aaaactttgccctgagatttcattg

SEQ ID NO: 2332 - DNA, 25 bp, Mus musculus
aaaactttgcccttagcatcccaag

SEQ ID NO: 2333 - DNA, 25 bp, Mus musculus
aaaactttgcctactactgatgata

SEQ ID NO: 2334 - DNA, 25 bp, Mus musculus
aaaactttgccttctactgatgata

SEQ ID NO: 2335 - DNA, 25 bp, Mus musculus
aaaactttggttcttgcactgctga

SEQ ID NO: 2336 - DNA, 25 bp, Mus musculus
aaaactttggttgttgcactgctga

SEQ ID NO: 2337 - DNA, 25 bp, Mus musculus
aaaacttttccaccgtgttctctgc

SEQ ID NO: 2338 - DNA, 25 bp, Mus musculus
aaaacttttccagcgtgttctctgc

SEQ ID NO: 2339 - DNA, 25 bp, Mus musculus
aaaacttttgcaccagagccatttc

SEQ ID NO: 2340 - DNA, 25 bp, Mus musculus
aaaacttttgcagcagagccatttc

SEQ ID NO: 2341 - DNA, 25 bp, Mus musculus
aaaactttttaacaatctgcctcat

SEQ ID NO: 2342 - DNA, 25 bp, Mus musculus
aaaactttttaagaatctgcctcat

SEQ ID NO: 2343 - DNA, 25 bp, Mus musculus
aaaactttttgacccagagctgcac

SEQ ID NO: 2344 - DNA, 25 bp, Mus musculus
aaaactttttgagccagagctgcac

SEQ ID NO: 2345 - DNA, 25 bp, Mus musculus
aaaagaaaacctatcctctctacat

SEQ ID NO: 2346 - DNA, 25 bp, Mus musculus
aaaagaaaacctttcctctctacat

SEQ ID NO: 2347 - DNA, 25 bp, Mus musculus
aaaagaaaatcacagcacgctgtat

SEQ ID NO: 2348 - DNA, 25 bp, Mus musculus
aaaagaaaatcagagcacgctgtat

SEQ ID NO: 2349 - DNA, 25 bp, Mus musculus
aaaagaaacccactcatggtggctt

SEQ ID NO: 2350 - DNA, 25 bp, Mus musculus
aaaagaaacccagtcatggtggctt

SEQ ID NO: 2351 - DNA, 25 bp, Mus musculus
aaaagaaacctaagaatgcattcaa

SEQ ID NO: 2352 - DNA, 25 bp, Mus musculus
aaaagaaacctatgaatgcattcaa

SEQ ID NO: 2353 - DNA, 25 bp, Mus musculus
aaaagaaactcaatgccagggcaag

SEQ ID NO: 2354 - DNA, 25 bp, Mus musculus
aaaagaaactcattgccagggcaag

SEQ ID NO: 2355 - DNA, 25 bp, Mus musculus
aaaagaaacttcacaccacctcaag

SEQ ID NO: 2356 - DNA, 25 bp, Mus musculus
aaaagaaacttctcaccacctcaag

SEQ ID NO: 2357 - DNA, 25 bp, Mus musculus
aaaagaaagcatctctcctgccgct

SEQ ID NO: 2358 - DNA, 25 bp, Mus musculus
aaaagaaagcatgtctcctgccgct

SEQ ID NO: 2359 - DNA, 25 bp, Mus musculus
aaaagaaagctcagtggctcctgcc

SEQ ID NO: 2360 - DNA, 25 bp, Mus musculus
aaaagaaagctctgtggctcctgcc

SEQ ID NO: 2361 - DNA, 25 bp, Mus musculus
aaaagaaattccacgctgggcagtg

SEQ ID NO: 2362 - DNA, 25 bp, Mus musculus
aaaagaaattcctcgctgggcagtg

SEQ ID NO: 2363 - DNA, 25 bp, Mus musculus
aaaagaacacttcagccagcccagt

SEQ ID NO: 2364 - DNA, 25 bp, Mus musculus
aaaagaacacttgagccagcccagt

SEQ ID NO: 2365 - DNA, 25 bp, Mus musculus
aaaagaacagcacccgtccaggccg

SEQ ID NO: 2366 - DNA, 25 bp, Mus musculus
aaaagaacagcagccgtccaggccg

SEQ ID NO: 2367 - DNA, 25 bp, Mus musculus
aaaagaacaggccaaagctgctgca

SEQ ID NO: 2368 - DNA, 25 bp, Mus musculus
aaaagaacaggcctgctcacctccg

SEQ ID NO: 2369 - DNA, 25 bp, Mus musculus
aaaagaacaggcgaaagctgctgca

SEQ ID NO: 2370 - DNA, 25 bp, Mus musculus
aaaagaacaggcgtgctcacctccg

SEQ ID NO: 2371 - DNA, 25 bp, Mus musculus
aaaagaaccgaccagctcacctgcg

SEQ ID NO: 2372 - DNA, 25 bp, Mus musculus
aaaagaaccgacgagctcacctgcg

SEQ ID NO: 2373 - DNA, 25 bp, Mus musculus
aaaagaaccgctagaccctagctag

SEQ ID NO: 2374 - DNA, 25 bp, Mus musculus
aaaagaaccgcttgaccctagctag

SEQ ID NO: 2375 - DNA, 25 bp, Mus musculus
aaaagaactagacgctcagccctcc

SEQ ID NO: 2376 - DNA, 25 bp, Mus musculus
aaaagaactagaggctcagccctcc

SEQ ID NO: 2377 - DNA, 25 bp, Mus musculus
aaaagaactagtatcccactgtcag

SEQ ID NO: 2378 - DNA, 25 bp, Mus musculus
aaaagaactagtttcccactgtcag

SEQ ID NO: 2379 - DNA, 25 bp, Mus musculus
aaaagaactgtgcactaatagagat

SEQ ID NO: 2380 - DNA, 25 bp, Mus musculus
aaaagaactgtggactaatagagat

SEQ ID NO: 2381 - DNA, 25 bp, Mus musculus
aaaagaagatttcaactgggacaag

SEQ ID NO: 2382 - DNA, 25 bp, Mus musculus
aaaagaagatttgaactgggacaag

SEQ ID NO: 2383 - DNA, 25 bp, Mus musculus
aaaagaagcaccatggctcccatgc

SEQ ID NO: 2384 - DNA, 25 bp, Mus musculus
aaaagaagcaccttggctcccatgc

SEQ ID NO: 2385 - DNA, 25 bp, Mus musculus
aaaagaagcgacaggctgcactggc

SEQ ID NO: 2386 - DNA, 25 bp, Mus musculus
aaaagaagcgactggctgcactggc

SEQ ID NO: 2387 - DNA, 25 bp, Mus musculus
aaaagaagcgctagcccaaacctca

SEQ ID NO: 2388 - DNA, 25 bp, Mus musculus
aaaagaagcgcttgcccaaacctca

SEQ ID NO: 2389 - DNA, 25 bp, Mus musculus
aaaagaaggcccaacttgctccaca

SEQ ID NO: 2390 - DNA, 25 bp, Mus musculus
aaaagaaggccctacttgctccaca

SEQ ID NO: 2391 - DNA, 25 bp, Mus musculus
aaaagaagggctaccatcctcacac

SEQ ID NO: 2392 - DNA, 25 bp, Mus musculus
aaaagaagggcttccatcctcacac

SEQ ID NO: 2393 - DNA, 25 bp, Mus musculus
aaaagaagtccaactgcagctacct

SEQ ID NO: 2394 - DNA, 25 bp, Mus musculus
aaaagaagtccatctgcagctacct

SEQ ID NO: 2395 - DNA, 25 bp, Mus musculus
aaaagaagtgagctgttccatccct

SEQ ID NO: 2396 - DNA, 25 bp, Mus musculus
aaaagaagtgaggtgttccatccct

SEQ ID NO: 2397 - DNA, 25 bp, Mus musculus
aaaagaatactgaagctcccgtgct

SEQ ID NO: 2398 - DNA, 25 bp, Mus musculus
aaaagaatactgcactcctttaatc

SEQ ID NO: 2399 - DNA, 25 bp, Mus musculus
aaaagaatactggactcctttaatc

SEQ ID NO: 2400 - DNA, 25 bp, Mus musculus
aaaagaatactgtagctcccgtgct

SEQ ID NO: 2401 - DNA, 25 bp, Mus musculus
aaaagaatagcacctgctcagtagc

SEQ ID NO: 2402 - DNA, 25 bp, Mus musculus
aaaagaatagcagctgctcagtagc

SEQ ID NO: 2403 - DNA, 25 bp, Mus musculus
aaaagaatgagactgtgtggcggaa

SEQ ID NO: 2404 - DNA, 25 bp, Mus musculus
aaaagaatgagagtgtgtggcggaa

SEQ ID NO: 2405 - DNA, 25 bp, Mus musculus
aaaagaatgatgaccctttccttgc

SEQ ID NO: 2406 - DNA, 25 bp, Mus musculus
aaaagaatgatgtccctttccttgc

SEQ ID NO: 2407 - DNA, 25 bp, Mus musculus
aaaagaatggttacttgcttcaaag

SEQ ID NO: 2408 - DNA, 25 bp, Mus musculus
aaaagaatggtttcttgcttcaaag

SEQ ID NO: 2409 - DNA, 25 bp, Mus musculus
aaaagaatgttcaacgtgcccaatc

SEQ ID NO: 2410 - DNA, 25 bp, Mus musculus
aaaagaatgttctacgtgcccaatc

SEQ ID NO: 2411 - DNA, 25 bp, Mus musculus
aaaagaattgggatagacgaatcat

SEQ ID NO: 2412 - DNA, 25 bp, Mus musculus
aaaagaattgggttagacgaatcat

SEQ ID NO: 2413 - DNA, 25 bp, Mus musculus
aaaagacaaagcaaccctcaccagg

SEQ ID NO: 2414 - DNA, 25 bp, Mus musculus
aaaagacaaagctaccctcaccagg

SEQ ID NO: 2415 - DNA, 25 bp, Mus musculus
aaaagacaacccctgtcctgctgct

SEQ ID NO: 2416 - DNA, 25 bp, Mus musculus
aaaagacaacccgtgtcctgctgct

SEQ ID NO: 2417 - DNA, 25 bp, Mus musculus
aaaagacaacctatcctggatgcca

SEQ ID NO: 2418 - DNA, 25 bp, Mus musculus
aaaagacaacctttcctggatgcca

SEQ ID NO: 2419 - DNA, 25 bp, Mus musculus
aaaagacaatgcctgaaccccagct

SEQ ID NO: 2420 - DNA, 25 bp, Mus musculus
aaaagacaatgcgtgaaccccagct

SEQ ID NO: 2421 - DNA, 25 bp, Mus musculus
aaaagacacgttaccctgagataca

SEQ ID NO: 2422 - DNA, 25 bp, Mus musculus
aaaagacacgtttccctgagataca

SEQ ID NO: 2423 - DNA, 25 bp, Mus musculus
aaaagacacttacttcatgtggtat

SEQ ID NO: 2424 - DNA, 25 bp, Mus musculus
aaaagacacttagttcatgtggtat

SEQ ID NO: 2425 - DNA, 25 bp, Mus musculus
aaaagacagaggctatcaacttgag

SEQ ID NO: 2426 - DNA, 25 bp, Mus musculus
aaaagacagagggtatcaacttgag

SEQ ID NO: 2427 - DNA, 25 bp, Mus musculus
aaaagacagcctctcctgaggcttt

SEQ ID NO: 2428 - DNA, 25 bp, Mus musculus
aaaagacagcctgtcctgaggcttt

SEQ ID NO: 2429 - DNA, 25 bp, Mus musculus
aaaagacagctcaaccttcgactcc

SEQ ID NO: 2430 - DNA, 25 bp, Mus musculus
aaaagacagctctaccttcgactcc

SEQ ID NO: 2431 - DNA, 25 bp, Mus musculus
aaaagacaggtcacctcacaccggt

SEQ ID NO: 2432 - DNA, 25 bp, Mus musculus
aaaagacaggtctcctcacaccggt

SEQ ID NO: 2433 - DNA, 25 bp, Mus musculus
aaaagacagtagagaggctggttag

SEQ ID NO: 2434 - DNA, 25 bp, Mus musculus
aaaagacagtagtgaggctggttag

SEQ ID NO: 2435 - DNA, 25 bp, Mus musculus
aaaagacataaactggcggcccagg

SEQ ID NO: 2436 - DNA, 25 bp, Mus musculus
aaaagacataaagtggcggcccagg

SEQ ID NO: 2437 - DNA, 25 bp, Mus musculus
aaaagacatcgtactggttgcctat

SEQ ID NO: 2438 - DNA, 25 bp, Mus musculus
aaaagacatcgttctggttgcctat

SEQ ID NO: 2439 - DNA, 25 bp, Mus musculus
aaaagacatctcaaacagtagcaag

SEQ ID NO: 2440 - DNA, 25 bp, Mus musculus
aaaagacatctctaacagtagcaag

SEQ ID NO: 2441 - DNA, 25 bp, Mus musculus
aaaagacatgctacagacccgttag

SEQ ID NO: 2442 - DNA, 25 bp, Mus musculus
aaaagacatgcttcagacccgttag

SEQ ID NO: 2443 - DNA, 25 bp, Mus musculus
aaaagaccaagacctggttcctcag

SEQ ID NO: 2444 - DNA, 25 bp, Mus musculus
aaaagaccaagagctggttcctcag

SEQ ID NO: 2445 - DNA, 25 bp, Mus musculus
aaaagaccaagtccctgcagtagtg

SEQ ID NO: 2446 - DNA, 25 bp, Mus musculus
aaaagaccaagtgcctgcagtagtg

SEQ ID NO: 2447 - DNA, 25 bp, Mus musculus
aaaagaccaatgaggctttccatct

SEQ ID NO: 2448 - DNA, 25 bp, Mus musculus
aaaagaccaatgtggctttccatct

SEQ ID NO: 2449 - DNA, 25 bp, Mus musculus
aaaagaccacgacccttctgtgtct

SEQ ID NO: 2450 - DNA, 25 bp, Mus musculus
aaaagaccacgagccttctgtgtct

SEQ ID NO: 2451 - DNA, 25 bp, Mus musculus
aaaagaccagtgagaggaccaaaga

SEQ ID NO: 2452 - DNA, 25 bp, Mus musculus
aaaagaccagtgtgaggaccaaaga

SEQ ID NO: 2453 - DNA, 25 bp, Mus musculus
aaaagacccatcaccaaggcagagg

SEQ ID NO: 2454 - DNA, 25 bp, Mus musculus
aaaagacccatctccaaggcagagg

SEQ ID NO: 2455 - DNA, 25 bp, Mus musculus
aaaagaccctggctgaatgtgacca

SEQ ID NO: 2456 - DNA, 25 bp, Mus musculus
aaaagaccctgggtgaatgtgacca

SEQ ID NO: 2457 - DNA, 25 bp, Mus musculus
aaaagacctactccgctgagatact

SEQ ID NO: 2458 - DNA, 25 bp, Mus musculus
aaaagacctactgcgctgagatact

SEQ ID NO: 2459 - DNA, 25 bp, Mus musculus
aaaagacctgaaccagctccacctg

SEQ ID NO: 2460 - DNA, 25 bp, Mus musculus
aaaagacctgaagcagctccacctg

SEQ ID NO: 2461 - DNA, 25 bp, Mus musculus
aaaagaccttgaaactactccagtt

SEQ ID NO: 2462 - DNA, 25 bp, Mus musculus
aaaagaccttgatactactccagtt

SEQ ID NO: 2463 - DNA, 25 bp, Mus musculus
aaaagacgaagaaccagcaagatga

SEQ ID NO: 2464 - DNA, 25 bp, Mus musculus
aaaagacgaagatccagcaagatga

SEQ ID NO: 2465 - DNA, 25 bp, Mus musculus
aaaagacgagtcagcctttgccctt

SEQ ID NO: 2466 - DNA, 25 bp, Mus musculus
aaaagacgagtctgcctttgccctt

SEQ ID NO: 2467 - DNA, 25 bp, Mus musculus
aaaagacgccaccaatctgttagcc

SEQ ID NO: 2468 - DNA, 25 bp, Mus musculus
aaaagacgccacgaatctgttagcc

SEQ ID NO: 2469 - DNA, 25 bp, Mus musculus
aaaagacgctggcacagctgcacac

SEQ ID NO: 2470 - DNA, 25 bp, Mus musculus
aaaagacgctgggacagctgcacac

SEQ ID NO: 2471 - DNA, 25 bp, Mus musculus
aaaagacgctttacagtggccaaga

SEQ ID NO: 2472 - DNA, 25 bp, Mus musculus
aaaagacgcttttcagtggccaaga

SEQ ID NO: 2473 - DNA, 25 bp, Mus musculus
aaaagactacgcatctgccttagaa

SEQ ID NO: 2474 - DNA, 25 bp, Mus musculus
aaaagactacgcttctgccttagaa

SEQ ID NO: 2475 - DNA, 25 bp, Mus musculus
aaaagactagctcactgccatgtca

SEQ ID NO: 2476 - DNA, 25 bp, Mus musculus
aaaagactagctgactgccatgtca

SEQ ID NO: 2477 - DNA, 25 bp, Mus musculus
aaaagactatttaatctcagatata

SEQ ID NO: 2478 - DNA, 25 bp, Mus musculus
aaaagactattttatctcagatata

SEQ ID NO: 2479 - DNA, 25 bp, Mus musculus
aaaagactcctgcaacctaccttat

SEQ ID NO: 2480 - DNA, 25 bp, Mus musculus
aaaagactcctggaacctaccttat

SEQ ID NO: 2481 - DNA, 25 bp, Mus musculus
aaaagactcgcactgactgttacct

SEQ ID NO: 2482 - DNA, 25 bp, Mus musculus
aaaagactcgcagtgactgttacct

SEQ ID NO: 2483 - DNA, 25 bp, Mus musculus
aaaagactcgctccctgtatttaaa

SEQ ID NO: 2484 - DNA, 25 bp, Mus musculus
aaaagactcgctgcctgtatttaaa

SEQ ID NO: 2485 - DNA, 25 bp, Mus musculus
aaaagactgcatcggccaacctagt

SEQ ID NO: 2486 - DNA, 25 bp, Mus musculus
aaaagactgcatgggccaacctagt

SEQ ID NO: 2487 - DNA, 25 bp, Mus musculus
aaaagactgggtatctccatccctg

SEQ ID NO: 2488 - DNA, 25 bp, Mus musculus
aaaagactgggtttctccatccctg

SEQ ID NO: 2489 - DNA, 25 bp, Mus musculus
aaaagactggttccccatcacgaca

SEQ ID NO: 2490 - DNA, 25 bp, Mus musculus
aaaagactggttgcccatcacgaca

SEQ ID NO: 2491 - DNA, 25 bp, Mus musculus
aaaagacttgatattgggccagttg

SEQ ID NO: 2492 - DNA, 25 bp, Mus musculus
aaaagacttgattttgggccagttg

SEQ ID NO: 2493 - DNA, 25 bp, Mus musculus
aaaagacttgtcagctacttggaat

SEQ ID NO: 2494 - DNA, 25 bp, Mus musculus
aaaagacttgtctgctacttggaat

SEQ ID NO: 2495 - DNA, 25 bp, Mus musculus
aaaagacttgtgaagccaggcgtgg

SEQ ID NO: 2496 - DNA, 25 bp, Mus musculus
aaaagacttgtgtagccaggcgtgg

SEQ ID NO: 2497 - DNA, 25 bp, Mus musculus
aaaagacttgttcgcccgagagtgg

SEQ ID NO: 2498 - DNA, 25 bp, Mus musculus
aaaagacttgttggcccgagagtgg

SEQ ID NO: 2499 - DNA, 25 bp, Mus musculus
aaaagactttgtagtgtacatgaca

SEQ ID NO: 2500 - DNA, 25 bp, Mus musculus
aaaagactttgttgtgtacatgaca

SEQ ID NO: 2501 - DNA, 25 bp, Mus musculus
aaaagagaccagcttgcttcccaag

SEQ ID NO: 2502 - DNA, 25 bp, Mus musculus
aaaagagaccaggttgcttcccaag

SEQ ID NO: 2503 - DNA, 25 bp, Mus musculus
aaaagagaccttacacattcatgtg

SEQ ID NO: 2504 - DNA, 25 bp, Mus musculus
aaaagagacctttcacattcatgtg

SEQ ID NO: 2505 - DNA, 25 bp, Mus musculus
aaaagagacgtcaggctcggctaca

SEQ ID NO: 2506 - DNA, 25 bp, Mus musculus
aaaagagacgtctggctcggctaca

SEQ ID NO: 2507 - DNA, 25 bp, Mus musculus
aaaagagagcctcccgtctctttgt

SEQ ID NO: 2508 - DNA, 25 bp, Mus musculus
aaaagagagcctgccgtctctttgt

SEQ ID NO: 2509 - DNA, 25 bp, Mus musculus
aaaagagcaaatcgaggccgagctg

SEQ ID NO: 2510 - DNA, 25 bp, Mus musculus
aaaagagcaaatggaggccgagctg

SEQ ID NO: 2511 - DNA, 25 bp, Mus musculus
aaaagagcaaggctgtctctggtga

SEQ ID NO: 2512 - DNA, 25 bp, Mus musculus
aaaagagcaagggtgtctctggtga

SEQ ID NO: 2513 - DNA, 25 bp, Mus musculus
aaaagagcactcatccacatttcta

SEQ ID NO: 2514 - DNA, 25 bp, Mus musculus
aaaagagcactcttccacatttcta

SEQ ID NO: 2515 - DNA, 25 bp, Mus musculus
aaaagagcagcaaagccctgaggct

SEQ ID NO: 2516 - DNA, 25 bp, Mus musculus
aaaagagcagcatagccctgaggct

SEQ ID NO: 2517 - DNA, 25 bp, Mus musculus
aaaagagcagccaggttactcccat

SEQ ID NO: 2518 - DNA, 25 bp, Mus musculus
aaaagagcagcctggttactcccat

SEQ ID NO: 2519 - DNA, 25 bp, Mus musculus
aaaagagcagctagcattcttaact

SEQ ID NO: 2520 - DNA, 25 bp, Mus musculus
aaaagagcagcttgcattcttaact

SEQ ID NO: 2521 - DNA, 25 bp, Mus musculus
aaaagagcagtacagggcccagccc

SEQ ID NO: 2522 - DNA, 25 bp, Mus musculus
aaaagagcagtagagggcccagccc

SEQ ID NO: 2523 - DNA, 25 bp, Mus musculus
aaaagagccattcacccagagttct

SEQ ID NO: 2524 - DNA, 25 bp, Mus musculus
aaaagagccattgacccagagttct

SEQ ID NO: 2525 - DNA, 25 bp, Mus musculus
aaaagagccctaatggctgcctacc

SEQ ID NO: 2526 - DNA, 25 bp, Mus musculus
aaaagagccctattggctgcctacc

SEQ ID NO: 2527 - DNA, 25 bp, Mus musculus
aaaagagccctccttgtgcttgttc

SEQ ID NO: 2528 - DNA, 25 bp, Mus musculus
aaaagagccctcgttgtgcttgttc

SEQ ID NO: 2529 - DNA, 25 bp, Mus musculus
aaaagagcctgaccccaaacattgg

SEQ ID NO: 2530 - DNA, 25 bp, Mus musculus
aaaagagcctgagcccaaacattgg

SEQ ID NO: 2531 - DNA, 25 bp, Mus musculus
aaaagagcctgcaggtttctacctg

SEQ ID NO: 2532 - DNA, 25 bp, Mus musculus
aaaagagcctgctggtttctacctg

SEQ ID NO: 2533 - DNA, 25 bp, Mus musculus
aaaagagcgattaccccagagcctt

SEQ ID NO: 2534 - DNA, 25 bp, Mus musculus
aaaagagcgatttccccagagcctt

SEQ ID NO: 2535 - DNA, 25 bp, Mus musculus
aaaagagctcccaacaggcgctatt

SEQ ID NO: 2536 - DNA, 25 bp, Mus musculus
aaaagagctccctacaggcgctatt

SEQ ID NO: 2537 - DNA, 25 bp, Mus musculus
aaaagagcttccaggttgccttgga

SEQ ID NO: 2538 - DNA, 25 bp, Mus musculus
aaaagagcttcctggttgccttgga

SEQ ID NO: 2539 - DNA, 25 bp, Mus musculus
aaaagagctttaagactagtcacat

SEQ ID NO: 2540 - DNA, 25 bp, Mus musculus
aaaagagctttatgactagtcacat

SEQ ID NO: 2541 - DNA, 25 bp, Mus musculus
aaaagagctttgaatttcctattca

SEQ ID NO: 2542 - DNA, 25 bp, Mus musculus
aaaagagctttgtatttcctattca

SEQ ID NO: 2543 - DNA, 25 bp, Mus musculus
aaaagaggacgacgctctgtggcca

SEQ ID NO: 2544 - DNA, 25 bp, Mus musculus
aaaagaggacgaggctctgtggcca

SEQ ID NO: 2545 - DNA, 25 bp, Mus musculus
aaaagaggatcaagtgtctggaatc

SEQ ID NO: 2546 - DNA, 25 bp, Mus musculus
aaaagaggatcatgtgtctggaatc

SEQ ID NO: 2547 - DNA, 25 bp, Mus musculus
aaaagaggatcccattccagctcca

SEQ ID NO: 2548 - DNA, 25 bp, Mus musculus
aaaagaggatccgattccagctcca

SEQ ID NO: 2549 - DNA, 25 bp, Mus musculus
aaaagaggcagacctttgccagaac

SEQ ID NO: 2550 - DNA, 25 bp, Mus musculus
aaaagaggcagagctttgccagaac

SEQ ID NO: 2551 - DNA, 25 bp, Mus musculus
aaaagaggcgcgctcagtctccatc

SEQ ID NO: 2552 - DNA, 25 bp, Mus musculus
aaaagaggcgcggtcagtctccatc

SEQ ID NO: 2553 - DNA, 25 bp, Mus musculus
aaaagaggctcacaggatgcggcat

SEQ ID NO: 2554 - DNA, 25 bp, Mus musculus
aaaagaggctcagaggatgcggcat

SEQ ID NO: 2555 - DNA, 25 bp, Mus musculus
aaaagaggtgctcgtgagcccttcc

SEQ ID NO: 2556 - DNA, 25 bp, Mus musculus
aaaagaggtgctggtgagcccttcc

SEQ ID NO: 2557 - DNA, 25 bp, Mus musculus
aaaagaggttctctcagtgccccta

SEQ ID NO: 2558 - DNA, 25 bp, Mus musculus
aaaagaggttctgtcagtgccccta

SEQ ID NO: 2559 - DNA, 25 bp, Mus musculus
aaaagagtactgagctgcctcagaa

SEQ ID NO: 2560 - DNA, 25 bp, Mus musculus
aaaagagtactgtgctgcctcagaa

SEQ ID NO: 2561 - DNA, 25 bp, Mus musculus
aaaagagtattgactgcctgccttg

SEQ ID NO: 2562 - DNA, 25 bp, Mus musculus
aaaagagtattgtctgcctgccttg

SEQ ID NO: 2563 - DNA, 25 bp, Mus musculus
aaaagagtccatcttgtgcctgctg

SEQ ID NO: 2564 - DNA, 25 bp, Mus musculus
aaaagagtccatgttgtgcctgctg

SEQ ID NO: 2565 - DNA, 25 bp, Mus musculus
aaaagagtcccacgccaagtgtctc

SEQ ID NO: 2566 - DNA, 25 bp, Mus musculus
aaaagagtcccaggccaagtgtctc

SEQ ID NO: 2567 - DNA, 25 bp, Mus musculus
aaaagagtccccaaagtcagtgagt

SEQ ID NO: 2568 - DNA, 25 bp, Mus musculus
aaaagagtcccctaagtcagtgagt

SEQ ID NO: 2569 - DNA, 25 bp, Mus musculus
aaaagagtccgtcctgcaaccgaag

SEQ ID NO: 2570 - DNA, 25 bp, Mus musculus
aaaagagtccgtgctgcaaccgaag

SEQ ID NO: 2571 - DNA, 25 bp, Mus musculus
aaaagagtcctccagccggaacatg

SEQ ID NO: 2572 - DNA, 25 bp, Mus musculus
aaaagagtcctcgagccggaacatg

SEQ ID NO: 2573 - DNA, 25 bp, Mus musculus
aaaagagtccttacaggcccagtct

SEQ ID NO: 2574 - DNA, 25 bp, Mus musculus
aaaagagtcctttcaggcccagtct

SEQ ID NO: 2575 - DNA, 25 bp, Mus musculus
aaaagagtcggtccatccctgagat

SEQ ID NO: 2576 - DNA, 25 bp, Mus musculus
aaaagagtcggtgcatccctgagat

SEQ ID NO: 2577 - DNA, 25 bp, Mus musculus
aaaagagttagcactcatcctccca

SEQ ID NO: 2578 - DNA, 25 bp, Mus musculus
aaaagagttagctctcatcctccca

SEQ ID NO: 2579 - DNA, 25 bp, Mus musculus
aaaagagtttgaatctggcacattc

SEQ ID NO: 2580 - DNA, 25 bp, Mus musculus
aaaagagtttgattctggcacattc

SEQ ID NO: 2581 - DNA, 25 bp, Mus musculus
aaaagataacccagccatcctattt

SEQ ID NO: 2582 - DNA, 25 bp, Mus musculus
aaaagataaccctgccatcctattt

SEQ ID NO: 2583 - DNA, 25 bp, Mus musculus
aaaagatacctcatccttccaagat

SEQ ID NO: 2584 - DNA, 25 bp, Mus musculus
aaaagatacctcttccttccaagat

SEQ ID NO: 2585 - DNA, 25 bp, Mus musculus
aaaagatacttgacttcagccatta

SEQ ID NO: 2586 - DNA, 25 bp, Mus musculus
aaaagatacttgtcttcagccatta

SEQ ID NO: 2587 - DNA, 25 bp, Mus musculus
aaaagatactttcctctgaagacaa

SEQ ID NO: 2588 - DNA, 25 bp, Mus musculus
aaaagatactttgctctgaagacaa

SEQ ID NO: 2589 - DNA, 25 bp, Mus musculus
aaaagatagcttactcctcgtcagg

SEQ ID NO: 2590 - DNA, 25 bp, Mus musculus
aaaagatagctttctcctcgtcagg

SEQ ID NO: 2591 - DNA, 25 bp, Mus musculus
aaaagatagtttaccttctgatatg

SEQ ID NO: 2592 - DNA, 25 bp, Mus musculus
aaaagatagttttccttctgatatg

SEQ ID NO: 2593 - DNA, 25 bp, Mus musculus
aaaagatatgtaatgcaggcccaga

SEQ ID NO: 2594 - DNA, 25 bp, Mus musculus
aaaagatatgtattgcaggcccaga

SEQ ID NO: 2595 - DNA, 25 bp, Mus musculus
aaaagatattgaatggtagactacc

SEQ ID NO: 2596 - DNA, 25 bp, Mus musculus
aaaagatattgattggtagactacc

SEQ ID NO: 2597 - DNA, 25 bp, Mus musculus
aaaagatcactcatcatctcgcttt

SEQ ID NO: 2598 - DNA, 25 bp, Mus musculus
aaaagatcactcttcatctcgcttt

SEQ ID NO: 2599 - DNA, 25 bp, Mus musculus
aaaagatcagccaccacagaagagt

SEQ ID NO: 2600 - DNA, 25 bp, Mus musculus
aaaagatcagcctccacagaagagt

SEQ ID NO: 2601 - DNA, 25 bp, Mus musculus
aaaagatcattaccaaccctacatc

SEQ ID NO: 2602 - DNA, 25 bp, Mus musculus
aaaagatcattagcaaccctacatc

SEQ ID NO: 2603 - DNA, 25 bp, Mus musculus
aaaagatccaatcggggctatgaac

SEQ ID NO: 2604 - DNA, 25 bp, Mus musculus
aaaagatccaatgggggctatgaac

SEQ ID NO: 2605 - DNA, 25 bp, Mus musculus
aaaagatccactagggctctgtcac

SEQ ID NO: 2606 - DNA, 25 bp, Mus musculus
aaaagatccacttgggctctgtcac

SEQ ID NO: 2607 - DNA, 25 bp, Mus musculus
aaaagatcccatccagagcggcctt

SEQ ID NO: 2608 - DNA, 25 bp, Mus musculus
aaaagatcccatgcagagcggcctt

SEQ ID NO: 2609 - DNA, 25 bp, Mus musculus
aaaagatccctgctgtgggccttca

SEQ ID NO: 2610 - DNA, 25 bp, Mus musculus
aaaagatccctggtgtgggccttca

SEQ ID NO: 2611 - DNA, 25 bp, Mus musculus
aaaagatccgaacacctatccaatg

SEQ ID NO: 2612 - DNA, 25 bp, Mus musculus
aaaagatccgaacggcatttgctgt

SEQ ID NO: 2613 - DNA, 25 bp, Mus musculus
aaaagatccgaagacctatccaatg

SEQ ID NO: 2614 - DNA, 25 bp, Mus musculus
aaaagatccgaagggcatttgctgt

SEQ ID NO: 2615 - DNA, 25 bp, Mus musculus
aaaagatccgatcattcctgtaatg

SEQ ID NO: 2616 - DNA, 25 bp, Mus musculus
aaaagatccgatgattcctgtaatg

SEQ ID NO: 2617 - DNA, 25 bp, Mus musculus
aaaagatcctcaactccagtgactt

SEQ ID NO: 2618 - DNA, 25 bp, Mus musculus
aaaagatcctcatctccagtgactt

SEQ ID NO: 2619 - DNA, 25 bp, Mus musculus
aaaagatcctggactgactgcccat

SEQ ID NO: 2620 - DNA, 25 bp, Mus musculus
aaaagatcctggtctgactgcccat

SEQ ID NO: 2621 - DNA, 25 bp, Mus musculus
aaaagatcgcctatactgtgtaaga

SEQ ID NO: 2622 - DNA, 25 bp, Mus musculus
aaaagatcgcctttactgtgtaaga

SEQ ID NO: 2623 - DNA, 25 bp, Mus musculus
aaaagatcgcgccggattattgctg

SEQ ID NO: 2624 - DNA, 25 bp, Mus musculus
aaaagatcgcgcgggattattgctg

SEQ ID NO: 2625 - DNA, 25 bp, Mus musculus
aaaagatctcacaggccaggtgccc

SEQ ID NO: 2626 - DNA, 25 bp, Mus musculus
aaaagatctcactggccaggtgccc

SEQ ID NO: 2627 - DNA, 25 bp, Mus musculus
aaaagatctcttctccctattgtca

SEQ ID NO: 2628 - DNA, 25 bp, Mus musculus
aaaagatctcttgtccctattgtca

SEQ ID NO: 2629 - DNA, 25 bp, Mus musculus
aaaagatctgataacctgctgctgt

SEQ ID NO: 2630 - DNA, 25 bp, Mus musculus
aaaagatctgattacctgctgctgt

SEQ ID NO: 2631 - DNA, 25 bp, Mus musculus
aaaagatctgccaagggccgtgaga

SEQ ID NO: 2632 - DNA, 25 bp, Mus musculus
aaaagatctgcctagggccgtgaga

SEQ ID NO: 2633 - DNA, 25 bp, Mus musculus
aaaagatcttagaccctgtctctct

SEQ ID NO: 2634 - DNA, 25 bp, Mus musculus
aaaagatcttagtccctgtctctct

SEQ ID NO: 2635 - DNA, 25 bp, Mus musculus
aaaagatgaactcttttgctttcct

SEQ ID NO: 2636 - DNA, 25 bp, Mus musculus
aaaagatgaactgttttgctttcct

SEQ ID NO: 2637 - DNA, 25 bp, Mus musculus
aaaagatgactaaaatccagctttc

SEQ ID NO: 2638 - DNA, 25 bp, Mus musculus
aaaagatgactataatccagctttc

SEQ ID NO: 2639 - DNA, 25 bp, Mus musculus
aaaagatgagtacctgaagccagtg

SEQ ID NO: 2640 - DNA, 25 bp, Mus musculus
aaaagatgagtagctgaagccagtg

SEQ ID NO: 2641 - DNA, 25 bp, Mus musculus
aaaagatgatttactgtcttcagaa

SEQ ID NO: 2642 - DNA, 25 bp, Mus musculus
aaaagatgattttctgtcttcagaa

SEQ ID NO: 2643 - DNA, 25 bp, Mus musculus
aaaagatgcagcctcaagcctccct

SEQ ID NO: 2644 - DNA, 25 bp, Mus musculus
aaaagatgcagcgtcaagcctccct

SEQ ID NO: 2645 - DNA, 25 bp, Mus musculus
aaaagatgccataattcacctccct

SEQ ID NO: 2646 - DNA, 25 bp, Mus musculus
aaaagatgccattattcacctccct

SEQ ID NO: 2647 - DNA, 25 bp, Mus musculus
aaaagatgcctactgctgtgctcaa

SEQ ID NO: 2648 - DNA, 25 bp, Mus musculus
aaaagatgcctagtgctgtgctcaa

SEQ ID NO: 2649 - DNA, 25 bp, Mus musculus
aaaagatgctcacggcgagaccttt

SEQ ID NO: 2650 - DNA, 25 bp, Mus musculus
aaaagatgctcagggcgagaccttt

SEQ ID NO: 2651 - DNA, 25 bp, Mus musculus
aaaagatggaacctttgctgcagga

SEQ ID NO: 2652 - DNA, 25 bp, Mus musculus
aaaagatggaacgtttgctgcagga

SEQ ID NO: 2653 - DNA, 25 bp, Mus musculus
aaaagatggataccctggccttgtc

SEQ ID NO: 2654 - DNA, 25 bp, Mus musculus
aaaagatggatagcctggccttgtc

SEQ ID NO: 2655 - DNA, 25 bp, Mus musculus
aaaagatggcaacgctgttaggctc

SEQ ID NO: 2656 - DNA, 25 bp, Mus musculus
aaaagatggcaaggctgttaggctc

SEQ ID NO: 2657 - DNA, 25 bp, Mus musculus
aaaagatggcccagttcttctggca

SEQ ID NO: 2658 - DNA, 25 bp, Mus musculus
aaaagatggccctgttcttctggca

SEQ ID NO: 2659 - DNA, 25 bp, Mus musculus
aaaagatgtcccagggctgggtgca

SEQ ID NO: 2660 - DNA, 25 bp, Mus musculus
aaaagatgtccctgggctgggtgca

SEQ ID NO: 2661 - DNA, 25 bp, Mus musculus
aaaagatgttatattgtgtttgact

SEQ ID NO: 2662 - DNA, 25 bp, Mus musculus
aaaagatgttattttgtgtttgact

SEQ ID NO: 2663 - DNA, 25 bp, Mus musculus
aaaagattaaaaccactggctgtat

SEQ ID NO: 2664 - DNA, 25 bp, Mus musculus
aaaagattaaaagcactggctgtat

SEQ ID NO: 2665 - DNA, 25 bp, Mus musculus
aaaagattgtctacctcactgggta

SEQ ID NO: 2666 - DNA, 25 bp, Mus musculus
aaaagattgtctcccagcagtttgc

SEQ ID NO: 2667 - DNA, 25 bp, Mus musculus
aaaagattgtctgccagcagtttgc

SEQ ID NO: 2668 - DNA, 25 bp, Mus musculus
aaaagattgtcttcctcactgggta

SEQ ID NO: 2669 - DNA, 25 bp, Mus musculus
aaaagatttcccacagtgctcactg

SEQ ID NO: 2670 - DNA, 25 bp, Mus musculus
aaaagatttccctcagtgctcactg

SEQ ID NO: 2671 - DNA, 25 bp, Mus musculus
aaaagatttcctctcgtggtggatt

SEQ ID NO: 2672 - DNA, 25 bp, Mus musculus
aaaagatttcctgtcgtggtggatt

SEQ ID NO: 2673 - DNA, 25 bp, Mus musculus
aaaagcaaaacgaaaagcagctagg

SEQ ID NO: 2674 - DNA, 25 bp, Mus musculus
aaaagcaaaacgtaaagcagctagg

SEQ ID NO: 2675 - DNA, 25 bp, Mus musculus
aaaagcaaaatcctcccattccaca

SEQ ID NO: 2676 - DNA, 25 bp, Mus musculus
aaaagcaaaatcgtcccattccaca

SEQ ID NO: 2677 - DNA, 25 bp, Mus musculus
aaaagcaaagcaccctaccgacaag

SEQ ID NO: 2678 - DNA, 25 bp, Mus musculus
aaaagcaaagcagcctaccgacaag

SEQ ID NO: 2679 - DNA, 25 bp, Mus musculus
aaaagcaaagcccagatttccacac

SEQ ID NO: 2680 - DNA, 25 bp, Mus musculus
aaaagcaaagccgagatttccacac

SEQ ID NO: 2681 - DNA, 25 bp, Mus musculus
aaaagcaaatcacacccaagggtgg

SEQ ID NO: 2682 - DNA, 25 bp, Mus musculus
aaaagcaaatcagacccaagggtgg

SEQ ID NO: 2683 - DNA, 25 bp, Mus musculus
aaaagcaaccatacttacttgtaag

SEQ ID NO: 2684 - DNA, 25 bp, Mus musculus
aaaagcaaccattcttacttgtaag

SEQ ID NO: 2685 - DNA, 25 bp, Mus musculus
aaaagcaactgcctgctgaccaaag

SEQ ID NO: 2686 - DNA, 25 bp, Mus musculus
aaaagcaactgcgtgctgaccaaag

SEQ ID NO: 2687 - DNA, 25 bp, Mus musculus
aaaagcaagctcctcattttctgac

SEQ ID NO: 2688 - DNA, 25 bp, Mus musculus
aaaagcaagctcgtcattttctgac

SEQ ID NO: 2689 - DNA, 25 bp, Mus musculus
aaaagcaagctgaatgaattcatta

SEQ ID NO: 2690 - DNA, 25 bp, Mus musculus
aaaagcaagctgtatgaattcatta

SEQ ID NO: 2691 - DNA, 25 bp, Mus musculus
aaaagcaaggctccacctgccgaaa

SEQ ID NO: 2692 - DNA, 25 bp, Mus musculus
aaaagcaaggctctgttctccacat

SEQ ID NO: 2693 - DNA, 25 bp, Mus musculus
aaaagcaaggctgcacctgccgaaa

SEQ ID NO: 2694 - DNA, 25 bp, Mus musculus
aaaagcaaggctgtgttctccacat

SEQ ID NO: 2695 - DNA, 25 bp, Mus musculus
aaaagcaataagcaagtggttccat

SEQ ID NO: 2696 - DNA, 25 bp, Mus musculus
aaaagcaataaggaagtggttccat

SEQ ID NO: 2697 - DNA, 25 bp, Mus musculus
aaaagcaatcacacttactgccgca

SEQ ID NO: 2698 - DNA, 25 bp, Mus musculus
aaaagcaatcactcttactgccgca

SEQ ID NO: 2699 - DNA, 25 bp, Mus musculus
aaaagcaatcagaaatccctaaata

SEQ ID NO: 2700 - DNA, 25 bp, Mus musculus
aaaagcaatcagtaatccctaaata

SEQ ID NO: 2701 - DNA, 25 bp, Mus musculus
aaaagcaatcctagtccttatagac

SEQ ID NO: 2702 - DNA, 25 bp, Mus musculus
aaaagcaatccttgtccttatagac

SEQ ID NO: 2703 - DNA, 25 bp, Mus musculus
aaaagcaatgccacgaactgacaga

SEQ ID NO: 2704 - DNA, 25 bp, Mus musculus
aaaagcaatgcctcgaactgacaga

SEQ ID NO: 2705 - DNA, 25 bp, Mus musculus
aaaagcaatgctatgtttacacagg

SEQ ID NO: 2706 - DNA, 25 bp, Mus musculus
aaaagcaatgctttgtttacacagg

SEQ ID NO: 2707 - DNA, 25 bp, Mus musculus
aaaagcacaacaatcgtctcatggg

SEQ ID NO: 2708 - DNA, 25 bp, Mus musculus
aaaagcacaacacaatcccagggat

SEQ ID NO: 2709 - DNA, 25 bp, Mus musculus
aaaagcacaacagaatcccagggat

SEQ ID NO: 2710 - DNA, 25 bp, Mus musculus
aaaagcacaacattcgtctcatggg

SEQ ID NO: 2711 - DNA, 25 bp, Mus musculus
aaaagcacaagacccttgcatgcgc

SEQ ID NO: 2712 - DNA, 25 bp, Mus musculus
aaaagcacaagagccttgcatgcgc

SEQ ID NO: 2713 - DNA, 25 bp, Mus musculus
aaaagcacagaccaggaaggcctca

SEQ ID NO: 2714 - DNA, 25 bp, Mus musculus
aaaagcacagacgaggaaggcctca

SEQ ID NO: 2715 - DNA, 25 bp, Mus musculus
aaaagcacatgtaagacacccctgt

SEQ ID NO: 2716 - DNA, 25 bp, Mus musculus
aaaagcacatgttagacacccctgt

SEQ ID NO: 2717 - DNA, 25 bp, Mus musculus
aaaagcaccagcaacctatgagaag

SEQ ID NO: 2718 - DNA, 25 bp, Mus musculus
aaaagcaccagctacctatgagaag

SEQ ID NO: 2719 - DNA, 25 bp, Mus musculus
aaaagcacccaaaacagacgaaatg

SEQ ID NO: 2720 - DNA, 25 bp, Mus musculus
aaaagcacccaatacagacgaaatg

SEQ ID NO: 2721 - DNA, 25 bp, Mus musculus
aaaagcaccctactgataccgctct

SEQ ID NO: 2722 - DNA, 25 bp, Mus musculus
aaaagcaccctagtgataccgctct

SEQ ID NO: 2723 - DNA, 25 bp, Mus musculus
aaaagcacctagatgtgttgatttc

SEQ ID NO: 2724 - DNA, 25 bp, Mus musculus
aaaagcacctagttgtgttgatttc

SEQ ID NO: 2725 - DNA, 25 bp, Mus musculus
aaaagcacgcacacacaagggacag

SEQ ID NO: 2726 - DNA, 25 bp, Mus musculus
aaaagcacgcactcacaagggacag

SEQ ID NO: 2727 - DNA, 25 bp, Mus musculus
aaaagcacgttcagtgcacacctcg

SEQ ID NO: 2728 - DNA, 25 bp, Mus musculus
aaaagcacgttctgtgcacacctcg

SEQ ID NO: 2729 - DNA, 25 bp, Mus musculus
aaaagcactaataggttggaaacat

SEQ ID NO: 2730 - DNA, 25 bp, Mus musculus
aaaagcactaattggttggaaacat

SEQ ID NO: 2731 - DNA, 25 bp, Mus musculus
aaaagcactagaccccatgatggaa

SEQ ID NO: 2732 - DNA, 25 bp, Mus musculus
aaaagcactagagcccatgatggaa

SEQ ID NO: 2733 - DNA, 25 bp, Mus musculus
aaaagcactagcagcttttccagag

SEQ ID NO: 2734 - DNA, 25 bp, Mus musculus
aaaagcactagctgcttttccagag

SEQ ID NO: 2735 - DNA, 25 bp, Mus musculus
aaaagcactctaaccttagtacttc

SEQ ID NO: 2736 - DNA, 25 bp, Mus musculus
aaaagcactctacgttatgttaata

SEQ ID NO: 2737 - DNA, 25 bp, Mus musculus
aaaagcactctaggttatgttaata

SEQ ID NO: 2738 - DNA, 25 bp, Mus musculus
aaaagcactctatccttagtacttc

SEQ ID NO: 2739 - DNA, 25 bp, Mus musculus
aaaagcactgctaccctcatgtgtg

SEQ ID NO: 2740 - DNA, 25 bp, Mus musculus
aaaagcactgcttccctcatgtgtg

SEQ ID NO: 2741 - DNA, 25 bp, Mus musculus
aaaagcacttgcactcagaaatgag

SEQ ID NO: 2742 - DNA, 25 bp, Mus musculus
aaaagcacttgctctcagaaatgag

SEQ ID NO: 2743 - DNA, 25 bp, Mus musculus
aaaagcacttggatgaaattgtact

SEQ ID NO: 2744 - DNA, 25 bp, Mus musculus
aaaagcacttggttgaaattgtact

SEQ ID NO: 2745 - DNA, 25 bp, Mus musculus
aaaagcagaagaccgacgccagcac

SEQ ID NO: 2746 - DNA, 25 bp, Mus musculus
aaaagcagaagagcgacgccagcac

SEQ ID NO: 2747 - DNA, 25 bp, Mus musculus
aaaagcagagggatcttgccaagat

SEQ ID NO: 2748 - DNA, 25 bp, Mus musculus
aaaagcagagggttcttgccaagat

SEQ ID NO: 2749 - DNA, 25 bp, Mus musculus
aaaagcagatgaaatccaggaggag

SEQ ID NO: 2750 - DNA, 25 bp, Mus musculus
aaaagcagatgactctatcccagcc

SEQ ID NO: 2751 - DNA, 25 bp, Mus musculus
aaaagcagatgagtctatcccagcc

SEQ ID NO: 2752 - DNA, 25 bp, Mus musculus
aaaagcagatgatatccaggaggag

SEQ ID NO: 2753 - DNA, 25 bp, Mus musculus
aaaagcagatgtcccctgactcaga

SEQ ID NO: 2754 - DNA, 25 bp, Mus musculus
aaaagcagatgtgccctgactcaga

SEQ ID NO: 2755 - DNA, 25 bp, Mus musculus
aaaagcagcaagctgtcccttctcg

SEQ ID NO: 2756 - DNA, 25 bp, Mus musculus
aaaagcagcaaggtgtcccttctcg

SEQ ID NO: 2757 - DNA, 25 bp, Mus musculus
aaaagcagcattacagtctcatttg

SEQ ID NO: 2758 - DNA, 25 bp, Mus musculus
aaaagcagcatttcagtctcatttg

SEQ ID NO: 2759 - DNA, 25 bp, Mus musculus
aaaagcagccacattattgctttga

SEQ ID NO: 2760 - DNA, 25 bp, Mus musculus
aaaagcagccactttattgctttga

SEQ ID NO: 2761 - DNA, 25 bp, Mus musculus
aaaagcagccgcaaaagcgttgaaa

SEQ ID NO: 2762 - DNA, 25 bp, Mus musculus
aaaagcagccgctaaagcgttgaaa

SEQ ID NO: 2763 - DNA, 25 bp, Mus musculus
aaaagcagcctcctgtgtattgcac

SEQ ID NO: 2764 - DNA, 25 bp, Mus musculus
aaaagcagcctcgtgtgtattgcac

SEQ ID NO: 2765 - DNA, 25 bp, Mus musculus
aaaagcagccttcgagaactgggaa

SEQ ID NO: 2766 - DNA, 25 bp, Mus musculus
aaaagcagccttggagaactgggaa

SEQ ID NO: 2767 - DNA, 25 bp, Mus musculus
aaaagcagcgcaattcatcggtgtc

SEQ ID NO: 2768 - DNA, 25 bp, Mus musculus
aaaagcagcgcatttcatcggtgtc

SEQ ID NO: 2769 - DNA, 25 bp, Mus musculus
aaaagcagcgttccctctccttaag

SEQ ID NO: 2770 - DNA, 25 bp, Mus musculus
aaaagcagcgttgcctctccttaag

SEQ ID NO: 2771 - DNA, 25 bp, Mus musculus
aaaagcagctcacaggtctgggctc

SEQ ID NO: 2772 - DNA, 25 bp, Mus musculus
aaaagcagctcagaggtctgggctc

SEQ ID NO: 2773 - DNA, 25 bp, Mus musculus
aaaagcagcttccagagttcaacat

SEQ ID NO: 2774 - DNA, 25 bp, Mus musculus
aaaagcagcttcgagagttcaacat

SEQ ID NO: 2775 - DNA, 25 bp, Mus musculus
aaaagcagtatcacccagtgactct

SEQ ID NO: 2776 - DNA, 25 bp, Mus musculus
aaaagcagtatctcccagtgactct

SEQ ID NO: 2777 - DNA, 25 bp, Mus musculus
aaaagcagtcctcccacgatgtcag

SEQ ID NO: 2778 - DNA, 25 bp, Mus musculus
aaaagcagtcctgccacgatgtcag

SEQ ID NO: 2779 - DNA, 25 bp, Mus musculus
aaaagcagtgacctcattcttgaag

SEQ ID NO: 2780 - DNA, 25 bp, Mus musculus
aaaagcagtgacgtcattcttgaag

SEQ ID NO: 2781 - DNA, 25 bp, Mus musculus
aaaagcagtgcaagcctaggctatt

SEQ ID NO: 2782 - DNA, 25 bp, Mus musculus
aaaagcagtgcatgcctaggctatt

SEQ ID NO: 2783 - DNA, 25 bp, Mus musculus
aaaagcagttcccaaagcagtcatg

SEQ ID NO: 2784 - DNA, 25 bp, Mus musculus
aaaagcagttccgaaagcagtcatg

SEQ ID NO: 2785 - DNA, 25 bp, Mus musculus
aaaagcagttggctccttctgatgc

SEQ ID NO: 2786 - DNA, 25 bp, Mus musculus
aaaagcagttgggtccttctgatgc

SEQ ID NO: 2787 - DNA, 25 bp, Mus musculus
aaaagcataaatcagccgggcgtgg

SEQ ID NO: 2788 - DNA, 25 bp, Mus musculus
aaaagcataaatgagccgggcgtgg

SEQ ID NO: 2789 - DNA, 25 bp, Mus musculus
aaaagcatacttctgttacatataa

SEQ ID NO: 2790 - DNA, 25 bp, Mus musculus
aaaagcatacttgtgttacatataa

SEQ ID NO: 2791 - DNA, 25 bp, Mus musculus
aaaagcatcatcattcacacctcag

SEQ ID NO: 2792 - DNA, 25 bp, Mus musculus
aaaagcatcatctttcacacctcag

SEQ ID NO: 2793 - DNA, 25 bp, Mus musculus
aaaagcatctgaacccttggagctg

SEQ ID NO: 2794 - DNA, 25 bp, Mus musculus
aaaagcatctgatcccttggagctg

SEQ ID NO: 2795 - DNA, 25 bp, Mus musculus
aaaagcatctgtccgcctgggtggc

SEQ ID NO: 2796 - DNA, 25 bp, Mus musculus
aaaagcatctgtgcgcctgggtggc

SEQ ID NO: 2797 - DNA, 25 bp, Mus musculus
aaaagcatctttaggttatcagtta

SEQ ID NO: 2798 - DNA, 25 bp, Mus musculus
aaaagcatcttttggttatcagtta

SEQ ID NO: 2799 - DNA, 25 bp, Mus musculus
aaaagcatgagccactcctggctta

SEQ ID NO: 2800 - DNA, 25 bp, Mus musculus
aaaagcatgagccttcctgccaagg

SEQ ID NO: 2801 - DNA, 25 bp, Mus musculus
aaaagcatgagcgactcctggctta

SEQ ID NO: 2802 - DNA, 25 bp, Mus musculus
aaaagcatgagcgttcctgccaagg

SEQ ID NO: 2803 - DNA, 25 bp, Mus musculus
aaaagcatgagtatggccgcggcag

SEQ ID NO: 2804 - DNA, 25 bp, Mus musculus
aaaagcatgagtcgcgacctccgtg

SEQ ID NO: 2805 - DNA, 25 bp, Mus musculus
aaaagcatgagtggcgacctccgtg

SEQ ID NO: 2806 - DNA, 25 bp, Mus musculus
aaaagcatgagtttggccgcggcag

SEQ ID NO: 2807 - DNA, 25 bp, Mus musculus
aaaagcatgatcaggcagggccagc

SEQ ID NO: 2808 - DNA, 25 bp, Mus musculus
aaaagcatgatctggcagggccagc

SEQ ID NO: 2809 - DNA, 25 bp, Mus musculus
aaaagcatgcaacagagaacaaggt

SEQ ID NO: 2810 - DNA, 25 bp, Mus musculus
aaaagcatgcaagagagaacaaggt

SEQ ID NO: 2811 - DNA, 25 bp, Mus musculus
aaaagcatgcctcgtgtcttaacac

SEQ ID NO: 2812 - DNA, 25 bp, Mus musculus
aaaagcatgcctggtgtcttaacac

SEQ ID NO: 2813 - DNA, 25 bp, Mus musculus
aaaagcatgctaagcccttctggag

SEQ ID NO: 2814 - DNA, 25 bp, Mus musculus
aaaagcatgctatgcccttctggag

SEQ ID NO: 2815 - DNA, 25 bp, Mus musculus
aaaagcatgcttccttacaacccca

SEQ ID NO: 2816 - DNA, 25 bp, Mus musculus
aaaagcatgcttgcttacaacccca

SEQ ID NO: 2817 - DNA, 25 bp, Mus musculus
aaaagcatgtgtcggtataatgggt

SEQ ID NO: 2818 - DNA, 25 bp, Mus musculus
aaaagcatgtgtgggtataatgggt

SEQ ID NO: 2819 - DNA, 25 bp, Mus musculus
aaaagcattagcacctctttcagag

SEQ ID NO: 2820 - DNA, 25 bp, Mus musculus
aaaagcattagctcctctttcagag

SEQ ID NO: 2821 - DNA, 25 bp, Mus musculus
aaaagcattagtacctgcccataat

SEQ ID NO: 2822 - DNA, 25 bp, Mus musculus
aaaagcattagttcctgcccataat

SEQ ID NO: 2823 - DNA, 25 bp, Mus musculus
aaaagcattcatcggcttctctcct

SEQ ID NO: 2824 - DNA, 25 bp, Mus musculus
aaaagcattcatgggcttctctcct

SEQ ID NO: 2825 - DNA, 25 bp, Mus musculus
aaaagcattctcaagcaaggcccca

SEQ ID NO: 2826 - DNA, 25 bp, Mus musculus
aaaagcattctctagcaaggcccca

SEQ ID NO: 2827 - DNA, 25 bp, Mus musculus
aaaagcattgtcatgagattattat

SEQ ID NO: 2828 - DNA, 25 bp, Mus musculus
aaaagcattgtcttgagattattat

SEQ ID NO: 2829 - DNA, 25 bp, Mus musculus
aaaagcattgtgacccaccatacag

SEQ ID NO: 2830 - DNA, 25 bp, Mus musculus
aaaagcattgtgtcccaccatacag

SEQ ID NO: 2831 - DNA, 25 bp, Mus musculus
aaaagcatttctcggtcctacatcc

SEQ ID NO: 2832 - DNA, 25 bp, Mus musculus
aaaagcatttctgggtcctacatcc

SEQ ID NO: 2833 - DNA, 25 bp, Mus musculus
aaaagcattttcaagtcttccctct

SEQ ID NO: 2834 - DNA, 25 bp, Mus musculus
aaaagcattttcagggactctctct

SEQ ID NO: 2835 - DNA, 25 bp, Mus musculus
aaaagcattttctagtcttccctct

SEQ ID NO: 2836 - DNA, 25 bp, Mus musculus
aaaagcattttctgggactctctct

SEQ ID NO: 2837 - DNA, 25 bp, Mus musculus
aaaagccaaatgaaccgagtagcat

SEQ ID NO: 2838 - DNA, 25 bp, Mus musculus
aaaagccaaatgtaccgagtagcat

SEQ ID NO: 2839 - DNA, 25 bp, Mus musculus
aaaagccaacaaattgaagaacgag

SEQ ID NO: 2840 - DNA, 25 bp, Mus musculus
aaaagccaacaatttgaagaacgag

SEQ ID NO: 2841 - DNA, 25 bp, Mus musculus
aaaagccaacctagggctacagaat

SEQ ID NO: 2842 - DNA, 25 bp, Mus musculus
aaaagccaaccttgggctacagaat

SEQ ID NO: 2843 - DNA, 25 bp, Mus musculus
aaaagccaactcaggcatgggagat

SEQ ID NO: 2844 - DNA, 25 bp, Mus musculus
aaaagccaactctggcatgggagat

SEQ ID NO: 2845 - DNA, 25 bp, Mus musculus
aaaagccaaggtccccatatggaaa

SEQ ID NO: 2846 - DNA, 25 bp, Mus musculus
aaaagccaaggtgcccatatggaaa

SEQ ID NO: 2847 - DNA, 25 bp, Mus musculus
aaaagccaatatctgctgttcctct

SEQ ID NO: 2848 - DNA, 25 bp, Mus musculus
aaaagccaatatgtgctgttcctct

SEQ ID NO: 2849 - DNA, 25 bp, Mus musculus
aaaagccacctaaccagaattggag

SEQ ID NO: 2850 - DNA, 25 bp, Mus musculus
aaaagccacctatccagaattggag

SEQ ID NO: 2851 - DNA, 25 bp, Mus musculus
aaaagccactacctgccagtgttga

SEQ ID NO: 2852 - DNA, 25 bp, Mus musculus
aaaagccactacgtgccagtgttga

SEQ ID NO: 2853 - DNA, 25 bp, Mus musculus
aaaagccactgactacatccacact

SEQ ID NO: 2854 - DNA, 25 bp, Mus musculus
aaaagccactgagtacatccacact

SEQ ID NO: 2855 - DNA, 25 bp, Mus musculus
aaaagccactgcagggatgctggcc

SEQ ID NO: 2856 - DNA, 25 bp, Mus musculus
aaaagccactgctgggatgctggcc

SEQ ID NO: 2857 - DNA, 25 bp, Mus musculus
aaaagccacttgcattagcatttta

SEQ ID NO: 2858 - DNA, 25 bp, Mus musculus
aaaagccacttggattagcatttta

SEQ ID NO: 2859 - DNA, 25 bp, Mus musculus
aaaagccagaacaccaactgatgag

SEQ ID NO: 2860 - DNA, 25 bp, Mus musculus
aaaagccagaactccaactgatgag

SEQ ID NO: 2861 - DNA, 25 bp, Mus musculus
aaaagccagaccagtgtgtgtcact

SEQ ID NO: 2862 - DNA, 25 bp, Mus musculus
aaaagccagaccattcacatggacc

SEQ ID NO: 2863 - DNA, 25 bp, Mus musculus
aaaagccagacctgtgtgtgtcact

SEQ ID NO: 2864 - DNA, 25 bp, Mus musculus
aaaagccagacctttcacatggacc

SEQ ID NO: 2865 - DNA, 25 bp, Mus musculus
aaaagccagcatcgtacctcatacc

SEQ ID NO: 2866 - DNA, 25 bp, Mus musculus
aaaagccagcatggtacctcatacc

SEQ ID NO: 2867 - DNA, 25 bp, Mus musculus
aaaagccagctcaattcggacttac

SEQ ID NO: 2868 - DNA, 25 bp, Mus musculus
aaaagccagctctattcggacttac

SEQ ID NO: 2869 - DNA, 25 bp, Mus musculus
aaaagccagcttccggtacgtgaca

SEQ ID NO: 2870 - DNA, 25 bp, Mus musculus
aaaagccagcttcttttgctgtctt

SEQ ID NO: 2871 - DNA, 25 bp, Mus musculus
aaaagccagcttgcggtacgtgaca

SEQ ID NO: 2872 - DNA, 25 bp, Mus musculus
aaaagccagcttgttttgctgtctt

SEQ ID NO: 2873 - DNA, 25 bp, Mus musculus
aaaagccaggcaagctccagctgag

SEQ ID NO: 2874 - DNA, 25 bp, Mus musculus
aaaagccaggcatgctccagctgag

SEQ ID NO: 2875 - DNA, 25 bp, Mus musculus
aaaagccaggctatgagctcctcat

SEQ ID NO: 2876 - DNA, 25 bp, Mus musculus
aaaagccaggctttgagctcctcat

SEQ ID NO: 2877 - DNA, 25 bp, Mus musculus
aaaagccagggccttatggtcccat

SEQ ID NO: 2878 - DNA, 25 bp, Mus musculus
aaaagccagggcgttatggtcccat

SEQ ID NO: 2879 - DNA, 25 bp, Mus musculus
aaaagccaggttatcagatggattg

SEQ ID NO: 2880 - DNA, 25 bp, Mus musculus
aaaagccaggttttcagatggattg

SEQ ID NO: 2881 - DNA, 25 bp, Mus musculus
aaaagccagtggatgttcagaattt

SEQ ID NO: 2882 - DNA, 25 bp, Mus musculus
aaaagccagtggttgttcagaattt

SEQ ID NO: 2883 - DNA, 25 bp, Mus musculus
aaaagccatatgagtgccgagagtg

SEQ ID NO: 2884 - DNA, 25 bp, Mus musculus
aaaagccatatgtgtgccgagagtg

SEQ ID NO: 2885 - DNA, 25 bp, Mus musculus
aaaagccatgacagacatgtcccac

SEQ ID NO: 2886 - DNA, 25 bp, Mus musculus
aaaagccatgacattcaccctctta

SEQ ID NO: 2887 - DNA, 25 bp, Mus musculus
aaaagccatgactgacatgtcccac

SEQ ID NO: 2888 - DNA, 25 bp, Mus musculus
aaaagccatgactttcaccctctta

SEQ ID NO: 2889 - DNA, 25 bp, Mus musculus
aaaagccatgctactcaaccaacat

SEQ ID NO: 2890 - DNA, 25 bp, Mus musculus
aaaagccatgcttctcaaccaacat

SEQ ID NO: 2891 - DNA, 25 bp, Mus musculus
aaaagccatggcctgaggactcgct

SEQ ID NO: 2892 - DNA, 25 bp, Mus musculus
aaaagccatggcgtgaggactcgct

SEQ ID NO: 2893 - DNA, 25 bp, Mus musculus
aaaagccattaaactgccagtcaag

SEQ ID NO: 2894 - DNA, 25 bp, Mus musculus
aaaagccattaatctgccagtcaag

SEQ ID NO: 2895 - DNA, 25 bp, Mus musculus
aaaagccattatagtgtcggaggaa

SEQ ID NO: 2896 - DNA, 25 bp, Mus musculus
aaaagccattattgtgtcggaggaa

SEQ ID NO: 2897 - DNA, 25 bp, Mus musculus
aaaagcccagcgacaatgcggttgc

SEQ ID NO: 2898 - DNA, 25 bp, Mus musculus
aaaagcccagcgtcaatgcggttgc

SEQ ID NO: 2899 - DNA, 25 bp, Mus musculus
aaaagcccagctcgttgctctctga

SEQ ID NO: 2900 - DNA, 25 bp, Mus musculus
aaaagcccagctggttgctctctga

SEQ ID NO: 2901 - DNA, 25 bp, Mus musculus
aaaagcccagtgaattcctcatgaa

SEQ ID NO: 2902 - DNA, 25 bp, Mus musculus
aaaagcccagtgtattcctcatgaa

SEQ ID NO: 2903 - DNA, 25 bp, Mus musculus
aaaagcccatgcacctgtggctgtg

SEQ ID NO: 2904 - DNA, 25 bp, Mus musculus
aaaagcccatgctcctgtggctgtg

SEQ ID NO: 2905 - DNA, 25 bp, Mus musculus
aaaagccccgtaacaaactgccatt

SEQ ID NO: 2906 - DNA, 25 bp, Mus musculus
aaaagccccgtatcaaactgccatt

SEQ ID NO: 2907 - DNA, 25 bp, Mus musculus
aaaagccccgtgcagtgtcttacaa

SEQ ID NO: 2908 - DNA, 25 bp, Mus musculus
aaaagccccgtggagtgtcttacaa

SEQ ID NO: 2909 - DNA, 25 bp, Mus musculus
aaaagcccctgcaagtaaggctcaa

SEQ ID NO: 2910 - DNA, 25 bp, Mus musculus
aaaagcccctgctagtaaggctcaa

SEQ ID NO: 2911 - DNA, 25 bp, Mus musculus
aaaagcccgcatcccaggcctggga

SEQ ID NO: 2912 - DNA, 25 bp, Mus musculus
aaaagcccgcatgccaggcctggga

SEQ ID NO: 2913 - DNA, 25 bp, Mus musculus
aaaagcccggagagtgacgtgttca

SEQ ID NO: 2914 - DNA, 25 bp, Mus musculus
aaaagcccggagtgtgacgtgttca

SEQ ID NO: 2915 - DNA, 25 bp, Mus musculus
aaaagccctactagcatttactgta

SEQ ID NO: 2916 - DNA, 25 bp, Mus musculus
aaaagccctacttgcatttactgta

SEQ ID NO: 2917 - DNA, 25 bp, Mus musculus
aaaagccctagaactgtcttccaag

SEQ ID NO: 2918 - DNA, 25 bp, Mus musculus
aaaagccctagatctgtcttccaag

SEQ ID NO: 2919 - DNA, 25 bp, Mus musculus
aaaagccctgttatggtttgaatgt

SEQ ID NO: 2920 - DNA, 25 bp, Mus musculus
aaaagccctgttttggtttgaatgt

SEQ ID NO: 2921 - DNA, 25 bp, Mus musculus
aaaagcccttgaacatcgactacat

SEQ ID NO: 2922 - DNA, 25 bp, Mus musculus
aaaagcccttgatcatcgactacat

SEQ ID NO: 2923 - DNA, 25 bp, Mus musculus
aaaagcccttgcctaatctggagcc

SEQ ID NO: 2924 - DNA, 25 bp, Mus musculus
aaaagcccttgcgtaatctggagcc

SEQ ID NO: 2925 - DNA, 25 bp, Mus musculus
aaaagccgagagatgcctaaggagc

SEQ ID NO: 2926 - DNA, 25 bp, Mus musculus
aaaagccgagagttgcctaaggagc

SEQ ID NO: 2927 - DNA, 25 bp, Mus musculus
aaaagccgatagactgtctgatggt

SEQ ID NO: 2928 - DNA, 25 bp, Mus musculus
aaaagccgatagtctgtctgatggt

SEQ ID NO: 2929 - DNA, 25 bp, Mus musculus
aaaagccgcatgcaaacttcttttt

SEQ ID NO: 2930 - DNA, 25 bp, Mus musculus
aaaagccgcatggaaacttcttttt

SEQ ID NO: 2931 - DNA, 25 bp, Mus musculus
aaaagccgcctcagtgcatttggtg

SEQ ID NO: 2932 - DNA, 25 bp, Mus musculus
aaaagccgcctctgtgcatttggtg

SEQ ID NO: 2933 - DNA, 25 bp, Mus musculus
aaaagccgcggaccgaactcgtgtt

SEQ ID NO: 2934 - DNA, 25 bp, Mus musculus
aaaagccgcggagcgaactcgtgtt

SEQ ID NO: 2935 - DNA, 25 bp, Mus musculus
aaaagccgggtaccctttgctcaga

SEQ ID NO: 2936 - DNA, 25 bp, Mus musculus
aaaagccgggtagcctttgctcaga

SEQ ID NO: 2937 - DNA, 25 bp, Mus musculus
aaaagccgtcccaaggagtcactgt

SEQ ID NO: 2938 - DNA, 25 bp, Mus musculus
aaaagccgtccctaggagtcactgt

SEQ ID NO: 2939 - DNA, 25 bp, Mus musculus
aaaagcctatttcttacacccagca

SEQ ID NO: 2940 - DNA, 25 bp, Mus musculus
aaaagcctatttgttacacccagca

SEQ ID NO: 2941 - DNA, 25 bp, Mus musculus
aaaagcctcaaaatgcatctctaat

SEQ ID NO: 2942 - DNA, 25 bp, Mus musculus
aaaagcctcaaattgcatctctaat

SEQ ID NO: 2943 - DNA, 25 bp, Mus musculus
aaaagcctcgcaacaacagctttga

SEQ ID NO: 2944 - DNA, 25 bp, Mus musculus
aaaagcctcgcatcaacagctttga

SEQ ID NO: 2945 - DNA, 25 bp, Mus musculus
aaaagcctctgtattctatcttgta

SEQ ID NO: 2946 - DNA, 25 bp, Mus musculus
aaaagcctctgttttctatcttgta

SEQ ID NO: 2947 - DNA, 25 bp, Mus musculus
aaaagcctgatgagtcctgggttgt

SEQ ID NO: 2948 - DNA, 25 bp, Mus musculus
aaaagcctgatgtgtcctgggttgt

SEQ ID NO: 2949 - DNA, 25 bp, Mus musculus
aaaagcctgcatccaaacttgctag

SEQ ID NO: 2950 - DNA, 25 bp, Mus musculus
aaaagcctgcatgcaaacttgctag

SEQ ID NO: 2951 - DNA, 25 bp, Mus musculus
aaaagcctgctaacttcactgaggg

SEQ ID NO: 2952 - DNA, 25 bp, Mus musculus
aaaagcctgctatcttcactgaggg

SEQ ID NO: 2953 - DNA, 25 bp, Mus musculus
aaaagcctggctctgttattgtccc

SEQ ID NO: 2954 - DNA, 25 bp, Mus musculus
aaaagcctggctgtgttattgtccc

SEQ ID NO: 2955 - DNA, 25 bp, Mus musculus
aaaagcctgggtcttatccatgctg

SEQ ID NO: 2956 - DNA, 25 bp, Mus musculus
aaaagcctgggtgttatccatgctg

SEQ ID NO: 2957 - DNA, 25 bp, Mus musculus
aaaagcctgtaaccctcaagagcta

SEQ ID NO: 2958 - DNA, 25 bp, Mus musculus
aaaagcctgtaagcctcaagagcta

SEQ ID NO: 2959 - DNA, 25 bp, Mus musculus
aaaagcctgtggcttgtttcctgtt

SEQ ID NO: 2960 - DNA, 25 bp, Mus musculus
aaaagcctgtgggttgtttcctgtt

SEQ ID NO: 2961 - DNA, 25 bp, Mus musculus
aaaagccttacacatgctcatggga

SEQ ID NO: 2962 - DNA, 25 bp, Mus musculus
aaaagccttacagatgctcatggga

SEQ ID NO: 2963 - DNA, 25 bp, Mus musculus
aaaagccttaccacttatcttcagg

SEQ ID NO: 2964 - DNA, 25 bp, Mus musculus
aaaagccttacctcttatcttcagg

SEQ ID NO: 2965 - DNA, 25 bp, Mus musculus
aaaagccttactccgtggtggtgcc

SEQ ID NO: 2966 - DNA, 25 bp, Mus musculus
aaaagccttactgcgtggtggtgcc

SEQ ID NO: 2967 - DNA, 25 bp, Mus musculus
aaaagccttcacagacatctctgaa

SEQ ID NO: 2968 - DNA, 25 bp, Mus musculus
aaaagccttcactgacatctctgaa

SEQ ID NO: 2969 - DNA, 25 bp, Mus musculus
aaaagccttcagagagtctggctgc

SEQ ID NO: 2970 - DNA, 25 bp, Mus musculus
aaaagccttcagtgagtctggctgc

SEQ ID NO: 2971 - DNA, 25 bp, Mus musculus
aaaagccttcatcacaagtactcgg

SEQ ID NO: 2972 - DNA, 25 bp, Mus musculus
aaaagccttcatgacaagtactcgg

SEQ ID NO: 2973 - DNA, 25 bp, Mus musculus
aaaagccttcgtattcaaagagcat

SEQ ID NO: 2974 - DNA, 25 bp, Mus musculus
aaaagccttcgttttcaaagagcat

SEQ ID NO: 2975 - DNA, 25 bp, Mus musculus
aaaagccttcttcatccatgggtag

SEQ ID NO: 2976 - DNA, 25 bp, Mus musculus
aaaagccttcttgatccatgggtag

SEQ ID NO: 2977 - DNA, 25 bp, Mus musculus
aaaagccttgctagtttcccagtag

SEQ ID NO: 2978 - DNA, 25 bp, Mus musculus
aaaagccttgcttgtttcccagtag

SEQ ID NO: 2979 - DNA, 25 bp, Mus musculus
aaaagccttggaagacttctacaaa

SEQ ID NO: 2980 - DNA, 25 bp, Mus musculus
aaaagccttggatgacttctacaaa

SEQ ID NO: 2981 - DNA, 25 bp, Mus musculus
aaaagcgagcggagctcctctgggc

SEQ ID NO: 2982 - DNA, 25 bp, Mus musculus
aaaagcgagcggtgctcctctgggc

SEQ ID NO: 2983 - DNA, 25 bp, Mus musculus
aaaagcgaggcgctgtccttgccgt

SEQ ID NO: 2984 - DNA, 25 bp, Mus musculus
aaaagcgaggcggtgtccttgccgt

SEQ ID NO: 2985 - DNA, 25 bp, Mus musculus
aaaagcgagttgattccatagttga

SEQ ID NO: 2986 - DNA, 25 bp, Mus musculus
aaaagcgagttgtttccatagttga

SEQ ID NO: 2987 - DNA, 25 bp, Mus musculus
aaaagcgcaagcaaattactttctg

SEQ ID NO: 2988 - DNA, 25 bp, Mus musculus
aaaagcgcaagcactcgacagcctt

SEQ ID NO: 2989 - DNA, 25 bp, Mus musculus
aaaagcgcaagctaattactttctg

SEQ ID NO: 2990 - DNA, 25 bp, Mus musculus
aaaagcgcaagctctcgacagcctt

SEQ ID NO: 2991 - DNA, 25 bp, Mus musculus
aaaagcgccagtctctacgcttgga

SEQ ID NO: 2992 - DNA, 25 bp, Mus musculus
aaaagcgccagtgtctacgcttgga

SEQ ID NO: 2993 - DNA, 25 bp, Mus musculus
aaaagcgcctaaactagaatttatc

SEQ ID NO: 2994 - DNA, 25 bp, Mus musculus
aaaagcgcctaatctagaatttatc

SEQ ID NO: 2995 - DNA, 25 bp, Mus musculus
aaaagcgctgctcttgtatgtctca

SEQ ID NO: 2996 - DNA, 25 bp, Mus musculus
aaaagcgctgctgttgtatgtctca

SEQ ID NO: 2997 - DNA, 25 bp, Mus musculus
aaaagcggccatcagatgagaatgc

SEQ ID NO: 2998 - DNA, 25 bp, Mus musculus
aaaagcggccatgagatgagaatgc

SEQ ID NO: 2999 - DNA, 25 bp, Mus musculus
aaaagcgggtcaatgcaaagggctg

SEQ ID NO: 3000 - DNA, 25 bp, Mus musculus
aaaagcgggtcattgcaaagggctg

SEQ ID NO: 3001 - DNA, 25 bp, Mus musculus
aaaagcggtacaatgccttcctgac

SEQ ID NO: 3002 - DNA, 25 bp, Mus musculus
aaaagcggtacattgccttcctgac

SEQ ID NO: 3003 - DNA, 25 bp, Mus musculus
aaaagcggtgtcaatgacgacccct

SEQ ID NO: 3004 - DNA, 25 bp, Mus musculus
aaaagcggtgtctatgacgacccct

SEQ ID NO: 3005 - DNA, 25 bp, Mus musculus
aaaagcgtaggcatgctggcctgag

SEQ ID NO: 3006 - DNA, 25 bp, Mus musculus
aaaagcgtaggcttgctggcctgag

SEQ ID NO: 3007 - DNA, 25 bp, Mus musculus
aaaagcgtccagatgccatgacctg

SEQ ID NO: 3008 - DNA, 25 bp, Mus musculus
aaaagcgtccagttgccatgacctg

SEQ ID NO: 3009 - DNA, 25 bp, Mus musculus
aaaagcgtctctcagatctttgtcc

SEQ ID NO: 3010 - DNA, 25 bp, Mus musculus
aaaagcgtctctgagatctttgtcc

SEQ ID NO: 3011 - DNA, 25 bp, Mus musculus
aaaagcgtcttcatcggaccagatt

SEQ ID NO: 3012 - DNA, 25 bp, Mus musculus
aaaagcgtcttcttcggaccagatt

SEQ ID NO: 3013 - DNA, 25 bp, Mus musculus
aaaagcgtgcttcctcatcgaggct

SEQ ID NO: 3014 - DNA, 25 bp, Mus musculus
aaaagcgtgcttgctcatcgaggct

SEQ ID NO: 3015 - DNA, 25 bp, Mus musculus
aaaagcgtggacagactgcatccta

SEQ ID NO: 3016 - DNA, 25 bp, Mus musculus
aaaagcgtggactgactgcatccta

SEQ ID NO: 3017 - DNA, 25 bp, Mus musculus
aaaagcgtggttatctgcagagtaa

SEQ ID NO: 3018 - DNA, 25 bp, Mus musculus
aaaagcgtggttttctgcagagtaa

SEQ ID NO: 3019 - DNA, 25 bp, Mus musculus
aaaagcgtgtttatcctgctccaaa

SEQ ID NO: 3020 - DNA, 25 bp, Mus musculus
aaaagcgtgtttttcctgctccaaa

SEQ ID NO: 3021 - DNA, 25 bp, Mus musculus
aaaagcgttcccattcgttgctgaa

SEQ ID NO: 3022 - DNA, 25 bp, Mus musculus
aaaagcgttccctttcgttgctgaa

SEQ ID NO: 3023 - DNA, 25 bp, Mus musculus
aaaagctaaccaataggcacctatt

SEQ ID NO: 3024 - DNA, 25 bp, Mus musculus
aaaagctaaccattaggcacctatt

SEQ ID NO: 3025 - DNA, 25 bp, Mus musculus
aaaagctaacttagtgggtgctcta

SEQ ID NO: 3026 - DNA, 25 bp, Mus musculus
aaaagctaactttgtgggtgctcta

SEQ ID NO: 3027 - DNA, 25 bp, Mus musculus
aaaagctaattgagtggcctggttg

SEQ ID NO: 3028 - DNA, 25 bp, Mus musculus
aaaagctaattgtgtggcctggttg

SEQ ID NO: 3029 - DNA, 25 bp, Mus musculus
aaaagctacgagatgcctgatgggc

SEQ ID NO: 3030 - DNA, 25 bp, Mus musculus
aaaagctacgagttgcctgatgggc

SEQ ID NO: 3031 - DNA, 25 bp, Mus musculus
aaaagctactagactggaccaggtg

SEQ ID NO: 3032 - DNA, 25 bp, Mus musculus
aaaagctactagtctggaccaggtg

SEQ ID NO: 3033 - DNA, 25 bp, Mus musculus
aaaagctactgtaatcccaactgcc

SEQ ID NO: 3034 - DNA, 25 bp, Mus musculus
aaaagctactgttatcccaactgcc

SEQ ID NO: 3035 - DNA, 25 bp, Mus musculus
aaaagctagcacatgacttcacaaa

SEQ ID NO: 3036 - DNA, 25 bp, Mus musculus
aaaagctagcacttgacttcacaaa

SEQ ID NO: 3037 - DNA, 25 bp, Mus musculus
aaaagctatcaacctgggccctgag

SEQ ID NO: 3038 - DNA, 25 bp, Mus musculus
aaaagctatcaagctgggccctgag

SEQ ID NO: 3039 - DNA, 25 bp, Mus musculus
aaaagctattgcctctgcatcacac

SEQ ID NO: 3040 - DNA, 25 bp, Mus musculus
aaaagctattgcgtctgcatcacac

SEQ ID NO: 3041 - DNA, 25 bp, Mus musculus
aaaagctatttacgctggttccagc

SEQ ID NO: 3042 - DNA, 25 bp, Mus musculus
aaaagctatttaggctggttccagc

SEQ ID NO: 3043 - DNA, 25 bp, Mus musculus
aaaagctcaagcatgcaaagtctga

SEQ ID NO: 3044 - DNA, 25 bp, Mus musculus
aaaagctcaagcttgcaaagtctga

SEQ ID NO: 3045 - DNA, 25 bp, Mus musculus
aaaagctcaagtagtgctgggcagt

SEQ ID NO: 3046 - DNA, 25 bp, Mus musculus
aaaagctcaagttgtgctgggcagt

SEQ ID NO: 3047 - DNA, 25 bp, Mus musculus
aaaagctcacctagctggttgtcag

SEQ ID NO: 3048 - DNA, 25 bp, Mus musculus
aaaagctcaccttgctggttgtcag

SEQ ID NO: 3049 - DNA, 25 bp, Mus musculus
aaaagctcacttcctgggtcctgct

SEQ ID NO: 3050 - DNA, 25 bp, Mus musculus
aaaagctcacttgctgggtcctgct

SEQ ID NO: 3051 - DNA, 25 bp, Mus musculus
aaaagctcagatccagctctgtaca

SEQ ID NO: 3052 - DNA, 25 bp, Mus musculus
aaaagctcagatgcagctctgtaca

SEQ ID NO: 3053 - DNA, 25 bp, Mus musculus
aaaagctcatacacctaaccctagg

SEQ ID NO: 3054 - DNA, 25 bp, Mus musculus
aaaagctcatactcctaaccctagg

SEQ ID NO: 3055 - DNA, 25 bp, Mus musculus
aaaagctcatgcctcgtttgcactc

SEQ ID NO: 3056 - DNA, 25 bp, Mus musculus
aaaagctcatgcgtcgtttgcactc

SEQ ID NO: 3057 - DNA, 25 bp, Mus musculus
aaaagctcccagattacttccatgt

SEQ ID NO: 3058 - DNA, 25 bp, Mus musculus
aaaagctcccagtttacttccatgt

SEQ ID NO: 3059 - DNA, 25 bp, Mus musculus
aaaagctccgctcaggaccaaagag

SEQ ID NO: 3060 - DNA, 25 bp, Mus musculus
aaaagctccgctgaggaccaaagag

SEQ ID NO: 3061 - DNA, 25 bp, Mus musculus
aaaagctcgcaaaccttgtcagcct

SEQ ID NO: 3062 - DNA, 25 bp, Mus musculus
aaaagctcgcaatccttgtcagcct

SEQ ID NO: 3063 - DNA, 25 bp, Mus musculus
aaaagctcggttaagagcccatgga

SEQ ID NO: 3064 - DNA, 25 bp, Mus musculus
aaaagctcggtttagagcccatgga

SEQ ID NO: 3065 - DNA, 25 bp, Mus musculus
aaaagctctaacatttggactcaag

SEQ ID NO: 3066 - DNA, 25 bp, Mus musculus
aaaagctctaacttttggactcaag

SEQ ID NO: 3067 - DNA, 25 bp, Mus musculus
aaaagctctagtcttgggtggtagt

SEQ ID NO: 3068 - DNA, 25 bp, Mus musculus
aaaagctctagtgttgggtggtagt

SEQ ID NO: 3069 - DNA, 25 bp, Mus musculus
aaaagctctcgcatgtcacaagaac

SEQ ID NO: 3070 - DNA, 25 bp, Mus musculus
aaaagctctcgcttgtcacaagaac

SEQ ID NO: 3071 - DNA, 25 bp, Mus musculus
aaaagctctctacttggcccagttt

SEQ ID NO: 3072 - DNA, 25 bp, Mus musculus
aaaagctctctagttggcccagttt

SEQ ID NO: 3073 - DNA, 25 bp, Mus musculus
aaaagctctcttacaatcatatcaa

SEQ ID NO: 3074 - DNA, 25 bp, Mus musculus
aaaagctctcttataatgtcccaga

SEQ ID NO: 3075 - DNA, 25 bp, Mus musculus
aaaagctctctttcaatcatatcaa

SEQ ID NO: 3076 - DNA, 25 bp, Mus musculus
aaaagctctcttttaatgtcccaga

SEQ ID NO: 3077 - DNA, 25 bp, Mus musculus
aaaagctctggcatcctgagaagga

SEQ ID NO: 3078 - DNA, 25 bp, Mus musculus
aaaagctctggcttcctgagaagga

SEQ ID NO: 3079 - DNA, 25 bp, Mus musculus
aaaagctctggtattccatcctttg

SEQ ID NO: 3080 - DNA, 25 bp, Mus musculus
aaaagctctggttttccatcctttg

SEQ ID NO: 3081 - DNA, 25 bp, Mus musculus
aaaagctcttccacgtccagcggaa

SEQ ID NO: 3082 - DNA, 25 bp, Mus musculus
aaaagctcttcctcgtccagcggaa

SEQ ID NO: 3083 - DNA, 25 bp, Mus musculus
aaaagctcttctactcttgcaacag

SEQ ID NO: 3084 - DNA, 25 bp, Mus musculus
aaaagctcttcttctcttgcaacag

SEQ ID NO: 3085 - DNA, 25 bp, Mus musculus
aaaagctgactgctcccaaggtcgt

SEQ ID NO: 3086 - DNA, 25 bp, Mus musculus
aaaagctgactggtcccaaggtcgt

SEQ ID NO: 3087 - DNA, 25 bp, Mus musculus
aaaagctgagtcagtccaaggagga

SEQ ID NO: 3088 - DNA, 25 bp, Mus musculus
aaaagctgagtctgtccaaggagga

SEQ ID NO: 3089 - DNA, 25 bp, Mus musculus
aaaagctgatgtacttctgtaaaag

SEQ ID NO: 3090 - DNA, 25 bp, Mus musculus
aaaagctgatgtatcttggcaagat

SEQ ID NO: 3091 - DNA, 25 bp, Mus musculus
aaaagctgatgttcttctgtaaaag

SEQ ID NO: 3092 - DNA, 25 bp, Mus musculus
aaaagctgatgtttcttggcaagat

SEQ ID NO: 3093 - DNA, 25 bp, Mus musculus
aaaagctgatttagctgctggacag

SEQ ID NO: 3094 - DNA, 25 bp, Mus musculus
aaaagctgattttgctgctggacag

SEQ ID NO: 3095 - DNA, 25 bp, Mus musculus
aaaagctgcagaacttccagcacct

SEQ ID NO: 3096 - DNA, 25 bp, Mus musculus
aaaagctgcagatcttccagcacct

SEQ ID NO: 3097 - DNA, 25 bp, Mus musculus
aaaagctgccacactcaccactgtt

SEQ ID NO: 3098 - DNA, 25 bp, Mus musculus
aaaagctgccactctcaccactgtt

SEQ ID NO: 3099 - DNA, 25 bp, Mus musculus
aaaagctgcccactgctcattgcat

SEQ ID NO: 3100 - DNA, 25 bp, Mus musculus
aaaagctgcccagtgctcattgcat

SEQ ID NO: 3101 - DNA, 25 bp, Mus musculus
aaaagctgccgcaaccccgaagagt

SEQ ID NO: 3102 - DNA, 25 bp, Mus musculus
aaaagctgccgctaccccgaagagt

SEQ ID NO: 3103 - DNA, 25 bp, Mus musculus
aaaagctgcctcagggtagtgccca

SEQ ID NO: 3104 - DNA, 25 bp, Mus musculus
aaaagctgcctctgggtagtgccca

SEQ ID NO: 3105 - DNA, 25 bp, Mus musculus
aaaagctgccttcctggactgggaa

SEQ ID NO: 3106 - DNA, 25 bp, Mus musculus
aaaagctgccttgctggactgggaa

SEQ ID NO: 3107 - DNA, 25 bp, Mus musculus
aaaagctgcgtgagaagtccccagt

SEQ ID NO: 3108 - DNA, 25 bp, Mus musculus
aaaagctgcgtgtgaagtccccagt

SEQ ID NO: 3109 - DNA, 25 bp, Mus musculus
aaaagctgctatccttggtaccaag

SEQ ID NO: 3110 - DNA, 25 bp, Mus musculus
aaaagctgctatgcttggtaccaag

SEQ ID NO: 3111 - DNA, 25 bp, Mus musculus
aaaagctgctgcatctctgtgatct

SEQ ID NO: 3112 - DNA, 25 bp, Mus musculus
aaaagctgctgcttctctgtgatct

SEQ ID NO: 3113 - DNA, 25 bp, Mus musculus
aaaagctgctttcgagccagccctc

SEQ ID NO: 3114 - DNA, 25 bp, Mus musculus
aaaagctgctttggagccagccctc

SEQ ID NO: 3115 - DNA, 25 bp, Mus musculus
aaaagctggaaacggcagtactgct

SEQ ID NO: 3116 - DNA, 25 bp, Mus musculus
aaaagctggaaagggcagtactgct

SEQ ID NO: 3117 - DNA, 25 bp, Mus musculus
aaaagctggcatctgacccggctct

SEQ ID NO: 3118 - DNA, 25 bp, Mus musculus
aaaagctggcatgtgacccggctct

SEQ ID NO: 3119 - DNA, 25 bp, Mus musculus
aaaagctggctgagattcacaacat

SEQ ID NO: 3120 - DNA, 25 bp, Mus musculus
aaaagctggctgtgattcacaacat

SEQ ID NO: 3121 - DNA, 25 bp, Mus musculus
aaaagctgggcaatgtcccacacac

SEQ ID NO: 3122 - DNA, 25 bp, Mus musculus
aaaagctgggcattgtcccacacac

SEQ ID NO: 3123 - DNA, 25 bp, Mus musculus
aaaagctgggctccaagcccttcaa

SEQ ID NO: 3124 - DNA, 25 bp, Mus musculus
aaaagctgggctgcaagcccttcaa

SEQ ID NO: 3125 - DNA, 25 bp, Mus musculus
aaaagctgggtcacggaactgccta

SEQ ID NO: 3126 - DNA, 25 bp, Mus musculus
aaaagctgggtctcggaactgccta

SEQ ID NO: 3127 - DNA, 25 bp, Mus musculus
aaaagctgggtgagttgcatgttaa

SEQ ID NO: 3128 - DNA, 25 bp, Mus musculus
aaaagctgggtgtgttgcatgttaa

SEQ ID NO: 3129 - DNA, 25 bp, Mus musculus
aaaagctgtaacataggaccagtga

SEQ ID NO: 3130 - DNA, 25 bp, Mus musculus
aaaagctgtaacttaggaccagtga

SEQ ID NO: 3131 - DNA, 25 bp, Mus musculus
aaaagctgtccacccactacaggga

SEQ ID NO: 3132 - DNA, 25 bp, Mus musculus
aaaagctgtccagccactacaggga

SEQ ID NO: 3133 - DNA, 25 bp, Mus musculus
aaaagctgtctcctctaagagcctg

SEQ ID NO: 3134 - DNA, 25 bp, Mus musculus
aaaagctgtctcgtctaagagcctg

SEQ ID NO: 3135 - DNA, 25 bp, Mus musculus
aaaagctgtcttcagggcactaatt

SEQ ID NO: 3136 - DNA, 25 bp, Mus musculus
aaaagctgtcttgagggcactaatt

SEQ ID NO: 3137 - DNA, 25 bp, Mus musculus
aaaagctgtgcacgagttcctggcc

SEQ ID NO: 3138 - DNA, 25 bp, Mus musculus
aaaagctgtgcacgcggaatcatcg

SEQ ID NO: 3139 - DNA, 25 bp, Mus musculus
aaaagctgtgcaggagttcctggcc

SEQ ID NO: 3140 - DNA, 25 bp, Mus musculus
aaaagctgtgcaggcggaatcatcg

SEQ ID NO: 3141 - DNA, 25 bp, Mus musculus
aaaagctgtgttccgatgactccta

SEQ ID NO: 3142 - DNA, 25 bp, Mus musculus
aaaagctgtgttgcgatgactccta

SEQ ID NO: 3143 - DNA, 25 bp, Mus musculus
aaaagctgttacacagccttcctgt

SEQ ID NO: 3144 - DNA, 25 bp, Mus musculus
aaaagctgttactcagccttcctgt

SEQ ID NO: 3145 - DNA, 25 bp, Mus musculus
aaaagctgttctatttcagcagtac

SEQ ID NO: 3146 - DNA, 25 bp, Mus musculus
aaaagctgttctttttcagcagtac

SEQ ID NO: 3147 - DNA, 25 bp, Mus musculus
aaaagcttaccccaaggacagtctg

SEQ ID NO: 3148 - DNA, 25 bp, Mus musculus
aaaagcttacccgaaggacagtctg

SEQ ID NO: 3149 - DNA, 25 bp, Mus musculus
aaaagcttagataacataggatgaa

SEQ ID NO: 3150 - DNA, 25 bp, Mus musculus
aaaagcttagattacataggatgaa

SEQ ID NO: 3151 - DNA, 25 bp, Mus musculus
aaaagcttagtcagaccagtctgat

SEQ ID NO: 3152 - DNA, 25 bp, Mus musculus
aaaagcttagtctgaccagtctgat

SEQ ID NO: 3153 - DNA, 25 bp, Mus musculus
aaaagcttagttagccacaaaggct

SEQ ID NO: 3154 - DNA, 25 bp, Mus musculus
aaaagcttagttagcgttcgtgtat

SEQ ID NO: 3155 - DNA, 25 bp, Mus musculus
aaaagcttagtttgccacaaaggct

SEQ ID NO: 3156 - DNA, 25 bp, Mus musculus
aaaagcttagtttgcgttcgtgtat

SEQ ID NO: 3157 - DNA, 25 bp, Mus musculus
aaaagcttcaaaaacagtgtgtagt

SEQ ID NO: 3158 - DNA, 25 bp, Mus musculus
aaaagcttcaaatacagtgtgtagt

SEQ ID NO: 3159 - DNA, 25 bp, Mus musculus
aaaagcttcagcaatacttcccact

SEQ ID NO: 3160 - DNA, 25 bp, Mus musculus
aaaagcttcagccactggtcgaagc

SEQ ID NO: 3161 - DNA, 25 bp, Mus musculus
aaaagcttcagcgactggtcgaagc

SEQ ID NO: 3162 - DNA, 25 bp, Mus musculus
aaaagcttcagctatacttcccact

SEQ ID NO: 3163 - DNA, 25 bp, Mus musculus
aaaagcttcatcactggaggtggaa

SEQ ID NO: 3164 - DNA, 25 bp, Mus musculus
aaaagcttcatctctggaggtggaa

SEQ ID NO: 3165 - DNA, 25 bp, Mus musculus
aaaagcttcattactccgatgcaga

SEQ ID NO: 3166 - DNA, 25 bp, Mus musculus
aaaagcttcatttctccgatgcaga

SEQ ID NO: 3167 - DNA, 25 bp, Mus musculus
aaaagcttctcgaggctggtggagt

SEQ ID NO: 3168 - DNA, 25 bp, Mus musculus
aaaagcttctcgtggctggtggagt

SEQ ID NO: 3169 - DNA, 25 bp, Mus musculus
aaaagcttcttacagaactctgact

SEQ ID NO: 3170 - DNA, 25 bp, Mus musculus
aaaagcttcttagagaactctgact

SEQ ID NO: 3171 - DNA, 25 bp, Mus musculus
aaaagcttgaacaggcagcccagag

SEQ ID NO: 3172 - DNA, 25 bp, Mus musculus
aaaagcttgaactggcagcccagag

SEQ ID NO: 3173 - DNA, 25 bp, Mus musculus
aaaagcttgcttcctgaaaccatca

SEQ ID NO: 3174 - DNA, 25 bp, Mus musculus
aaaagcttgcttgctgaaaccatca

SEQ ID NO: 3175 - DNA, 25 bp, Mus musculus
aaaagcttgggaacacatggtagaa

SEQ ID NO: 3176 - DNA, 25 bp, Mus musculus
aaaagcttgggaacagaactgtttc

SEQ ID NO: 3177 - DNA, 25 bp, Mus musculus
aaaagcttgggatcacatggtagaa

SEQ ID NO: 3178 - DNA, 25 bp, Mus musculus
aaaagcttgggatcagaactgtttc

SEQ ID NO: 3179 - DNA, 25 bp, Mus musculus
aaaagcttgtccattgcaacctgat

SEQ ID NO: 3180 - DNA, 25 bp, Mus musculus
aaaagcttgtcctttgcaacctgat

SEQ ID NO: 3181 - DNA, 25 bp, Mus musculus
aaaagcttgtgaactctgtcctgag

SEQ ID NO: 3182 - DNA, 25 bp, Mus musculus
aaaagcttgtgaactgtatccagaa

SEQ ID NO: 3183 - DNA, 25 bp, Mus musculus
aaaagcttgtgatctctgtcctgag

SEQ ID NO: 3184 - DNA, 25 bp, Mus musculus
aaaagcttgtgatctgtatccagaa

SEQ ID NO: 3185 - DNA, 25 bp, Mus musculus
aaaagctttcctccagagtcttgtg

SEQ ID NO: 3186 - DNA, 25 bp, Mus musculus
aaaagctttcctgcagagtcttgtg

SEQ ID NO: 3187 - DNA, 25 bp, Mus musculus
aaaagctttggcagacctcatgctt

SEQ ID NO: 3188 - DNA, 25 bp, Mus musculus
aaaagctttggctgacctcatgctt

SEQ ID NO: 3189 - DNA, 25 bp, Mus musculus
aaaagcttttgaatactggatgtac

SEQ ID NO: 3190 - DNA, 25 bp, Mus musculus
aaaagcttttgattactggatgtac

SEQ ID NO: 3191 - DNA, 25 bp, Mus musculus
aaaaggaaaacccactgctaatcat

SEQ ID NO: 3192 - DNA, 25 bp, Mus musculus
aaaaggaaaaccgactgctaatcat

SEQ ID NO: 3193 - DNA, 25 bp, Mus musculus
aaaaggaaacaactagctgggcagt

SEQ ID NO: 3194 - DNA, 25 bp, Mus musculus
aaaaggaaacaagtagctgggcagt

SEQ ID NO: 3195 - DNA, 25 bp, Mus musculus
aaaaggaacactagcattctcatgc

SEQ ID NO: 3196 - DNA, 25 bp, Mus musculus
aaaaggaacacttgcattctcatgc

SEQ ID NO: 3197 - DNA, 25 bp, Mus musculus
aaaaggaaccttcccgcggcgtcat

SEQ ID NO: 3198 - DNA, 25 bp, Mus musculus
aaaaggaaccttgccgcggcgtcat

SEQ ID NO: 3199 - DNA, 25 bp, Mus musculus
aaaaggaacttacctggctgtggtg

SEQ ID NO: 3200 - DNA, 25 bp, Mus musculus
aaaaggaacttagctggctgtggtg

SEQ ID NO: 3201 - DNA, 25 bp, Mus musculus
aaaaggaacttcaaccactcacctg

SEQ ID NO: 3202 - DNA, 25 bp, Mus musculus
aaaaggaacttctaccactcacctg

SEQ ID NO: 3203 - DNA, 25 bp, Mus musculus
aaaaggaagcacaccgccaggatca

SEQ ID NO: 3204 - DNA, 25 bp, Mus musculus
aaaaggaagcactccgccaggatca

SEQ ID NO: 3205 - DNA, 25 bp, Mus musculus
aaaaggaagcgtccgctcttgcggc

SEQ ID NO: 3206 - DNA, 25 bp, Mus musculus
aaaaggaagcgtgcgctcttgcggc

SEQ ID NO: 3207 - DNA, 25 bp, Mus musculus
aaaaggaagtatatgctgcagtttt

SEQ ID NO: 3208 - DNA, 25 bp, Mus musculus
aaaaggaagtatttgctgcagtttt

SEQ ID NO: 3209 - DNA, 25 bp, Mus musculus
aaaaggaagtcaccatctctaagcg

SEQ ID NO: 3210 - DNA, 25 bp, Mus musculus
aaaaggaagtcagcatctctaagcg

SEQ ID NO: 3211 - DNA, 25 bp, Mus musculus
aaaaggaatcgtcgctggcactgga

SEQ ID NO: 3212 - DNA, 25 bp, Mus musculus
aaaaggaatcgtggctggcactgga

SEQ ID NO: 3213 - DNA, 25 bp, Mus musculus
aaaaggacaatcaaggtgccccact

SEQ ID NO: 3214 - DNA, 25 bp, Mus musculus
aaaaggacaatctaggtgccccact

SEQ ID NO: 3215 - DNA, 25 bp, Mus musculus
aaaaggacacgtctggcccttatgt

SEQ ID NO: 3216 - DNA, 25 bp, Mus musculus
aaaaggacacgtgtggcccttatgt

SEQ ID NO: 3217 - DNA, 25 bp, Mus musculus
aaaaggaccaatatgcatagtgcaa

SEQ ID NO: 3218 - DNA, 25 bp, Mus musculus
aaaaggaccaatttgcatagtgcaa

SEQ ID NO: 3219 - DNA, 25 bp, Mus musculus
aaaaggaccgcacggacagacgcct

SEQ ID NO: 3220 - DNA, 25 bp, Mus musculus
aaaaggaccgcagggacagacgcct

SEQ ID NO: 3221 - DNA, 25 bp, Mus musculus
aaaaggactactaactagcctgcat

SEQ ID NO: 3222 - DNA, 25 bp, Mus musculus
aaaaggactacttactagcctgcat

SEQ ID NO: 3223 - DNA, 25 bp, Mus musculus
aaaaggactagcattgaaaaccaat

SEQ ID NO: 3224 - DNA, 25 bp, Mus musculus
aaaaggactagctttgaaaaccaat

SEQ ID NO: 3225 - DNA, 25 bp, Mus musculus
aaaaggactgacacccagaccaatg

SEQ ID NO: 3226 - DNA, 25 bp, Mus musculus
aaaaggactgactcccagaccaatg

SEQ ID NO: 3227 - DNA, 25 bp, Mus musculus
aaaaggactggcctccatgacattc

SEQ ID NO: 3228 - DNA, 25 bp, Mus musculus
aaaaggactggcgtccatgacattc

SEQ ID NO: 3229 - DNA, 25 bp, Mus musculus
aaaaggactgtgactctgtcagaca

SEQ ID NO: 3230 - DNA, 25 bp, Mus musculus
aaaaggactgtgtctctgtcagaca

SEQ ID NO: 3231 - DNA, 25 bp, Mus musculus
aaaaggactttcagtcactgcctaa

SEQ ID NO: 3232 - DNA, 25 bp, Mus musculus
aaaaggactttctgtcactgcctaa

SEQ ID NO: 3233 - DNA, 25 bp, Mus musculus
aaaaggagaaacagcaggcgaggca

SEQ ID NO: 3234 - DNA, 25 bp, Mus musculus
aaaaggagaaactgcaggcgaggca

SEQ ID NO: 3235 - DNA, 25 bp, Mus musculus
aaaaggagattcacatcggaagtaa

SEQ ID NO: 3236 - DNA, 25 bp, Mus musculus
aaaaggagattctcatcggaagtaa

SEQ ID NO: 3237 - DNA, 25 bp, Mus musculus
aaaaggagcaaaccgaggacctgga

SEQ ID NO: 3238 - DNA, 25 bp, Mus musculus
aaaaggagcaaagcgaggacctgga

SEQ ID NO: 3239 - DNA, 25 bp, Mus musculus
aaaaggagcctcagctatctactgc

SEQ ID NO: 3240 - DNA, 25 bp, Mus musculus
aaaaggagcctctgctatctactgc

SEQ ID NO: 3241 - DNA, 25 bp, Mus musculus
aaaaggagctgcatggtccctcctt

SEQ ID NO: 3242 - DNA, 25 bp, Mus musculus
aaaaggagctgcttggtccctcctt

SEQ ID NO: 3243 - DNA, 25 bp, Mus musculus
aaaaggaggcaccacccatggagaa

SEQ ID NO: 3244 - DNA, 25 bp, Mus musculus
aaaaggaggcacgacccatggagaa

SEQ ID NO: 3245 - DNA, 25 bp, Mus musculus
aaaaggagtactagccctgcgtcct

SEQ ID NO: 3246 - DNA, 25 bp, Mus musculus
aaaaggagtacttgccctgcgtcct

SEQ ID NO: 3247 - DNA, 25 bp, Mus musculus
aaaaggagtccaacccacaattctg

SEQ ID NO: 3248 - DNA, 25 bp, Mus musculus
aaaaggagtccatcccacaattctg

SEQ ID NO: 3249 - DNA, 25 bp, Mus musculus
aaaaggagtgcccagctcctttcct

SEQ ID NO: 3250 - DNA, 25 bp, Mus musculus
aaaaggagtgccgagctcctttcct

SEQ ID NO: 3251 - DNA, 25 bp, Mus musculus
aaaaggagtgtcacggcttgcctgc

SEQ ID NO: 3252 - DNA, 25 bp, Mus musculus
aaaaggagtgtctcggcttgcctgc

SEQ ID NO: 3253 - DNA, 25 bp, Mus musculus
aaaaggagtgtgagaatgcacgcca

SEQ ID NO: 3254 - DNA, 25 bp, Mus musculus
aaaaggagtgtgtgaatgcacgcca

SEQ ID NO: 3255 - DNA, 25 bp, Mus musculus
aaaaggatccacatgactcaaatga

SEQ ID NO: 3256 - DNA, 25 bp, Mus musculus
aaaaggatccacttgactcaaatga

SEQ ID NO: 3257 - DNA, 25 bp, Mus musculus
aaaaggatggccagtctcatgtatc

SEQ ID NO: 3258 - DNA, 25 bp, Mus musculus
aaaaggatggcctgtctcatgtatc

SEQ ID NO: 3259 - DNA, 25 bp, Mus musculus
aaaaggatgtccacatgcctaagca

SEQ ID NO: 3260 - DNA, 25 bp, Mus musculus
aaaaggatgtcctcatgcctaagca

SEQ ID NO: 3261 - DNA, 25 bp, Mus musculus
aaaaggattctgaggcagcctaccc

SEQ ID NO: 3262 - DNA, 25 bp, Mus musculus
aaaaggattctgtggcagcctaccc

SEQ ID NO: 3263 - DNA, 25 bp, Mus musculus
aaaaggattggtctgtgacagtccg

SEQ ID NO: 3264 - DNA, 25 bp, Mus musculus
aaaaggattggtgtgtgacagtccg

SEQ ID NO: 3265 - DNA, 25 bp, Mus musculus
aaaaggcaacaaacattccagagtg

SEQ ID NO: 3266 - DNA, 25 bp, Mus musculus
aaaaggcaacaatcattccagagtg

SEQ ID NO: 3267 - DNA, 25 bp, Mus musculus
aaaaggcaacggagcttgtgtctgg

SEQ ID NO: 3268 - DNA, 25 bp, Mus musculus
aaaaggcaacggtgcttgtgtctgg

SEQ ID NO: 3269 - DNA, 25 bp, Mus musculus
aaaaggcacctcatgcctgaagcag

SEQ ID NO: 3270 - DNA, 25 bp, Mus musculus
aaaaggcacctcttgcctgaagcag

SEQ ID NO: 3271 - DNA, 25 bp, Mus musculus
aaaaggcactcaccctgagttgtta

SEQ ID NO: 3272 - DNA, 25 bp, Mus musculus
aaaaggcactcagcctgagttgtta

SEQ ID NO: 3273 - DNA, 25 bp, Mus musculus
aaaaggcactgacccggcggaccgt

SEQ ID NO: 3274 - DNA, 25 bp, Mus musculus
aaaaggcactgagccggcggaccgt

SEQ ID NO: 3275 - DNA, 25 bp, Mus musculus
aaaaggcactgtaagtctcttctag

SEQ ID NO: 3276 - DNA, 25 bp, Mus musculus
aaaaggcactgttagtctcttctag

SEQ ID NO: 3277 - DNA, 25 bp, Mus musculus
aaaaggcagagcattcaaccccaac

SEQ ID NO: 3278 - DNA, 25 bp, Mus musculus
aaaaggcagagctttcaaccccaac

SEQ ID NO: 3279 - DNA, 25 bp, Mus musculus
aaaaggcagattatcagcaagctct

SEQ ID NO: 3280 - DNA, 25 bp, Mus musculus
aaaaggcagattttcagcaagctct

SEQ ID NO: 3281 - DNA, 25 bp, Mus musculus
aaaaggcagtcaccgcatttctgag

SEQ ID NO: 3282 - DNA, 25 bp, Mus musculus
aaaaggcagtcagcgcatttctgag

SEQ ID NO: 3283 - DNA, 25 bp, Mus musculus
aaaaggcatcttacagtgcagtttt

SEQ ID NO: 3284 - DNA, 25 bp, Mus musculus
aaaaggcatctttcagtgcagtttt

SEQ ID NO: 3285 - DNA, 25 bp, Mus musculus
aaaaggcattgtcctctccattgag

SEQ ID NO: 3286 - DNA, 25 bp, Mus musculus
aaaaggcattgtgctctccattgag

SEQ ID NO: 3287 - DNA, 25 bp, Mus musculus
aaaaggccaccgaatccattctgaa

SEQ ID NO: 3288 - DNA, 25 bp, Mus musculus
aaaaggccaccgtatccattctgaa

SEQ ID NO: 3289 - DNA, 25 bp, Mus musculus
aaaaggccacctagtgcctaggcta

SEQ ID NO: 3290 - DNA, 25 bp, Mus musculus
aaaaggccaccttgtgcctaggcta

SEQ ID NO: 3291 - DNA, 25 bp, Mus musculus
aaaaggccagacatagcgtgctgca

SEQ ID NO: 3292 - DNA, 25 bp, Mus musculus
aaaaggccagacttagcgtgctgca

SEQ ID NO: 3293 - DNA, 25 bp, Mus musculus
aaaaggccagttatgagtctcatca

SEQ ID NO: 3294 - DNA, 25 bp, Mus musculus
aaaaggccagttttgagtctcatca

SEQ ID NO: 3295 - DNA, 25 bp, Mus musculus
aaaaggccattgcaccatcttggtg

SEQ ID NO: 3296 - DNA, 25 bp, Mus musculus
aaaaggccattggaccatcttggtg

SEQ ID NO: 3297 - DNA, 25 bp, Mus musculus
aaaaggccctgcagaccacctatgg

SEQ ID NO: 3298 - DNA, 25 bp, Mus musculus
aaaaggccctgctgaccacctatgg

SEQ ID NO: 3299 - DNA, 25 bp, Mus musculus
aaaaggccctggagtcaggcaaggc

SEQ ID NO: 3300 - DNA, 25 bp, Mus musculus
aaaaggccctggtgtcaggcaaggc

SEQ ID NO: 3301 - DNA, 25 bp, Mus musculus
aaaaggccctgtacagagccctgaa

SEQ ID NO: 3302 - DNA, 25 bp, Mus musculus
aaaaggccctgttcagagccctgaa

SEQ ID NO: 3303 - DNA, 25 bp, Mus musculus
aaaaggccgactcagcctaacggat

SEQ ID NO: 3304 - DNA, 25 bp, Mus musculus
aaaaggccgactgagcctaacggat

SEQ ID NO: 3305 - DNA, 25 bp, Mus musculus
aaaaggccgagaccttttctgtcgg

SEQ ID NO: 3306 - DNA, 25 bp, Mus musculus
aaaaggccgagagcttttctgtcgg

SEQ ID NO: 3307 - DNA, 25 bp, Mus musculus
aaaaggcctaatctcagaagcatga

SEQ ID NO: 3308 - DNA, 25 bp, Mus musculus
aaaaggcctaatgtcagaagcatga

SEQ ID NO: 3309 - DNA, 25 bp, Mus musculus
aaaaggcgaagtcagctgcagttgc

SEQ ID NO: 3310 - DNA, 25 bp, Mus musculus
aaaaggcgaagtgagctgcagttgc

SEQ ID NO: 3311 - DNA, 25 bp, Mus musculus
aaaaggcggcttagcactttctgat

SEQ ID NO: 3312 - DNA, 25 bp, Mus musculus
aaaaggcggctttgcactttctgat

SEQ ID NO: 3313 - DNA, 25 bp, Mus musculus
aaaaggctaagaccccaacaccaag

SEQ ID NO: 3314 - DNA, 25 bp, Mus musculus
aaaaggctaagagcccaacaccaag

SEQ ID NO: 3315 - DNA, 25 bp, Mus musculus
aaaaggctagcgatgcagctcggtt

SEQ ID NO: 3316 - DNA, 25 bp, Mus musculus
aaaaggctagcgttgcagctcggtt

SEQ ID NO: 3317 - DNA, 25 bp, Mus musculus
aaaaggctatcgcagtgcctggcat

SEQ ID NO: 3318 - DNA, 25 bp, Mus musculus
aaaaggctatcggagtgcctggcat

SEQ ID NO: 3319 - DNA, 25 bp, Mus musculus
aaaaggctatctctgtttctgtgca

SEQ ID NO: 3320 - DNA, 25 bp, Mus musculus
aaaaggctatctgtgtttctgtgca

SEQ ID NO: 3321 - DNA, 25 bp, Mus musculus
aaaaggctcaaaccccagtgctgga

SEQ ID NO: 3322 - DNA, 25 bp, Mus musculus
aaaaggctcaaagcccagtgctgga

SEQ ID NO: 3323 - DNA, 25 bp, Mus musculus
aaaaggctcagaccagatacacgct

SEQ ID NO: 3324 - DNA, 25 bp, Mus musculus
aaaaggctcagagcagatacacgct

SEQ ID NO: 3325 - DNA, 25 bp, Mus musculus
aaaaggctccgtagtgccagacagc

SEQ ID NO: 3326 - DNA, 25 bp, Mus musculus
aaaaggctccgttgtgccagacagc

SEQ ID NO: 3327 - DNA, 25 bp, Mus musculus
aaaaggctctaaatggatctgattt

SEQ ID NO: 3328 - DNA, 25 bp, Mus musculus
aaaaggctctaattggatctgattt

SEQ ID NO: 3329 - DNA, 25 bp, Mus musculus
aaaaggctctagaaccaaggaatca

SEQ ID NO: 3330 - DNA, 25 bp, Mus musculus
aaaaggctctagtaccaaggaatca

SEQ ID NO: 3331 - DNA, 25 bp, Mus musculus
aaaaggctgcacatccgccagttag

SEQ ID NO: 3332 - DNA, 25 bp, Mus musculus
aaaaggctgcacttccgccagttag

SEQ ID NO: 3333 - DNA, 25 bp, Mus musculus
aaaaggctgcatcagatgctgcatg

SEQ ID NO: 3334 - DNA, 25 bp, Mus musculus
aaaaggctgcatgagatgctgcatg

SEQ ID NO: 3335 - DNA, 25 bp, Mus musculus
aaaaggctgcctatgctgtagctca

SEQ ID NO: 3336 - DNA, 25 bp, Mus musculus
aaaaggctgcctttgctgtagctca

SEQ ID NO: 3337 - DNA, 25 bp, Mus musculus
aaaaggctgggaagtctttctctcc

SEQ ID NO: 3338 - DNA, 25 bp, Mus musculus
aaaaggctgggatgtctttctctcc

SEQ ID NO: 3339 - DNA, 25 bp, Mus musculus
aaaaggctgtggagtgtccctgatc

SEQ ID NO: 3340 - DNA, 25 bp, Mus musculus
aaaaggctgtggtgtgtccctgatc

SEQ ID NO: 3341 - DNA, 25 bp, Mus musculus
aaaaggctgttgatctaggagactc

SEQ ID NO: 3342 - DNA, 25 bp, Mus musculus
aaaaggctgttgttctaggagactc

SEQ ID NO: 3343 - DNA, 25 bp, Mus musculus
aaaaggcttcggagccagagtccag

SEQ ID NO: 3344 - DNA, 25 bp, Mus musculus
aaaaggcttcggtgccagagtccag

SEQ ID NO: 3345 - DNA, 25 bp, Mus musculus
aaaaggcttcttcacacctctgagc

SEQ ID NO: 3346 - DNA, 25 bp, Mus musculus
aaaaggcttcttgacacctctgagc

SEQ ID NO: 3347 - DNA, 25 bp, Mus musculus
aaaaggcttgggactgtagttcagt

SEQ ID NO: 3348 - DNA, 25 bp, Mus musculus
aaaaggcttgggtctgtagttcagt

SEQ ID NO: 3349 - DNA, 25 bp, Mus musculus
aaaaggctttctcaactccagccgt

SEQ ID NO: 3350 - DNA, 25 bp, Mus musculus
aaaaggctttctgaactccagccgt

SEQ ID NO: 3351 - DNA, 25 bp, Mus musculus
aaaagggacactccagctgaatgag

SEQ ID NO: 3352 - DNA, 25 bp, Mus musculus
aaaagggacactgcagctgaatgag

SEQ ID NO: 3353 - DNA, 25 bp, Mus musculus
aaaagggaccttatgagcatcctag

SEQ ID NO: 3354 - DNA, 25 bp, Mus musculus
aaaagggaccttttgagcatcctag

SEQ ID NO: 3355 - DNA, 25 bp, Mus musculus
aaaagggacgggagtctctcatctt

SEQ ID NO: 3356 - DNA, 25 bp, Mus musculus
aaaagggacgggtgtctctcatctt

SEQ ID NO: 3357 - DNA, 25 bp, Mus musculus
aaaagggatccacttttatggtgat

SEQ ID NO: 3358 - DNA, 25 bp, Mus musculus
aaaagggatccagttttatggtgat

SEQ ID NO: 3359 - DNA, 25 bp, Mus musculus
aaaagggatgttcgctctctttctc

SEQ ID NO: 3360 - DNA, 25 bp, Mus musculus
aaaagggatgttggctctctttctc

SEQ ID NO: 3361 - DNA, 25 bp, Mus musculus
aaaagggattcccttctgttgccat

SEQ ID NO: 3362 - DNA, 25 bp, Mus musculus
aaaagggattccgttctgttgccat

SEQ ID NO: 3363 - DNA, 25 bp, Mus musculus
aaaagggcacaccttgaggacatta

SEQ ID NO: 3364 - DNA, 25 bp, Mus musculus
aaaagggcacacgttgaggacatta

SEQ ID NO: 3365 - DNA, 25 bp, Mus musculus
aaaagggcacttcgcttcctatgga

SEQ ID NO: 3366 - DNA, 25 bp, Mus musculus
aaaagggcacttggcttcctatgga

SEQ ID NO: 3367 - DNA, 25 bp, Mus musculus
aaaagggcagaactccaggaatgta

SEQ ID NO: 3368 - DNA, 25 bp, Mus musculus
aaaagggcagaagtccaggaatgta

SEQ ID NO: 3369 - DNA, 25 bp, Mus musculus
aaaagggcagagctagcttcagtgc

SEQ ID NO: 3370 - DNA, 25 bp, Mus musculus
aaaagggcagaggtagcttcagtgc

SEQ ID NO: 3371 - DNA, 25 bp, Mus musculus
aaaagggcagatctgcctttaatcc

SEQ ID NO: 3372 - DNA, 25 bp, Mus musculus
aaaagggcagatgtgcctttaatcc

SEQ ID NO: 3373 - DNA, 25 bp, Mus musculus
aaaagggcatcaactggtggcttca

SEQ ID NO: 3374 - DNA, 25 bp, Mus musculus
aaaagggcatcatctggtggcttca

SEQ ID NO: 3375 - DNA, 25 bp, Mus musculus
aaaagggcatgtccagctggtgtct

SEQ ID NO: 3376 - DNA, 25 bp, Mus musculus
aaaagggcatgtgcagctggtgtct

SEQ ID NO: 3377 - DNA, 25 bp, Mus musculus
aaaagggccatgaacctgtgccaaa

SEQ ID NO: 3378 - DNA, 25 bp, Mus musculus
aaaagggccatgtacctgtgccaaa

SEQ ID NO: 3379 - DNA, 25 bp, Mus musculus
aaaagggcccatactcaagtttcat

SEQ ID NO: 3380 - DNA, 25 bp, Mus musculus
aaaagggcccattctcaagtttcat

SEQ ID NO: 3381 - DNA, 25 bp, Mus musculus
aaaagggccttgcactcaggtgcca

SEQ ID NO: 3382 - DNA, 25 bp, Mus musculus
aaaagggccttggactcaggtgcca

SEQ ID NO: 3383 - DNA, 25 bp, Mus musculus
aaaagggctatccaagtcttcaata

SEQ ID NO: 3384 - DNA, 25 bp, Mus musculus
aaaagggctatcgaagtcttcaata

SEQ ID NO: 3385 - DNA, 25 bp, Mus musculus
aaaagggctgacagtgctcctccag

SEQ ID NO: 3386 - DNA, 25 bp, Mus musculus
aaaagggctgactgtgctcctccag

SEQ ID NO: 3387 - DNA, 25 bp, Mus musculus
aaaagggcttggcagcaccagtgcc

SEQ ID NO: 3388 - DNA, 25 bp, Mus musculus
aaaagggcttgggagcaccagtgcc

SEQ ID NO: 3389 - DNA, 25 bp, Mus musculus
aaaagggtcatgaggcctctgctcc

SEQ ID NO: 3390 - DNA, 25 bp, Mus musculus
aaaagggtcatgtggcctctgctcc

SEQ ID NO: 3391 - DNA, 25 bp, Mus musculus
aaaagggtctttccttctgatgaaa

SEQ ID NO: 3392 - DNA, 25 bp, Mus musculus
aaaagggtctttgcttctgatgaaa

SEQ ID NO: 3393 - DNA, 25 bp, Mus musculus
aaaagggtgactcagaagccctggc

SEQ ID NO: 3394 - DNA, 25 bp, Mus musculus
aaaagggtgactgagaagccctggc

SEQ ID NO: 3395 - DNA, 25 bp, Mus musculus
aaaagggtgggaagactcctctact

SEQ ID NO: 3396 - DNA, 25 bp, Mus musculus
aaaagggtgggatgactcctctact

SEQ ID NO: 3397 - DNA, 25 bp, Mus musculus
aaaagggtgggcatgcttctctaag

SEQ ID NO: 3398 - DNA, 25 bp, Mus musculus
aaaagggtgggcttgcttctctaag

SEQ ID NO: 3399 - DNA, 25 bp, Mus musculus
aaaagggtgttgagctgtcccaggt

SEQ ID NO: 3400 - DNA, 25 bp, Mus musculus
aaaagggtgttgtgctgtcccaggt

SEQ ID NO: 3401 - DNA, 25 bp, Mus musculus
aaaaggtaccagatgcatgccaaac

SEQ ID NO: 3402 - DNA, 25 bp, Mus musculus
aaaaggtaccagttgcatgccaaac

SEQ ID NO: 3403 - DNA, 25 bp, Mus musculus
aaaaggtacgtcatcaccaatcctc

SEQ ID NO: 3404 - DNA, 25 bp, Mus musculus
aaaaggtacgtcttcaccaatcctc

SEQ ID NO: 3405 - DNA, 25 bp, Mus musculus
aaaaggtactcccacatcttaggct

SEQ ID NO: 3406 - DNA, 25 bp, Mus musculus
aaaaggtactccgacatcttaggct

SEQ ID NO: 3407 - DNA, 25 bp, Mus musculus
aaaaggtcacagctcttcacagccg

SEQ ID NO: 3408 - DNA, 25 bp, Mus musculus
aaaaggtcacaggtcttcacagccg

SEQ ID NO: 3409 - DNA, 25 bp, Mus musculus
aaaaggtcacggatcgcctacagtg

SEQ ID NO: 3410 - DNA, 25 bp, Mus musculus
aaaaggtcacggttcgcctacagtg

SEQ ID NO: 3411 - DNA, 25 bp, Mus musculus
aaaaggtcacttcacacgccatagt

SEQ ID NO: 3412 - DNA, 25 bp, Mus musculus
aaaaggtcacttgacacgccatagt

SEQ ID NO: 3413 - DNA, 25 bp, Mus musculus
aaaaggtcagtcaactccaagaggg

SEQ ID NO: 3414 - DNA, 25 bp, Mus musculus
aaaaggtcagtctactccaagaggg

SEQ ID NO: 3415 - DNA, 25 bp, Mus musculus
aaaaggtcatagcatctggcagtgg

SEQ ID NO: 3416 - DNA, 25 bp, Mus musculus
aaaaggtcataggatctggcagtgg

SEQ ID NO: 3417 - DNA, 25 bp, Mus musculus
aaaaggtcccatctactcatccttc

SEQ ID NO: 3418 - DNA, 25 bp, Mus musculus
aaaaggtcccatgtactcatccttc

SEQ ID NO: 3419 - DNA, 25 bp, Mus musculus
aaaaggtcgttcaaggtgctggatt

SEQ ID NO: 3420 - DNA, 25 bp, Mus musculus
aaaaggtcgttctaggtgctggatt

SEQ ID NO: 3421 - DNA, 25 bp, Mus musculus
aaaaggtctcccctcgtggcagtga

SEQ ID NO: 3422 - DNA, 25 bp, Mus musculus
aaaaggtctcccgtcgtggcagtga

SEQ ID NO: 3423 - DNA, 25 bp, Mus musculus
aaaaggtctctccagcagcaaagta

SEQ ID NO: 3424 - DNA, 25 bp, Mus musculus
aaaaggtctctcgagcagcaaagta

SEQ ID NO: 3425 - DNA, 25 bp, Mus musculus
aaaaggtctttcaagattgtgtcta

SEQ ID NO: 3426 - DNA, 25 bp, Mus musculus
aaaaggtctttctagattgtgtcta

SEQ ID NO: 3427 - DNA, 25 bp, Mus musculus
aaaaggtgaactcagcatgctgccc

SEQ ID NO: 3428 - DNA, 25 bp, Mus musculus
aaaaggtgaactgagcatgctgccc

SEQ ID NO: 3429 - DNA, 25 bp, Mus musculus
aaaaggtgacatcctcctggactac

SEQ ID NO: 3430 - DNA, 25 bp, Mus musculus
aaaaggtgacatgctcctggactac

SEQ ID NO: 3431 - DNA, 25 bp, Mus musculus
aaaaggtgacctaagtttagtgcag

SEQ ID NO: 3432 - DNA, 25 bp, Mus musculus
aaaaggtgaccttagtttagtgcag

SEQ ID NO: 3433 - DNA, 25 bp, Mus musculus
aaaaggtgacgcatgtctcggctgc

SEQ ID NO: 3434 - DNA, 25 bp, Mus musculus
aaaaggtgacgcttgtctcggctgc

SEQ ID NO: 3435 - DNA, 25 bp, Mus musculus
aaaaggtgactccttctgtaacata

SEQ ID NO: 3436 - DNA, 25 bp, Mus musculus
aaaaggtgactcgttctgtaacata

SEQ ID NO: 3437 - DNA, 25 bp, Mus musculus
aaaaggtgcctcaggccactcttac

SEQ ID NO: 3438 - DNA, 25 bp, Mus musculus
aaaaggtgcctctggccactcttac

SEQ ID NO: 3439 - DNA, 25 bp, Mus musculus
aaaaggtgcctgcagcatgtctctt

SEQ ID NO: 3440 - DNA, 25 bp, Mus musculus
aaaaggtgcctggagcatgtctctt

SEQ ID NO: 3441 - DNA, 25 bp, Mus musculus
aaaaggtgccttcatggaaaaatat

SEQ ID NO: 3442 - DNA, 25 bp, Mus musculus
aaaaggtgccttgatggaaaaatat

SEQ ID NO: 3443 - DNA, 25 bp, Mus musculus
aaaaggttcagcagtaccctctctc

SEQ ID NO: 3444 - DNA, 25 bp, Mus musculus
aaaaggttcagctgtaccctctctc

SEQ ID NO: 3445 - DNA, 25 bp, Mus musculus
aaaaggttcatgacctgacttcctc

SEQ ID NO: 3446 - DNA, 25 bp, Mus musculus
aaaaggttcatgctctgtgtcacag

SEQ ID NO: 3447 - DNA, 25 bp, Mus musculus
aaaaggttcatggtctgtgtcacag

SEQ ID NO: 3448 - DNA, 25 bp, Mus musculus
aaaaggttcatgtcctgacttcctc

SEQ ID NO: 3449 - DNA, 25 bp, Mus musculus
aaaaggttctgtcgcgaacacgctg

SEQ ID NO: 3450 - DNA, 25 bp, Mus musculus
aaaaggttctgtggcgaacacgctg

SEQ ID NO: 3451 - DNA, 25 bp, Mus musculus
aaaaggttgatactgggactggcaa

SEQ ID NO: 3452 - DNA, 25 bp, Mus musculus
aaaaggttgatagtgggactggcaa

SEQ ID NO: 3453 - DNA, 25 bp, Mus musculus
aaaaggtttgtgatcaccaggccat

SEQ ID NO: 3454 - DNA, 25 bp, Mus musculus
aaaaggtttgtgttcaccaggccat

SEQ ID NO: 3455 - DNA, 25 bp, Mus musculus
aaaagtaacataaccttgcctctta

SEQ ID NO: 3456 - DNA, 25 bp, Mus musculus
aaaagtaacatatccttgcctctta

SEQ ID NO: 3457 - DNA, 25 bp, Mus musculus
aaaagtaaggcccacttgctgtatt

SEQ ID NO: 3458 - DNA, 25 bp, Mus musculus
aaaagtaaggccgacttgctgtatt

SEQ ID NO: 3459 - DNA, 25 bp, Mus musculus
aaaagtaaggctctggatgccagaa

SEQ ID NO: 3460 - DNA, 25 bp, Mus musculus
aaaagtaaggctgtggatgccagaa

SEQ ID NO: 3461 - DNA, 25 bp, Mus musculus
aaaagtaatcctagcgccgggcagt

SEQ ID NO: 3462 - DNA, 25 bp, Mus musculus
aaaagtaatccttgcgccgggcagt

SEQ ID NO: 3463 - DNA, 25 bp, Mus musculus
aaaagtaatctgatacccctccaca

SEQ ID NO: 3464 - DNA, 25 bp, Mus musculus
aaaagtaatctgttacccctccaca

SEQ ID NO: 3465 - DNA, 25 bp, Mus musculus
aaaagtacacatcgagctgggcgtg

SEQ ID NO: 3466 - DNA, 25 bp, Mus musculus
aaaagtacacatggagctgggcgtg

SEQ ID NO: 3467 - DNA, 25 bp, Mus musculus
aaaagtacatttagttggccagcat

SEQ ID NO: 3468 - DNA, 25 bp, Mus musculus
aaaagtacattttgttggccagcat

SEQ ID NO: 3469 - DNA, 25 bp, Mus musculus
aaaagtaccactaatgaattcgata

SEQ ID NO: 3470 - DNA, 25 bp, Mus musculus
aaaagtaccacttatgaattcgata

SEQ ID NO: 3471 - DNA, 25 bp, Mus musculus
aaaagtacccagaagtgctcctcgt

SEQ ID NO: 3472 - DNA, 25 bp, Mus musculus
aaaagtacccagtagtgctcctcgt

SEQ ID NO: 3473 - DNA, 25 bp, Mus musculus
aaaagtacccctcacctcagaatgg

SEQ ID NO: 3474 - DNA, 25 bp, Mus musculus
aaaagtacccctgacctcagaatgg

SEQ ID NO: 3475 - DNA, 25 bp, Mus musculus
aaaagtacccggctggcgatacaga

SEQ ID NO: 3476 - DNA, 25 bp, Mus musculus
aaaagtacccgggtggcgatacaga

SEQ ID NO: 3477 - DNA, 25 bp, Mus musculus
aaaagtaccgagatggaagtccacg

SEQ ID NO: 3478 - DNA, 25 bp, Mus musculus
aaaagtaccgagttggaagtccacg

SEQ ID NO: 3479 - DNA, 25 bp, Mus musculus
aaaagtaccgccatgctgccctgag

SEQ ID NO: 3480 - DNA, 25 bp, Mus musculus
aaaagtaccgccttgctgccctgag

SEQ ID NO: 3481 - DNA, 25 bp, Mus musculus
aaaagtaccggcagttgactgctgt

SEQ ID NO: 3482 - DNA, 25 bp, Mus musculus
aaaagtaccggctgttgactgctgt

SEQ ID NO: 3483 - DNA, 25 bp, Mus musculus
aaaagtacgcccattgactgctgac

SEQ ID NO: 3484 - DNA, 25 bp, Mus musculus
aaaagtacgccctttgactgctgac

SEQ ID NO: 3485 - DNA, 25 bp, Mus musculus
aaaagtactaccatctgtggctgag

SEQ ID NO: 3486 - DNA, 25 bp, Mus musculus
aaaagtactaccttctgtggctgag

SEQ ID NO: 3487 - DNA, 25 bp, Mus musculus
aaaagtactattacacgccattatg

SEQ ID NO: 3488 - DNA, 25 bp, Mus musculus
aaaagtactatttcacgccattatg

SEQ ID NO: 3489 - DNA, 25 bp, Mus musculus
aaaagtactcttacatgcttgaacc

SEQ ID NO: 3490 - DNA, 25 bp, Mus musculus
aaaagtactctttcatgcttgaacc

SEQ ID NO: 3491 - DNA, 25 bp, Mus musculus
aaaagtacttggcttctgaggaact

SEQ ID NO: 3492 - DNA, 25 bp, Mus musculus
aaaagtacttgggttctgaggaact

SEQ ID NO: 3493 - DNA, 25 bp, Mus musculus
aaaagtacttgtcctggcatcgcat

SEQ ID NO: 3494 - DNA, 25 bp, Mus musculus
aaaagtacttgtgctggcatcgcat

SEQ ID NO: 3495 - DNA, 25 bp, Mus musculus
aaaagtagactgataatttccttat

SEQ ID NO: 3496 - DNA, 25 bp, Mus musculus
aaaagtagactgttaatttccttat

SEQ ID NO: 3497 - DNA, 25 bp, Mus musculus
aaaagtagagtgaaatgccagtgaa

SEQ ID NO: 3498 - DNA, 25 bp, Mus musculus
aaaagtagagtgtaatgccagtgaa

SEQ ID NO: 3499 - DNA, 25 bp, Mus musculus
aaaagtagcactaccccttgcaaag

SEQ ID NO: 3500 - DNA, 25 bp, Mus musculus
aaaagtagcacttccccttgcaaag

SEQ ID NO: 3501 - DNA, 25 bp, Mus musculus
aaaagtagccaaacctgctggccta

SEQ ID NO: 3502 - DNA, 25 bp, Mus musculus
aaaagtagccaatcctgctggccta

SEQ ID NO: 3503 - DNA, 25 bp, Mus musculus
aaaagtagccagagcgtctccagct

SEQ ID NO: 3504 - DNA, 25 bp, Mus musculus
aaaagtagccagtgcgtctccagct

SEQ ID NO: 3505 - DNA, 25 bp, Mus musculus
aaaagtagcctgcagctaggataga

SEQ ID NO: 3506 - DNA, 25 bp, Mus musculus
aaaagtagcctggagctaggataga

SEQ ID NO: 3507 - DNA, 25 bp, Mus musculus
aaaagtagggcacggctagcttgcc

SEQ ID NO: 3508 - DNA, 25 bp, Mus musculus
aaaagtagggcagggctagcttgcc

SEQ ID NO: 3509 - DNA, 25 bp, Mus musculus
aaaagtagtatcacctggtggccta

SEQ ID NO: 3510 - DNA, 25 bp, Mus musculus
aaaagtagtatctcctggtggccta

SEQ ID NO: 3511 - DNA, 25 bp, Mus musculus
aaaagtagtcccagtcacccttcag

SEQ ID NO: 3512 - DNA, 25 bp, Mus musculus
aaaagtagtccctgtcacccttcag

SEQ ID NO: 3513 - DNA, 25 bp, Mus musculus
aaaagtagtctcctggcttaaccat

SEQ ID NO: 3514 - DNA, 25 bp, Mus musculus
aaaagtagtctcgtggcttaaccat

SEQ ID NO: 3515 - DNA, 25 bp, Mus musculus
aaaagtagtgcccaaaagctgtgcc

SEQ ID NO: 3516 - DNA, 25 bp, Mus musculus
aaaagtagtgccgaaaagctgtgcc

SEQ ID NO: 3517 - DNA, 25 bp, Mus musculus
aaaagtagtgtcaacctgcaaatga

SEQ ID NO: 3518 - DNA, 25 bp, Mus musculus
aaaagtagtgtctacctgcaaatga

SEQ ID NO: 3519 - DNA, 25 bp, Mus musculus
aaaagtatatccacaaattatcgaa

SEQ ID NO: 3520 - DNA, 25 bp, Mus musculus
aaaagtatatcctcaaattatcgaa

SEQ ID NO: 3521 - DNA, 25 bp, Mus musculus
aaaagtatcactcaccaagccgaaa

SEQ ID NO: 3522 - DNA, 25 bp, Mus musculus
aaaagtatcactgaccaagccgaaa

SEQ ID NO: 3523 - DNA, 25 bp, Mus musculus
aaaagtatcctgactgagctagttt

SEQ ID NO: 3524 - DNA, 25 bp, Mus musculus
aaaagtatcctgtctgagctagttt

SEQ ID NO: 3525 - DNA, 25 bp, Mus musculus
aaaagtatcgcacttgactatgcat

SEQ ID NO: 3526 - DNA, 25 bp, Mus musculus
aaaagtatcgcagttgactatgcat

SEQ ID NO: 3527 - DNA, 25 bp, Mus musculus
aaaagtatgaaccactacacccagc

SEQ ID NO: 3528 - DNA, 25 bp, Mus musculus
aaaagtatgaacgactacacccagc

SEQ ID NO: 3529 - DNA, 25 bp, Mus musculus
aaaagtatgcatcctgtttccagta

SEQ ID NO: 3530 - DNA, 25 bp, Mus musculus
aaaagtatgcatgctgtttccagta

SEQ ID NO: 3531 - DNA, 25 bp, Mus musculus
aaaagtatggccctgcctggcagga

SEQ ID NO: 3532 - DNA, 25 bp, Mus musculus
aaaagtatggccgtgcctggcagga

SEQ ID NO: 3533 - DNA, 25 bp, Mus musculus
aaaagtattgctatttcccagaaat

SEQ ID NO: 3534 - DNA, 25 bp, Mus musculus
aaaagtattgctttttcccagaaat

SEQ ID NO: 3535 - DNA, 25 bp, Mus musculus
aaaagtatttaaccctgccacctct

SEQ ID NO: 3536 - DNA, 25 bp, Mus musculus
aaaagtatttaagcctgccacctct

SEQ ID NO: 3537 - DNA, 25 bp, Mus musculus
aaaagtatttgcacagtacccaagc

SEQ ID NO: 3538 - DNA, 25 bp, Mus musculus
aaaagtatttgctcagtacccaagc

SEQ ID NO: 3539 - DNA, 25 bp, Mus musculus
aaaagtcaacaaaagccagtggcgg

SEQ ID NO: 3540 - DNA, 25 bp, Mus musculus
aaaagtcaacaatagccagtggcgg

SEQ ID NO: 3541 - DNA, 25 bp, Mus musculus
aaaagtcaagtactcttgctccaac

SEQ ID NO: 3542 - DNA, 25 bp, Mus musculus
aaaagtcaagtagtcttgctccaac

SEQ ID NO: 3543 - DNA, 25 bp, Mus musculus
aaaagtcacaaccatgcactgggtt

SEQ ID NO: 3544 - DNA, 25 bp, Mus musculus
aaaagtcacaacgatgcactgggtt

SEQ ID NO: 3545 - DNA, 25 bp, Mus musculus
aaaagtcacagccaaggcgaccgtg

SEQ ID NO: 3546 - DNA, 25 bp, Mus musculus
aaaagtcacagcgaaggcgaccgtg

SEQ ID NO: 3547 - DNA, 25 bp, Mus musculus
aaaagtcacatacttcgaggcctcc

SEQ ID NO: 3548 - DNA, 25 bp, Mus musculus
aaaagtcacatagttcgaggcctcc

SEQ ID NO: 3549 - DNA, 25 bp, Mus musculus
aaaagtcaccagcaccaaagagttg

SEQ ID NO: 3550 - DNA, 25 bp, Mus musculus
aaaagtcaccaggaccaaagagttg

SEQ ID NO: 3551 - DNA, 25 bp, Mus musculus
aaaagtcaccatactgcatttagct

SEQ ID NO: 3552 - DNA, 25 bp, Mus musculus
aaaagtcaccattctgcatttagct

SEQ ID NO: 3553 - DNA, 25 bp, Mus musculus
aaaagtcaccgcctgtttcaaagca

SEQ ID NO: 3554 - DNA, 25 bp, Mus musculus
aaaagtcaccgcgtgtttcaaagca

SEQ ID NO: 3555 - DNA, 25 bp, Mus musculus
aaaagtcactgaaggtctggacact

SEQ ID NO: 3556 - DNA, 25 bp, Mus musculus
aaaagtcactgatggtctggacact

SEQ ID NO: 3557 - DNA, 25 bp, Mus musculus
aaaagtcactgtctcatcctcagga

SEQ ID NO: 3558 - DNA, 25 bp, Mus musculus
aaaagtcactgtgtcatcctcagga

SEQ ID NO: 3559 - DNA, 25 bp, Mus musculus
aaaagtcagcccattgccttggttt

SEQ ID NO: 3560 - DNA, 25 bp, Mus musculus
aaaagtcagccctttgccttggttt

SEQ ID NO: 3561 - DNA, 25 bp, Mus musculus
aaaagtcagcttcactcccacttga

SEQ ID NO: 3562 - DNA, 25 bp, Mus musculus
aaaagtcagcttgactcccacttga

SEQ ID NO: 3563 - DNA, 25 bp, Mus musculus
aaaagtcaggttagcagccatcatt

SEQ ID NO: 3564 - DNA, 25 bp, Mus musculus
aaaagtcaggtttgcagccatcatt

SEQ ID NO: 3565 - DNA, 25 bp, Mus musculus
aaaagtcagtgccatggtggcccac

SEQ ID NO: 3566 - DNA, 25 bp, Mus musculus
aaaagtcagtgcgatggtggcccac

SEQ ID NO: 3567 - DNA, 25 bp, Mus musculus
aaaagtcatctcactggtttgcagc

SEQ ID NO: 3568 - DNA, 25 bp, Mus musculus
aaaagtcatctctctggtttgcagc

SEQ ID NO: 3569 - DNA, 25 bp, Mus musculus
aaaagtcatctgagctcctgaagtc

SEQ ID NO: 3570 - DNA, 25 bp, Mus musculus
aaaagtcatctgtgctcctgaagtc

SEQ ID NO: 3571 - DNA, 25 bp, Mus musculus
aaaagtcatgtaattgtctcagtct

SEQ ID NO: 3572 - DNA, 25 bp, Mus musculus
aaaagtcatgtacaccaaacagggc

SEQ ID NO: 3573 - DNA, 25 bp, Mus musculus
aaaagtcatgtagaccaaacagggc

SEQ ID NO: 3574 - DNA, 25 bp, Mus musculus
aaaagtcatgtatttgtctcagtct

SEQ ID NO: 3575 - DNA, 25 bp, Mus musculus
aaaagtcattcgcaggtgtcacctg

SEQ ID NO: 3576 - DNA, 25 bp, Mus musculus
aaaagtcattcggaggtgtcacctg

SEQ ID NO: 3577 - DNA, 25 bp, Mus musculus
aaaagtcatttcctgaagatccacc

SEQ ID NO: 3578 - DNA, 25 bp, Mus musculus
aaaagtcatttcgtgaagatccacc

SEQ ID NO: 3579 - DNA, 25 bp, Mus musculus
aaaagtccaaccagctgtgttcatt

SEQ ID NO: 3580 - DNA, 25 bp, Mus musculus
aaaagtccaacctgctgtgttcatt

SEQ ID NO: 3581 - DNA, 25 bp, Mus musculus
aaaagtccaatgctcagtgacagga

SEQ ID NO: 3582 - DNA, 25 bp, Mus musculus
aaaagtccaatggtcagtgacagga

SEQ ID NO: 3583 - DNA, 25 bp, Mus musculus
aaaagtccacttctagcctatgtct

SEQ ID NO: 3584 - DNA, 25 bp, Mus musculus
aaaagtccacttgtagcctatgtct

SEQ ID NO: 3585 - DNA, 25 bp, Mus musculus
aaaagtccagcaccggcatgcccat

SEQ ID NO: 3586 - DNA, 25 bp, Mus musculus
aaaagtccagcagcggcatgcccat

SEQ ID NO: 3587 - DNA, 25 bp, Mus musculus
aaaagtccatatcaggcccaatctc

SEQ ID NO: 3588 - DNA, 25 bp, Mus musculus
aaaagtccatatgaggcccaatctc

SEQ ID NO: 3589 - DNA, 25 bp, Mus musculus
aaaagtccatgcaagggtctggaaa

SEQ ID NO: 3590 - DNA, 25 bp, Mus musculus
aaaagtccatgctagggtctggaaa

SEQ ID NO: 3591 - DNA, 25 bp, Mus musculus
aaaagtccattacctgccagtcaag

SEQ ID NO: 3592 - DNA, 25 bp, Mus musculus
aaaagtccattagctgccagtcaag

SEQ ID NO: 3593 - DNA, 25 bp, Mus musculus
aaaagtccattccaagaggccattg

SEQ ID NO: 3594 - DNA, 25 bp, Mus musculus
aaaagtccattcgaagaggccattg

SEQ ID NO: 3595 - DNA, 25 bp, Mus musculus
aaaagtcccatcagagacaggcccc

SEQ ID NO: 3596 - DNA, 25 bp, Mus musculus
aaaagtcccatctgagacaggcccc

SEQ ID NO: 3597 - DNA, 25 bp, Mus musculus
aaaagtccccgaacatttctcttct

SEQ ID NO: 3598 - DNA, 25 bp, Mus musculus
aaaagtccccgatcatttctcttct

SEQ ID NO: 3599 - DNA, 25 bp, Mus musculus
aaaagtcccgcaaaggcacacgtgt

SEQ ID NO: 3600 - DNA, 25 bp, Mus musculus
aaaagtcccgcataggcacacgtgt

SEQ ID NO: 3601 - DNA, 25 bp, Mus musculus
aaaagtcccgtcatgcggaggtcct

SEQ ID NO: 3602 - DNA, 25 bp, Mus musculus
aaaagtcccgtcttgcggaggtcct

SEQ ID NO: 3603 - DNA, 25 bp, Mus musculus
aaaagtccctttcatcccactgagc

SEQ ID NO: 3604 - DNA, 25 bp, Mus musculus
aaaagtccctttgatcccactgagc

SEQ ID NO: 3605 - DNA, 25 bp, Mus musculus
aaaagtcctcatcggctcgtgggaa

SEQ ID NO: 3606 - DNA, 25 bp, Mus musculus
aaaagtcctcatgggctcgtgggaa

SEQ ID NO: 3607 - DNA, 25 bp, Mus musculus
aaaagtcctgagaggattccttcag

SEQ ID NO: 3608 - DNA, 25 bp, Mus musculus
aaaagtcctgagtggattccttcag

SEQ ID NO: 3609 - DNA, 25 bp, Mus musculus
aaaagtcctgatacccctgagtaat

SEQ ID NO: 3610 - DNA, 25 bp, Mus musculus
aaaagtcctgattcccctgagtaat

SEQ ID NO: 3611 - DNA, 25 bp, Mus musculus
aaaagtcctgttctaatggcattga

SEQ ID NO: 3612 - DNA, 25 bp, Mus musculus
aaaagtcctgttgtaatggcattga

SEQ ID NO: 3613 - DNA, 25 bp, Mus musculus
aaaagtccttctcaactgctctgta

SEQ ID NO: 3614 - DNA, 25 bp, Mus musculus
aaaagtccttctgaactgctctgta

SEQ ID NO: 3615 - DNA, 25 bp, Mus musculus
aaaagtcctttgagacggtgctgga

SEQ ID NO: 3616 - DNA, 25 bp, Mus musculus
aaaagtcctttgtgacggtgctgga

SEQ ID NO: 3617 - DNA, 25 bp, Mus musculus
aaaagtcgatgcatgaatgcgcccc

SEQ ID NO: 3618 - DNA, 25 bp, Mus musculus
aaaagtcgatgcttgaatgcgcccc

SEQ ID NO: 3619 - DNA, 25 bp, Mus musculus
aaaagtctactgaggtcatgaatac

SEQ ID NO: 3620 - DNA, 25 bp, Mus musculus
aaaagtctactgtggtcatgaatac

SEQ ID NO: 3621 - DNA, 25 bp, Mus musculus
aaaagtctcaggaagaatgcccaat

SEQ ID NO: 3622 - DNA, 25 bp, Mus musculus
aaaagtctcaggtagaatgcccaat

SEQ ID NO: 3623 - DNA, 25 bp, Mus musculus
aaaagtctccatccacttctgaggg

SEQ ID NO: 3624 - DNA, 25 bp, Mus musculus
aaaagtctccatgcacttctgaggg

SEQ ID NO: 3625 - DNA, 25 bp, Mus musculus
aaaagtctcggaatggctgtgctgc

SEQ ID NO: 3626 - DNA, 25 bp, Mus musculus
aaaagtctcggattggctgtgctgc

SEQ ID NO: 3627 - DNA, 25 bp, Mus musculus
aaaagtctcggtctcgatctcagag

SEQ ID NO: 3628 - DNA, 25 bp, Mus musculus
aaaagtctcggtgtcgatctcagag

SEQ ID NO: 3629 - DNA, 25 bp, Mus musculus
aaaagtctctccattgactgaagaa

SEQ ID NO: 3630 - DNA, 25 bp, Mus musculus
aaaagtctctcctttgactgaagaa

SEQ ID NO: 3631 - DNA, 25 bp, Mus musculus
aaaagtctgagacccaaagatgaca

SEQ ID NO: 3632 - DNA, 25 bp, Mus musculus
aaaagtctgagagccaaagatgaca

SEQ ID NO: 3633 - DNA, 25 bp, Mus musculus
aaaagtctgcacaagtcaaccagca

SEQ ID NO: 3634 - DNA, 25 bp, Mus musculus
aaaagtctgcaccaaagcccagtat

SEQ ID NO: 3635 - DNA, 25 bp, Mus musculus
aaaagtctgcacgaaagcccagtat

SEQ ID NO: 3636 - DNA, 25 bp, Mus musculus
aaaagtctgcactagtcaaccagca

SEQ ID NO: 3637 - DNA, 25 bp, Mus musculus
aaaagtctgcttaccgctctagaag

SEQ ID NO: 3638 - DNA, 25 bp, Mus musculus
aaaagtctgctttccgctctagaag

SEQ ID NO: 3639 - DNA, 25 bp, Mus musculus
aaaagtctgggccaacctctgacaa

SEQ ID NO: 3640 - DNA, 25 bp, Mus musculus
aaaagtctgggcgaacctctgacaa

SEQ ID NO: 3641 - DNA, 25 bp, Mus musculus
aaaagtctgtctacaactccccaag

SEQ ID NO: 3642 - DNA, 25 bp, Mus musculus
aaaagtctgtcttcaactccccaag

SEQ ID NO: 3643 - DNA, 25 bp, Mus musculus
aaaagtctgtgtagcctgctgtctt

SEQ ID NO: 3644 - DNA, 25 bp, Mus musculus
aaaagtctgtgttgcctgctgtctt

SEQ ID NO: 3645 - DNA, 25 bp, Mus musculus
aaaagtcttatgatgccatctcctg

SEQ ID NO: 3646 - DNA, 25 bp, Mus musculus
aaaagtcttatgttgccatctcctg

SEQ ID NO: 3647 - DNA, 25 bp, Mus musculus
aaaagtcttcgtcaagccagggaag

SEQ ID NO: 3648 - DNA, 25 bp, Mus musculus
aaaagtcttcgtgaagccagggaag

SEQ ID NO: 3649 - DNA, 25 bp, Mus musculus
aaaagtcttggtctctcagcatcca

SEQ ID NO: 3650 - DNA, 25 bp, Mus musculus
aaaagtcttggtgtctcagcatcca

SEQ ID NO: 3651 - DNA, 25 bp, Mus musculus
aaaagtgaactccagctacgtgaaa

SEQ ID NO: 3652 - DNA, 25 bp, Mus musculus
aaaagtgaactcgagctacgtgaaa

SEQ ID NO: 3653 - DNA, 25 bp, Mus musculus
aaaagtgaatccagccatccccttg

SEQ ID NO: 3654 - DNA, 25 bp, Mus musculus
aaaagtgaatcctgccatccccttg

SEQ ID NO: 3655 - DNA, 25 bp, Mus musculus
aaaagtgacagtcccaacagcccca

SEQ ID NO: 3656 - DNA, 25 bp, Mus musculus
aaaagtgacagtgccaacagcccca

SEQ ID NO: 3657 - DNA, 25 bp, Mus musculus
aaaagtgacccgacaccacagatct

SEQ ID NO: 3658 - DNA, 25 bp, Mus musculus
aaaagtgacccgtcaccacagatct

SEQ ID NO: 3659 - DNA, 25 bp, Mus musculus
aaaagtgaccctccggtgacagaag

SEQ ID NO: 3660 - DNA, 25 bp, Mus musculus
aaaagtgaccctgcggtgacagaag

SEQ ID NO: 3661 - DNA, 25 bp, Mus musculus
aaaagtgacctcagccaggcccgag

SEQ ID NO: 3662 - DNA, 25 bp, Mus musculus
aaaagtgacctctgccaggcccgag

SEQ ID NO: 3663 - DNA, 25 bp, Mus musculus
aaaagtgacgacatgggactccagt

SEQ ID NO: 3664 - DNA, 25 bp, Mus musculus
aaaagtgacgacttgggactccagt

SEQ ID NO: 3665 - DNA, 25 bp, Mus musculus
aaaagtgacgcaccagttcctccaa

SEQ ID NO: 3666 - DNA, 25 bp, Mus musculus
aaaagtgacgcagcagttcctccaa

SEQ ID NO: 3667 - DNA, 25 bp, Mus musculus
aaaagtgcaggcagcgctgtctttg

SEQ ID NO: 3668 - DNA, 25 bp, Mus musculus
aaaagtgcaggctgcgctgtctttg

SEQ ID NO: 3669 - DNA, 25 bp, Mus musculus
aaaagtgccaagaccctctagtagg

SEQ ID NO: 3670 - DNA, 25 bp, Mus musculus
aaaagtgccaagtccctctagtagg

SEQ ID NO: 3671 - DNA, 25 bp, Mus musculus
aaaagtgccactatctacaacccca

SEQ ID NO: 3672 - DNA, 25 bp, Mus musculus
aaaagtgccactttctacaacccca

SEQ ID NO: 3673 - DNA, 25 bp, Mus musculus
aaaagtgccattacatgatggtggc

SEQ ID NO: 3674 - DNA, 25 bp, Mus musculus
aaaagtgccatttcatgatggtggc

SEQ ID NO: 3675 - DNA, 25 bp, Mus musculus
aaaagtgcccctctattctcctgtt

SEQ ID NO: 3676 - DNA, 25 bp, Mus musculus
aaaagtgcccctgtattctcctgtt

SEQ ID NO: 3677 - DNA, 25 bp, Mus musculus
aaaagtgccgttatcagcatctgaa

SEQ ID NO: 3678 - DNA, 25 bp, Mus musculus
aaaagtgccgttttcagcatctgaa

SEQ ID NO: 3679 - DNA, 25 bp, Mus musculus
aaaagtgcctctactgatgctttcc

SEQ ID NO: 3680 - DNA, 25 bp, Mus musculus
aaaagtgcctcttctgatgctttcc

SEQ ID NO: 3681 - DNA, 25 bp, Mus musculus
aaaagtgccttaagccgggcagtgg

SEQ ID NO: 3682 - DNA, 25 bp, Mus musculus
aaaagtgccttatgccgggcagtgg

SEQ ID NO: 3683 - DNA, 25 bp, Mus musculus
aaaagtgccttcaattataaaagag

SEQ ID NO: 3684 - DNA, 25 bp, Mus musculus
aaaagtgccttctattataaaagag

SEQ ID NO: 3685 - DNA, 25 bp, Mus musculus
aaaagtgcgtgtcttggccctcaac

SEQ ID NO: 3686 - DNA, 25 bp, Mus musculus
aaaagtgcgtgtgttggccctcaac

SEQ ID NO: 3687 - DNA, 25 bp, Mus musculus
aaaagtgcgttcctgatcgcagtcc

SEQ ID NO: 3688 - DNA, 25 bp, Mus musculus
aaaagtgcgttcgtgatcgcagtcc

SEQ ID NO: 3689 - DNA, 25 bp, Mus musculus
aaaagtgctctgctattcttccctt

SEQ ID NO: 3690 - DNA, 25 bp, Mus musculus
aaaagtgctctggtattcttccctt

SEQ ID NO: 3691 - DNA, 25 bp, Mus musculus
aaaagtgctgaacaggttcctgatg

SEQ ID NO: 3692 - DNA, 25 bp, Mus musculus
aaaagtgctgaagaggttcctgatg

SEQ ID NO: 3693 - DNA, 25 bp, Mus musculus
aaaagtgctggcctctccatgacta

SEQ ID NO: 3694 - DNA, 25 bp, Mus musculus
aaaagtgctggcgtctccatgacta

SEQ ID NO: 3695 - DNA, 25 bp, Mus musculus
aaaagtgctggtaccttcaaatatt

SEQ ID NO: 3696 - DNA, 25 bp, Mus musculus
aaaagtgctggttccttcaaatatt

SEQ ID NO: 3697 - DNA, 25 bp, Mus musculus
aaaagtgctgttatttcctccgttg

SEQ ID NO: 3698 - DNA, 25 bp, Mus musculus
aaaagtgctgttttttcctccgttg

SEQ ID NO: 3699 - DNA, 25 bp, Mus musculus
aaaagtgcttccctggtactgagct

SEQ ID NO: 3700 - DNA, 25 bp, Mus musculus
aaaagtgcttccgtggtactgagct

SEQ ID NO: 3701 - DNA, 25 bp, Mus musculus
aaaagtgctttgaagcctcctggat

SEQ ID NO: 3702 - DNA, 25 bp, Mus musculus
aaaagtgctttgtagcctcctggat

SEQ ID NO: 3703 - DNA, 25 bp, Mus musculus
aaaagtggacatcaccttggctctc

SEQ ID NO: 3704 - DNA, 25 bp, Mus musculus
aaaagtggacatgaccttggctctc

SEQ ID NO: 3705 - DNA, 25 bp, Mus musculus
aaaagtggcaatatcatgatagctg

SEQ ID NO: 3706 - DNA, 25 bp, Mus musculus
aaaagtggcaatttcatgatagctg

SEQ ID NO: 3707 - DNA, 25 bp, Mus musculus
aaaagtggcattccttcctccaagg

SEQ ID NO: 3708 - DNA, 25 bp, Mus musculus
aaaagtggcattgcttcctccaagg

SEQ ID NO: 3709 - DNA, 25 bp, Mus musculus
aaaagtggccatcagcaccgtgaac

SEQ ID NO: 3710 - DNA, 25 bp, Mus musculus
aaaagtggccatgagcaccgtgaac

SEQ ID NO: 3711 - DNA, 25 bp, Mus musculus
aaaagtggcccactagagctactcg

SEQ ID NO: 3712 - DNA, 25 bp, Mus musculus
aaaagtggcccagtagagctactcg

SEQ ID NO: 3713 - DNA, 25 bp, Mus musculus
aaaagtggcccgagtacagcccgag

SEQ ID NO: 3714 - DNA, 25 bp, Mus musculus
aaaagtggcccgtgtacagcccgag

SEQ ID NO: 3715 - DNA, 25 bp, Mus musculus
aaaagtggctaaacggtaggttgca

SEQ ID NO: 3716 - DNA, 25 bp, Mus musculus
aaaagtggctaatcggtaggttgca

SEQ ID NO: 3717 - DNA, 25 bp, Mus musculus
aaaagtggctcacctagctaggtgt

SEQ ID NO: 3718 - DNA, 25 bp, Mus musculus
aaaagtggctcagctagctaggtgt

SEQ ID NO: 3719 - DNA, 25 bp, Mus musculus
aaaagtggcttcagcactcttcatg

SEQ ID NO: 3720 - DNA, 25 bp, Mus musculus
aaaagtggcttctgcactcttcatg

SEQ ID NO: 3721 - DNA, 25 bp, Mus musculus
aaaagtgggcgaatcctgaggagca

SEQ ID NO: 3722 - DNA, 25 bp, Mus musculus
aaaagtgggcgattcctgaggagca

SEQ ID NO: 3723 - DNA, 25 bp, Mus musculus
aaaagtgggctgctcctggaattct

SEQ ID NO: 3724 - DNA, 25 bp, Mus musculus
aaaagtgggctggtcctggaattct

SEQ ID NO: 3725 - DNA, 25 bp, Mus musculus
aaaagtgggtgtcgcatctcacaaa

SEQ ID NO: 3726 - DNA, 25 bp, Mus musculus
aaaagtgggtgtggcatctcacaaa

SEQ ID NO: 3727 - DNA, 25 bp, Mus musculus
aaaagtggtaggacgagctaacctg

SEQ ID NO: 3728 - DNA, 25 bp, Mus musculus
aaaagtggtaggtcgagctaacctg

SEQ ID NO: 3729 - DNA, 25 bp, Mus musculus
aaaagtggtcttcaggtttgagcct

SEQ ID NO: 3730 - DNA, 25 bp, Mus musculus
aaaagtggtcttgaggtttgagcct

SEQ ID NO: 3731 - DNA, 25 bp, Mus musculus
aaaagtgtaactatgctctgtttct

SEQ ID NO: 3732 - DNA, 25 bp, Mus musculus
aaaagtgtaactttgctctgtttct

SEQ ID NO: 3733 - DNA, 25 bp, Mus musculus
aaaagtgtaagtatcctgcatttct

SEQ ID NO: 3734 - DNA, 25 bp, Mus musculus
aaaagtgtaagtttcctgcatttct

SEQ ID NO: 3735 - DNA, 25 bp, Mus musculus
aaaagtgtactcctcacatactggc

SEQ ID NO: 3736 - DNA, 25 bp, Mus musculus
aaaagtgtactcgtcacatactggc

SEQ ID NO: 3737 - DNA, 25 bp, Mus musculus
aaaagtgtcaccaggaactgccctc

SEQ ID NO: 3738 - DNA, 25 bp, Mus musculus
aaaagtgtcacctggaactgccctc

SEQ ID NO: 3739 - DNA, 25 bp, Mus musculus
aaaagtgtcattcagccatgcatac

SEQ ID NO: 3740 - DNA, 25 bp, Mus musculus
aaaagtgtcattgagccatgcatac

SEQ ID NO: 3741 - DNA, 25 bp, Mus musculus
aaaagtgtccaccatgtgatgaatg

SEQ ID NO: 3742 - DNA, 25 bp, Mus musculus
aaaagtgtccacgatgtgatgaatg

SEQ ID NO: 3743 - DNA, 25 bp, Mus musculus
aaaagtgtcccaagcttcgattctg

SEQ ID NO: 3744 - DNA, 25 bp, Mus musculus
aaaagtgtcccatgcttcgattctg

SEQ ID NO: 3745 - DNA, 25 bp, Mus musculus
aaaagtgtccgactactgaagccaa

SEQ ID NO: 3746 - DNA, 25 bp, Mus musculus
aaaagtgtccgagtactgaagccaa

SEQ ID NO: 3747 - DNA, 25 bp, Mus musculus
aaaagtgtccgcacctaatcttctg

SEQ ID NO: 3748 - DNA, 25 bp, Mus musculus
aaaagtgtccgctcctaatcttctg

SEQ ID NO: 3749 - DNA, 25 bp, Mus musculus
aaaagtgtcgccatattctgccatt

SEQ ID NO: 3750 - DNA, 25 bp, Mus musculus
aaaagtgtcgccttattctgccatt

SEQ ID NO: 3751 - DNA, 25 bp, Mus musculus
aaaagtgtgaacagcctcaccctct

SEQ ID NO: 3752 - DNA, 25 bp, Mus musculus
aaaagtgtgaactgcctcaccctct

SEQ ID NO: 3753 - DNA, 25 bp, Mus musculus
aaaagtgtgctaccgcggagtgttc

SEQ ID NO: 3754 - DNA, 25 bp, Mus musculus
aaaagtgtgctagcgcggagtgttc

SEQ ID NO: 3755 - DNA, 25 bp, Mus musculus
aaaagtgtgcttaacattgacataa

SEQ ID NO: 3756 - DNA, 25 bp, Mus musculus
aaaagtgtgcttctgtgactgtgta

SEQ ID NO: 3757 - DNA, 25 bp, Mus musculus
aaaagtgtgcttgtgtgactgtgta

SEQ ID NO: 3758 - DNA, 25 bp, Mus musculus
aaaagtgtgctttacattgacataa

SEQ ID NO: 3759 - DNA, 25 bp, Mus musculus
aaaagtgtggtgatctagagaggca

SEQ ID NO: 3760 - DNA, 25 bp, Mus musculus
aaaagtgtggtgttctagagaggca

SEQ ID NO: 3761 - DNA, 25 bp, Mus musculus
aaaagtgtgtagagcctggcagcat

SEQ ID NO: 3762 - DNA, 25 bp, Mus musculus
aaaagtgtgtagtgcctggcagcat

SEQ ID NO: 3763 - DNA, 25 bp, Mus musculus
aaaagtgtgtcaacttgtctcccag

SEQ ID NO: 3764 - DNA, 25 bp, Mus musculus
aaaagtgtgtcatcttgtctcccag

SEQ ID NO: 3765 - DNA, 25 bp, Mus musculus
aaaagtgtgtgtcaccattgcccag

SEQ ID NO: 3766 - DNA, 25 bp, Mus musculus
aaaagtgtgtgtgaccattgcccag

SEQ ID NO: 3767 - DNA, 25 bp, Mus musculus
aaaagtgtgtttcttccgattctgc

SEQ ID NO: 3768 - DNA, 25 bp, Mus musculus
aaaagtgtgtttgttccgattctgc

SEQ ID NO: 3769 - DNA, 25 bp, Mus musculus
aaaagtgttacgattgagtgccaag

SEQ ID NO: 3770 - DNA, 25 bp, Mus musculus
aaaagtgttacgtttgagtgccaag

SEQ ID NO: 3771 - DNA, 25 bp, Mus musculus
aaaagtgttcatatgtacctcccat

SEQ ID NO: 3772 - DNA, 25 bp, Mus musculus
aaaagtgttcatttgtacctcccat

SEQ ID NO: 3773 - DNA, 25 bp, Mus musculus
aaaagtgttggcatcagccctacac

SEQ ID NO: 3774 - DNA, 25 bp, Mus musculus
aaaagtgttggcttcagccctacac

SEQ ID NO: 3775 - DNA, 25 bp, Mus musculus
aaaagtgtttcaccagctggatgta

SEQ ID NO: 3776 - DNA, 25 bp, Mus musculus
aaaagtgtttcagcagctggatgta

SEQ ID NO: 3777 - DNA, 25 bp, Mus musculus
aaaagtgtttgtctgcgcctaggac

SEQ ID NO: 3778 - DNA, 25 bp, Mus musculus
aaaagtgtttgtgtgcgcctaggac

SEQ ID NO: 3779 - DNA, 25 bp, Mus musculus
aaaagtgttttgctgtgtacacata

SEQ ID NO: 3780 - DNA, 25 bp, Mus musculus
aaaagtgttttggtgtgtacacata

SEQ ID NO: 3781 - DNA, 25 bp, Mus musculus
aaaagttaaaccacactgtgcagct

SEQ ID NO: 3782 - DNA, 25 bp, Mus musculus
aaaagttaaacctcactgtgcagct

SEQ ID NO: 3783 - DNA, 25 bp, Mus musculus
aaaagttaagtcctgcttctgttca

SEQ ID NO: 3784 - DNA, 25 bp, Mus musculus
aaaagttaagtcgtgcttctgttca

SEQ ID NO: 3785 - DNA, 25 bp, Mus musculus
aaaagttaatccagtttgccattca

SEQ ID NO: 3786 - DNA, 25 bp, Mus musculus
aaaagttaatcctgtttgccattca

SEQ ID NO: 3787 - DNA, 25 bp, Mus musculus
aaaagttacaccataagacagcttg

SEQ ID NO: 3788 - DNA, 25 bp, Mus musculus
aaaagttacaccttaagacagcttg

SEQ ID NO: 3789 - DNA, 25 bp, Mus musculus
aaaagttaggtcacggtcctgcagt

SEQ ID NO: 3790 - DNA, 25 bp, Mus musculus
aaaagttaggtctcggtcctgcagt

SEQ ID NO: 3791 - DNA, 25 bp, Mus musculus
aaaagttattgactcctggagccct

SEQ ID NO: 3792 - DNA, 25 bp, Mus musculus
aaaagttattgagtcctggagccct

SEQ ID NO: 3793 - DNA, 25 bp, Mus musculus
aaaagttcacttcttactgcaaaat

SEQ ID NO: 3794 - DNA, 25 bp, Mus musculus
aaaagttcacttgttactgcaaaat

SEQ ID NO: 3795 - DNA, 25 bp, Mus musculus
aaaagttcagtaaggtctcaaggag

SEQ ID NO: 3796 - DNA, 25 bp, Mus musculus
aaaagttcagtatggtctcaaggag

SEQ ID NO: 3797 - DNA, 25 bp, Mus musculus
aaaagttcatccacatctatctcga

SEQ ID NO: 3798 - DNA, 25 bp, Mus musculus
aaaagttcatcctcatctatctcga

SEQ ID NO: 3799 - DNA, 25 bp, Mus musculus
aaaagttcatttccagcttctacaa

SEQ ID NO: 3800 - DNA, 25 bp, Mus musculus
aaaagttcatttgcagcttctacaa

SEQ ID NO: 3801 - DNA, 25 bp, Mus musculus
aaaagttccagtaagccgcaatagc

SEQ ID NO: 3802 - DNA, 25 bp, Mus musculus
aaaagttccagttagccgcaatagc

SEQ ID NO: 3803 - DNA, 25 bp, Mus musculus
aaaagttcccacagtacctgtgtca

SEQ ID NO: 3804 - DNA, 25 bp, Mus musculus
aaaagttcccactgtacctgtgtca

SEQ ID NO: 3805 - DNA, 25 bp, Mus musculus
aaaagttcccgcagtggtccggcat

SEQ ID NO: 3806 - DNA, 25 bp, Mus musculus
aaaagttcccgctgtggtccggcat

SEQ ID NO: 3807 - DNA, 25 bp, Mus musculus
aaaagttccgcaaggccaggatttc

SEQ ID NO: 3808 - DNA, 25 bp, Mus musculus
aaaagttccgcatggccaggatttc

SEQ ID NO: 3809 - DNA, 25 bp, Mus musculus
aaaagttcctcgcacaccacggttg

SEQ ID NO: 3810 - DNA, 25 bp, Mus musculus
aaaagttcctcggacaccacggttg

SEQ ID NO: 3811 - DNA, 25 bp, Mus musculus
aaaagttcctttcacagcttcccag

SEQ ID NO: 3812 - DNA, 25 bp, Mus musculus
aaaagttcctttgacagcttcccag

SEQ ID NO: 3813 - DNA, 25 bp, Mus musculus
aaaagttctctcacatttgctgttg

SEQ ID NO: 3814 - DNA, 25 bp, Mus musculus
aaaagttctctctcatttgctgttg

SEQ ID NO: 3815 - DNA, 25 bp, Mus musculus
aaaagttcttagcaaattccaggct

SEQ ID NO: 3816 - DNA, 25 bp, Mus musculus
aaaagttcttaggaaattccaggct

SEQ ID NO: 3817 - DNA, 25 bp, Mus musculus
aaaagttctttcatatctctggtaa

SEQ ID NO: 3818 - DNA, 25 bp, Mus musculus
aaaagttctttcttatctctggtaa

SEQ ID NO: 3819 - DNA, 25 bp, Mus musculus
aaaagttcttttagctcattaggag

SEQ ID NO: 3820 - DNA, 25 bp, Mus musculus
aaaagttctttttgctcattaggag

SEQ ID NO: 3821 - DNA, 25 bp, Mus musculus
aaaagttgcatcaattatttttctc

SEQ ID NO: 3822 - DNA, 25 bp, Mus musculus
aaaagttgcatctattatttttctc

SEQ ID NO: 3823 - DNA, 25 bp, Mus musculus
aaaagttgccataagcctcagcttc

SEQ ID NO: 3824 - DNA, 25 bp, Mus musculus
aaaagttgccattagcctcagcttc

SEQ ID NO: 3825 - DNA, 25 bp, Mus musculus
aaaagttgcccaagatatgacccaa

SEQ ID NO: 3826 - DNA, 25 bp, Mus musculus
aaaagttgcccatgatatgacccaa

SEQ ID NO: 3827 - DNA, 25 bp, Mus musculus
aaaagttgccgtcgctgcctgagtt

SEQ ID NO: 3828 - DNA, 25 bp, Mus musculus
aaaagttgccgtggctgcctgagtt

SEQ ID NO: 3829 - DNA, 25 bp, Mus musculus
aaaagttgcgtgaaatcccctgagg

SEQ ID NO: 3830 - DNA, 25 bp, Mus musculus
aaaagttgcgtgtaatcccctgagg

SEQ ID NO: 3831 - DNA, 25 bp, Mus musculus
aaaagttgctatctccttgatgagc

SEQ ID NO: 3832 - DNA, 25 bp, Mus musculus
aaaagttgctatgtccttgatgagc

SEQ ID NO: 3833 - DNA, 25 bp, Mus musculus
aaaagttgctgcactgacagtctta

SEQ ID NO: 3834 - DNA, 25 bp, Mus musculus
aaaagttgctgctctgacagtctta

SEQ ID NO: 3835 - DNA, 25 bp, Mus musculus
aaaagttggccaagtgtacttcact

SEQ ID NO: 3836 - DNA, 25 bp, Mus musculus
aaaagttggccatgtgtacttcact

SEQ ID NO: 3837 - DNA, 25 bp, Mus musculus
aaaagttggctcaactaatgaatac

SEQ ID NO: 3838 - DNA, 25 bp, Mus musculus
aaaagttggctctactaatgaatac

SEQ ID NO: 3839 - DNA, 25 bp, Mus musculus
aaaagttgggttcccagcttctggg

SEQ ID NO: 3840 - DNA, 25 bp, Mus musculus
aaaagttgggttgccagcttctggg

SEQ ID NO: 3841 - DNA, 25 bp, Mus musculus
aaaagttgtattccaggcacagaag

SEQ ID NO: 3842 - DNA, 25 bp, Mus musculus
aaaagttgtattgcaggcacagaag

SEQ ID NO: 3843 - DNA, 25 bp, Mus musculus
aaaagttgtgatctcatgttgtctt

SEQ ID NO: 3844 - DNA, 25 bp, Mus musculus
aaaagttgtgatgtcatgttgtctt

SEQ ID NO: 3845 - DNA, 25 bp, Mus musculus
aaaagtttaacacctcggatgtctc

SEQ ID NO: 3846 - DNA, 25 bp, Mus musculus
aaaagtttaacagctcggatgtctc

SEQ ID NO: 3847 - DNA, 25 bp, Mus musculus
aaaagtttaaggcattttgctcaag

SEQ ID NO: 3848 - DNA, 25 bp, Mus musculus
aaaagtttaagggattttgctcaag

SEQ ID NO: 3849 - DNA, 25 bp, Mus musculus
aaaagtttactgctgagggattcat

SEQ ID NO: 3850 - DNA, 25 bp, Mus musculus
aaaagtttactggtgagggattcat

SEQ ID NO: 3851 - DNA, 25 bp, Mus musculus
aaaagtttcccaacttgagctgcaa

SEQ ID NO: 3852 - DNA, 25 bp, Mus musculus
aaaagtttcccatcttgagctgcaa

SEQ ID NO: 3853 - DNA, 25 bp, Mus musculus
aaaagtttctctccctacagtgcca

SEQ ID NO: 3854 - DNA, 25 bp, Mus musculus
aaaagtttctctgcctacagtgcca

SEQ ID NO: 3855 - DNA, 25 bp, Mus musculus
aaaagtttctgcacagaactgagga

SEQ ID NO: 3856 - DNA, 25 bp, Mus musculus
aaaagtttctgccttcacttcctgt

SEQ ID NO: 3857 - DNA, 25 bp, Mus musculus
aaaagtttctgcgttcacttcctgt

SEQ ID NO: 3858 - DNA, 25 bp, Mus musculus
aaaagtttctgctcagaactgagga

SEQ ID NO: 3859 - DNA, 25 bp, Mus musculus
aaaagtttctttacagtgttctgca

SEQ ID NO: 3860 - DNA, 25 bp, Mus musculus
aaaagtttcttttcagtgttctgca

SEQ ID NO: 3861 - DNA, 25 bp, Mus musculus
aaaagtttgagaatatcctaggcta

SEQ ID NO: 3862 - DNA, 25 bp, Mus musculus
aaaagtttgagattatcctaggcta

SEQ ID NO: 3863 - DNA, 25 bp, Mus musculus
aaaagtttgcccctcttgagtctgg

SEQ ID NO: 3864 - DNA, 25 bp, Mus musculus
aaaagtttgcccgtcttgagtctgg

SEQ ID NO: 3865 - DNA, 25 bp, Mus musculus
aaaataaaccagagccccatcagaa

SEQ ID NO: 3866 - DNA, 25 bp, Mus musculus
aaaataaaccagtgccccatcagaa

SEQ ID NO: 3867 - DNA, 25 bp, Mus musculus
aaaataaagactactgccaggcatg

SEQ ID NO: 3868 - DNA, 25 bp, Mus musculus
aaaataaagacttctgccaggcatg

SEQ ID NO: 3869 - DNA, 25 bp, Mus musculus
aaaataaatgaccactcgacctggg

SEQ ID NO: 3870 - DNA, 25 bp, Mus musculus
aaaataaatgacgactcgacctggg

SEQ ID NO: 3871 - DNA, 25 bp, Mus musculus
aaaataacctacatgtgcctgagcc

SEQ ID NO: 3872 - DNA, 25 bp, Mus musculus
aaaataacctacttgtgcctgagcc

SEQ ID NO: 3873 - DNA, 25 bp, Mus musculus
aaaataacgcaacaagcttgctgga

SEQ ID NO: 3874 - DNA, 25 bp, Mus musculus
aaaataacgcaagaagcttgctgga

SEQ ID NO: 3875 - DNA, 25 bp, Mus musculus
aaaataactactcgtcagcaggctt

SEQ ID NO: 3876 - DNA, 25 bp, Mus musculus
aaaataactactggtcagcaggctt

SEQ ID NO: 3877 - DNA, 25 bp, Mus musculus
aaaataacttcaaacttcctcacct

SEQ ID NO: 3878 - DNA, 25 bp, Mus musculus
aaaataacttcatacttcctcacct

SEQ ID NO: 3879 - DNA, 25 bp, Mus musculus
aaaataagagctccactcctgtccc

SEQ ID NO: 3880 - DNA, 25 bp, Mus musculus
aaaataagagctgcactcctgtccc

SEQ ID NO: 3881 - DNA, 25 bp, Mus musculus
aaaataagattccttcagaaggaca

SEQ ID NO: 3882 - DNA, 25 bp, Mus musculus
aaaataagattcgttcagaaggaca

SEQ ID NO: 3883 - DNA, 25 bp, Mus musculus
aaaataagcagccacctgcctggat

SEQ ID NO: 3884 - DNA, 25 bp, Mus musculus
aaaataagcagcgacctgcctggat

SEQ ID NO: 3885 - DNA, 25 bp, Mus musculus
aaaataagcctaacccatatatcgg

SEQ ID NO: 3886 - DNA, 25 bp, Mus musculus
aaaataagcctatcccatatatcgg

SEQ ID NO: 3887 - DNA, 25 bp, Mus musculus
aaaataagtagcagggccagggcct

SEQ ID NO: 3888 - DNA, 25 bp, Mus musculus
aaaataagtagctgggccagggcct

SEQ ID NO: 3889 - DNA, 25 bp, Mus musculus
aaaataagtggcaggaatttccttg

SEQ ID NO: 3890 - DNA, 25 bp, Mus musculus
aaaataagtggctggaatttccttg

SEQ ID NO: 3891 - DNA, 25 bp, Mus musculus
aaaataataattctcctggctacgt

SEQ ID NO: 3892 - DNA, 25 bp, Mus musculus
aaaataataattgtcctggctacgt

SEQ ID NO: 3893 - DNA, 25 bp, Mus musculus
aaaataatgctcagttccttttagc

SEQ ID NO: 3894 - DNA, 25 bp, Mus musculus
aaaataatgctctgttccttttagc

SEQ ID NO: 3895 - DNA, 25 bp, Mus musculus
aaaataatggctatccgaatgagag

SEQ ID NO: 3896 - DNA, 25 bp, Mus musculus
aaaataatggctttccgaatgagag

SEQ ID NO: 3897 - DNA, 25 bp, Mus musculus
aaaataatttttctggcctcaccag

SEQ ID NO: 3898 - DNA, 25 bp, Mus musculus
aaaataatttttgtggcctcaccag

SEQ ID NO: 3899 - DNA, 25 bp, Mus musculus
aaaatacaacgcacaaggcctgggc

SEQ ID NO: 3900 - DNA, 25 bp, Mus musculus
aaaatacaacgctcaaggcctgggc

SEQ ID NO: 3901 - DNA, 25 bp, Mus musculus
aaaatacaccagactgcaccttcaa

SEQ ID NO: 3902 - DNA, 25 bp, Mus musculus
aaaatacaccagtctgcaccttcaa

SEQ ID NO: 3903 - DNA, 25 bp, Mus musculus
aaaatacacctccttgtgattccca

SEQ ID NO: 3904 - DNA, 25 bp, Mus musculus
aaaatacacctcgttgtgattccca

SEQ ID NO: 3905 - DNA, 25 bp, Mus musculus
aaaatacaccttcgccatagctttg

SEQ ID NO: 3906 - DNA, 25 bp, Mus musculus
aaaatacaccttggccatagctttg

SEQ ID NO: 3907 - DNA, 25 bp, Mus musculus
aaaatacagacgaatcgctccttcc

SEQ ID NO: 3908 - DNA, 25 bp, Mus musculus
aaaatacagacgtatcgctccttcc

SEQ ID NO: 3909 - DNA, 25 bp, Mus musculus
aaaatacagggcactacagttcaga

SEQ ID NO: 3910 - DNA, 25 bp, Mus musculus
aaaatacagggctctacagttcaga

SEQ ID NO: 3911 - DNA, 25 bp, Mus musculus
aaaatacagtagaagcatgctccag

SEQ ID NO: 3912 - DNA, 25 bp, Mus musculus
aaaatacagtagtagcatgctccag

SEQ ID NO: 3913 - DNA, 25 bp, Mus musculus
aaaatacagtctcagaccctgcctc

SEQ ID NO: 3914 - DNA, 25 bp, Mus musculus
aaaatacagtctgagaccctgcctc

SEQ ID NO: 3915 - DNA, 25 bp, Mus musculus
aaaatacagtgcaccctgcagtgca

SEQ ID NO: 3916 - DNA, 25 bp, Mus musculus
aaaatacagtgctccctgcagtgca

SEQ ID NO: 3917 - DNA, 25 bp, Mus musculus
aaaatacatctacctttccagactc

SEQ ID NO: 3918 - DNA, 25 bp, Mus musculus
aaaatacatctagctttccagactc

SEQ ID NO: 3919 - DNA, 25 bp, Mus musculus
aaaataccagagctgatgttctcag

SEQ ID NO: 3920 - DNA, 25 bp, Mus musculus
aaaataccagaggtgatgttctcag

SEQ ID NO: 3921 - DNA, 25 bp, Mus musculus
aaaataccagatcaggcttggcaga

SEQ ID NO: 3922 - DNA, 25 bp, Mus musculus
aaaataccagatgaggcttggcaga

SEQ ID NO: 3923 - DNA, 25 bp, Mus musculus
aaaataccatctcggttcgtctcct

SEQ ID NO: 3924 - DNA, 25 bp, Mus musculus
aaaataccatctgggttcgtctcct

SEQ ID NO: 3925 - DNA, 25 bp, Mus musculus
aaaataccatggattgttcttttgg

SEQ ID NO: 3926 - DNA, 25 bp, Mus musculus
aaaataccatggtttgttcttttgg

SEQ ID NO: 3927 - DNA, 25 bp, Mus musculus
aaaatacccaatcagcaggctgatt

SEQ ID NO: 3928 - DNA, 25 bp, Mus musculus
aaaatacccaatgagcaggctgatt

SEQ ID NO: 3929 - DNA, 25 bp, Mus musculus
aaaatacccacacgtgtgcccagag

SEQ ID NO: 3930 - DNA, 25 bp, Mus musculus
aaaatacccacaggtgtgcccagag

SEQ ID NO: 3931 - DNA, 25 bp, Mus musculus
aaaatacccgacatccaacagcagg

SEQ ID NO: 3932 - DNA, 25 bp, Mus musculus
aaaatacccgacttccaacagcagg

SEQ ID NO: 3933 - DNA, 25 bp, Mus musculus
aaaatacccgcccatggattcagag

SEQ ID NO: 3934 - DNA, 25 bp, Mus musculus
aaaatacccgccgatggattcagag

SEQ ID NO: 3935 - DNA, 25 bp, Mus musculus
aaaatacctccccatagtgctaatt

SEQ ID NO: 3936 - DNA, 25 bp, Mus musculus
aaaatacctcccgatagtgctaatt

SEQ ID NO: 3937 - DNA, 25 bp, Mus musculus
aaaatacctctgctggtggcactct

SEQ ID NO: 3938 - DNA, 25 bp, Mus musculus
aaaatacctctggtggtggcactct

SEQ ID NO: 3939 - DNA, 25 bp, Mus musculus
aaaatacctgtacctgtgctccttg

SEQ ID NO: 3940 - DNA, 25 bp, Mus musculus
aaaatacctgtagctgtgctccttg

SEQ ID NO: 3941 - DNA, 25 bp, Mus musculus
aaaatacctgtgctcaagattgttt

SEQ ID NO: 3942 - DNA, 25 bp, Mus musculus
aaaatacctgtggtcaagattgttt

SEQ ID NO: 3943 - DNA, 25 bp, Mus musculus
aaaataccttagatgctggcctatc

SEQ ID NO: 3944 - DNA, 25 bp, Mus musculus
aaaataccttagttgctggcctatc

SEQ ID NO: 3945 - DNA, 25 bp, Mus musculus
aaaataccttccatgcatgatgccc

SEQ ID NO: 3946 - DNA, 25 bp, Mus musculus
aaaataccttccttgcatgatgccc

SEQ ID NO: 3947 - DNA, 25 bp, Mus musculus
aaaatacgacgactaccaccacgag

SEQ ID NO: 3948 - DNA, 25 bp, Mus musculus
aaaatacgacgagtaccaccacgag

SEQ ID NO: 3949 - DNA, 25 bp, Mus musculus
aaaatacgcaatctgagctgccgaa

SEQ ID NO: 3950 - DNA, 25 bp, Mus musculus
aaaatacgcaatgtgagctgccgaa

SEQ ID NO: 3951 - DNA, 25 bp, Mus musculus
aaaatactagtcacagactctgatg

SEQ ID NO: 3952 - DNA, 25 bp, Mus musculus
aaaatactagtctcagactctgatg

SEQ ID NO: 3953 - DNA, 25 bp, Mus musculus
aaaatactcctgcaaaatggaatat

SEQ ID NO: 3954 - DNA, 25 bp, Mus musculus
aaaatactcctggaaaatggaatat

SEQ ID NO: 3955 - DNA, 25 bp, Mus musculus
aaaatactcgtacccattcagcaag

SEQ ID NO: 3956 - DNA, 25 bp, Mus musculus
aaaatactcgtagccattcagcaag

SEQ ID NO: 3957 - DNA, 25 bp, Mus musculus
aaaatactgcttatgctccatcttc

SEQ ID NO: 3958 - DNA, 25 bp, Mus musculus
aaaatactgcttttgctccatcttc

SEQ ID NO: 3959 - DNA, 25 bp, Mus musculus
aaaatactggagcaggagcaaactg

SEQ ID NO: 3960 - DNA, 25 bp, Mus musculus
aaaatactggaggaggagcaaactg

SEQ ID NO: 3961 - DNA, 25 bp, Mus musculus
aaaatactggccagccatgtccttt

SEQ ID NO: 3962 - DNA, 25 bp, Mus musculus
aaaatactggcctgccatgtccttt

SEQ ID NO: 3963 - DNA, 25 bp, Mus musculus
aaaatactgtatcaccaggtggtgg

SEQ ID NO: 3964 - DNA, 25 bp, Mus musculus
aaaatactgtatgaccaggtggtgg

SEQ ID NO: 3965 - DNA, 25 bp, Mus musculus
aaaatactgtccctggatcctagta

SEQ ID NO: 3966 - DNA, 25 bp, Mus musculus
aaaatactgtccgtggatcctagta

SEQ ID NO: 3967 - DNA, 25 bp, Mus musculus
aaaatacttagaatgttacagggtg

SEQ ID NO: 3968 - DNA, 25 bp, Mus musculus
aaaatacttagattgttacagggtg

SEQ ID NO: 3969 - DNA, 25 bp, Mus musculus
aaaatacttcaaccacttctctcct

SEQ ID NO: 3970 - DNA, 25 bp, Mus musculus
aaaatacttcaagcacttctctcct

SEQ ID NO: 3971 - DNA, 25 bp, Mus musculus
aaaatacttctacttctgggctgga

SEQ ID NO: 3972 - DNA, 25 bp, Mus musculus
aaaatacttctagttctgggctgga

SEQ ID NO: 3973 - DNA, 25 bp, Mus musculus
aaaatacttgctatttagtagcttg

SEQ ID NO: 3974 - DNA, 25 bp, Mus musculus
aaaatacttgctttttagtagcttg

SEQ ID NO: 3975 - DNA, 25 bp, Mus musculus
aaaatagactagaaaaggctgtgga

SEQ ID NO: 3976 - DNA, 25 bp, Mus musculus
aaaatagactagtaaaggctgtgga

SEQ ID NO: 3977 - DNA, 25 bp, Mus musculus
aaaatagactctctgatcctcaaat

SEQ ID NO: 3978 - DNA, 25 bp, Mus musculus
aaaatagactctgtgatcctcaaat

SEQ ID NO: 3979 - DNA, 25 bp, Mus musculus
aaaatagatcctaagtgactgacac

SEQ ID NO: 3980 - DNA, 25 bp, Mus musculus
aaaatagatccttagtgactgacac

SEQ ID NO: 3981 - DNA, 25 bp, Mus musculus
aaaatagatgtgctgtagctgcgaa

SEQ ID NO: 3982 - DNA, 25 bp, Mus musculus
aaaatagatgtggtgtagctgcgaa

SEQ ID NO: 3983 - DNA, 25 bp, Mus musculus
aaaatagcagaaatcctgactcagc

SEQ ID NO: 3984 - DNA, 25 bp, Mus musculus
aaaatagcagaattcctgactcagc

SEQ ID NO: 3985 - DNA, 25 bp, Mus musculus
aaaatagcatcactcggctcaccga

SEQ ID NO: 3986 - DNA, 25 bp, Mus musculus
aaaatagcatcagtcggctcaccga

SEQ ID NO: 3987 - DNA, 25 bp, Mus musculus
aaaatagcatttccaaccctttgat

SEQ ID NO: 3988 - DNA, 25 bp, Mus musculus
aaaatagcatttgcaaccctttgat

SEQ ID NO: 3989 - DNA, 25 bp, Mus musculus
aaaatagccaaccatcaccaacagt

SEQ ID NO: 3990 - DNA, 25 bp, Mus musculus
aaaatagccaacgatcaccaacagt

SEQ ID NO: 3991 - DNA, 25 bp, Mus musculus
aaaatagccactcccacgttgatgt

SEQ ID NO: 3992 - DNA, 25 bp, Mus musculus
aaaatagccactgccacgttgatgt

SEQ ID NO: 3993 - DNA, 25 bp, Mus musculus
aaaatagcccagagcctagtccata

SEQ ID NO: 3994 - DNA, 25 bp, Mus musculus
aaaatagcccagtgcctagtccata

SEQ ID NO: 3995 - DNA, 25 bp, Mus musculus
aaaatagccctcatttagacgcaaa

SEQ ID NO: 3996 - DNA, 25 bp, Mus musculus
aaaatagccctcttttagacgcaaa

SEQ ID NO: 3997 - DNA, 25 bp, Mus musculus
aaaatagccgtgcattagtcccgta

SEQ ID NO: 3998 - DNA, 25 bp, Mus musculus
aaaatagccgtggattagtcccgta

SEQ ID NO: 3999 - DNA, 25 bp, Mus musculus
aaaatagcctaactgtgccccttct

SEQ ID NO: 4000 - DNA, 25 bp, Mus musculus
aaaatagcctaagtgtgccccttct

SEQ ID NO: 4001 - DNA, 25 bp, Mus musculus
aaaatagcctcactgttagagatgg

SEQ ID NO: 4002 - DNA, 25 bp, Mus musculus
aaaatagcctcagtgttagagatgg

SEQ ID NO: 4003 - DNA, 25 bp, Mus musculus
aaaatagcctgcctgtagcccgagc

SEQ ID NO: 4004 - DNA, 25 bp, Mus musculus
aaaatagcctgcgtgtagcccgagc

SEQ ID NO: 4005 - DNA, 25 bp, Mus musculus
aaaatagctcatccaaacaggcagg

SEQ ID NO: 4006 - DNA, 25 bp, Mus musculus
aaaatagctcatgcaaacaggcagg

SEQ ID NO: 4007 - DNA, 25 bp, Mus musculus
aaaatagctgcaaggcctggcctca

SEQ ID NO: 4008 - DNA, 25 bp, Mus musculus
aaaatagctgcatggcctggcctca

SEQ ID NO: 4009 - DNA, 25 bp, Mus musculus
aaaatagctgttccctcactaagtg

SEQ ID NO: 4010 - DNA, 25 bp, Mus musculus
aaaatagctgttgcctcactaagtg

SEQ ID NO: 4011 - DNA, 25 bp, Mus musculus
aaaatagcttccctgacgatcccag

SEQ ID NO: 4012 - DNA, 25 bp, Mus musculus
aaaatagcttccgtgacgatcccag

SEQ ID NO: 4013 - DNA, 25 bp, Mus musculus
aaaatagcttgtctcactttcttga

SEQ ID NO: 4014 - DNA, 25 bp, Mus musculus
aaaatagcttgtgtcactttcttga

SEQ ID NO: 4015 - DNA, 25 bp, Mus musculus
aaaataggacacatgattcttttca

SEQ ID NO: 4016 - DNA, 25 bp, Mus musculus
aaaataggacacttgattcttttca

SEQ ID NO: 4017 - DNA, 25 bp, Mus musculus
aaaataggatgtatcctcgctccac

SEQ ID NO: 4018 - DNA, 25 bp, Mus musculus
aaaataggatgtttcctcgctccac

SEQ ID NO: 4019 - DNA, 25 bp, Mus musculus
aaaataggccacagttcccatctgc

SEQ ID NO: 4020 - DNA, 25 bp, Mus musculus
aaaataggccactgttcccatctgc

SEQ ID NO: 4021 - DNA, 25 bp, Mus musculus
aaaataggccatcctcttgcctctt

SEQ ID NO: 4022 - DNA, 25 bp, Mus musculus
aaaataggccatctttaggtgctca

SEQ ID NO: 4023 - DNA, 25 bp, Mus musculus
aaaataggccatgctcttgcctctt

SEQ ID NO: 4024 - DNA, 25 bp, Mus musculus
aaaataggccatgtttaggtgctca

SEQ ID NO: 4025 - DNA, 25 bp, Mus musculus
aaaataggcctgctgtctactgctc

SEQ ID NO: 4026 - DNA, 25 bp, Mus musculus
aaaataggcctggtgtctactgctc

SEQ ID NO: 4027 - DNA, 25 bp, Mus musculus
aaaataggctctctttaggctctgc

SEQ ID NO: 4028 - DNA, 25 bp, Mus musculus
aaaataggctctgtttaggctctgc

SEQ ID NO: 4029 - DNA, 25 bp, Mus musculus
aaaataggctgtatccctgacacct

SEQ ID NO: 4030 - DNA, 25 bp, Mus musculus
aaaataggctgtttccctgacacct

SEQ ID NO: 4031 - DNA, 25 bp, Mus musculus
aaaatagggctgaggctatggatca

SEQ ID NO: 4032 - DNA, 25 bp, Mus musculus
aaaatagggctgtggctatggatca

SEQ ID NO: 4033 - DNA, 25 bp, Mus musculus
aaaatagtcaaaagtgccgggcact

SEQ ID NO: 4034 - DNA, 25 bp, Mus musculus
aaaatagtcaaatgtgccgggcact

SEQ ID NO: 4035 - DNA, 25 bp, Mus musculus
aaaatagtcaatccagctgccaact

SEQ ID NO: 4036 - DNA, 25 bp, Mus musculus
aaaatagtcaatgcagctgccaact

SEQ ID NO: 4037 - DNA, 25 bp, Mus musculus
aaaatagtcatcaagattatgctaa

SEQ ID NO: 4038 - DNA, 25 bp, Mus musculus
aaaatagtcatctagattatgctaa

SEQ ID NO: 4039 - DNA, 25 bp, Mus musculus
aaaatagtcgatcctatgttatgta

SEQ ID NO: 4040 - DNA, 25 bp, Mus musculus
aaaatagtcgatgctatgttatgta

SEQ ID NO: 4041 - DNA, 25 bp, Mus musculus
aaaatagtctctagtaccccaggct

SEQ ID NO: 4042 - DNA, 25 bp, Mus musculus
aaaatagtctcttgtaccccaggct

SEQ ID NO: 4043 - DNA, 25 bp, Mus musculus
aaaatagtcttacccctgcagcttg

SEQ ID NO: 4044 - DNA, 25 bp, Mus musculus
aaaatagtcttagccctgcagcttg

SEQ ID NO: 4045 - DNA, 25 bp, Mus musculus
aaaatagtctttctccagtgcttaa

SEQ ID NO: 4046 - DNA, 25 bp, Mus musculus
aaaatagtctttgtccagtgcttaa

SEQ ID NO: 4047 - DNA, 25 bp, Mus musculus
aaaatagtgcatacctgcgtgattt

SEQ ID NO: 4048 - DNA, 25 bp, Mus musculus
aaaatagtgcattcctgcgtgattt

SEQ ID NO: 4049 - DNA, 25 bp, Mus musculus
aaaatagtgtgtcacccgctcggct

SEQ ID NO: 4050 - DNA, 25 bp, Mus musculus
aaaatagtgtgtccccagctaggca

SEQ ID NO: 4051 - DNA, 25 bp, Mus musculus
aaaatagtgtgtgacccgctcggct

SEQ ID NO: 4052 - DNA, 25 bp, Mus musculus
aaaatagtgtgtgcccagctaggca

SEQ ID NO: 4053 - DNA, 25 bp, Mus musculus
aaaatagttatgactgtgggctgga

SEQ ID NO: 4054 - DNA, 25 bp, Mus musculus
aaaatagttatgtctgtgggctgga

SEQ ID NO: 4055 - DNA, 25 bp, Mus musculus
aaaatagttctcacattaatgacca

SEQ ID NO: 4056 - DNA, 25 bp, Mus musculus
aaaatagttctctcattaatgacca

SEQ ID NO: 4057 - DNA, 25 bp, Mus musculus
aaaatagttgcacggctctggtcag

SEQ ID NO: 4058 - DNA, 25 bp, Mus musculus
aaaatagttgcagggctctggtcag

SEQ ID NO: 4059 - DNA, 25 bp, Mus musculus
aaaatagttgccagtaccgcataaa

SEQ ID NO: 4060 - DNA, 25 bp, Mus musculus
aaaatagttgcctgtaccgcataaa

SEQ ID NO: 4061 - DNA, 25 bp, Mus musculus
aaaatagttgggactggtagtgctg

SEQ ID NO: 4062 - DNA, 25 bp, Mus musculus
aaaatagttgggtctggtagtgctg

SEQ ID NO: 4063 - DNA, 25 bp, Mus musculus
aaaatagttgtccatattttcacat

SEQ ID NO: 4064 - DNA, 25 bp, Mus musculus
aaaatagttgtcgatattttcacat

SEQ ID NO: 4065 - DNA, 25 bp, Mus musculus
aaaatagtttctaactggtatgcta

SEQ ID NO: 4066 - DNA, 25 bp, Mus musculus
aaaatagtttcttactggtatgcta

SEQ ID NO: 4067 - DNA, 25 bp, Mus musculus
aaaatataatcaagctgaccccccc

SEQ ID NO: 4068 - DNA, 25 bp, Mus musculus
aaaatataatcatgctgaccccccc

SEQ ID NO: 4069 - DNA, 25 bp, Mus musculus
aaaatatagttcctcctcttactgc

SEQ ID NO: 4070 - DNA, 25 bp, Mus musculus
aaaatatagttcgtcctcttactgc

SEQ ID NO: 4071 - DNA, 25 bp, Mus musculus
aaaatatcagagcaacccgaaggtt

SEQ ID NO: 4072 - DNA, 25 bp, Mus musculus
aaaatatcagaggaacccgaaggtt

SEQ ID NO: 4073 - DNA, 25 bp, Mus musculus
aaaatatcagtactacacactgctt

SEQ ID NO: 4074 - DNA, 25 bp, Mus musculus
aaaatatcagtagtacacactgctt

SEQ ID NO: 4075 - DNA, 25 bp, Mus musculus
aaaatatcctcaactgttccttcag

SEQ ID NO: 4076 - DNA, 25 bp, Mus musculus
aaaatatcctcatctgttccttcag

SEQ ID NO: 4077 - DNA, 25 bp, Mus musculus
aaaatatcctcgcaagagtgcgccc

SEQ ID NO: 4078 - DNA, 25 bp, Mus musculus
aaaatatcctcggaagagtgcgccc

SEQ ID NO: 4079 - DNA, 25 bp, Mus musculus
aaaatatcctggcattgctcccgag

SEQ ID NO: 4080 - DNA, 25 bp, Mus musculus
aaaatatcctgggattgctcccgag

SEQ ID NO: 4081 - DNA, 25 bp, Mus musculus
aaaatatcgccgcaatcccttctgc

SEQ ID NO: 4082 - DNA, 25 bp, Mus musculus
aaaatatcgccggaatcccttctgc

SEQ ID NO: 4083 - DNA, 25 bp, Mus musculus
aaaatatgaattacctgaagctagc

SEQ ID NO: 4084 - DNA, 25 bp, Mus musculus
aaaatatgaattcctctggtcccag

SEQ ID NO: 4085 - DNA, 25 bp, Mus musculus
aaaatatgaattgctctggtcccag

SEQ ID NO: 4086 - DNA, 25 bp, Mus musculus
aaaatatgaatttcctgaagctagc

SEQ ID NO: 4087 - DNA, 25 bp, Mus musculus
aaaatatgcactctttaggattggg

SEQ ID NO: 4088 - DNA, 25 bp, Mus musculus
aaaatatgcactgtttaggattggg

SEQ ID NO: 4089 - DNA, 25 bp, Mus musculus
aaaatatgcggaatgcctgcctgga

SEQ ID NO: 4090 - DNA, 25 bp, Mus musculus
aaaatatgcggattgcctgcctgga

SEQ ID NO: 4091 - DNA, 25 bp, Mus musculus
aaaatatgctaacccctgtgctcac

SEQ ID NO: 4092 - DNA, 25 bp, Mus musculus
aaaatatgctaagccctgtgctcac

SEQ ID NO: 4093 - DNA, 25 bp, Mus musculus
aaaatatgcttgcttaacatttgca

SEQ ID NO: 4094 - DNA, 25 bp, Mus musculus
aaaatatgcttggttaacatttgca

SEQ ID NO: 4095 - DNA, 25 bp, Mus musculus
aaaatatgctttcctcccaccataa

SEQ ID NO: 4096 - DNA, 25 bp, Mus musculus
aaaatatgctttgctcccaccataa

SEQ ID NO: 4097 - DNA, 25 bp, Mus musculus
aaaatatgggcacaagacttgggca

SEQ ID NO: 4098 - DNA, 25 bp, Mus musculus
aaaatatgggcagaagacttgggca

SEQ ID NO: 4099 - DNA, 25 bp, Mus musculus
aaaatatgtcttctgcaggaaacca

SEQ ID NO: 4100 - DNA, 25 bp, Mus musculus
aaaatatgtcttgtgcaggaaacca

SEQ ID NO: 4101 - DNA, 25 bp, Mus musculus
aaaatattatctctcggccaaggca

SEQ ID NO: 4102 - DNA, 25 bp, Mus musculus
aaaatattatctgtcggccaaggca

SEQ ID NO: 4103 - DNA, 25 bp, Mus musculus
aaaatattccagatcatgctcatga

SEQ ID NO: 4104 - DNA, 25 bp, Mus musculus
aaaatattccagttcatgctcatga

SEQ ID NO: 4105 - DNA, 25 bp, Mus musculus
aaaatattctgccaggccccaagaa

SEQ ID NO: 4106 - DNA, 25 bp, Mus musculus
aaaatattctgcgaggccccaagaa

SEQ ID NO: 4107 - DNA, 25 bp, Mus musculus
aaaatattctgtctgccacaggccc

SEQ ID NO: 4108 - DNA, 25 bp, Mus musculus
aaaatattctgtgtgccacaggccc

SEQ ID NO: 4109 - DNA, 25 bp, Mus musculus
aaaatatttcctagtctatgctgac

SEQ ID NO: 4110 - DNA, 25 bp, Mus musculus
aaaatatttccttgtctatgctgac

SEQ ID NO: 4111 - DNA, 25 bp, Mus musculus
aaaatatttgggaatggcactgact

SEQ ID NO: 4112 - DNA, 25 bp, Mus musculus
aaaatatttgggtatggcactgact

SEQ ID NO: 4113 - DNA, 25 bp, Mus musculus
aaaatcaaaacactagccgcgacgt

SEQ ID NO: 4114 - DNA, 25 bp, Mus musculus
aaaatcaaaacagtagccgcgacgt

SEQ ID NO: 4115 - DNA, 25 bp, Mus musculus
aaaatcaacatcaccaacatatccc

SEQ ID NO: 4116 - DNA, 25 bp, Mus musculus
aaaatcaacatctccaacatatccc

SEQ ID NO: 4117 - DNA, 25 bp, Mus musculus
aaaatcaactaaacatgggcaaagg

SEQ ID NO: 4118 - DNA, 25 bp, Mus musculus
aaaatcaactaatcatgggcaaagg

SEQ ID NO: 4119 - DNA, 25 bp, Mus musculus
aaaatcaactatctctttggcttag

SEQ ID NO: 4120 - DNA, 25 bp, Mus musculus
aaaatcaactatgtctttggcttag

SEQ ID NO: 4121 - DNA, 25 bp, Mus musculus
aaaatcaacttaatatgtcaggcat

SEQ ID NO: 4122 - DNA, 25 bp, Mus musculus
aaaatcaacttattatgtcaggcat

SEQ ID NO: 4123 - DNA, 25 bp, Mus musculus
aaaatcaagatcactgctcctcagg

SEQ ID NO: 4124 - DNA, 25 bp, Mus musculus
aaaatcaagatctctgctcctcagg

SEQ ID NO: 4125 - DNA, 25 bp, Mus musculus
aaaatcaagcccctcaagaagtact

SEQ ID NO: 4126 - DNA, 25 bp, Mus musculus
aaaatcaagcccgtcaagaagtact

SEQ ID NO: 4127 - DNA, 25 bp, Mus musculus
aaaatcaagtaaccgcttctcagct

SEQ ID NO: 4128 - DNA, 25 bp, Mus musculus
aaaatcaagtaagcgcttctcagct

SEQ ID NO: 4129 - DNA, 25 bp, Mus musculus
aaaatcaatgtaatcctgcctgctc

SEQ ID NO: 4130 - DNA, 25 bp, Mus musculus
aaaatcaatgtattcctgcctgctc

SEQ ID NO: 4131 - DNA, 25 bp, Mus musculus
aaaatcaattctaacccactctata

SEQ ID NO: 4132 - DNA, 25 bp, Mus musculus
aaaatcaattcttacccactctata

SEQ ID NO: 4133 - DNA, 25 bp, Mus musculus
aaaatcacatcaaaagttgcacaaa

SEQ ID NO: 4134 - DNA, 25 bp, Mus musculus
aaaatcacatcataagttgcacaaa

SEQ ID NO: 4135 - DNA, 25 bp, Mus musculus
aaaatcacattaaactgaacctggg

SEQ ID NO: 4136 - DNA, 25 bp, Mus musculus
aaaatcacattatactgaacctggg

SEQ ID NO: 4137 - DNA, 25 bp, Mus musculus
aaaatcacattcactgttcagccgt

SEQ ID NO: 4138 - DNA, 25 bp, Mus musculus
aaaatcacattctctgttcagccgt

SEQ ID NO: 4139 - DNA, 25 bp, Mus musculus
aaaatcaccactattgcaagctgtt

SEQ ID NO: 4140 - DNA, 25 bp, Mus musculus
aaaatcaccacttttgcaagctgtt

SEQ ID NO: 4141 - DNA, 25 bp, Mus musculus
aaaatcaccgggatgctgctggaaa

SEQ ID NO: 4142 - DNA, 25 bp, Mus musculus
aaaatcaccgggttgctgctggaaa

SEQ ID NO: 4143 - DNA, 25 bp, Mus musculus
aaaatcacgcccctgctagatagag

SEQ ID NO: 4144 - DNA, 25 bp, Mus musculus
aaaatcacgcccgtgctagatagag

SEQ ID NO: 4145 - DNA, 25 bp, Mus musculus
aaaatcacgctaacgacgccttgtt

SEQ ID NO: 4146 - DNA, 25 bp, Mus musculus
aaaatcacgctatcgacgccttgtt

SEQ ID NO: 4147 - DNA, 25 bp, Mus musculus
aaaatcactcacagaatcgcttcag

SEQ ID NO: 4148 - DNA, 25 bp, Mus musculus
aaaatcactcactgaatcgcttcag

SEQ ID NO: 4149 - DNA, 25 bp, Mus musculus
aaaatcactctcagtcattcctgtc

SEQ ID NO: 4150 - DNA, 25 bp, Mus musculus
aaaatcactctctgtcattcctgtc

SEQ ID NO: 4151 - DNA, 25 bp, Mus musculus
aaaatcactgcgcaattgctagtta

SEQ ID NO: 4152 - DNA, 25 bp, Mus musculus
aaaatcactgcggaattgctagtta

SEQ ID NO: 4153 - DNA, 25 bp, Mus musculus
aaaatcactgtcctactgaggccca

SEQ ID NO: 4154 - DNA, 25 bp, Mus musculus
aaaatcactgtcgtactgaggccca

SEQ ID NO: 4155 - DNA, 25 bp, Mus musculus
aaaatcagacgcatgatcctgccat

SEQ ID NO: 4156 - DNA, 25 bp, Mus musculus
aaaatcagacgcttgatcctgccat

SEQ ID NO: 4157 - DNA, 25 bp, Mus musculus
aaaatcagaggccaacaggtaaggg

SEQ ID NO: 4158 - DNA, 25 bp, Mus musculus
aaaatcagaggccattcccaaccaa

SEQ ID NO: 4159 - DNA, 25 bp, Mus musculus
aaaatcagaggcgaacaggtaaggg

SEQ ID NO: 4160 - DNA, 25 bp, Mus musculus
aaaatcagaggcgattcccaaccaa

SEQ ID NO: 4161 - DNA, 25 bp, Mus musculus
aaaatcagatgccaagaacttcaga

SEQ ID NO: 4162 - DNA, 25 bp, Mus musculus
aaaatcagatgcgaagaacttcaga

SEQ ID NO: 4163 - DNA, 25 bp, Mus musculus
aaaatcagcagcctcctggaggagc

SEQ ID NO: 4164 - DNA, 25 bp, Mus musculus
aaaatcagcagcgtcctggaggagc

SEQ ID NO: 4165 - DNA, 25 bp, Mus musculus
aaaatcagccttctgaacatgtcag

SEQ ID NO: 4166 - DNA, 25 bp, Mus musculus
aaaatcagccttgtgaacatgtcag

SEQ ID NO: 4167 - DNA, 25 bp, Mus musculus
aaaatcagctttcggagagccttcc

SEQ ID NO: 4168 - DNA, 25 bp, Mus musculus
aaaatcagctttgggagagccttcc

SEQ ID NO: 4169 - DNA, 25 bp, Mus musculus
aaaatcaggtgcactccatgtttgt

SEQ ID NO: 4170 - DNA, 25 bp, Mus musculus
aaaatcaggtgctctccatgtttgt

SEQ ID NO: 4171 - DNA, 25 bp, Mus musculus
aaaatcagtattcttagaggcaggg

SEQ ID NO: 4172 - DNA, 25 bp, Mus musculus
aaaatcagtattgttagaggcaggg

SEQ ID NO: 4173 - DNA, 25 bp, Mus musculus
aaaatcagtcctacagctctaaggt

SEQ ID NO: 4174 - DNA, 25 bp, Mus musculus
aaaatcagtcctctgcagtgctctt

SEQ ID NO: 4175 - DNA, 25 bp, Mus musculus
aaaatcagtcctgtgcagtgctctt

SEQ ID NO: 4176 - DNA, 25 bp, Mus musculus
aaaatcagtccttcagctctaaggt

SEQ ID NO: 4177 - DNA, 25 bp, Mus musculus
aaaatcagtctccaagttccttctg

SEQ ID NO: 4178 - DNA, 25 bp, Mus musculus
aaaatcagtctcgaagttccttctg

SEQ ID NO: 4179 - DNA, 25 bp, Mus musculus
aaaatcagtgatcgaagagaggcct

SEQ ID NO: 4180 - DNA, 25 bp, Mus musculus
aaaatcagtgatggaagagaggcct

SEQ ID NO: 4181 - DNA, 25 bp, Mus musculus
aaaatcagtgtcacgtagtcccagt

SEQ ID NO: 4182 - DNA, 25 bp, Mus musculus
aaaatcagtgtctcgtagtcccagt

SEQ ID NO: 4183 - DNA, 25 bp, Mus musculus
aaaatcagttcccagtaaagcagtg

SEQ ID NO: 4184 - DNA, 25 bp, Mus musculus
aaaatcagttccgagtaaagcagtg

SEQ ID NO: 4185 - DNA, 25 bp, Mus musculus
aaaatcatattcacttgtctgtaat

SEQ ID NO: 4186 - DNA, 25 bp, Mus musculus
aaaatcatattctcttgtctgtaat

SEQ ID NO: 4187 - DNA, 25 bp, Mus musculus
aaaatcatctaccatcttattgaag

SEQ ID NO: 4188 - DNA, 25 bp, Mus musculus
aaaatcatctacgatcttattgaag

SEQ ID NO: 4189 - DNA, 25 bp, Mus musculus
aaaatcatgcctctatccggcacca

SEQ ID NO: 4190 - DNA, 25 bp, Mus musculus
aaaatcatgcctgtatccggcacca

SEQ ID NO: 4191 - DNA, 25 bp, Mus musculus
aaaatcatgcttccacccttggtgt

SEQ ID NO: 4192 - DNA, 25 bp, Mus musculus
aaaatcatgcttgcacccttggtgt

SEQ ID NO: 4193 - DNA, 25 bp, Mus musculus
aaaatcatgttaccccttccagtgt

SEQ ID NO: 4194 - DNA, 25 bp, Mus musculus
aaaatcatgttagcccttccagtgt

SEQ ID NO: 4195 - DNA, 25 bp, Mus musculus
aaaatcatgttcagtcctataagga

SEQ ID NO: 4196 - DNA, 25 bp, Mus musculus
aaaatcatgttccttggaggcccca

SEQ ID NO: 4197 - DNA, 25 bp, Mus musculus
aaaatcatgttcgttggaggcccca

SEQ ID NO: 4198 - DNA, 25 bp, Mus musculus
aaaatcatgttctgtcctataagga

SEQ ID NO: 4199 - DNA, 25 bp, Mus musculus
aaaatcattaggcacagtctggtaa

SEQ ID NO: 4200 - DNA, 25 bp, Mus musculus
aaaatcattagggacagtctggtaa

SEQ ID NO: 4201 - DNA, 25 bp, Mus musculus
aaaatcattctactttccacccaat

SEQ ID NO: 4202 - DNA, 25 bp, Mus musculus
aaaatcattctagtttccacccaat

SEQ ID NO: 4203 - DNA, 25 bp, Mus musculus
aaaatcattgcactttggtcagaaa

SEQ ID NO: 4204 - DNA, 25 bp, Mus musculus
aaaatcattgcagtttggtcagaaa

SEQ ID NO: 4205 - DNA, 25 bp, Mus musculus
aaaatcatttcccattcatatactg

SEQ ID NO: 4206 - DNA, 25 bp, Mus musculus
aaaatcatttccgattcatatactg

SEQ ID NO: 4207 - DNA, 25 bp, Mus musculus
aaaatcatttctagcactgtgaagc

SEQ ID NO: 4208 - DNA, 25 bp, Mus musculus
aaaatcatttcttgcactgtgaagc

SEQ ID NO: 4209 - DNA, 25 bp, Mus musculus
aaaatcatttgcacattcctgagta

SEQ ID NO: 4210 - DNA, 25 bp, Mus musculus
aaaatcatttgctcattcctgagta

SEQ ID NO: 4211 - DNA, 25 bp, Mus musculus
aaaatccaagccacacaactgttca

SEQ ID NO: 4212 - DNA, 25 bp, Mus musculus
aaaatccaagcctcacaactgttca

SEQ ID NO: 4213 - DNA, 25 bp, Mus musculus
aaaatccaatgtctgggtcaggcat

SEQ ID NO: 4214 - DNA, 25 bp, Mus musculus
aaaatccaatgtgtgggtcaggcat

SEQ ID NO: 4215 - DNA, 25 bp, Mus musculus
aaaatccacagtcacaaaacccctg

SEQ ID NO: 4216 - DNA, 25 bp, Mus musculus
aaaatccacagtgacaaaacccctg

SEQ ID NO: 4217 - DNA, 25 bp, Mus musculus
aaaatccaccttaactgcctctatt

SEQ ID NO: 4218 - DNA, 25 bp, Mus musculus
aaaatccacctttactgcctctatt

SEQ ID NO: 4219 - DNA, 25 bp, Mus musculus
aaaatccacggaaacctttgcaggt

SEQ ID NO: 4220 - DNA, 25 bp, Mus musculus
aaaatccacggatacctttgcaggt

SEQ ID NO: 4221 - DNA, 25 bp, Mus musculus
aaaatccacgtgatgtcagctttct

SEQ ID NO: 4222 - DNA, 25 bp, Mus musculus
aaaatccacgtgttgtcagctttct

SEQ ID NO: 4223 - DNA, 25 bp, Mus musculus
aaaatccagcagatcgagcgcgagt

SEQ ID NO: 4224 - DNA, 25 bp, Mus musculus
aaaatccagcagttcgagcgcgagt

SEQ ID NO: 4225 - DNA, 25 bp, Mus musculus
aaaatccagctgagatgggctacat

SEQ ID NO: 4226 - DNA, 25 bp, Mus musculus
aaaatccagctgtgatgggctacat

SEQ ID NO: 4227 - DNA, 25 bp, Mus musculus
aaaatccagcttactgcctgtcggc

SEQ ID NO: 4228 - DNA, 25 bp, Mus musculus
aaaatccagctttctgcctgtcggc

SEQ ID NO: 4229 - DNA, 25 bp, Mus musculus
aaaatccagggaagccgcacatctc

SEQ ID NO: 4230 - DNA, 25 bp, Mus musculus
aaaatccagggatgccgcacatctc

SEQ ID NO: 4231 - DNA, 25 bp, Mus musculus
aaaatccagggtcaacactgcacca

SEQ ID NO: 4232 - DNA, 25 bp, Mus musculus
aaaatccagggtgaacactgcacca

SEQ ID NO: 4233 - DNA, 25 bp, Mus musculus
aaaatccagtcaccggagggctgca

SEQ ID NO: 4234 - DNA, 25 bp, Mus musculus
aaaatccagtcagcggagggctgca

SEQ ID NO: 4235 - DNA, 25 bp, Mus musculus
aaaatccagttgcagttttggttgc

SEQ ID NO: 4236 - DNA, 25 bp, Mus musculus
aaaatccagttggagttttggttgc

SEQ ID NO: 4237 - DNA, 25 bp, Mus musculus
aaaatccagtttacatctctgcaga

SEQ ID NO: 4238 - DNA, 25 bp, Mus musculus
aaaatccagttttcatctctgcaga

SEQ ID NO: 4239 - DNA, 25 bp, Mus musculus
aaaatccatcccaatactcaggcag

SEQ ID NO: 4240 - DNA, 25 bp, Mus musculus
aaaatccatccctatactcaggcag

SEQ ID NO: 4241 - DNA, 25 bp, Mus musculus
aaaatccatgttctactcccctctg

SEQ ID NO: 4242 - DNA, 25 bp, Mus musculus
aaaatccatgttgtactcccctctg

SEQ ID NO: 4243 - DNA, 25 bp, Mus musculus
aaaatccattatacttttgaccttg

SEQ ID NO: 4244 - DNA, 25 bp, Mus musculus
aaaatccattattcttttgaccttg

SEQ ID NO: 4245 - DNA, 25 bp, Mus musculus
aaaatccattgcagtgccttgggtt

SEQ ID NO: 4246 - DNA, 25 bp, Mus musculus
aaaatccattgctgtgccttgggtt

SEQ ID NO: 4247 - DNA, 25 bp, Mus musculus
aaaatcccaagaagtcgggttctgg

SEQ ID NO: 4248 - DNA, 25 bp, Mus musculus
aaaatcccaagatgtcgggttctgg

SEQ ID NO: 4249 - DNA, 25 bp, Mus musculus
aaaatcccacgtctgcagcaaatcc

SEQ ID NO: 4250 - DNA, 25 bp, Mus musculus
aaaatcccacgtgtgcagcaaatcc

SEQ ID NO: 4251 - DNA, 25 bp, Mus musculus
aaaatcccagcccagatggcctggc

SEQ ID NO: 4252 - DNA, 25 bp, Mus musculus
aaaatcccagccgagatggcctggc

SEQ ID NO: 4253 - DNA, 25 bp, Mus musculus
aaaatcccaggtacatttcagttgg

SEQ ID NO: 4254 - DNA, 25 bp, Mus musculus
aaaatcccaggttcatttcagttgg

SEQ ID NO: 4255 - DNA, 25 bp, Mus musculus
aaaatccccagtctcgtcacaggta

SEQ ID NO: 4256 - DNA, 25 bp, Mus musculus
aaaatccccagtgtcgtcacaggta

SEQ ID NO: 4257 - DNA, 25 bp, Mus musculus
aaaatccccgcacaggcatggcatg

SEQ ID NO: 4258 - DNA, 25 bp, Mus musculus
aaaatccccgcagaggcatggcatg

SEQ ID NO: 4259 - DNA, 25 bp, Mus musculus
aaaatcccctaacactctgatgtgt

SEQ ID NO: 4260 - DNA, 25 bp, Mus musculus
aaaatcccctaagactctgatgtgt

SEQ ID NO: 4261 - DNA, 25 bp, Mus musculus
aaaatccctaatctggcttcagccc

SEQ ID NO: 4262 - DNA, 25 bp, Mus musculus
aaaatccctaatgtggcttcagccc

SEQ ID NO: 4263 - DNA, 25 bp, Mus musculus
aaaatccctcccaggagttgtggct

SEQ ID NO: 4264 - DNA, 25 bp, Mus musculus
aaaatccctccctggagttgtggct

SEQ ID NO: 4265 - DNA, 25 bp, Mus musculus
aaaatccctcctatgagcaagcaag

SEQ ID NO: 4266 - DNA, 25 bp, Mus musculus
aaaatccctcctttgagcaagcaag

SEQ ID NO: 4267 - DNA, 25 bp, Mus musculus
aaaatccctgaccttgtggctatta

SEQ ID NO: 4268 - DNA, 25 bp, Mus musculus
aaaatccctgacgttgtggctatta

SEQ ID NO: 4269 - DNA, 25 bp, Mus musculus
aaaatccctggactgaattcaccta

SEQ ID NO: 4270 - DNA, 25 bp, Mus musculus
aaaatccctggagtgaattcaccta

SEQ ID NO: 4271 - DNA, 25 bp, Mus musculus
aaaatccctggcacagttgctagag

SEQ ID NO: 4272 - DNA, 25 bp, Mus musculus
aaaatccctggctcagttgctagag

SEQ ID NO: 4273 - DNA, 25 bp, Mus musculus
aaaatcccttctccttataaactag

SEQ ID NO: 4274 - DNA, 25 bp, Mus musculus
aaaatcccttctgcttataaactag

SEQ ID NO: 4275 - DNA, 25 bp, Mus musculus
aaaatcccttgccatcattacttgc

SEQ ID NO: 4276 - DNA, 25 bp, Mus musculus
aaaatcccttgcgatcattacttgc

SEQ ID NO: 4277 - DNA, 25 bp, Mus musculus
aaaatccctttccattctcttccag

SEQ ID NO: 4278 - DNA, 25 bp, Mus musculus
aaaatccctttcgattctcttccag

SEQ ID NO: 4279 - DNA, 25 bp, Mus musculus
aaaatccgaaagcatatccacccat

SEQ ID NO: 4280 - DNA, 25 bp, Mus musculus
aaaatccgaaaggatatccacccat

SEQ ID NO: 4281 - DNA, 25 bp, Mus musculus
aaaatccgacttaattctccatctg

SEQ ID NO: 4282 - DNA, 25 bp, Mus musculus
aaaatccgactttattctccatctg

SEQ ID NO: 4283 - DNA, 25 bp, Mus musculus
aaaatccgccttaggtcagtcaact

SEQ ID NO: 4284 - DNA, 25 bp, Mus musculus
aaaatccgcctttggtcagtcaact

SEQ ID NO: 4285 - DNA, 25 bp, Mus musculus
aaaatccgctcactggtgagcctgc

SEQ ID NO: 4286 - DNA, 25 bp, Mus musculus
aaaatccgctcagtggtgagcctgc

SEQ ID NO: 4287 - DNA, 25 bp, Mus musculus
aaaatccgtcgtcttggtgtgtcca

SEQ ID NO: 4288 - DNA, 25 bp, Mus musculus
aaaatccgtcgtgttggtgtgtcca

SEQ ID NO: 4289 - DNA, 25 bp, Mus musculus
aaaatccgtgcaaggagatataggg

SEQ ID NO: 4290 - DNA, 25 bp, Mus musculus
aaaatccgtgcatggagatataggg

SEQ ID NO: 4291 - DNA, 25 bp, Mus musculus
aaaatcctcaatacagaacactggc

SEQ ID NO: 4292 - DNA, 25 bp, Mus musculus
aaaatcctcaattcagaacactggc

SEQ ID NO: 4293 - DNA, 25 bp, Mus musculus
aaaatcctcagcactagtccatctg

SEQ ID NO: 4294 - DNA, 25 bp, Mus musculus
aaaatcctcagctctagtccatctg

SEQ ID NO: 4295 - DNA, 25 bp, Mus musculus
aaaatcctcagtcccatctgatgtt

SEQ ID NO: 4296 - DNA, 25 bp, Mus musculus
aaaatcctcagtgccatctgatgtt

SEQ ID NO: 4297 - DNA, 25 bp, Mus musculus
aaaatcctcggcatcatcatgtttg

SEQ ID NO: 4298 - DNA, 25 bp, Mus musculus
aaaatcctcggcttcatcatgtttg

SEQ ID NO: 4299 - DNA, 25 bp, Mus musculus
aaaatcctctccaataaactagaag

SEQ ID NO: 4300 - DNA, 25 bp, Mus musculus
aaaatcctctcctataaactagaag

SEQ ID NO: 4301 - DNA, 25 bp, Mus musculus
aaaatcctggcaaagagcccatcac

SEQ ID NO: 4302 - DNA, 25 bp, Mus musculus
aaaatcctggcatagagcccatcac

SEQ ID NO: 4303 - DNA, 25 bp, Mus musculus
aaaatcctgggtaagctgactgaaa

SEQ ID NO: 4304 - DNA, 25 bp, Mus musculus
aaaatcctgggttagctgactgaaa

SEQ ID NO: 4305 - DNA, 25 bp, Mus musculus
aaaatcctgtatacctataggaaat

SEQ ID NO: 4306 - DNA, 25 bp, Mus musculus
aaaatcctgtattcctataggaaat

SEQ ID NO: 4307 - DNA, 25 bp, Mus musculus
aaaatcctgtttaacatggtcacat

SEQ ID NO: 4308 - DNA, 25 bp, Mus musculus
aaaatcctgttttacatggtcacat

SEQ ID NO: 4309 - DNA, 25 bp, Mus musculus
aaaatccttatccacattagcttaa

SEQ ID NO: 4310 - DNA, 25 bp, Mus musculus
aaaatccttatcgacattagcttaa

SEQ ID NO: 4311 - DNA, 25 bp, Mus musculus
aaaatccttcgactggcgcatgtac

SEQ ID NO: 4312 - DNA, 25 bp, Mus musculus
aaaatccttcgagtggcgcatgtac

SEQ ID NO: 4313 - DNA, 25 bp, Mus musculus
aaaatccttctacgcagctcacttg

SEQ ID NO: 4314 - DNA, 25 bp, Mus musculus
aaaatccttctaggcagctcacttg

SEQ ID NO: 4315 - DNA, 25 bp, Mus musculus
aaaatccttctcaggagcatccctg

SEQ ID NO: 4316 - DNA, 25 bp, Mus musculus
aaaatccttctctggagcatccctg

SEQ ID NO: 4317 - DNA, 25 bp, Mus musculus
aaaatcctttatagtctctgactct

SEQ ID NO: 4318 - DNA, 25 bp, Mus musculus
aaaatcctttattgtctctgactct

SEQ ID NO: 4319 - DNA, 25 bp, Mus musculus
aaaatcctttcacaggacccgatga

SEQ ID NO: 4320 - DNA, 25 bp, Mus musculus
aaaatcctttcagaggacccgatga

SEQ ID NO: 4321 - DNA, 25 bp, Mus musculus
aaaatcctttgcattgtgcctccag

SEQ ID NO: 4322 - DNA, 25 bp, Mus musculus
aaaatcctttgctttgtgcctccag

SEQ ID NO: 4323 - DNA, 25 bp, Mus musculus
aaaatcgacagcactctgacagagt

SEQ ID NO: 4324 - DNA, 25 bp, Mus musculus
aaaatcgacagctctctgacagagt

SEQ ID NO: 4325 - DNA, 25 bp, Mus musculus
aaaatcgactttacctcaaggctat

SEQ ID NO: 4326 - DNA, 25 bp, Mus musculus
aaaatcgacttttcctcaaggctat

SEQ ID NO: 4327 - DNA, 25 bp, Mus musculus
aaaatcgatcgacagggcaaaccac

SEQ ID NO: 4328 - DNA, 25 bp, Mus musculus
aaaatcgatcgagagggcaaaccac

SEQ ID NO: 4329 - DNA, 25 bp, Mus musculus
aaaatcgatgataccatcttccaga

SEQ ID NO: 4330 - DNA, 25 bp, Mus musculus
aaaatcgatgattccatcttccaga

SEQ ID NO: 4331 - DNA, 25 bp, Mus musculus
aaaatcgcaccacacctcctgtatt

SEQ ID NO: 4332 - DNA, 25 bp, Mus musculus
aaaatcgcaccagacctcctgtatt

SEQ ID NO: 4333 - DNA, 25 bp, Mus musculus
aaaatcgcataaactcactttcaca

SEQ ID NO: 4334 - DNA, 25 bp, Mus musculus
aaaatcgcataatctcactttcaca

SEQ ID NO: 4335 - DNA, 25 bp, Mus musculus
aaaatcgcattcatggctttcagcc

SEQ ID NO: 4336 - DNA, 25 bp, Mus musculus
aaaatcgcattcttggctttcagcc

SEQ ID NO: 4337 - DNA, 25 bp, Mus musculus
aaaatcgcccagagcaagccaagga

SEQ ID NO: 4338 - DNA, 25 bp, Mus musculus
aaaatcgcccagtgcaagccaagga

SEQ ID NO: 4339 - DNA, 25 bp, Mus musculus
aaaatcgctgacatgggctgccctc

SEQ ID NO: 4340 - DNA, 25 bp, Mus musculus
aaaatcgctgacttgggctgccctc

SEQ ID NO: 4341 - DNA, 25 bp, Mus musculus
aaaatcggagccagccctgctaaaa

SEQ ID NO: 4342 - DNA, 25 bp, Mus musculus
aaaatcggagcctgccctgctaaaa

SEQ ID NO: 4343 - DNA, 25 bp, Mus musculus
aaaatcggataaacatcttgccctc

SEQ ID NO: 4344 - DNA, 25 bp, Mus musculus
aaaatcggataatcatcttgccctc

SEQ ID NO: 4345 - DNA, 25 bp, Mus musculus
aaaatcggattcacagctgtcactg

SEQ ID NO: 4346 - DNA, 25 bp, Mus musculus
aaaatcggattctcagctgtcactg

SEQ ID NO: 4347 - DNA, 25 bp, Mus musculus
aaaatcggctttctggcattttggt

SEQ ID NO: 4348 - DNA, 25 bp, Mus musculus
aaaatcggctttgtggcattttggt

SEQ ID NO: 4349 - DNA, 25 bp, Mus musculus
aaaatcgggctcaagaactgacatt

SEQ ID NO: 4350 - DNA, 25 bp, Mus musculus
aaaatcgggctctagaactgacatt

SEQ ID NO: 4351 - DNA, 25 bp, Mus musculus
aaaatcgggctgaatttggcacagg

SEQ ID NO: 4352 - DNA, 25 bp, Mus musculus
aaaatcgggctgtatttggcacagg

SEQ ID NO: 4353 - DNA, 25 bp, Mus musculus
aaaatcgtacttagatgtggagctg

SEQ ID NO: 4354 - DNA, 25 bp, Mus musculus
aaaatcgtactttgatgtggagctg

SEQ ID NO: 4355 - DNA, 25 bp, Mus musculus
aaaatcgtccagacctgatctgagt

SEQ ID NO: 4356 - DNA, 25 bp, Mus musculus
aaaatcgtccagtcctgatctgagt

SEQ ID NO: 4357 - DNA, 25 bp, Mus musculus
aaaatcgtgactactgtgttctctc

SEQ ID NO: 4358 - DNA, 25 bp, Mus musculus
aaaatcgtgacttctgtgttctctc

SEQ ID NO: 4359 - DNA, 25 bp, Mus musculus
aaaatcgtggttcgctgggaacaca

SEQ ID NO: 4360 - DNA, 25 bp, Mus musculus
aaaatcgtggttggctgggaacaca

SEQ ID NO: 4361 - DNA, 25 bp, Mus musculus
aaaatctaatttcctgtgacgacag

SEQ ID NO: 4362 - DNA, 25 bp, Mus musculus
aaaatctaatttgctgtgacgacag

SEQ ID NO: 4363 - DNA, 25 bp, Mus musculus
aaaatctacatcatctacttgagcc

SEQ ID NO: 4364 - DNA, 25 bp, Mus musculus
aaaatctacatcttctacttgagcc

SEQ ID NO: 4365 - DNA, 25 bp, Mus musculus
aaaatctacctcacaggtactgtga

SEQ ID NO: 4366 - DNA, 25 bp, Mus musculus
aaaatctacctctcaggtactgtga

SEQ ID NO: 4367 - DNA, 25 bp, Mus musculus
aaaatctagagaccgctcactgagc

SEQ ID NO: 4368 - DNA, 25 bp, Mus musculus
aaaatctagagagcgctcactgagc

SEQ ID NO: 4369 - DNA, 25 bp, Mus musculus
aaaatctagcccaagcagagttagg

SEQ ID NO: 4370 - DNA, 25 bp, Mus musculus
aaaatctagccctagcagagttagg

SEQ ID NO: 4371 - DNA, 25 bp, Mus musculus
aaaatctagggcatcccactcattt

SEQ ID NO: 4372 - DNA, 25 bp, Mus musculus
aaaatctagggcttcccactcattt

SEQ ID NO: 4373 - DNA, 25 bp, Mus musculus
aaaatctagtccaggctcaccttat

SEQ ID NO: 4374 - DNA, 25 bp, Mus musculus
aaaatctagtcctggctcaccttat

SEQ ID NO: 4375 - DNA, 25 bp, Mus musculus
aaaatctataataatgaagccatgg

SEQ ID NO: 4376 - DNA, 25 bp, Mus musculus
aaaatctataattatgaagccatgg

SEQ ID NO: 4377 - DNA, 25 bp, Mus musculus
aaaatctatgctcggacgcctcggt

SEQ ID NO: 4378 - DNA, 25 bp, Mus musculus
aaaatctatgctgggacgcctcggt

SEQ ID NO: 4379 - DNA, 25 bp, Mus musculus
aaaatctatgggacagccgatactt

SEQ ID NO: 4380 - DNA, 25 bp, Mus musculus
aaaatctatgggtcagccgatactt

SEQ ID NO: 4381 - DNA, 25 bp, Mus musculus
aaaatctatttcacaactggacttg

SEQ ID NO: 4382 - DNA, 25 bp, Mus musculus
aaaatctatttctcaactggacttg

SEQ ID NO: 4383 - DNA, 25 bp, Mus musculus
aaaatctcacagacccagagctgat

SEQ ID NO: 4384 - DNA, 25 bp, Mus musculus
aaaatctcacagtcccagagctgat

SEQ ID NO: 4385 - DNA, 25 bp, Mus musculus
aaaatctcagcactatgtgtgtggc

SEQ ID NO: 4386 - DNA, 25 bp, Mus musculus
aaaatctcagcagtatgtgtgtggc

SEQ ID NO: 4387 - DNA, 25 bp, Mus musculus
aaaatctcatttctgccttccttac

SEQ ID NO: 4388 - DNA, 25 bp, Mus musculus
aaaatctcatttgtgccttccttac

SEQ ID NO: 4389 - DNA, 25 bp, Mus musculus
aaaatctccactacaaccctgatga

SEQ ID NO: 4390 - DNA, 25 bp, Mus musculus
aaaatctccactccatgtaactact

SEQ ID NO: 4391 - DNA, 25 bp, Mus musculus
aaaatctccactcctgtcgagtgtc

SEQ ID NO: 4392 - DNA, 25 bp, Mus musculus
aaaatctccactgcatgtaactact

SEQ ID NO: 4393 - DNA, 25 bp, Mus musculus
aaaatctccactgctgtcgagtgtc

SEQ ID NO: 4394 - DNA, 25 bp, Mus musculus
aaaatctccacttcaaccctgatga

SEQ ID NO: 4395 - DNA, 25 bp, Mus musculus
aaaatctcctgcacacctttgtaat

SEQ ID NO: 4396 - DNA, 25 bp, Mus musculus
aaaatctcctgctcacctttgtaat

SEQ ID NO: 4397 - DNA, 25 bp, Mus musculus
aaaatctcgggtattgacagagcta

SEQ ID NO: 4398 - DNA, 25 bp, Mus musculus
aaaatctcgggttttgacagagcta

SEQ ID NO: 4399 - DNA, 25 bp, Mus musculus
aaaatctctgccaagaagaaaattg

SEQ ID NO: 4400 - DNA, 25 bp, Mus musculus
aaaatctctgcctagaagaaaattg

SEQ ID NO: 4401 - DNA, 25 bp, Mus musculus
aaaatctctgtcacggggttctagg

SEQ ID NO: 4402 - DNA, 25 bp, Mus musculus
aaaatctctgtctcggggttctagg

SEQ ID NO: 4403 - DNA, 25 bp, Mus musculus
aaaatctctgtgaacttgccttgaa

SEQ ID NO: 4404 - DNA, 25 bp, Mus musculus
aaaatctctgtgtacttgccttgaa

SEQ ID NO: 4405 - DNA, 25 bp, Mus musculus
aaaatctctttaacacattggataa

SEQ ID NO: 4406 - DNA, 25 bp, Mus musculus
aaaatctctttatcacattggataa

SEQ ID NO: 4407 - DNA, 25 bp, Mus musculus
aaaatctgacctaacctcttttctg

SEQ ID NO: 4408 - DNA, 25 bp, Mus musculus
aaaatctgacctcctgtattccatc

SEQ ID NO: 4409 - DNA, 25 bp, Mus musculus
aaaatctgacctgctgtattccatc

SEQ ID NO: 4410 - DNA, 25 bp, Mus musculus
aaaatctgaccttacctcttttctg

SEQ ID NO: 4411 - DNA, 25 bp, Mus musculus
aaaatctgagctatgtagtaatgta

SEQ ID NO: 4412 - DNA, 25 bp, Mus musculus
aaaatctgagctttgtagtaatgta

SEQ ID NO: 4413 - DNA, 25 bp, Mus musculus
aaaatctgagtaaggatgcagcata

SEQ ID NO: 4414 - DNA, 25 bp, Mus musculus
aaaatctgagtaatgctctaagcaa

SEQ ID NO: 4415 - DNA, 25 bp, Mus musculus
aaaatctgagtatggatgcagcata

SEQ ID NO: 4416 - DNA, 25 bp, Mus musculus
aaaatctgagtattgctctaagcaa

SEQ ID NO: 4417 - DNA, 25 bp, Mus musculus
aaaatctgatgccctggtctggagt

SEQ ID NO: 4418 - DNA, 25 bp, Mus musculus
aaaatctgatgcgctggtctggagt

SEQ ID NO: 4419 - DNA, 25 bp, Mus musculus
aaaatctgcagcagctaccgaggaa

SEQ ID NO: 4420 - DNA, 25 bp, Mus musculus
aaaatctgcagctgctaccgaggaa

SEQ ID NO: 4421 - DNA, 25 bp, Mus musculus
aaaatctgcagtattctggagaaag

SEQ ID NO: 4422 - DNA, 25 bp, Mus musculus
aaaatctgcagttttctggagaaag

SEQ ID NO: 4423 - DNA, 25 bp, Mus musculus
aaaatctgccttatagtacaataga

SEQ ID NO: 4424 - DNA, 25 bp, Mus musculus
aaaatctgccttttagtacaataga

SEQ ID NO: 4425 - DNA, 25 bp, Mus musculus
aaaatctgctttacttaacatagtt

SEQ ID NO: 4426 - DNA, 25 bp, Mus musculus
aaaatctgcttttcttaacatagtt

SEQ ID NO: 4427 - DNA, 25 bp, Mus musculus
aaaatctggaatctcagggtctcgc

SEQ ID NO: 4428 - DNA, 25 bp, Mus musculus
aaaatctggaatgtcagggtctcgc

SEQ ID NO: 4429 - DNA, 25 bp, Mus musculus
aaaatctggatgaaggactgggcat

SEQ ID NO: 4430 - DNA, 25 bp, Mus musculus
aaaatctggatgtaggactgggcat

SEQ ID NO: 4431 - DNA, 25 bp, Mus musculus
aaaatctggcccatattccatctgg

SEQ ID NO: 4432 - DNA, 25 bp, Mus musculus
aaaatctggcccttattccatctgg

SEQ ID NO: 4433 - DNA, 25 bp, Mus musculus
aaaatctgggacactgatctctcat

SEQ ID NO: 4434 - DNA, 25 bp, Mus musculus
aaaatctgggactctgatctctcat

SEQ ID NO: 4435 - DNA, 25 bp, Mus musculus
aaaatctgggatactttgacctcag

SEQ ID NO: 4436 - DNA, 25 bp, Mus musculus
aaaatctgggattctttgacctcag

SEQ ID NO: 4437 - DNA, 25 bp, Mus musculus
aaaatctggtacagactttctggtc

SEQ ID NO: 4438 - DNA, 25 bp, Mus musculus
aaaatctggtactgactttctggtc

SEQ ID NO: 4439 - DNA, 25 bp, Mus musculus
aaaatctggtgactggctctttctt

SEQ ID NO: 4440 - DNA, 25 bp, Mus musculus
aaaatctggtgagtggctctttctt

SEQ ID NO: 4441 - DNA, 25 bp, Mus musculus
aaaatctggttgctgctcatctaaa

SEQ ID NO: 4442 - DNA, 25 bp, Mus musculus
aaaatctggttggtgctcatctaaa

SEQ ID NO: 4443 - DNA, 25 bp, Mus musculus
aaaatctggtttctatagataacat

SEQ ID NO: 4444 - DNA, 25 bp, Mus musculus
aaaatctggtttgtatagataacat

SEQ ID NO: 4445 - DNA, 25 bp, Mus musculus
aaaatctgtccaccatttgtggtga

SEQ ID NO: 4446 - DNA, 25 bp, Mus musculus
aaaatctgtccagcatttgtggtga

SEQ ID NO: 4447 - DNA, 25 bp, Mus musculus
aaaatctgtgagctttctggcctat

SEQ ID NO: 4448 - DNA, 25 bp, Mus musculus
aaaatctgtgaggtttctggcctat

SEQ ID NO: 4449 - DNA, 25 bp, Mus musculus
aaaatctgtgatccaggcctcactg

SEQ ID NO: 4450 - DNA, 25 bp, Mus musculus
aaaatctgtgatgcaggcctcactg

SEQ ID NO: 4451 - DNA, 25 bp, Mus musculus
aaaatctgtggtacactgtctttta

SEQ ID NO: 4452 - DNA, 25 bp, Mus musculus
aaaatctgtggttcactgtctttta

SEQ ID NO: 4453 - DNA, 25 bp, Mus musculus
aaaatcttaaacagtaacggctgag

SEQ ID NO: 4454 - DNA, 25 bp, Mus musculus
aaaatcttaaactgtaacggctgag

SEQ ID NO: 4455 - DNA, 25 bp, Mus musculus
aaaatcttaagtacgcctagcctgg

SEQ ID NO: 4456 - DNA, 25 bp, Mus musculus
aaaatcttaagttcgcctagcctgg

SEQ ID NO: 4457 - DNA, 25 bp, Mus musculus
aaaatcttagtcaacctctgtagaa

SEQ ID NO: 4458 - DNA, 25 bp, Mus musculus
aaaatcttagtctacctctgtagaa

SEQ ID NO: 4459 - DNA, 25 bp, Mus musculus
aaaatcttatcaccatttctctcct

SEQ ID NO: 4460 - DNA, 25 bp, Mus musculus
aaaatcttatcagcatttctctcct

SEQ ID NO: 4461 - DNA, 25 bp, Mus musculus
aaaatcttcatacctttgacaaaat

SEQ ID NO: 4462 - DNA, 25 bp, Mus musculus
aaaatcttcatagctttgacaaaat

SEQ ID NO: 4463 - DNA, 25 bp, Mus musculus
aaaatcttcctgctgggcttcttat

SEQ ID NO: 4464 - DNA, 25 bp, Mus musculus
aaaatcttcctggtgggcttcttat

SEQ ID NO: 4465 - DNA, 25 bp, Mus musculus
aaaatcttgacaacattaccttttg

SEQ ID NO: 4466 - DNA, 25 bp, Mus musculus
aaaatcttgacatcattaccttttg

SEQ ID NO: 4467 - DNA, 25 bp, Mus musculus
aaaatcttgatgctcatacccagtg

SEQ ID NO: 4468 - DNA, 25 bp, Mus musculus
aaaatcttgatggtcatacccagtg

SEQ ID NO: 4469 - DNA, 25 bp, Mus musculus
aaaatcttgcttagatcacccaggc

SEQ ID NO: 4470 - DNA, 25 bp, Mus musculus
aaaatcttgcttctggccatgctat

SEQ ID NO: 4471 - DNA, 25 bp, Mus musculus
aaaatcttgcttgtggccatgctat

SEQ ID NO: 4472 - DNA, 25 bp, Mus musculus
aaaatcttgctttgatcacccaggc

SEQ ID NO: 4473 - DNA, 25 bp, Mus musculus
aaaatcttggtcctttgccaatgcc

SEQ ID NO: 4474 - DNA, 25 bp, Mus musculus
aaaatcttggtcgtttgccaatgcc

SEQ ID NO: 4475 - DNA, 25 bp, Mus musculus
aaaatcttgtcgctcctttgacagt

SEQ ID NO: 4476 - DNA, 25 bp, Mus musculus
aaaatcttgtcggtcctttgacagt

SEQ ID NO: 4477 - DNA, 25 bp, Mus musculus
aaaatcttgtgcattgacgaggcca

SEQ ID NO: 4478 - DNA, 25 bp, Mus musculus
aaaatcttgtgctttgacgaggcca

SEQ ID NO: 4479 - DNA, 25 bp, Mus musculus
aaaatctttaccagtgtccttctgc

SEQ ID NO: 4480 - DNA, 25 bp, Mus musculus
aaaatctttacctgtgtccttctgc

SEQ ID NO: 4481 - DNA, 25 bp, Mus musculus
aaaatctttatcaccagttcatata

SEQ ID NO: 4482 - DNA, 25 bp, Mus musculus
aaaatctttatctccagttcatata

SEQ ID NO: 4483 - DNA, 25 bp, Mus musculus
aaaatctttcagcttccatcccatg

SEQ ID NO: 4484 - DNA, 25 bp, Mus musculus
aaaatctttcaggttccatcccatg

SEQ ID NO: 4485 - DNA, 25 bp, Mus musculus
aaaatctttgtgagacggtctggaa

SEQ ID NO: 4486 - DNA, 25 bp, Mus musculus
aaaatctttgtgtgacggtctggaa

SEQ ID NO: 4487 - DNA, 25 bp, Mus musculus
aaaatctttttcagccttactatat

SEQ ID NO: 4488 - DNA, 25 bp, Mus musculus
aaaatctttttctgccttactatat

SEQ ID NO: 4489 - DNA, 25 bp, Mus musculus
aaaatgaaatatccctgcatcttgc

SEQ ID NO: 4490 - DNA, 25 bp, Mus musculus
aaaatgaaatatgcctgcatcttgc

SEQ ID NO: 4491 - DNA, 25 bp, Mus musculus
aaaatgaagaagcttggtttgctct

SEQ ID NO: 4492 - DNA, 25 bp, Mus musculus
aaaatgaagaaggttggtttgctct

SEQ ID NO: 4493 - DNA, 25 bp, Mus musculus
aaaatgaagcatactttgggtccta

SEQ ID NO: 4494 - DNA, 25 bp, Mus musculus
aaaatgaagcattctttgggtccta

SEQ ID NO: 4495 - DNA, 25 bp, Mus musculus
aaaatgaattccactccactccagt

SEQ ID NO: 4496 - DNA, 25 bp, Mus musculus
aaaatgaattcctctccactccagt

SEQ ID NO: 4497 - DNA, 25 bp, Mus musculus
aaaatgacacagcaacagatccagt

SEQ ID NO: 4498 - DNA, 25 bp, Mus musculus
aaaatgacacaggaacagatccagt

SEQ ID NO: 4499 - DNA, 25 bp, Mus musculus
aaaatgacccaaatccacagctacc

SEQ ID NO: 4500 - DNA, 25 bp, Mus musculus
aaaatgacccaattccacagctacc

SEQ ID NO: 4501 - DNA, 25 bp, Mus musculus
aaaatgacctccacaggccacgtca

SEQ ID NO: 4502 - DNA, 25 bp, Mus musculus
aaaatgacctcctcaggccacgtca

SEQ ID NO: 4503 - DNA, 25 bp, Mus musculus
aaaatgacctctcccggacagaagg

SEQ ID NO: 4504 - DNA, 25 bp, Mus musculus
aaaatgacctctgccggacagaagg

SEQ ID NO: 4505 - DNA, 25 bp, Mus musculus
aaaatgacgctgatttcaggatgtc

SEQ ID NO: 4506 - DNA, 25 bp, Mus musculus
aaaatgacgctgttttcaggatgtc

SEQ ID NO: 4507 - DNA, 25 bp, Mus musculus
aaaatgacgcttacttcagcagcaa

SEQ ID NO: 4508 - DNA, 25 bp, Mus musculus
aaaatgacgctttcttcagcagcaa

SEQ ID NO: 4509 - DNA, 25 bp, Mus musculus
aaaatgacgtcgctccatttcaacc

SEQ ID NO: 4510 - DNA, 25 bp, Mus musculus
aaaatgacgtcggtccatttcaacc

SEQ ID NO: 4511 - DNA, 25 bp, Mus musculus
aaaatgactcagacggctcctagat

SEQ ID NO: 4512 - DNA, 25 bp, Mus musculus
aaaatgactcagtcggctcctagat

SEQ ID NO: 4513 - DNA, 25 bp, Mus musculus
aaaatgactccaagcctcttattca

SEQ ID NO: 4514 - DNA, 25 bp, Mus musculus
aaaatgactccatgcctcttattca

SEQ ID NO: 4515 - DNA, 25 bp, Mus musculus
aaaatgactcttcccagcaactttt

SEQ ID NO: 4516 - DNA, 25 bp, Mus musculus
aaaatgactcttgccagcaactttt

SEQ ID NO: 4517 - DNA, 25 bp, Mus musculus
aaaatgactggcattctgcttccta

SEQ ID NO: 4518 - DNA, 25 bp, Mus musculus
aaaatgactggctttctgcttccta

SEQ ID NO: 4519 - DNA, 25 bp, Mus musculus
aaaatgactgtcactacttgtaaag

SEQ ID NO: 4520 - DNA, 25 bp, Mus musculus
aaaatgactgtctctacttgtaaag

SEQ ID NO: 4521 - DNA, 25 bp, Mus musculus
aaaatgactgtgcttgttcgtgaca

SEQ ID NO: 4522 - DNA, 25 bp, Mus musculus
aaaatgactgtggttgttcgtgaca

SEQ ID NO: 4523 - DNA, 25 bp, Mus musculus
aaaatgacttccaagtcacctcaca

SEQ ID NO: 4524 - DNA, 25 bp, Mus musculus
aaaatgacttcctagtcacctcaca

SEQ ID NO: 4525 - DNA, 25 bp, Mus musculus
aaaatgacttctcccgagctggaca

SEQ ID NO: 4526 - DNA, 25 bp, Mus musculus
aaaatgacttctgccgagctggaca

SEQ ID NO: 4527 - DNA, 25 bp, Mus musculus
aaaatgagacaaccgggctgtgcgt

SEQ ID NO: 4528 - DNA, 25 bp, Mus musculus
aaaatgagacaagcgggctgtgcgt

SEQ ID NO: 4529 - DNA, 25 bp, Mus musculus
aaaatgagacagacactgggctggg

SEQ ID NO: 4530 - DNA, 25 bp, Mus musculus
aaaatgagacagtcactgggctggg

SEQ ID NO: 4531 - DNA, 25 bp, Mus musculus
aaaatgagacgaagcttccctctgt

SEQ ID NO: 4532 - DNA, 25 bp, Mus musculus
aaaatgagacgatgcttccctctgt

SEQ ID NO: 4533 - DNA, 25 bp, Mus musculus
aaaatgagagtccttttgcaaagta

SEQ ID NO: 4534 - DNA, 25 bp, Mus musculus
aaaatgagagtcgttttgcaaagta

SEQ ID NO: 4535 - DNA, 25 bp, Mus musculus
aaaatgagatctcgaattcggtgct

SEQ ID NO: 4536 - DNA, 25 bp, Mus musculus
aaaatgagatctggaattcggtgct

SEQ ID NO: 4537 - DNA, 25 bp, Mus musculus
aaaatgagcgatctgcaagctgcag

SEQ ID NO: 4538 - DNA, 25 bp, Mus musculus
aaaatgagcgatgtgcaagctgcag

SEQ ID NO: 4539 - DNA, 25 bp, Mus musculus
aaaatgagcttcatccccacaagga

SEQ ID NO: 4540 - DNA, 25 bp, Mus musculus
aaaatgagcttcttccccacaagga

SEQ ID NO: 4541 - DNA, 25 bp, Mus musculus
aaaatgagctttatagtacacacaa

SEQ ID NO: 4542 - DNA, 25 bp, Mus musculus
aaaatgagctttttagtacacacaa

SEQ ID NO: 4543 - DNA, 25 bp, Mus musculus
aaaatgaggaggaccgccggtgaat

SEQ ID NO: 4544 - DNA, 25 bp, Mus musculus
aaaatgaggaggtccgccggtgaat

SEQ ID NO: 4545 - DNA, 25 bp, Mus musculus
aaaatgagtagcctgccgatatagc

SEQ ID NO: 4546 - DNA, 25 bp, Mus musculus
aaaatgagtagcgtgccgatatagc

SEQ ID NO: 4547 - DNA, 25 bp, Mus musculus
aaaatgagtccacgagtttacagag

SEQ ID NO: 4548 - DNA, 25 bp, Mus musculus
aaaatgagtccaggagtttacagag

SEQ ID NO: 4549 - DNA, 25 bp, Mus musculus
aaaatgagtgtcagcattttgccct

SEQ ID NO: 4550 - DNA, 25 bp, Mus musculus
aaaatgagtgtctgcattttgccct

SEQ ID NO: 4551 - DNA, 25 bp, Mus musculus
aaaatgatagctagtctcctgtggg

SEQ ID NO: 4552 - DNA, 25 bp, Mus musculus
aaaatgatagcttgtctcctgtggg

SEQ ID NO: 4553 - DNA, 25 bp, Mus musculus
aaaatgatccctattctccaccttc

SEQ ID NO: 4554 - DNA, 25 bp, Mus musculus
aaaatgatcccttttctccaccttc

SEQ ID NO: 4555 - DNA, 25 bp, Mus musculus
aaaatgatccttccccagcggtggg

SEQ ID NO: 4556 - DNA, 25 bp, Mus musculus
aaaatgatccttgcccagcggtggg

SEQ ID NO: 4557 - DNA, 25 bp, Mus musculus
aaaatgatcttgcatggctgtgaat

SEQ ID NO: 4558 - DNA, 25 bp, Mus musculus
aaaatgatcttggatggctgtgaat

SEQ ID NO: 4559 - DNA, 25 bp, Mus musculus
aaaatgatgaagacaccctgcagct

SEQ ID NO: 4560 - DNA, 25 bp, Mus musculus
aaaatgatgaagtcaccctgcagct

SEQ ID NO: 4561 - DNA, 25 bp, Mus musculus
aaaatgatgacccactctgggtata

SEQ ID NO: 4562 - DNA, 25 bp, Mus musculus
aaaatgatgaccgactctgggtata

SEQ ID NO: 4563 - DNA, 25 bp, Mus musculus
aaaatgatgactcgctttttggaaa

SEQ ID NO: 4564 - DNA, 25 bp, Mus musculus
aaaatgatgactggctttttggaaa

SEQ ID NO: 4565 - DNA, 25 bp, Mus musculus
aaaatgatgctgaggccgggcgtcc

SEQ ID NO: 4566 - DNA, 25 bp, Mus musculus
aaaatgatgctgtggccgggcgtcc

SEQ ID NO: 4567 - DNA, 25 bp, Mus musculus
aaaatgattaacctctgcggccctt

SEQ ID NO: 4568 - DNA, 25 bp, Mus musculus
aaaatgattaacgtctgcggccctt

SEQ ID NO: 4569 - DNA, 25 bp, Mus musculus
aaaatgattacactgaggccatgca

SEQ ID NO: 4570 - DNA, 25 bp, Mus musculus
aaaatgattacagtgaggccatgca

SEQ ID NO: 4571 - DNA, 25 bp, Mus musculus
aaaatgattcaacgcctcttccgga

SEQ ID NO: 4572 - DNA, 25 bp, Mus musculus
aaaatgattcaaggcctcttccgga

SEQ ID NO: 4573 - DNA, 25 bp, Mus musculus
aaaatgattcccacactctggccca

SEQ ID NO: 4574 - DNA, 25 bp, Mus musculus
aaaatgattcccagtgatcttctgg

SEQ ID NO: 4575 - DNA, 25 bp, Mus musculus
aaaatgattccctcactctggccca

SEQ ID NO: 4576 - DNA, 25 bp, Mus musculus
aaaatgattccctgtgatcttctgg

SEQ ID NO: 4577 - DNA, 25 bp, Mus musculus
aaaatgattcgtctctggtgtcttc

SEQ ID NO: 4578 - DNA, 25 bp, Mus musculus
aaaatgattcgtgtctggtgtcttc

SEQ ID NO: 4579 - DNA, 25 bp, Mus musculus
aaaatgattcttacccagttctcct

SEQ ID NO: 4580 - DNA, 25 bp, Mus musculus
aaaatgattctttcccagttctcct

SEQ ID NO: 4581 - DNA, 25 bp, Mus musculus
aaaatgatttccaatgctgctgtaa

SEQ ID NO: 4582 - DNA, 25 bp, Mus musculus
aaaatgatttcctatgctgctgtaa

SEQ ID NO: 4583 - DNA, 25 bp, Mus musculus
aaaatgcaaaaccttcttcagaata

SEQ ID NO: 4584 - DNA, 25 bp, Mus musculus
aaaatgcaaaacgttcttcagaata

SEQ ID NO: 4585 - DNA, 25 bp, Mus musculus
aaaatgcaacctaatgtccctctct

SEQ ID NO: 4586 - DNA, 25 bp, Mus musculus
aaaatgcaaccttatgtccctctct

SEQ ID NO: 4587 - DNA, 25 bp, Mus musculus
aaaatgcaagcgagcctgtcatggg

SEQ ID NO: 4588 - DNA, 25 bp, Mus musculus
aaaatgcaagcgtgcctgtcatggg

SEQ ID NO: 4589 - DNA, 25 bp, Mus musculus
aaaatgcacaggatacacatgcaga

SEQ ID NO: 4590 - DNA, 25 bp, Mus musculus
aaaatgcacaggttacacatgcaga

SEQ ID NO: 4591 - DNA, 25 bp, Mus musculus
aaaatgcacagtagacagttgggtt

SEQ ID NO: 4592 - DNA, 25 bp, Mus musculus
aaaatgcacagtctgttacaggttg

SEQ ID NO: 4593 - DNA, 25 bp, Mus musculus
aaaatgcacagtgtgttacaggttg

SEQ ID NO: 4594 - DNA, 25 bp, Mus musculus
aaaatgcacagttgacagttgggtt

SEQ ID NO: 4595 - DNA, 25 bp, Mus musculus
aaaatgcaccaccttctaagatgag

SEQ ID NO: 4596 - DNA, 25 bp, Mus musculus
aaaatgcaccacgttctaagatgag

SEQ ID NO: 4597 - DNA, 25 bp, Mus musculus
aaaatgcaccttagtgccggagaac

SEQ ID NO: 4598 - DNA, 25 bp, Mus musculus
aaaatgcacctttgtgccggagaac

SEQ ID NO: 4599 - DNA, 25 bp, Mus musculus
aaaatgcacgagcaggagcaccatc

SEQ ID NO: 4600 - DNA, 25 bp, Mus musculus
aaaatgcacgaggaggagcaccatc

SEQ ID NO: 4601 - DNA, 25 bp, Mus musculus
aaaatgcagaagagtttcaacatga

SEQ ID NO: 4602 - DNA, 25 bp, Mus musculus
aaaatgcagaagtgtttcaacatga

SEQ ID NO: 4603 - DNA, 25 bp, Mus musculus
aaaatgcagatgctaaccctggaca

SEQ ID NO: 4604 - DNA, 25 bp, Mus musculus
aaaatgcagatggtaaccctggaca

SEQ ID NO: 4605 - DNA, 25 bp, Mus musculus
aaaatgcagctgctgggtcctctga

SEQ ID NO: 4606 - DNA, 25 bp, Mus musculus
aaaatgcagctggtgggtcctctga

SEQ ID NO: 4607 - DNA, 25 bp, Mus musculus
aaaatgcagtccacctaagtcccgg

SEQ ID NO: 4608 - DNA, 25 bp, Mus musculus
aaaatgcagtcctcctaagtcccgg

SEQ ID NO: 4609 - DNA, 25 bp, Mus musculus
aaaatgcagtgacaggttcgctctt

SEQ ID NO: 4610 - DNA, 25 bp, Mus musculus
aaaatgcagtgagaggttcgctctt

SEQ ID NO: 4611 - DNA, 25 bp, Mus musculus
aaaatgcagtgcctgggtaaccagc

SEQ ID NO: 4612 - DNA, 25 bp, Mus musculus
aaaatgcagtgcgtgggtaaccagc

SEQ ID NO: 4613 - DNA, 25 bp, Mus musculus
aaaatgcataccacaatcccttgtc

SEQ ID NO: 4614 - DNA, 25 bp, Mus musculus
aaaatgcatacctcaatcccttgtc

SEQ ID NO: 4615 - DNA, 25 bp, Mus musculus
aaaatgcatattatctggagttaaa

SEQ ID NO: 4616 - DNA, 25 bp, Mus musculus
aaaatgcatattttctggagttaaa

SEQ ID NO: 4617 - DNA, 25 bp, Mus musculus
aaaatgcatgcacggaggataccgg

SEQ ID NO: 4618 - DNA, 25 bp, Mus musculus
aaaatgcatgcagggaggataccgg

SEQ ID NO: 4619 - DNA, 25 bp, Mus musculus
aaaatgcatgtgacagtcggcgtcc

SEQ ID NO: 4620 - DNA, 25 bp, Mus musculus
aaaatgcatgtgtcagtcggcgtcc

SEQ ID NO: 4621 - DNA, 25 bp, Mus musculus
aaaatgcattctaccttcccagtgt

SEQ ID NO: 4622 - DNA, 25 bp, Mus musculus
aaaatgcattcttccttcccagtgt

SEQ ID NO: 4623 - DNA, 25 bp, Mus musculus
aaaatgccaaccctgaggctgcagt

SEQ ID NO: 4624 - DNA, 25 bp, Mus musculus
aaaatgccaaccgtgaggctgcagt

SEQ ID NO: 4625 - DNA, 25 bp, Mus musculus
aaaatgccaactctggtctctccag

SEQ ID NO: 4626 - DNA, 25 bp, Mus musculus
aaaatgccaactgtggtctctccag

SEQ ID NO: 4627 - DNA, 25 bp, Mus musculus
aaaatgccaatactctctgccggga

SEQ ID NO: 4628 - DNA, 25 bp, Mus musculus
aaaatgccaatagtctctgccggga

SEQ ID NO: 4629 - DNA, 25 bp, Mus musculus
aaaatgccacatcaccgcaggatcc

SEQ ID NO: 4630 - DNA, 25 bp, Mus musculus
aaaatgccacatgaccgcaggatcc

SEQ ID NO: 4631 - DNA, 25 bp, Mus musculus
aaaatgccacctcactctcaggcaa

SEQ ID NO: 4632 - DNA, 25 bp, Mus musculus
aaaatgccacctgactctcaggcaa

SEQ ID NO: 4633 - DNA, 25 bp, Mus musculus
aaaatgccagacacccaagtcagac

SEQ ID NO: 4634 - DNA, 25 bp, Mus musculus
aaaatgccagactcccaagtcagac

SEQ ID NO: 4635 - DNA, 25 bp, Mus musculus
aaaatgccaggcaccatggcttcat

SEQ ID NO: 4636 - DNA, 25 bp, Mus musculus
aaaatgccaggctccatggcttcat

SEQ ID NO: 4637 - DNA, 25 bp, Mus musculus
aaaatgccaggtatcctgtgcctcc

SEQ ID NO: 4638 - DNA, 25 bp, Mus musculus
aaaatgccaggtttcctgtgcctcc

SEQ ID NO: 4639 - DNA, 25 bp, Mus musculus
aaaatgccagtcatgattcctgtaa

SEQ ID NO: 4640 - DNA, 25 bp, Mus musculus
aaaatgccagtcttgattcctgtaa

SEQ ID NO: 4641 - DNA, 25 bp, Mus musculus
aaaatgccagtgagtttcaccgccc

SEQ ID NO: 4642 - DNA, 25 bp, Mus musculus
aaaatgccagtgcaccttctttgca

SEQ ID NO: 4643 - DNA, 25 bp, Mus musculus
aaaatgccagtggaccttctttgca

SEQ ID NO: 4644 - DNA, 25 bp, Mus musculus
aaaatgccagtgtgtttcaccgccc

SEQ ID NO: 4645 - DNA, 25 bp, Mus musculus
aaaatgcccacacttcctagcctgg

SEQ ID NO: 4646 - DNA, 25 bp, Mus musculus
aaaatgcccacagttcctagcctgg

SEQ ID NO: 4647 - DNA, 25 bp, Mus musculus
aaaatgcccataaacaacaaattca

SEQ ID NO: 4648 - DNA, 25 bp, Mus musculus
aaaatgcccatatacaacaaattca

SEQ ID NO: 4649 - DNA, 25 bp, Mus musculus
aaaatgccccttctaggtcctggat

SEQ ID NO: 4650 - DNA, 25 bp, Mus musculus
aaaatgccccttgtaggtcctggat

SEQ ID NO: 4651 - DNA, 25 bp, Mus musculus
aaaatgccctgtcgtttccaggtct

SEQ ID NO: 4652 - DNA, 25 bp, Mus musculus
aaaatgccctgtggtttccaggtct

SEQ ID NO: 4653 - DNA, 25 bp, Mus musculus
aaaatgcccttacagctgtgcttat

SEQ ID NO: 4654 - DNA, 25 bp, Mus musculus
aaaatgcccttagagctgtgcttat

SEQ ID NO: 4655 - DNA, 25 bp, Mus musculus
aaaatgccggcgagctgatatcctg

SEQ ID NO: 4656 - DNA, 25 bp, Mus musculus
aaaatgccggcgtgctgatatcctg

SEQ ID NO: 4657 - DNA, 25 bp, Mus musculus
aaaatgccgtcccaggaggcaggaa

SEQ ID NO: 4658 - DNA, 25 bp, Mus musculus
aaaatgccgtccgaggaggcaggaa

SEQ ID NO: 4659 - DNA, 25 bp, Mus musculus
aaaatgcctagaacacaggttttta

SEQ ID NO: 4660 - DNA, 25 bp, Mus musculus
aaaatgcctagatcacaggttttta

SEQ ID NO: 4661 - DNA, 25 bp, Mus musculus
aaaatgcctgggactaggcgctgtg

SEQ ID NO: 4662 - DNA, 25 bp, Mus musculus
aaaatgcctgggtctaggcgctgtg

SEQ ID NO: 4663 - DNA, 25 bp, Mus musculus
aaaatgcctggtatgaatagcgttc

SEQ ID NO: 4664 - DNA, 25 bp, Mus musculus
aaaatgcctggtttgaatagcgttc

SEQ ID NO: 4665 - DNA, 25 bp, Mus musculus
aaaatgccttctacagagatcatgg

SEQ ID NO: 4666 - DNA, 25 bp, Mus musculus
aaaatgccttctaggtatcagttag

SEQ ID NO: 4667 - DNA, 25 bp, Mus musculus
aaaatgccttcttcagagatcatgg

SEQ ID NO: 4668 - DNA, 25 bp, Mus musculus
aaaatgccttcttggtatcagttag

SEQ ID NO: 4669 - DNA, 25 bp, Mus musculus
aaaatgccttgaacctccgaaacag

SEQ ID NO: 4670 - DNA, 25 bp, Mus musculus
aaaatgccttgatcctccgaaacag

SEQ ID NO: 4671 - DNA, 25 bp, Mus musculus
aaaatgcctttcctcctgctgtgaa

SEQ ID NO: 4672 - DNA, 25 bp, Mus musculus
aaaatgcctttcgtcctgctgtgaa

SEQ ID NO: 4673 - DNA, 25 bp, Mus musculus
aaaatgcgcacaaataagcccctca

SEQ ID NO: 4674 - DNA, 25 bp, Mus musculus
aaaatgcgcacatataagcccctca

SEQ ID NO: 4675 - DNA, 25 bp, Mus musculus
aaaatgctacagactgcagcctatt

SEQ ID NO: 4676 - DNA, 25 bp, Mus musculus
aaaatgctacagtctgcagcctatt

SEQ ID NO: 4677 - DNA, 25 bp, Mus musculus
aaaatgctcactcgacacttgctca

SEQ ID NO: 4678 - DNA, 25 bp, Mus musculus
aaaatgctcactggacacttgctca

SEQ ID NO: 4679 - DNA, 25 bp, Mus musculus
aaaatgctcataacttttcccatat

SEQ ID NO: 4680 - DNA, 25 bp, Mus musculus
aaaatgctcatatcttttcccatat

SEQ ID NO: 4681 - DNA, 25 bp, Mus musculus
aaaatgctccttaatgtcatgacca

SEQ ID NO: 4682 - DNA, 25 bp, Mus musculus
aaaatgctcctttatgtcatgacca

SEQ ID NO: 4683 - DNA, 25 bp, Mus musculus
aaaatgctctgacccgggttcgcag

SEQ ID NO: 4684 - DNA, 25 bp, Mus musculus
aaaatgctctgagccgggttcgcag

SEQ ID NO: 4685 - DNA, 25 bp, Mus musculus
aaaatgctgatgagcacaccccact

SEQ ID NO: 4686 - DNA, 25 bp, Mus musculus
aaaatgctgatgtgcacaccccact

SEQ ID NO: 4687 - DNA, 25 bp, Mus musculus
aaaatgctgcgcagatctaccgtcg

SEQ ID NO: 4688 - DNA, 25 bp, Mus musculus
aaaatgctgcgctgatctaccgtcg

SEQ ID NO: 4689 - DNA, 25 bp, Mus musculus
aaaatgctgcttctccaatctgaaa

SEQ ID NO: 4690 - DNA, 25 bp, Mus musculus
aaaatgctgcttgtccaatctgaaa

SEQ ID NO: 4691 - DNA, 25 bp, Mus musculus
aaaatgctgggcactctgcggtccg

SEQ ID NO: 4692 - DNA, 25 bp, Mus musculus
aaaatgctgggctctctgcggtccg

SEQ ID NO: 4693 - DNA, 25 bp, Mus musculus
aaaatgctgttgcttcgggttctta

SEQ ID NO: 4694 - DNA, 25 bp, Mus musculus
aaaatgctgttggttcgggttctta

SEQ ID NO: 4695 - DNA, 25 bp, Mus musculus
aaaatgcttctgatgtctgagatca

SEQ ID NO: 4696 - DNA, 25 bp, Mus musculus
aaaatgcttctgttgtctgagatca

SEQ ID NO: 4697 - DNA, 25 bp, Mus musculus
aaaatgcttcttacagctgctctct

SEQ ID NO: 4698 - DNA, 25 bp, Mus musculus
aaaatgcttctttcagctgctctct

SEQ ID NO: 4699 - DNA, 25 bp, Mus musculus
aaaatgcttgatatgaattcgcaga

SEQ ID NO: 4700 - DNA, 25 bp, Mus musculus
aaaatgcttgatttgaattcgcaga

SEQ ID NO: 4701 - DNA, 25 bp, Mus musculus
aaaatgcttgctctgctagcataag

SEQ ID NO: 4702 - DNA, 25 bp, Mus musculus
aaaatgcttgctgtgctagcataag

SEQ ID NO: 4703 - DNA, 25 bp, Mus musculus
aaaatgctttctcttcctgcaaccc

SEQ ID NO: 4704 - DNA, 25 bp, Mus musculus
aaaatgctttctgttcctgcaaccc

SEQ ID NO: 4705 - DNA, 25 bp, Mus musculus
aaaatggaagacagctcccgaccct

SEQ ID NO: 4706 - DNA, 25 bp, Mus musculus
aaaatggaagactgctcccgaccct

SEQ ID NO: 4707 - DNA, 25 bp, Mus musculus
aaaatggacccaagctgctccttta

SEQ ID NO: 4708 - DNA, 25 bp, Mus musculus
aaaatggacccacactcagtagtag

SEQ ID NO: 4709 - DNA, 25 bp, Mus musculus
aaaatggacccagactcagtagtag

SEQ ID NO: 4710 - DNA, 25 bp, Mus musculus
aaaatggacccatgctgctccttta

SEQ ID NO: 4711 - DNA, 25 bp, Mus musculus
aaaatggaccttactgctacttcaa

SEQ ID NO: 4712 - DNA, 25 bp, Mus musculus
aaaatggaccttcccttggttagag

SEQ ID NO: 4713 - DNA, 25 bp, Mus musculus
aaaatggaccttgccttggttagag

SEQ ID NO: 4714 - DNA, 25 bp, Mus musculus
aaaatggacctttctgctacttcaa

SEQ ID NO: 4715 - DNA, 25 bp, Mus musculus
aaaatggactccaagcaatgctctg

SEQ ID NO: 4716 - DNA, 25 bp, Mus musculus
aaaatggactcctagcaatgctctg

SEQ ID NO: 4717 - DNA, 25 bp, Mus musculus
aaaatggagagcacggaaaggaagt

SEQ ID NO: 4718 - DNA, 25 bp, Mus musculus
aaaatggagagctcggaaaggaagt

SEQ ID NO: 4719 - DNA, 25 bp, Mus musculus
aaaatggaggtactcgggctttgct

SEQ ID NO: 4720 - DNA, 25 bp, Mus musculus
aaaatggaggtagtcgggctttgct

SEQ ID NO: 4721 - DNA, 25 bp, Mus musculus
aaaatggatcacctcatgactaagg

SEQ ID NO: 4722 - DNA, 25 bp, Mus musculus
aaaatggatcacgtcatgactaagg

SEQ ID NO: 4723 - DNA, 25 bp, Mus musculus
aaaatggatttgagggcgtcagatt

SEQ ID NO: 4724 - DNA, 25 bp, Mus musculus
aaaatggatttgtgggcgtcagatt

SEQ ID NO: 4725 - DNA, 25 bp, Mus musculus
aaaatggcacctcttcctcttgacg

SEQ ID NO: 4726 - DNA, 25 bp, Mus musculus
aaaatggcacctgttcctcttgacg

SEQ ID NO: 4727 - DNA, 25 bp, Mus musculus
aaaatggccaccacgaatccagtgt

SEQ ID NO: 4728 - DNA, 25 bp, Mus musculus
aaaatggccacctcgaatccagtgt

SEQ ID NO: 4729 - DNA, 25 bp, Mus musculus
aaaatggcccagaggagggtgcctt

SEQ ID NO: 4730 - DNA, 25 bp, Mus musculus
aaaatggcccagtggagggtgcctt

SEQ ID NO: 4731 - DNA, 25 bp, Mus musculus
aaaatggcccttcggatgtacagtc

SEQ ID NO: 4732 - DNA, 25 bp, Mus musculus
aaaatggcccttgggatgtacagtc

SEQ ID NO: 4733 - DNA, 25 bp, Mus musculus
aaaatggcctctagacatctgatgt

SEQ ID NO: 4734 - DNA, 25 bp, Mus musculus
aaaatggcctcttgacatctgatgt

SEQ ID NO: 4735 - DNA, 25 bp, Mus musculus
aaaatggcctttctcagtagtactc

SEQ ID NO: 4736 - DNA, 25 bp, Mus musculus
aaaatggcctttgtcagtagtactc

SEQ ID NO: 4737 - DNA, 25 bp, Mus musculus
aaaatggcggctcactcaaacgttc

SEQ ID NO: 4738 - DNA, 25 bp, Mus musculus
aaaatggcggctgactcaaacgttc

SEQ ID NO: 4739 - DNA, 25 bp, Mus musculus
aaaatggcgggcagcttgagccttc

SEQ ID NO: 4740 - DNA, 25 bp, Mus musculus
aaaatggcgggctgcttgagccttc

SEQ ID NO: 4741 - DNA, 25 bp, Mus musculus
aaaatggcggtgatgttactacagc

SEQ ID NO: 4742 - DNA, 25 bp, Mus musculus
aaaatggcggtgttgttactacagc

SEQ ID NO: 4743 - DNA, 25 bp, Mus musculus
aaaatggctcataatgtggattaaa

SEQ ID NO: 4744 - DNA, 25 bp, Mus musculus
aaaatggctcattatgtggattaaa

SEQ ID NO: 4745 - DNA, 25 bp, Mus musculus
aaaatggctcctctgctccatattt

SEQ ID NO: 4746 - DNA, 25 bp, Mus musculus
aaaatggctcctgtgctccatattt

SEQ ID NO: 4747 - DNA, 25 bp, Mus musculus
aaaatggctctcatacagtggaaat

SEQ ID NO: 4748 - DNA, 25 bp, Mus musculus
aaaatggctctcttacagtggaaat

SEQ ID NO: 4749 - DNA, 25 bp, Mus musculus
aaaatggctcttctgttctttgata

SEQ ID NO: 4750 - DNA, 25 bp, Mus musculus
aaaatggctcttgtgttctttgata

SEQ ID NO: 4751 - DNA, 25 bp, Mus musculus
aaaatggctgaaaacgttgctgcat

SEQ ID NO: 4752 - DNA, 25 bp, Mus musculus
aaaatggctgaatacgttgctgcat

SEQ ID NO: 4753 - DNA, 25 bp, Mus musculus
aaaatggctgccaagcctatgctgc

SEQ ID NO: 4754 - DNA, 25 bp, Mus musculus
aaaatggctgcctagcctatgctgc

SEQ ID NO: 4755 - DNA, 25 bp, Mus musculus
aaaatggctgctactctgttcggag

SEQ ID NO: 4756 - DNA, 25 bp, Mus musculus
aaaatggctgctccaccaccggaag

SEQ ID NO: 4757 - DNA, 25 bp, Mus musculus
aaaatggctgctgcaccaccggaag

SEQ ID NO: 4758 - DNA, 25 bp, Mus musculus
aaaatggctgcttctctgttcggag

SEQ ID NO: 4759 - DNA, 25 bp, Mus musculus
aaaatggctggacccagtgcccaat

SEQ ID NO: 4760 - DNA, 25 bp, Mus musculus
aaaatggctggagccagtgcccaat

SEQ ID NO: 4761 - DNA, 25 bp, Mus musculus
aaaatgggatcgagaacctcaaatc

SEQ ID NO: 4762 - DNA, 25 bp, Mus musculus
aaaatgggatcgtgaacctcaaatc

SEQ ID NO: 4763 - DNA, 25 bp, Mus musculus
aaaatgggcagacccctggttcata

SEQ ID NO: 4764 - DNA, 25 bp, Mus musculus
aaaatgggcagactccaggccactg

SEQ ID NO: 4765 - DNA, 25 bp, Mus musculus
aaaatgggcagagccctggttcata

SEQ ID NO: 4766 - DNA, 25 bp, Mus musculus
aaaatgggcagagtccaggccactg

SEQ ID NO: 4767 - DNA, 25 bp, Mus musculus
aaaatgggccccatgaactcattct

SEQ ID NO: 4768 - DNA, 25 bp, Mus musculus
aaaatgggccccttgaactcattct

SEQ ID NO: 4769 - DNA, 25 bp, Mus musculus
aaaatgggccctaagctgtgaccat

SEQ ID NO: 4770 - DNA, 25 bp, Mus musculus
aaaatgggcccttagctgtgaccat

SEQ ID NO: 4771 - DNA, 25 bp, Mus musculus
aaaatgggccttcaaatgtcatcaa

SEQ ID NO: 4772 - DNA, 25 bp, Mus musculus
aaaatgggccttgaaatgtcatcaa

SEQ ID NO: 4773 - DNA, 25 bp, Mus musculus
aaaatgggcgccctctcggaggctt

SEQ ID NO: 4774 - DNA, 25 bp, Mus musculus
aaaatgggcgccgtctcggaggctt

SEQ ID NO: 4775 - DNA, 25 bp, Mus musculus
aaaatgggtctaactcctgcatgtg

SEQ ID NO: 4776 - DNA, 25 bp, Mus musculus
aaaatgggtctatctcctgcatgtg

SEQ ID NO: 4777 - DNA, 25 bp, Mus musculus
aaaatggtccatcttctcccgtagt

SEQ ID NO: 4778 - DNA, 25 bp, Mus musculus
aaaatggtccatgttctcccgtagt

SEQ ID NO: 4779 - DNA, 25 bp, Mus musculus
aaaatggtcctcaactgaccttcct

SEQ ID NO: 4780 - DNA, 25 bp, Mus musculus
aaaatggtcctctactgaccttcct

SEQ ID NO: 4781 - DNA, 25 bp, Mus musculus
aaaatggtcgtgatacatctctcgg

SEQ ID NO: 4782 - DNA, 25 bp, Mus musculus
aaaatggtcgtgttacatctctcgg

SEQ ID NO: 4783 - DNA, 25 bp, Mus musculus
aaaatggtctatagtttttcctctg

SEQ ID NO: 4784 - DNA, 25 bp, Mus musculus
aaaatggtctattgtttttcctctg

SEQ ID NO: 4785 - DNA, 25 bp, Mus musculus
aaaatggtgagtcaacggcccctat

SEQ ID NO: 4786 - DNA, 25 bp, Mus musculus
aaaatggtgagtgaacggcccctat

SEQ ID NO: 4787 - DNA, 25 bp, Mus musculus
aaaatggtgcttccagcttctcatt

SEQ ID NO: 4788 - DNA, 25 bp, Mus musculus
aaaatggtgcttgcagcttctcatt

SEQ ID NO: 4789 - DNA, 25 bp, Mus musculus
aaaatggtgtttcctgtctatatgc

SEQ ID NO: 4790 - DNA, 25 bp, Mus musculus
aaaatggtgtttgctgtctatatgc

SEQ ID NO: 4791 - DNA, 25 bp, Mus musculus
aaaatggttatgcttctggcggcta

SEQ ID NO: 4792 - DNA, 25 bp, Mus musculus
aaaatggttatggttctggcggcta

SEQ ID NO: 4793 - DNA, 25 bp, Mus musculus
aaaatggttcaacatgtagcaagac

SEQ ID NO: 4794 - DNA, 25 bp, Mus musculus
aaaatggttcaagatgtagcaagac

SEQ ID NO: 4795 - DNA, 25 bp, Mus musculus
aaaatggttcatcgctccatccaat

SEQ ID NO: 4796 - DNA, 25 bp, Mus musculus
aaaatggttcatggctccatccaat

SEQ ID NO: 4797 - DNA, 25 bp, Mus musculus
aaaatggttctgactttacaatgtg

SEQ ID NO: 4798 - DNA, 25 bp, Mus musculus
aaaatggttctgtctttacaatgtg

SEQ ID NO: 4799 - DNA, 25 bp, Mus musculus
aaaatggttggacagctggtccaga

SEQ ID NO: 4800 - DNA, 25 bp, Mus musculus
aaaatggttggagagctggtccaga

SEQ ID NO: 4801 - DNA, 25 bp, Mus musculus
aaaatggtttgacactgattgagct

SEQ ID NO: 4802 - DNA, 25 bp, Mus musculus
aaaatggtttgagactgattgagct

SEQ ID NO: 4803 - DNA, 25 bp, Mus musculus
aaaatgtacacgaaccaagcctggg

SEQ ID NO: 4804 - DNA, 25 bp, Mus musculus
aaaatgtacacgtaccaagcctggg

SEQ ID NO: 4805 - DNA, 25 bp, Mus musculus
aaaatgtacagacacccctcactat

SEQ ID NO: 4806 - DNA, 25 bp, Mus musculus
aaaatgtacagagacccctcactat

SEQ ID NO: 4807 - DNA, 25 bp, Mus musculus
aaaatgtaccccagaatgtcttatt

SEQ ID NO: 4808 - DNA, 25 bp, Mus musculus
aaaatgtacccctgaatgtcttatt

SEQ ID NO: 4809 - DNA, 25 bp, Mus musculus
aaaatgtatagcaagggcttgccta

SEQ ID NO: 4810 - DNA, 25 bp, Mus musculus
aaaatgtatagctagggcttgccta

SEQ ID NO: 4811 - DNA, 25 bp, Mus musculus
aaaatgtatgcaccttgcccagaac

SEQ ID NO: 4812 - DNA, 25 bp, Mus musculus
aaaatgtatgcagcttgcccagaac

SEQ ID NO: 4813 - DNA, 25 bp, Mus musculus
aaaatgtatgtgacctagttgcaaa

SEQ ID NO: 4814 - DNA, 25 bp, Mus musculus
aaaatgtatgtgtcctagttgcaaa

SEQ ID NO: 4815 - DNA, 25 bp, Mus musculus
aaaatgtattacctagctctactca

SEQ ID NO: 4816 - DNA, 25 bp, Mus musculus
aaaatgtattacgtagctctactca

SEQ ID NO: 4817 - DNA, 25 bp, Mus musculus
aaaatgtatttcaccctaccattgc

SEQ ID NO: 4818 - DNA, 25 bp, Mus musculus
aaaatgtatttctccctaccattgc

SEQ ID NO: 4819 - DNA, 25 bp, Mus musculus
aaaatgtatttgagccttctgtgag

SEQ ID NO: 4820 - DNA, 25 bp, Mus musculus
aaaatgtatttgtgccttctgtgag

SEQ ID NO: 4821 - DNA, 25 bp, Mus musculus
aaaatgtcaaatacactgcccggga

SEQ ID NO: 4822 - DNA, 25 bp, Mus musculus
aaaatgtcaaattcactgcccggga

SEQ ID NO: 4823 - DNA, 25 bp, Mus musculus
aaaatgtcacacatcttctctcgac

SEQ ID NO: 4824 - DNA, 25 bp, Mus musculus
aaaatgtcacacttcttctctcgac

SEQ ID NO: 4825 - DNA, 25 bp, Mus musculus
aaaatgtcacctaacttcactagag

SEQ ID NO: 4826 - DNA, 25 bp, Mus musculus
aaaatgtcaccttacttcactagag

SEQ ID NO: 4827 - DNA, 25 bp, Mus musculus
aaaatgtcactaattctacctcctt

SEQ ID NO: 4828 - DNA, 25 bp, Mus musculus
aaaatgtcactatttctacctcctt

SEQ ID NO: 4829 - DNA, 25 bp, Mus musculus
aaaatgtcactgcttttcggctgcg

SEQ ID NO: 4830 - DNA, 25 bp, Mus musculus
aaaatgtcactggttttcggctgcg

SEQ ID NO: 4831 - DNA, 25 bp, Mus musculus
aaaatgtcacttaatttccaaatat

SEQ ID NO: 4832 - DNA, 25 bp, Mus musculus
aaaatgtcactttatttccaaatat

SEQ ID NO: 4833 - DNA, 25 bp, Mus musculus
aaaatgtcagtcacttcattgagct

SEQ ID NO: 4834 - DNA, 25 bp, Mus musculus
aaaatgtcagtctcttcattgagct

SEQ ID NO: 4835 - DNA, 25 bp, Mus musculus
aaaatgtcatacattgcctccacca

SEQ ID NO: 4836 - DNA, 25 bp, Mus musculus
aaaatgtcatactttgcctccacca

SEQ ID NO: 4837 - DNA, 25 bp, Mus musculus
aaaatgtcatctcatccttgatcca

SEQ ID NO: 4838 - DNA, 25 bp, Mus musculus
aaaatgtcatctgatccttgatcca

SEQ ID NO: 4839 - DNA, 25 bp, Mus musculus
aaaatgtcatggctactggagttga

SEQ ID NO: 4840 - DNA, 25 bp, Mus musculus
aaaatgtcatgggtactggagttga

SEQ ID NO: 4841 - DNA, 25 bp, Mus musculus
aaaatgtccagtcaaaccacccaga

SEQ ID NO: 4842 - DNA, 25 bp, Mus musculus
aaaatgtccagtgaaaccacccaga

SEQ ID NO: 4843 - DNA, 25 bp, Mus musculus
aaaatgtcccaacctgcatgcatgt

SEQ ID NO: 4844 - DNA, 25 bp, Mus musculus
aaaatgtcccaagctgcatgcatgt

SEQ ID NO: 4845 - DNA, 25 bp, Mus musculus
aaaatgtccccacgtgtgtgcacag

SEQ ID NO: 4846 - DNA, 25 bp, Mus musculus
aaaatgtccccaggtgtgtgcacag

SEQ ID NO: 4847 - DNA, 25 bp, Mus musculus
aaaatgtccccgaggtcactctttg

SEQ ID NO: 4848 - DNA, 25 bp, Mus musculus
aaaatgtccccgtggtcactctttg

SEQ ID NO: 4849 - DNA, 25 bp, Mus musculus
aaaatgtcccggctcctagaggtgg

SEQ ID NO: 4850 - DNA, 25 bp, Mus musculus
aaaatgtcccgggtcctagaggtgg

SEQ ID NO: 4851 - DNA, 25 bp, Mus musculus
aaaatgtcccttaactctgaactca

SEQ ID NO: 4852 - DNA, 25 bp, Mus musculus
aaaatgtccctttactctgaactca

SEQ ID NO: 4853 - DNA, 25 bp, Mus musculus
aaaatgtccggcacgtctgtgttct

SEQ ID NO: 4854 - DNA, 25 bp, Mus musculus
aaaatgtccggctcgtctgtgttct

SEQ ID NO: 4855 - DNA, 25 bp, Mus musculus
aaaatgtcctggacaccttgtacga

SEQ ID NO: 4856 - DNA, 25 bp, Mus musculus
aaaatgtcctggctaaggtctcgag

SEQ ID NO: 4857 - DNA, 25 bp, Mus musculus
aaaatgtcctgggtaaggtctcgag

SEQ ID NO: 4858 - DNA, 25 bp, Mus musculus
aaaatgtcctggtcaccttgtacga

SEQ ID NO: 4859 - DNA, 25 bp, Mus musculus
aaaatgtccttaacactgatggcaa

SEQ ID NO: 4860 - DNA, 25 bp, Mus musculus
aaaatgtccttatcactgatggcaa

SEQ ID NO: 4861 - DNA, 25 bp, Mus musculus
aaaatgtccttcatgatccctagtc

SEQ ID NO: 4862 - DNA, 25 bp, Mus musculus
aaaatgtccttcttgatccctagtc

SEQ ID NO: 4863 - DNA, 25 bp, Mus musculus
aaaatgtcctttagcttcacgccca

SEQ ID NO: 4864 - DNA, 25 bp, Mus musculus
aaaatgtccttttgcttcacgccca

SEQ ID NO: 4865 - DNA, 25 bp, Mus musculus
aaaatgtcgaatatggcaccctcac

SEQ ID NO: 4866 - DNA, 25 bp, Mus musculus
aaaatgtcgaatttggcaccctcac

SEQ ID NO: 4867 - DNA, 25 bp, Mus musculus
aaaatgtcgaggctgcatccgtgcc

SEQ ID NO: 4868 - DNA, 25 bp, Mus musculus
aaaatgtcgagggtgcatccgtgcc

SEQ ID NO: 4869 - DNA, 25 bp, Mus musculus
aaaatgtcgtatctctgcctctggt

SEQ ID NO: 4870 - DNA, 25 bp, Mus musculus
aaaatgtcgtatgtctgcctctggt

SEQ ID NO: 4871 - DNA, 25 bp, Mus musculus
aaaatgtcgtttatgttacagcaca

SEQ ID NO: 4872 - DNA, 25 bp, Mus musculus
aaaatgtcgtttttgttacagcaca

SEQ ID NO: 4873 - DNA, 25 bp, Mus musculus
aaaatgtctaataacctgcattatt

SEQ ID NO: 4874 - DNA, 25 bp, Mus musculus
aaaatgtctaattacctgcattatt

SEQ ID NO: 4875 - DNA, 25 bp, Mus musculus
aaaatgtctagaatccttgtgcaag

SEQ ID NO: 4876 - DNA, 25 bp, Mus musculus
aaaatgtctagattccttgtgcaag

SEQ ID NO: 4877 - DNA, 25 bp, Mus musculus
aaaatgtctgttctatcacctcgtg

SEQ ID NO: 4878 - DNA, 25 bp, Mus musculus
aaaatgtctgttgtatcacctcgtg

SEQ ID NO: 4879 - DNA, 25 bp, Mus musculus
aaaatgtctttaatcaggccgtcaa

SEQ ID NO: 4880 - DNA, 25 bp, Mus musculus
aaaatgtctttattcaggccgtcaa

SEQ ID NO: 4881 - DNA, 25 bp, Mus musculus
aaaatgtgattcatggggtctgccc

SEQ ID NO: 4882 - DNA, 25 bp, Mus musculus
aaaatgtgattcttggggtctgccc

SEQ ID NO: 4883 - DNA, 25 bp, Mus musculus
aaaatgtgcatacactagccaggtg

SEQ ID NO: 4884 - DNA, 25 bp, Mus musculus
aaaatgtgcatagactagccaggtg

SEQ ID NO: 4885 - DNA, 25 bp, Mus musculus
aaaatgtgcatcatctgtatacttt

SEQ ID NO: 4886 - DNA, 25 bp, Mus musculus
aaaatgtgcatcttctgtatacttt

SEQ ID NO: 4887 - DNA, 25 bp, Mus musculus
aaaatgtgcgcactgtgggcttgca

SEQ ID NO: 4888 - DNA, 25 bp, Mus musculus
aaaatgtgcgcagtgtgggcttgca

SEQ ID NO: 4889 - DNA, 25 bp, Mus musculus
aaaatgtggacaccacacagtcggc

SEQ ID NO: 4890 - DNA, 25 bp, Mus musculus
aaaatgtggacagcacacagtcggc

SEQ ID NO: 4891 - DNA, 25 bp, Mus musculus
aaaatgtggccaccgctagatttct

SEQ ID NO: 4892 - DNA, 25 bp, Mus musculus
aaaatgtggccagcgctagatttct

SEQ ID NO: 4893 - DNA, 25 bp, Mus musculus
aaaatgtggcccagtgagctggcta

SEQ ID NO: 4894 - DNA, 25 bp, Mus musculus
aaaatgtggccctgtgagctggcta

SEQ ID NO: 4895 - DNA, 25 bp, Mus musculus
aaaatgtggtgcctctgtcacctta

SEQ ID NO: 4896 - DNA, 25 bp, Mus musculus
aaaatgtggtgcgtctgtcacctta

SEQ ID NO: 4897 - DNA, 25 bp, Mus musculus
aaaatgtgtacccagtctttgctcg

SEQ ID NO: 4898 - DNA, 25 bp, Mus musculus
aaaatgtgtaccgagtctttgctcg

SEQ ID NO: 4899 - DNA, 25 bp, Mus musculus
aaaatgtgtcacaccataagaagaa

SEQ ID NO: 4900 - DNA, 25 bp, Mus musculus
aaaatgtgtcactccataagaagaa

SEQ ID NO: 4901 - DNA, 25 bp, Mus musculus
aaaatgtgtctgattggagctctgt

SEQ ID NO: 4902 - DNA, 25 bp, Mus musculus
aaaatgtgtctgtttggagctctgt

SEQ ID NO: 4903 - DNA, 25 bp, Mus musculus
aaaatgtgtgtcacctctttgcgga

SEQ ID NO: 4904 - DNA, 25 bp, Mus musculus
aaaatgtgtgtcatgcaaatgccat

SEQ ID NO: 4905 - DNA, 25 bp, Mus musculus
aaaatgtgtgtctcctctttgcgga

SEQ ID NO: 4906 - DNA, 25 bp, Mus musculus
aaaatgtgtgtcttgcaaatgccat

SEQ ID NO: 4907 - DNA, 25 bp, Mus musculus
aaaatgtgtttactcccgtcaggca

SEQ ID NO: 4908 - DNA, 25 bp, Mus musculus
aaaatgtgtttagtcccgtcaggca

SEQ ID NO: 4909 - DNA, 25 bp, Mus musculus
aaaatgttaaatctgtggcttgctg

SEQ ID NO: 4910 - DNA, 25 bp, Mus musculus
aaaatgttaaatgtgtggcttgctg

SEQ ID NO: 4911 - DNA, 25 bp, Mus musculus
aaaatgttacagcacgagcccgacc

SEQ ID NO: 4912 - DNA, 25 bp, Mus musculus
aaaatgttacaggacgagcccgacc

SEQ ID NO: 4913 - DNA, 25 bp, Mus musculus
aaaatgttagagctgtggagactga

SEQ ID NO: 4914 - DNA, 25 bp, Mus musculus
aaaatgttagaggtgtggagactga

SEQ ID NO: 4915 - DNA, 25 bp, Mus musculus
aaaatgttagttactccatccccag

SEQ ID NO: 4916 - DNA, 25 bp, Mus musculus
aaaatgttagtttctccatccccag

SEQ ID NO: 4917 - DNA, 25 bp, Mus musculus
aaaatgttatgtatgcgcacttgct

SEQ ID NO: 4918 - DNA, 25 bp, Mus musculus
aaaatgttatgtttgcgcacttgct

SEQ ID NO: 4919 - DNA, 25 bp, Mus musculus
aaaatgttcatcacagggttgtaat

SEQ ID NO: 4920 - DNA, 25 bp, Mus musculus
aaaatgttcatctcagggttgtaat

SEQ ID NO: 4921 - DNA, 25 bp, Mus musculus
aaaatgttcatgcaacggttcctca

SEQ ID NO: 4922 - DNA, 25 bp, Mus musculus
aaaatgttcatggaacggttcctca

SEQ ID NO: 4923 - DNA, 25 bp, Mus musculus
aaaatgttctgcagccagtcagtgg

SEQ ID NO: 4924 - DNA, 25 bp, Mus musculus
aaaatgttctgctgccagtcagtgg

SEQ ID NO: 4925 - DNA, 25 bp, Mus musculus
aaaatgttcttgacattgcagcatc

SEQ ID NO: 4926 - DNA, 25 bp, Mus musculus
aaaatgttcttgagccttgggtgta

SEQ ID NO: 4927 - DNA, 25 bp, Mus musculus
aaaatgttcttgtcattgcagcatc

SEQ ID NO: 4928 - DNA, 25 bp, Mus musculus
aaaatgttcttgtgccttgggtgta

SEQ ID NO: 4929 - DNA, 25 bp, Mus musculus
aaaatgttgagacggcaccagcaca

SEQ ID NO: 4930 - DNA, 25 bp, Mus musculus
aaaatgttgagagggcaccagcaca

SEQ ID NO: 4931 - DNA, 25 bp, Mus musculus
aaaatgttgatccttgccagagtga

SEQ ID NO: 4932 - DNA, 25 bp, Mus musculus
aaaatgttgatcgttgccagagtga

SEQ ID NO: 4933 - DNA, 25 bp, Mus musculus
aaaatgttggccacctgtgactttt

SEQ ID NO: 4934 - DNA, 25 bp, Mus musculus
aaaatgttggcctcctgtgactttt

SEQ ID NO: 4935 - DNA, 25 bp, Mus musculus
aaaatgttgtggcagctcctgggca

SEQ ID NO: 4936 - DNA, 25 bp, Mus musculus
aaaatgttgtgggagctcctgggca

SEQ ID NO: 4937 - DNA, 25 bp, Mus musculus
aaaatgttgttgctaacccaccagt

SEQ ID NO: 4938 - DNA, 25 bp, Mus musculus
aaaatgttgttggtaacccaccagt

SEQ ID NO: 4939 - DNA, 25 bp, Mus musculus
aaaatgttgtttaccttctcagagt

SEQ ID NO: 4940 - DNA, 25 bp, Mus musculus
aaaatgttgtttagaggcacaagga

SEQ ID NO: 4941 - DNA, 25 bp, Mus musculus
aaaatgttgttttccttctcagagt

SEQ ID NO: 4942 - DNA, 25 bp, Mus musculus
aaaatgttgttttgaggcacaagga

SEQ ID NO: 4943 - DNA, 25 bp, Mus musculus
aaaatgtttactcttccatcattta

SEQ ID NO: 4944 - DNA, 25 bp, Mus musculus
aaaatgtttactgttccatcattta

SEQ ID NO: 4945 - DNA, 25 bp, Mus musculus
aaaatgtttccaattcttggttctg

SEQ ID NO: 4946 - DNA, 25 bp, Mus musculus
aaaatgtttccatttcttggttctg

SEQ ID NO: 4947 - DNA, 25 bp, Mus musculus
aaaatgtttgtgactttcctgtaag

SEQ ID NO: 4948 - DNA, 25 bp, Mus musculus
aaaatgtttgtgtctttcctgtaag

SEQ ID NO: 4949 - DNA, 25 bp, Mus musculus
aaaatgtttttacctgggtacagag

SEQ ID NO: 4950 - DNA, 25 bp, Mus musculus
aaaatgtttttagctgggtacagag

SEQ ID NO: 4951 - DNA, 25 bp, Mus musculus
aaaattaaacatccctctcaatagg

SEQ ID NO: 4952 - DNA, 25 bp, Mus musculus
aaaattaaacatgcctctcaatagg

SEQ ID NO: 4953 - DNA, 25 bp, Mus musculus
aaaattaaacgaacgctgcagagtt

SEQ ID NO: 4954 - DNA, 25 bp, Mus musculus
aaaattaaacgatcgctgcagagtt

SEQ ID NO: 4955 - DNA, 25 bp, Mus musculus
aaaattaaccccatgttgcaggatg

SEQ ID NO: 4956 - DNA, 25 bp, Mus musculus
aaaattaaccccttgttgcaggatg

SEQ ID NO: 4957 - DNA, 25 bp, Mus musculus
aaaattaactatatgcaccgaaatg

SEQ ID NO: 4958 - DNA, 25 bp, Mus musculus
aaaattaactatttgcaccgaaatg

SEQ ID NO: 4959 - DNA, 25 bp, Mus musculus
aaaattaactccctgtgaatcttgg

SEQ ID NO: 4960 - DNA, 25 bp, Mus musculus
aaaattaactccgtgtgaatcttgg

SEQ ID NO: 4961 - DNA, 25 bp, Mus musculus
aaaattacacatctgacttacagag

SEQ ID NO: 4962 - DNA, 25 bp, Mus musculus
aaaattacacatgtgacttacagag

SEQ ID NO: 4963 - DNA, 25 bp, Mus musculus
aaaattacaccgcagcacgctgcga

SEQ ID NO: 4964 - DNA, 25 bp, Mus musculus
aaaattacaccggagcacgctgcga

SEQ ID NO: 4965 - DNA, 25 bp, Mus musculus
aaaattacaggcctctctcatcttt

SEQ ID NO: 4966 - DNA, 25 bp, Mus musculus
aaaattacaggcctggtctcgccgt

SEQ ID NO: 4967 - DNA, 25 bp, Mus musculus
aaaattacaggcgtctctcatcttt

SEQ ID NO: 4968 - DNA, 25 bp, Mus musculus
aaaattacaggcgtggtctcgccgt

SEQ ID NO: 4969 - DNA, 25 bp, Mus musculus
aaaattacctatcttatctctcacc

SEQ ID NO: 4970 - DNA, 25 bp, Mus musculus
aaaattacctatgttatctctcacc

SEQ ID NO: 4971 - DNA, 25 bp, Mus musculus
aaaattacctggatgccgcaaacat

SEQ ID NO: 4972 - DNA, 25 bp, Mus musculus
aaaattacctggttgccgcaaacat

SEQ ID NO: 4973 - DNA, 25 bp, Mus musculus
aaaattactagaaccattccttctt

SEQ ID NO: 4974 - DNA, 25 bp, Mus musculus
aaaattactagatccattccttctt

SEQ ID NO: 4975 - DNA, 25 bp, Mus musculus
aaaattacttgactttatgaggcag

SEQ ID NO: 4976 - DNA, 25 bp, Mus musculus
aaaattacttgagtttatgaggcag

SEQ ID NO: 4977 - DNA, 25 bp, Mus musculus
aaaattagacctatgtggcgacatt

SEQ ID NO: 4978 - DNA, 25 bp, Mus musculus
aaaattagacctttgtggcgacatt

SEQ ID NO: 4979 - DNA, 25 bp, Mus musculus
aaaattagagtgatgccttccagct

SEQ ID NO: 4980 - DNA, 25 bp, Mus musculus
aaaattagagtgttgccttccagct

SEQ ID NO: 4981 - DNA, 25 bp, Mus musculus
aaaattagatttatgttcattgtgt

SEQ ID NO: 4982 - DNA, 25 bp, Mus musculus
aaaattagatttttgttcattgtgt

SEQ ID NO: 4983 - DNA, 25 bp, Mus musculus
aaaattagcctcaaacctgccggtg

SEQ ID NO: 4984 - DNA, 25 bp, Mus musculus
aaaattagcctctaacctgccggtg

SEQ ID NO: 4985 - DNA, 25 bp, Mus musculus
aaaattaggcagatgttacataata

SEQ ID NO: 4986 - DNA, 25 bp, Mus musculus
aaaattaggcagttgttacataata

SEQ ID NO: 4987 - DNA, 25 bp, Mus musculus
aaaattatagacaagcttctggcaa

SEQ ID NO: 4988 - DNA, 25 bp, Mus musculus
aaaattatagactagcttctggcaa

SEQ ID NO: 4989 - DNA, 25 bp, Mus musculus
aaaattatattcacccttctctctt

SEQ ID NO: 4990 - DNA, 25 bp, Mus musculus
aaaattatattctcccttctctctt

SEQ ID NO: 4991 - DNA, 25 bp, Mus musculus
aaaattatcaacactgcttctcttc

SEQ ID NO: 4992 - DNA, 25 bp, Mus musculus
aaaattatcaactctgcttctcttc

SEQ ID NO: 4993 - DNA, 25 bp, Mus musculus
aaaattatccatcagctctctccag

SEQ ID NO: 4994 - DNA, 25 bp, Mus musculus
aaaattatccatcctgtatacttgc

SEQ ID NO: 4995 - DNA, 25 bp, Mus musculus
aaaattatccatgagctctctccag

SEQ ID NO: 4996 - DNA, 25 bp, Mus musculus
aaaattatccatgctgtatacttgc

SEQ ID NO: 4997 - DNA, 25 bp, Mus musculus
aaaattatgattacctgctttcaga

SEQ ID NO: 4998 - DNA, 25 bp, Mus musculus
aaaattatgatttcctgctttcaga

SEQ ID NO: 4999 - DNA, 25 bp, Mus musculus
aaaattatggttcggcctggccagt

SEQ ID NO: 5000 - DNA, 25 bp, Mus musculus
aaaattatggttgggcctggccagt

SEQ ID NO: 5001 - DNA, 25 bp, Mus musculus
aaaattatgtatctacccagctgat

SEQ ID NO: 5002 - DNA, 25 bp, Mus musculus
aaaattatgtatgtacccagctgat

SEQ ID NO: 5003 - DNA, 25 bp, Mus musculus
aaaattatgttgatgcttctttgta

SEQ ID NO: 5004 - DNA, 25 bp, Mus musculus
aaaattatgttgttgcttctttgta

SEQ ID NO: 5005 - DNA, 25 bp, Mus musculus
aaaattattggaaccagcaaatgtt

SEQ ID NO: 5006 - DNA, 25 bp, Mus musculus
aaaattattggatccagcaaatgtt

SEQ ID NO: 5007 - DNA, 25 bp, Mus musculus
aaaattcaaggccacttagcaagac

SEQ ID NO: 5008 - DNA, 25 bp, Mus musculus
aaaattcaaggcgacttagcaagac

SEQ ID NO: 5009 - DNA, 25 bp, Mus musculus
aaaattcacgatcctgtcagtcaag

SEQ ID NO: 5010 - DNA, 25 bp, Mus musculus
aaaattcacgatgctgtcagtcaag

SEQ ID NO: 5011 - DNA, 25 bp, Mus musculus
aaaattcacgtcctttcactgacag

SEQ ID NO: 5012 - DNA, 25 bp, Mus musculus
aaaattcacgtcgtttcactgacag

SEQ ID NO: 5013 - DNA, 25 bp, Mus musculus
aaaattcactagcaagttctctgga

SEQ ID NO: 5014 - DNA, 25 bp, Mus musculus
aaaattcactaggaagttctctgga

SEQ ID NO: 5015 - DNA, 25 bp, Mus musculus
aaaattcactggctcaccggaactc

SEQ ID NO: 5016 - DNA, 25 bp, Mus musculus
aaaattcactgggtcaccggaactc

SEQ ID NO: 5017 - DNA, 25 bp, Mus musculus
aaaattcactgtaccactttgagaa

SEQ ID NO: 5018 - DNA, 25 bp, Mus musculus
aaaattcactgttccactttgagaa

SEQ ID NO: 5019 - DNA, 25 bp, Mus musculus
aaaattcagcagcagtgcagagact

SEQ ID NO: 5020 - DNA, 25 bp, Mus musculus
aaaattcagcaggagtgcagagact

SEQ ID NO: 5021 - DNA, 25 bp, Mus musculus
aaaattcagtgcatgccgctacaag

SEQ ID NO: 5022 - DNA, 25 bp, Mus musculus
aaaattcagtgcttgccgctacaag

SEQ ID NO: 5023 - DNA, 25 bp, Mus musculus
aaaattcatatcagcctctgtcagc

SEQ ID NO: 5024 - DNA, 25 bp, Mus musculus
aaaattcatatctgcctctgtcagc

SEQ ID NO: 5025 - DNA, 25 bp, Mus musculus
aaaattcatattagctacctggata

SEQ ID NO: 5026 - DNA, 25 bp, Mus musculus
aaaattcatatttgctacctggata

SEQ ID NO: 5027 - DNA, 25 bp, Mus musculus
aaaattcatctcatgcagtccaaca

SEQ ID NO: 5028 - DNA, 25 bp, Mus musculus
aaaattcatctcttgcagtccaaca

SEQ ID NO: 5029 - DNA, 25 bp, Mus musculus
aaaattcatgctacacttttgtgaa

SEQ ID NO: 5030 - DNA, 25 bp, Mus musculus
aaaattcatgcttcacttttgtgaa

SEQ ID NO: 5031 - DNA, 25 bp, Mus musculus
aaaattccaaacatattgtctgata

SEQ ID NO: 5032 - DNA, 25 bp, Mus musculus
aaaattccaaacttattgtctgata

SEQ ID NO: 5033 - DNA, 25 bp, Mus musculus
aaaattccagctatgtgatgagtag

SEQ ID NO: 5034 - DNA, 25 bp, Mus musculus
aaaattccagctttgtgatgagtag

SEQ ID NO: 5035 - DNA, 25 bp, Mus musculus
aaaattccatagatcatggcacact

SEQ ID NO: 5036 - DNA, 25 bp, Mus musculus
aaaattccatagttcatggcacact

SEQ ID NO: 5037 - DNA, 25 bp, Mus musculus
aaaattccatgaactatcctcaaaa

SEQ ID NO: 5038 - DNA, 25 bp, Mus musculus
aaaattccatgatctatcctcaaaa

SEQ ID NO: 5039 - DNA, 25 bp, Mus musculus
aaaattccccaacacaatcatcctg

SEQ ID NO: 5040 - DNA, 25 bp, Mus musculus
aaaattccccaagacaatcatcctg

SEQ ID NO: 5041 - DNA, 25 bp, Mus musculus
aaaattccctcgctgctttgaaatt

SEQ ID NO: 5042 - DNA, 25 bp, Mus musculus
aaaattccctcggtgctttgaaatt

SEQ ID NO: 5043 - DNA, 25 bp, Mus musculus
aaaattccgcttcaagcctctgtca

SEQ ID NO: 5044 - DNA, 25 bp, Mus musculus
aaaattccgcttgaagcctctgtca

SEQ ID NO: 5045 - DNA, 25 bp, Mus musculus
aaaattccgtacctgtgcatgcctg

SEQ ID NO: 5046 - DNA, 25 bp, Mus musculus
aaaattccgtacgtgtgcatgcctg

SEQ ID NO: 5047 - DNA, 25 bp, Mus musculus
aaaattcctaccagaatcctcttct

SEQ ID NO: 5048 - DNA, 25 bp, Mus musculus
aaaattcctacctgaatcctcttct

SEQ ID NO: 5049 - DNA, 25 bp, Mus musculus
aaaattcctccacttggctcatggt

SEQ ID NO: 5050 - DNA, 25 bp, Mus musculus
aaaattcctccagttggctcatggt

SEQ ID NO: 5051 - DNA, 25 bp, Mus musculus
aaaattcctgaaccttatgggtggc

SEQ ID NO: 5052 - DNA, 25 bp, Mus musculus
aaaattcctgaagcttatgggtggc

SEQ ID NO: 5053 - DNA, 25 bp, Mus musculus
aaaattcctgatactagacccacac

SEQ ID NO: 5054 - DNA, 25 bp, Mus musculus
aaaattcctgattctagacccacac

SEQ ID NO: 5055 - DNA, 25 bp, Mus musculus
aaaattcctgctactattgctgcta

SEQ ID NO: 5056 - DNA, 25 bp, Mus musculus
aaaattcctgcttctattgctgcta

SEQ ID NO: 5057 - DNA, 25 bp, Mus musculus
aaaattcctggaaggctgcagatgt

SEQ ID NO: 5058 - DNA, 25 bp, Mus musculus
aaaattcctggatggctgcagatgt

SEQ ID NO: 5059 - DNA, 25 bp, Mus musculus
aaaattcctgggcaggcacaggcta

SEQ ID NO: 5060 - DNA, 25 bp, Mus musculus
aaaattcctggggaggcacaggcta

SEQ ID NO: 5061 - DNA, 25 bp, Mus musculus
aaaattcgttctagtttatctctga

SEQ ID NO: 5062 - DNA, 25 bp, Mus musculus
aaaattcgttcttgtttatctctga

SEQ ID NO: 5063 - DNA, 25 bp, Mus musculus
aaaattctaccactggagacggata

SEQ ID NO: 5064 - DNA, 25 bp, Mus musculus
aaaattctaccagtggagacggata

SEQ ID NO: 5065 - DNA, 25 bp, Mus musculus
aaaattctagatagcttttcactct

SEQ ID NO: 5066 - DNA, 25 bp, Mus musculus
aaaattctagattgcttttcactct

SEQ ID NO: 5067 - DNA, 25 bp, Mus musculus
aaaattctatctagtgccccatgaa

SEQ ID NO: 5068 - DNA, 25 bp, Mus musculus
aaaattctatcttgtgccccatgaa

SEQ ID NO: 5069 - DNA, 25 bp, Mus musculus
aaaattctatgtctccttgccagta

SEQ ID NO: 5070 - DNA, 25 bp, Mus musculus
aaaattctatgtgtccttgccagta

SEQ ID NO: 5071 - DNA, 25 bp, Mus musculus
aaaattctcaatctggacccaaagg

SEQ ID NO: 5072 - DNA, 25 bp, Mus musculus
aaaattctcaatgtggacccaaagg

SEQ ID NO: 5073 - DNA, 25 bp, Mus musculus
aaaattctcacgattgtgtgggata

SEQ ID NO: 5074 - DNA, 25 bp, Mus musculus
aaaattctcacgtttgtgtgggata

SEQ ID NO: 5075 - DNA, 25 bp, Mus musculus
aaaattctcagaagcaccatgcaga

SEQ ID NO: 5076 - DNA, 25 bp, Mus musculus
aaaattctcagatgcaccatgcaga

SEQ ID NO: 5077 - DNA, 25 bp, Mus musculus
aaaattctccacatttgaacactgg

SEQ ID NO: 5078 - DNA, 25 bp, Mus musculus
aaaattctccacttttgaacactgg

SEQ ID NO: 5079 - DNA, 25 bp, Mus musculus
aaaattctctcaagactgctccaga

SEQ ID NO: 5080 - DNA, 25 bp, Mus musculus
aaaattctctcatgactgctccaga

SEQ ID NO: 5081 - DNA, 25 bp, Mus musculus
aaaattctctgacctttaatcctat

SEQ ID NO: 5082 - DNA, 25 bp, Mus musculus
aaaattctctgagctttaatcctat

SEQ ID NO: 5083 - DNA, 25 bp, Mus musculus
aaaattctgatgactgcattgtatc

SEQ ID NO: 5084 - DNA, 25 bp, Mus musculus
aaaattctgatgtctgcattgtatc

SEQ ID NO: 5085 - DNA, 25 bp, Mus musculus
aaaattctgcacatagggctcaagt

SEQ ID NO: 5086 - DNA, 25 bp, Mus musculus
aaaattctgcacctctttcaacgtg

SEQ ID NO: 5087 - DNA, 25 bp, Mus musculus
aaaattctgcacgtctttcaacgtg

SEQ ID NO: 5088 - DNA, 25 bp, Mus musculus
aaaattctgcacttagggctcaagt

SEQ ID NO: 5089 - DNA, 25 bp, Mus musculus
aaaattctggtactgacacttcaca

SEQ ID NO: 5090 - DNA, 25 bp, Mus musculus
aaaattctggtagtgacacttcaca

SEQ ID NO: 5091 - DNA, 25 bp, Mus musculus
aaaattctgtgcagttttgctcagg

SEQ ID NO: 5092 - DNA, 25 bp, Mus musculus
aaaattctgtgcctttacttcctgg

SEQ ID NO: 5093 - DNA, 25 bp, Mus musculus
aaaattctgtgcgtttacttcctgg

SEQ ID NO: 5094 - DNA, 25 bp, Mus musculus
aaaattctgtgctgttttgctcagg

SEQ ID NO: 5095 - DNA, 25 bp, Mus musculus
aaaattcttcatccacatccatata

SEQ ID NO: 5096 - DNA, 25 bp, Mus musculus
aaaattcttcatgcacatccatata

SEQ ID NO: 5097 - DNA, 25 bp, Mus musculus
aaaattcttccactttcagcagggt

SEQ ID NO: 5098 - DNA, 25 bp, Mus musculus
aaaattcttccagtttcagcagggt

SEQ ID NO: 5099 - DNA, 25 bp, Mus musculus
aaaattcttgcaagccactggtcat

SEQ ID NO: 5100 - DNA, 25 bp, Mus musculus
aaaattcttgcatgccactggtcat

SEQ ID NO: 5101 - DNA, 25 bp, Mus musculus
aaaattcttgcccatctcatcaaca

SEQ ID NO: 5102 - DNA, 25 bp, Mus musculus
aaaattcttgccgatctcatcaaca

SEQ ID NO: 5103 - DNA, 25 bp, Mus musculus
aaaattcttgctcgtgttcacccat

SEQ ID NO: 5104 - DNA, 25 bp, Mus musculus
aaaattcttgctggtgttcacccat

SEQ ID NO: 5105 - DNA, 25 bp, Mus musculus
aaaattcttggcatgctgtggccat

SEQ ID NO: 5106 - DNA, 25 bp, Mus musculus
aaaattcttggcttgctgtggccat

SEQ ID NO: 5107 - DNA, 25 bp, Mus musculus
aaaattctttataggccatcttaga

SEQ ID NO: 5108 - DNA, 25 bp, Mus musculus
aaaattctttattggccatcttaga

SEQ ID NO: 5109 - DNA, 25 bp, Mus musculus
aaaattctttggcatgttagcagtt

SEQ ID NO: 5110 - DNA, 25 bp, Mus musculus
aaaattctttgggatgttagcagtt

SEQ ID NO: 5111 - DNA, 25 bp, Mus musculus
aaaattgacggtagcccctagacag

SEQ ID NO: 5112 - DNA, 25 bp, Mus musculus
aaaattgacggttgcccctagacag

SEQ ID NO: 5113 - DNA, 25 bp, Mus musculus
aaaattgatctgaactttcttggtc

SEQ ID NO: 5114 - DNA, 25 bp, Mus musculus
aaaattgatctgctggactttggcc

SEQ ID NO: 5115 - DNA, 25 bp, Mus musculus
aaaattgatctggtggactttggcc

SEQ ID NO: 5116 - DNA, 25 bp, Mus musculus
aaaattgatctgtactttcttggtc

SEQ ID NO: 5117 - DNA, 25 bp, Mus musculus
aaaattgcacaacacgcacgcacac

SEQ ID NO: 5118 - DNA, 25 bp, Mus musculus
aaaattgcacaagacgcacgcacac

SEQ ID NO: 5119 - DNA, 25 bp, Mus musculus
aaaattgcacgtccttttccaggcc

SEQ ID NO: 5120 - DNA, 25 bp, Mus musculus
aaaattgcacgtgcttttccaggcc

SEQ ID NO: 5121 - DNA, 25 bp, Mus musculus
aaaattgcaggcaatcaaccagtag

SEQ ID NO: 5122 - DNA, 25 bp, Mus musculus
aaaattgcaggctatcaaccagtag

SEQ ID NO: 5123 - DNA, 25 bp, Mus musculus
aaaattgccaggcaagatatacttt

SEQ ID NO: 5124 - DNA, 25 bp, Mus musculus
aaaattgccagggaagatatacttt

SEQ ID NO: 5125 - DNA, 25 bp, Mus musculus
aaaattgcctgtaccagtggccttg

SEQ ID NO: 5126 - DNA, 25 bp, Mus musculus
aaaattgcctgttccagtggccttg

SEQ ID NO: 5127 - DNA, 25 bp, Mus musculus
aaaattgcctttaggcacctggcgc

SEQ ID NO: 5128 - DNA, 25 bp, Mus musculus
aaaattgccttttggcacctggcgc

SEQ ID NO: 5129 - DNA, 25 bp, Mus musculus
aaaattgcgctgagatattcctccc

SEQ ID NO: 5130 - DNA, 25 bp, Mus musculus
aaaattgcgctgtgatattcctccc

SEQ ID NO: 5131 - DNA, 25 bp, Mus musculus
aaaattggacaaacggcagtgaggt

SEQ ID NO: 5132 - DNA, 25 bp, Mus musculus
aaaattggacaatcggcagtgaggt

SEQ ID NO: 5133 - DNA, 25 bp, Mus musculus
aaaattggcaggaccaccatcttgc

SEQ ID NO: 5134 - DNA, 25 bp, Mus musculus
aaaattggcaggtccaccatcttgc

SEQ ID NO: 5135 - DNA, 25 bp, Mus musculus
aaaattggccttagtcatcagaatc

SEQ ID NO: 5136 - DNA, 25 bp, Mus musculus
aaaattggcctttgtcatcagaatc

SEQ ID NO: 5137 - DNA, 25 bp, Mus musculus
aaaattggcggtatattgtgcccat

SEQ ID NO: 5138 - DNA, 25 bp, Mus musculus
aaaattggcggtttattgtgcccat

SEQ ID NO: 5139 - DNA, 25 bp, Mus musculus
aaaattggctacaggcgtgtatgta

SEQ ID NO: 5140 - DNA, 25 bp, Mus musculus
aaaattggctactggcgtgtatgta

SEQ ID NO: 5141 - DNA, 25 bp, Mus musculus
aaaattggctttcttctcctcagac

SEQ ID NO: 5142 - DNA, 25 bp, Mus musculus
aaaattggctttgttctcctcagac

SEQ ID NO: 5143 - DNA, 25 bp, Mus musculus
aaaattgggtccacagcactacaga

SEQ ID NO: 5144 - DNA, 25 bp, Mus musculus
aaaattgggtcctcagcactacaga

SEQ ID NO: 5145 - DNA, 25 bp, Mus musculus
aaaattggtgtgaatgcatccagcc

SEQ ID NO: 5146 - DNA, 25 bp, Mus musculus
aaaattggtgtgtatgcatccagcc

SEQ ID NO: 5147 - DNA, 25 bp, Mus musculus
aaaattgtaaggaccaggcataggg

SEQ ID NO: 5148 - DNA, 25 bp, Mus musculus
aaaattgtaaggtccaggcataggg

SEQ ID NO: 5149 - DNA, 25 bp, Mus musculus
aaaattgtaagtaagtcataccttg

SEQ ID NO: 5150 - DNA, 25 bp, Mus musculus
aaaattgtaagttagtcataccttg

SEQ ID NO: 5151 - DNA, 25 bp, Mus musculus
aaaattgtacatatggttttgccaa

SEQ ID NO: 5152 - DNA, 25 bp, Mus musculus
aaaattgtacatttggttttgccaa

SEQ ID NO: 5153 - DNA, 25 bp, Mus musculus
aaaattgtcctgaggtggaccccag

SEQ ID NO: 5154 - DNA, 25 bp, Mus musculus
aaaattgtcctgtggtggaccccag

SEQ ID NO: 5155 - DNA, 25 bp, Mus musculus
aaaattgtctccaaggtcccttgag

SEQ ID NO: 5156 - DNA, 25 bp, Mus musculus
aaaattgtctcctaggtcccttgag

SEQ ID NO: 5157 - DNA, 25 bp, Mus musculus
aaaattgtgacaacctcagctgccc

SEQ ID NO: 5158 - DNA, 25 bp, Mus musculus
aaaattgtgacatcctcagctgccc

SEQ ID NO: 5159 - DNA, 25 bp, Mus musculus
aaaattgtgcacatgagttctccag

SEQ ID NO: 5160 - DNA, 25 bp, Mus musculus
aaaattgtgcacttgagttctccag

SEQ ID NO: 5161 - DNA, 25 bp, Mus musculus
aaaattgtgggtctgcattgtaaaa

SEQ ID NO: 5162 - DNA, 25 bp, Mus musculus
aaaattgtgggtgtgcattgtaaaa

SEQ ID NO: 5163 - DNA, 25 bp, Mus musculus
aaaattgtggtcaatctctgaaaac

SEQ ID NO: 5164 - DNA, 25 bp, Mus musculus
aaaattgtggtctatctctgaaaac

SEQ ID NO: 5165 - DNA, 25 bp, Mus musculus
aaaattgtgtatcttgggaggagat

SEQ ID NO: 5166 - DNA, 25 bp, Mus musculus
aaaattgtgtatgttgggaggagat

SEQ ID NO: 5167 - DNA, 25 bp, Mus musculus
aaaattgtgtccagtgcttttagac

SEQ ID NO: 5168 - DNA, 25 bp, Mus musculus
aaaattgtgtcctgtgcttttagac

SEQ ID NO: 5169 - DNA, 25 bp, Mus musculus
aaaattgtgtctcggaacatgttcc

SEQ ID NO: 5170 - DNA, 25 bp, Mus musculus
aaaattgtgtctgggaacatgttcc

SEQ ID NO: 5171 - DNA, 25 bp, Mus musculus
aaaattgttcagctcatgagactgg

SEQ ID NO: 5172 - DNA, 25 bp, Mus musculus
aaaattgttcaggtcatgagactgg

SEQ ID NO: 5173 - DNA, 25 bp, Mus musculus
aaaattgttcgcagggcttcttgca

SEQ ID NO: 5174 - DNA, 25 bp, Mus musculus
aaaattgttcgctgggcttcttgca

SEQ ID NO: 5175 - DNA, 25 bp, Mus musculus
aaaattgtttctactctgtctactt

SEQ ID NO: 5176 - DNA, 25 bp, Mus musculus
aaaattgtttcttctctgtctactt

SEQ ID NO: 5177 - DNA, 25 bp, Mus musculus
aaaattgtttgcattctctgtaaag

SEQ ID NO: 5178 - DNA, 25 bp, Mus musculus
aaaattgtttgctttctctgtaaag

SEQ ID NO: 5179 - DNA, 25 bp, Mus musculus
aaaatttaaacaacgtatgcgcata

SEQ ID NO: 5180 - DNA, 25 bp, Mus musculus
aaaatttaaacatcgtatgcgcata

SEQ ID NO: 5181 - DNA, 25 bp, Mus musculus
aaaatttaaatgcttctctcaggaa

SEQ ID NO: 5182 - DNA, 25 bp, Mus musculus
aaaatttaaatggttctctcaggaa

SEQ ID NO: 5183 - DNA, 25 bp, Mus musculus
aaaatttaagccagctgcctgttca

SEQ ID NO: 5184 - DNA, 25 bp, Mus musculus
aaaatttaagcctgctgcctgttca

SEQ ID NO: 5185 - DNA, 25 bp, Mus musculus
aaaatttagacaccagctgtaactg

SEQ ID NO: 5186 - DNA, 25 bp, Mus musculus
aaaatttagacagcagctgtaactg

SEQ ID NO: 5187 - DNA, 25 bp, Mus musculus
aaaatttattcacccttggattcac

SEQ ID NO: 5188 - DNA, 25 bp, Mus musculus
aaaatttattcagccttggattcac

SEQ ID NO: 5189 - DNA, 25 bp, Mus musculus
aaaatttattttcctaggtgtggtg

SEQ ID NO: 5190 - DNA, 25 bp, Mus musculus
aaaatttattttgctaggtgtggtg

SEQ ID NO: 5191 - DNA, 25 bp, Mus musculus
aaaatttcacccattaattcagcca

SEQ ID NO: 5192 - DNA, 25 bp, Mus musculus
aaaatttcaccctttaattcagcca

SEQ ID NO: 5193 - DNA, 25 bp, Mus musculus
aaaatttcactcatctaccactgga

SEQ ID NO: 5194 - DNA, 25 bp, Mus musculus
aaaatttcactcttctaccactgga

SEQ ID NO: 5195 - DNA, 25 bp, Mus musculus
aaaatttcaggaaccacaccaatga

SEQ ID NO: 5196 - DNA, 25 bp, Mus musculus
aaaatttcaggatccacaccaatga

SEQ ID NO: 5197 - DNA, 25 bp, Mus musculus
aaaatttcatgtcgatcgcccatgc

SEQ ID NO: 5198 - DNA, 25 bp, Mus musculus
aaaatttcatgtggatcgcccatgc

SEQ ID NO: 5199 - DNA, 25 bp, Mus musculus
aaaatttccacaagcttgttaagaa

SEQ ID NO: 5200 - DNA, 25 bp, Mus musculus
aaaatttccacatgcttgttaagaa

SEQ ID NO: 5201 - DNA, 25 bp, Mus musculus
aaaatttccaggagtcagatcaaaa

SEQ ID NO: 5202 - DNA, 25 bp, Mus musculus
aaaatttccaggtgtcagatcaaaa

SEQ ID NO: 5203 - DNA, 25 bp, Mus musculus
aaaatttcctttctaatgtgctgtc

SEQ ID NO: 5204 - DNA, 25 bp, Mus musculus
aaaatttcctttgtaatgtgctgtc

SEQ ID NO: 5205 - DNA, 25 bp, Mus musculus
aaaatttctataacagtcttcaaag

SEQ ID NO: 5206 - DNA, 25 bp, Mus musculus
aaaatttctatatcagtcttcaaag

SEQ ID NO: 5207 - DNA, 25 bp, Mus musculus
aaaatttctcagataattctgttga

SEQ ID NO: 5208 - DNA, 25 bp, Mus musculus
aaaatttctcagttaattctgttga

SEQ ID NO: 5209 - DNA, 25 bp, Mus musculus
aaaatttctgacagtccttaagaca

SEQ ID NO: 5210 - DNA, 25 bp, Mus musculus
aaaatttctgactgtccttaagaca

SEQ ID NO: 5211 - DNA, 25 bp, Mus musculus
aaaatttctgatcaccacaaacttt

SEQ ID NO: 5212 - DNA, 25 bp, Mus musculus
aaaatttctgatgaccacaaacttt

SEQ ID NO: 5213 - DNA, 25 bp, Mus musculus
aaaatttctgcaaggttaccagttt

SEQ ID NO: 5214 - DNA, 25 bp, Mus musculus
aaaatttctgcatggttaccagttt

SEQ ID NO: 5215 - DNA, 25 bp, Mus musculus
aaaatttctgtcagtcattctgttt

SEQ ID NO: 5216 - DNA, 25 bp, Mus musculus
aaaatttctgtctgtcattctgttt

SEQ ID NO: 5217 - DNA, 25 bp, Mus musculus
aaaatttcttgcatcagttgattca

SEQ ID NO: 5218 - DNA, 25 bp, Mus musculus
aaaatttcttgcttcagttgattca

SEQ ID NO: 5219 - DNA, 25 bp, Mus musculus
aaaatttgaggcagcgctttggagg

SEQ ID NO: 5220 - DNA, 25 bp, Mus musculus
aaaatttgaggctgcgctttggagg

SEQ ID NO: 5221 - DNA, 25 bp, Mus musculus
aaaatttgcaaactcataccccatg

SEQ ID NO: 5222 - DNA, 25 bp, Mus musculus
aaaatttgcaaagtcataccccatg

SEQ ID NO: 5223 - DNA, 25 bp, Mus musculus
aaaatttgctatcccagtatgctgg

SEQ ID NO: 5224 - DNA, 25 bp, Mus musculus
aaaatttgctatgccagtatgctgg

SEQ ID NO: 5225 - DNA, 25 bp, Mus musculus
aaaatttgctcactactaccccaag

SEQ ID NO: 5226 - DNA, 25 bp, Mus musculus
aaaatttgctcagtactaccccaag

SEQ ID NO: 5227 - DNA, 25 bp, Mus musculus
aaaatttggcatcctgattgggtgt

SEQ ID NO: 5228 - DNA, 25 bp, Mus musculus
aaaatttggcatgctgattgggtgt

SEQ ID NO: 5229 - DNA, 25 bp, Mus musculus
aaaatttgggtgactgacatgcagc

SEQ ID NO: 5230 - DNA, 25 bp, Mus musculus
aaaatttgggtgtctgacatgcagc

SEQ ID NO: 5231 - DNA, 25 bp, Mus musculus
aaaatttggtttcgcgcttgtcata

SEQ ID NO: 5232 - DNA, 25 bp, Mus musculus
aaaatttggtttggcgcttgtcata

SEQ ID NO: 5233 - DNA, 25 bp, Mus musculus
aaaattttagcacacagaccaaggg

SEQ ID NO: 5234 - DNA, 25 bp, Mus musculus
aaaattttagcagacagaccaaggg

SEQ ID NO: 5235 - DNA, 25 bp, Mus musculus
aaaattttcaccattgccaccattt

SEQ ID NO: 5236 - DNA, 25 bp, Mus musculus
aaaattttcaccctgcttgcatttg

SEQ ID NO: 5237 - DNA, 25 bp, Mus musculus
aaaattttcaccgtgcttgcatttg

SEQ ID NO: 5238 - DNA, 25 bp, Mus musculus
aaaattttcacctttgccaccattt

SEQ ID NO: 5239 - DNA, 25 bp, Mus musculus
aaaattttcagtatagtacagtaca

SEQ ID NO: 5240 - DNA, 25 bp, Mus musculus
aaaattttcagtttagtacagtaca

SEQ ID NO: 5241 - DNA, 25 bp, Mus musculus
aaaattttcatccttaaataacatg

SEQ ID NO: 5242 - DNA, 25 bp, Mus musculus
aaaattttcatcgttaaataacatg

SEQ ID NO: 5243 - DNA, 25 bp, Mus musculus
aaaattttcattatggtgacctgac

SEQ ID NO: 5244 - DNA, 25 bp, Mus musculus
aaaattttcattttggtgacctgac

SEQ ID NO: 5245 - DNA, 25 bp, Mus musculus
aaaattttcccaccagcatgtccat

SEQ ID NO: 5246 - DNA, 25 bp, Mus musculus
aaaattttcccactccacagacagc

SEQ ID NO: 5247 - DNA, 25 bp, Mus musculus
aaaattttcccagcagcatgtccat

SEQ ID NO: 5248 - DNA, 25 bp, Mus musculus
aaaattttcccagtccacagacagc

SEQ ID NO: 5249 - DNA, 25 bp, Mus musculus
aaaattttgatcatgccatatgcct

SEQ ID NO: 5250 - DNA, 25 bp, Mus musculus
aaaattttgatcttgccatatgcct

SEQ ID NO: 5251 - DNA, 25 bp, Mus musculus
aaaattttggtcctacctgctgtgt

SEQ ID NO: 5252 - DNA, 25 bp, Mus musculus
aaaattttggtcgtacctgctgtgt

SEQ ID NO: 5253 - DNA, 25 bp, Mus musculus
aaacaaaaagggacctatcatgact

SEQ ID NO: 5254 - DNA, 25 bp, Mus musculus
aaacaaaaagggtcctatcatgact

SEQ ID NO: 5255 - DNA, 25 bp, Mus musculus
aaacaaaaagttcatgtgcacaatg

SEQ ID NO: 5256 - DNA, 25 bp, Mus musculus
aaacaaaaagttgatgtgcacaatg

SEQ ID NO: 5257 - DNA, 25 bp, Mus musculus
aaacaaaaatctacacctgccttgg

SEQ ID NO: 5258 - DNA, 25 bp, Mus musculus
aaacaaaaatcttcacctgccttgg

SEQ ID NO: 5259 - DNA, 25 bp, Mus musculus
aaacaaaaatgtagtcacactggaa

SEQ ID NO: 5260 - DNA, 25 bp, Mus musculus
aaacaaaaatgttgtcacactggaa

SEQ ID NO: 5261 - DNA, 25 bp, Mus musculus
aaacaaaacacaacttggccaccac

SEQ ID NO: 5262 - DNA, 25 bp, Mus musculus
aaacaaaacacatcttggccaccac

SEQ ID NO: 5263 - DNA, 25 bp, Mus musculus
aaacaaaactctcttcttggcccag

SEQ ID NO: 5264 - DNA, 25 bp, Mus musculus
aaacaaaactctgttcttggcccag

SEQ ID NO: 5265 - DNA, 25 bp, Mus musculus
aaacaaaagcaacgccagttccagg

SEQ ID NO: 5266 - DNA, 25 bp, Mus musculus
aaacaaaagcaaggccagttccagg

SEQ ID NO: 5267 - DNA, 25 bp, Mus musculus
aaacaaaaggctaccctcgtgtgct

SEQ ID NO: 5268 - DNA, 25 bp, Mus musculus
aaacaaaaggcttccctcgtgtgct

SEQ ID NO: 5269 - DNA, 25 bp, Mus musculus
aaacaaaattgcactagggcagtaa

SEQ ID NO: 5270 - DNA, 25 bp, Mus musculus
aaacaaaattgctctagggcagtaa

SEQ ID NO: 5271 - DNA, 25 bp, Mus musculus
aaacaaacaaccaggcaccggagca

SEQ ID NO: 5272 - DNA, 25 bp, Mus musculus
aaacaaacaacctggcaccggagca

SEQ ID NO: 5273 - DNA, 25 bp, Mus musculus
aaacaaacaagccagcacacaaaaa

SEQ ID NO: 5274 - DNA, 25 bp, Mus musculus
aaacaaacaagcgagcacacaaaaa

SEQ ID NO: 5275 - DNA, 25 bp, Mus musculus
aaacaaacaataaaggtgcagtggg

SEQ ID NO: 5276 - DNA, 25 bp, Mus musculus
aaacaaacaatataggtgcagtggg

SEQ ID NO: 5277 - DNA, 25 bp, Mus musculus
aaacaaaccaagagagcgttcctct

SEQ ID NO: 5278 - DNA, 25 bp, Mus musculus
aaacaaaccaagtgagcgttcctct

SEQ ID NO: 5279 - DNA, 25 bp, Mus musculus
aaacaaaccatgatcctttcctgac

SEQ ID NO: 5280 - DNA, 25 bp, Mus musculus
aaacaaaccatgttcctttcctgac

SEQ ID NO: 5281 - DNA, 25 bp, Mus musculus
aaacaaacccagagcatactcctct

SEQ ID NO: 5282 - DNA, 25 bp, Mus musculus
aaacaaacccagtgcatactcctct

SEQ ID NO: 5283 - DNA, 25 bp, Mus musculus
aaacaaacccataaccatgtccatt

SEQ ID NO: 5284 - DNA, 25 bp, Mus musculus
aaacaaacccattaccatgtccatt

SEQ ID NO: 5285 - DNA, 25 bp, Mus musculus
aaacaaaccgcgcatggctttgaat

SEQ ID NO: 5286 - DNA, 25 bp, Mus musculus
aaacaaaccgcggatggctttgaat

SEQ ID NO: 5287 - DNA, 25 bp, Mus musculus
aaacaaactccaagctttctgacag

SEQ ID NO: 5288 - DNA, 25 bp, Mus musculus
aaacaaactccatgctttctgacag

SEQ ID NO: 5289 - DNA, 25 bp, Mus musculus
aaacaaactgtgaagtggccttcat

SEQ ID NO: 5290 - DNA, 25 bp, Mus musculus
aaacaaactgtgtagtggccttcat

SEQ ID NO: 5291 - DNA, 25 bp, Mus musculus
aaacaaactgttcggctactggaca

SEQ ID NO: 5292 - DNA, 25 bp, Mus musculus
aaacaaactgttgggctactggaca

SEQ ID NO: 5293 - DNA, 25 bp, Mus musculus
aaacaaacttatacctctatgccac

SEQ ID NO: 5294 - DNA, 25 bp, Mus musculus
aaacaaacttattcctctatgccac

SEQ ID NO: 5295 - DNA, 25 bp, Mus musculus
aaacaaacttctagctttagccagg

SEQ ID NO: 5296 - DNA, 25 bp, Mus musculus
aaacaaacttcttgctttagccagg

SEQ ID NO: 5297 - DNA, 25 bp, Mus musculus
aaacaaacttgtcccacagctccaa

SEQ ID NO: 5298 - DNA, 25 bp, Mus musculus
aaacaaacttgtgccacagctccaa

SEQ ID NO: 5299 - DNA, 25 bp, Mus musculus
aaacaaagactgctgtcccttctct

SEQ ID NO: 5300 - DNA, 25 bp, Mus musculus
aaacaaagactggtgtcccttctct

SEQ ID NO: 5301 - DNA, 25 bp, Mus musculus
aaacaaagagagagagccacattta

SEQ ID NO: 5302 - DNA, 25 bp, Mus musculus
aaacaaagagagtgagccacattta

SEQ ID NO: 5303 - DNA, 25 bp, Mus musculus
aaacaaagccgtacatctccacaga

SEQ ID NO: 5304 - DNA, 25 bp, Mus musculus
aaacaaagccgttcatctccacaga

SEQ ID NO: 5305 - DNA, 25 bp, Mus musculus
aaacaaagctggagtagaggcccgg

SEQ ID NO: 5306 - DNA, 25 bp, Mus musculus
aaacaaagctggtgtagaggcccgg

SEQ ID NO: 5307 - DNA, 25 bp, Mus musculus
aaacaaagggttccagcctctgcat

SEQ ID NO: 5308 - DNA, 25 bp, Mus musculus
aaacaaagggttgcagcctctgcat

SEQ ID NO: 5309 - DNA, 25 bp, Mus musculus
aaacaaaggtcgatgctggcccaga

SEQ ID NO: 5310 - DNA, 25 bp, Mus musculus
aaacaaaggtcgttgctggcccaga

SEQ ID NO: 5311 - DNA, 25 bp, Mus musculus
aaacaaagtaagaggctcggcagaa

SEQ ID NO: 5312 - DNA, 25 bp, Mus musculus
aaacaaagtaagtggctcggcagaa

SEQ ID NO: 5313 - DNA, 25 bp, Mus musculus
aaacaaagtcaacactcttgcggaa

SEQ ID NO: 5314 - DNA, 25 bp, Mus musculus
aaacaaagtcaagactcttgcggaa

SEQ ID NO: 5315 - DNA, 25 bp, Mus musculus
aaacaaagtcttaccaacgtctgct

SEQ ID NO: 5316 - DNA, 25 bp, Mus musculus
aaacaaagtctttccaacgtctgct

SEQ ID NO: 5317 - DNA, 25 bp, Mus musculus
aaacaaataagccatctcgcctgcc

SEQ ID NO: 5318 - DNA, 25 bp, Mus musculus
aaacaaataagcgatctcgcctgcc

SEQ ID NO: 5319 - DNA, 25 bp, Mus musculus
aaacaaatcttgatgctgatttgtc

SEQ ID NO: 5320 - DNA, 25 bp, Mus musculus
aaacaaatcttgttgctgatttgtc

SEQ ID NO: 5321 - DNA, 25 bp, Mus musculus
aaacaaatgatgaggctggtcctaa

SEQ ID NO: 5322 - DNA, 25 bp, Mus musculus
aaacaaatgatgtggctggtcctaa

SEQ ID NO: 5323 - DNA, 25 bp, Mus musculus
aaacaaattgctaatccttcagagt

SEQ ID NO: 5324 - DNA, 25 bp, Mus musculus
aaacaaattgcttatccttcagagt

SEQ ID NO: 5325 - DNA, 25 bp, Mus musculus
aaacaacaaagcacaggatactggt

SEQ ID NO: 5326 - DNA, 25 bp, Mus musculus
aaacaacaaagctcaggatactggt

SEQ ID NO: 5327 - DNA, 25 bp, Mus musculus
aaacaacaaccaatctagccagtag

SEQ ID NO: 5328 - DNA, 25 bp, Mus musculus
aaacaacaaccattctagccagtag

SEQ ID NO: 5329 - DNA, 25 bp, Mus musculus
aaacaacacattaagaccttacatt

SEQ ID NO: 5330 - DNA, 25 bp, Mus musculus
aaacaacacatttagaccttacatt

SEQ ID NO: 5331 - DNA, 25 bp, Mus musculus
aaacaacacctgagccacccaggag

SEQ ID NO: 5332 - DNA, 25 bp, Mus musculus
aaacaacacctgtgccacccaggag

SEQ ID NO: 5333 - DNA, 25 bp, Mus musculus
aaacaacacgttctcaaggatataa

SEQ ID NO: 5334 - DNA, 25 bp, Mus musculus
aaacaacacgttgtcaaggatataa

SEQ ID NO: 5335 - DNA, 25 bp, Mus musculus
aaacaacactacaggcattcataga

SEQ ID NO: 5336 - DNA, 25 bp, Mus musculus
aaacaacactactggcattcataga

SEQ ID NO: 5337 - DNA, 25 bp, Mus musculus
aaacaacactgtcttcctgtttctt

SEQ ID NO: 5338 - DNA, 25 bp, Mus musculus
aaacaacactgtgttcctgtttctt

SEQ ID NO: 5339 - DNA, 25 bp, Mus musculus
aaacaacagacgctgtcacctggat

SEQ ID NO: 5340 - DNA, 25 bp, Mus musculus
aaacaacagacggtgtcacctggat

SEQ ID NO: 5341 - DNA, 25 bp, Mus musculus
aaacaacagcaaacccactccttat

SEQ ID NO: 5342 - DNA, 25 bp, Mus musculus
aaacaacagcaatcccactccttat

SEQ ID NO: 5343 - DNA, 25 bp, Mus musculus
aaacaacagctgcataggtggccct

SEQ ID NO: 5344 - DNA, 25 bp, Mus musculus
aaacaacagctggataggtggccct

SEQ ID NO: 5345 - DNA, 25 bp, Mus musculus
aaacaacagcttcggtatgtgatgg

SEQ ID NO: 5346 - DNA, 25 bp, Mus musculus
aaacaacagcttgggtatgtgatgg

SEQ ID NO: 5347 - DNA, 25 bp, Mus musculus
aaacaacagggccttcaggtggcac

SEQ ID NO: 5348 - DNA, 25 bp, Mus musculus
aaacaacagggcgttcaggtggcac

SEQ ID NO: 5349 - DNA, 25 bp, Mus musculus
aaacaacagggtcatggatggatac

SEQ ID NO: 5350 - DNA, 25 bp, Mus musculus
aaacaacagggtgatggatggatac

SEQ ID NO: 5351 - DNA, 25 bp, Mus musculus
aaacaacagtttaaccagcctctgc

SEQ ID NO: 5352 - DNA, 25 bp, Mus musculus
aaacaacagttttaccagcctctgc

SEQ ID NO: 5353 - DNA, 25 bp, Mus musculus
aaacaacatgaccttggcttctcag

SEQ ID NO: 5354 - DNA, 25 bp, Mus musculus
aaacaacatgacgttggcttctcag

SEQ ID NO: 5355 - DNA, 25 bp, Mus musculus
aaacaaccaaagaaatctctcattg

SEQ ID NO: 5356 - DNA, 25 bp, Mus musculus
aaacaaccaaagtaatctctcattg

SEQ ID NO: 5357 - DNA, 25 bp, Mus musculus
aaacaaccatgtctcttccagctgt

SEQ ID NO: 5358 - DNA, 25 bp, Mus musculus
aaacaaccatgtgtcttccagctgt

SEQ ID NO: 5359 - DNA, 25 bp, Mus musculus
aaacaacccacccagggtgcagata

SEQ ID NO: 5360 - DNA, 25 bp, Mus musculus
aaacaacccaccgagggtgcagata

SEQ ID NO: 5361 - DNA, 25 bp, Mus musculus
aaacaacccagacgccatccgtagg

SEQ ID NO: 5362 - DNA, 25 bp, Mus musculus
aaacaacccagaggccatccgtagg

SEQ ID NO: 5363 - DNA, 25 bp, Mus musculus
aaacaacccgatctgaaggcctcaa

SEQ ID NO: 5364 - DNA, 25 bp, Mus musculus
aaacaacccgatgtgaaggcctcaa

SEQ ID NO: 5365 - DNA, 25 bp, Mus musculus
aaacaaccctgacaagaactgaggt

SEQ ID NO: 5366 - DNA, 25 bp, Mus musculus
aaacaaccctgagaagaactgaggt

SEQ ID NO: 5367 - DNA, 25 bp, Mus musculus
aaacaaccgcagaggtgctggcagc

SEQ ID NO: 5368 - DNA, 25 bp, Mus musculus
aaacaaccgcagtggtgctggcagc

SEQ ID NO: 5369 - DNA, 25 bp, Mus musculus
aaacaaccggcaactagcttctggg

SEQ ID NO: 5370 - DNA, 25 bp, Mus musculus
aaacaaccggcatctagcttctggg

SEQ ID NO: 5371 - DNA, 25 bp, Mus musculus
aaacaacctccacaatgacaatgat

SEQ ID NO: 5372 - DNA, 25 bp, Mus musculus
aaacaacctccagaatgacaatgat

SEQ ID NO: 5373 - DNA, 25 bp, Mus musculus
aaacaacctgcccaggaggcgggct

SEQ ID NO: 5374 - DNA, 25 bp, Mus musculus
aaacaacctgccgaggaggcgggct

SEQ ID NO: 5375 - DNA, 25 bp, Mus musculus
aaacaacctgtcacaggaaggaggt

SEQ ID NO: 5376 - DNA, 25 bp, Mus musculus
aaacaacctgtctcaggaaggaggt

SEQ ID NO: 5377 - DNA, 25 bp, Mus musculus
aaacaacgacttcagacccagaggg

SEQ ID NO: 5378 - DNA, 25 bp, Mus musculus
aaacaacgacttgagacccagaggg

SEQ ID NO: 5379 - DNA, 25 bp, Mus musculus
aaacaacgctatatccacttggctt

SEQ ID NO: 5380 - DNA, 25 bp, Mus musculus
aaacaacgctatttccacttggctt

SEQ ID NO: 5381 - DNA, 25 bp, Mus musculus
aaacaacgctttctgtgcactacat

SEQ ID NO: 5382 - DNA, 25 bp, Mus musculus
aaacaacgctttgtgtgcactacat

SEQ ID NO: 5383 - DNA, 25 bp, Mus musculus
aaacaacggccacgtgttcatccct

SEQ ID NO: 5384 - DNA, 25 bp, Mus musculus
aaacaacggccaggtgttcatccct

SEQ ID NO: 5385 - DNA, 25 bp, Mus musculus
aaacaacgtgcccagccagctagtc

SEQ ID NO: 5386 - DNA, 25 bp, Mus musculus
aaacaacgtgccgagccagctagtc

SEQ ID NO: 5387 - DNA, 25 bp, Mus musculus
aaacaactaagacagctggcccgca

SEQ ID NO: 5388 - DNA, 25 bp, Mus musculus
aaacaactaagagagctggcccgca

SEQ ID NO: 5389 - DNA, 25 bp, Mus musculus
aaacaactcatcagcacctgcggac

SEQ ID NO: 5390 - DNA, 25 bp, Mus musculus
aaacaactcatctgcacctgcggac

SEQ ID NO: 5391 - DNA, 25 bp, Mus musculus
aaacaactccagctagttaccttag

SEQ ID NO: 5392 - DNA, 25 bp, Mus musculus
aaacaactccaggtagttaccttag

SEQ ID NO: 5393 - DNA, 25 bp, Mus musculus
aaacaactccatagccatttcataa

SEQ ID NO: 5394 - DNA, 25 bp, Mus musculus
aaacaactccattgccatttcataa

SEQ ID NO: 5395 - DNA, 25 bp, Mus musculus
aaacaactcggaatacacagactat

SEQ ID NO: 5396 - DNA, 25 bp, Mus musculus
aaacaactcggattacacagactat

SEQ ID NO: 5397 - DNA, 25 bp, Mus musculus
aaacaactctacaaacgcgacgacg

SEQ ID NO: 5398 - DNA, 25 bp, Mus musculus
aaacaactctactaacgcgacgacg

SEQ ID NO: 5399 - DNA, 25 bp, Mus musculus
aaacaactctctacatgggcctaga

SEQ ID NO: 5400 - DNA, 25 bp, Mus musculus
aaacaactctcttcatgggcctaga

SEQ ID NO: 5401 - DNA, 25 bp, Mus musculus
aaacaactctgcagctggtgcccat

SEQ ID NO: 5402 - DNA, 25 bp, Mus musculus
aaacaactctgctgctggtgcccat

SEQ ID NO: 5403 - DNA, 25 bp, Mus musculus
aaacaactgagcaaatccacacaag

SEQ ID NO: 5404 - DNA, 25 bp, Mus musculus
aaacaactgagctaatccacacaag

SEQ ID NO: 5405 - DNA, 25 bp, Mus musculus
aaacaactgcaaagtgcctctacag

SEQ ID NO: 5406 - DNA, 25 bp, Mus musculus
aaacaactgcaatgtgcctctacag

SEQ ID NO: 5407 - DNA, 25 bp, Mus musculus
aaacaactgcacagggagtcgcaat

SEQ ID NO: 5408 - DNA, 25 bp, Mus musculus
aaacaactgcactgggagtcgcaat

SEQ ID NO: 5409 - DNA, 25 bp, Mus musculus
aaacaactgctaagcccttttcatc

SEQ ID NO: 5410 - DNA, 25 bp, Mus musculus
aaacaactgctatgcccttttcatc

SEQ ID NO: 5411 - DNA, 25 bp, Mus musculus
aaacaactgcttatgactttggaga

SEQ ID NO: 5412 - DNA, 25 bp, Mus musculus
aaacaactgcttttgactttggaga

SEQ ID NO: 5413 - DNA, 25 bp, Mus musculus
aaacaactggcacatagcttcctct

SEQ ID NO: 5414 - DNA, 25 bp, Mus musculus
aaacaactggcagatagcttcctct

SEQ ID NO: 5415 - DNA, 25 bp, Mus musculus
aaacaactgggtcactgggctgtct

SEQ ID NO: 5416 - DNA, 25 bp, Mus musculus
aaacaactgggtgactgggctgtct

SEQ ID NO: 5417 - DNA, 25 bp, Mus musculus
aaacaactgtacagaggagatgctc

SEQ ID NO: 5418 - DNA, 25 bp, Mus musculus
aaacaactgtactgaggagatgctc

SEQ ID NO: 5419 - DNA, 25 bp, Mus musculus
aaacaactgtatccctatgatttca

SEQ ID NO: 5420 - DNA, 25 bp, Mus musculus
aaacaactgtatgcctatgatttca

SEQ ID NO: 5421 - DNA, 25 bp, Mus musculus
aaacaactgtcaagggagtggactt

SEQ ID NO: 5422 - DNA, 25 bp, Mus musculus
aaacaactgtcatgggagtggactt

SEQ ID NO: 5423 - DNA, 25 bp, Mus musculus
aaacaactgtgtctcggtgcttact

SEQ ID NO: 5424 - DNA, 25 bp, Mus musculus
aaacaactgtgtgtcggtgcttact

SEQ ID NO: 5425 - DNA, 25 bp, Mus musculus
aaacaacttatcagtgctcgccatt

SEQ ID NO: 5426 - DNA, 25 bp, Mus musculus
aaacaacttatccaaagccactcac

SEQ ID NO: 5427 - DNA, 25 bp, Mus musculus
aaacaacttatcgaaagccactcac

SEQ ID NO: 5428 - DNA, 25 bp, Mus musculus
aaacaacttatctgtgctcgccatt

SEQ ID NO: 5429 - DNA, 25 bp, Mus musculus
aaacaacttcgacgagcaacccgcg

SEQ ID NO: 5430 - DNA, 25 bp, Mus musculus
aaacaacttcgaggagcaacccgcg

SEQ ID NO: 5431 - DNA, 25 bp, Mus musculus
aaacaacttgcaacatgttctcctc

SEQ ID NO: 5432 - DNA, 25 bp, Mus musculus
aaacaacttgcatcatgttctcctc

SEQ ID NO: 5433 - DNA, 25 bp, Mus musculus
aaacaacttgccagaagcctgagac

SEQ ID NO: 5434 - DNA, 25 bp, Mus musculus
aaacaacttgcctgaagcctgagac

SEQ ID NO: 5435 - DNA, 25 bp, Mus musculus
aaacaacttgctataaatcattctg

SEQ ID NO: 5436 - DNA, 25 bp, Mus musculus
aaacaacttgctttaaatcattctg

SEQ ID NO: 5437 - DNA, 25 bp, Mus musculus
aaacaactttcccagcggtagtgag

SEQ ID NO: 5438 - DNA, 25 bp, Mus musculus
aaacaactttccgagcggtagtgag

SEQ ID NO: 5439 - DNA, 25 bp, Mus musculus
aaacaagaactacggccagcaagtg

SEQ ID NO: 5440 - DNA, 25 bp, Mus musculus
aaacaagaactagggccagcaagtg

SEQ ID NO: 5441 - DNA, 25 bp, Mus musculus
aaacaagaatacaccatgcaagcga

SEQ ID NO: 5442 - DNA, 25 bp, Mus musculus
aaacaagaatactccatgcaagcga

SEQ ID NO: 5443 - DNA, 25 bp, Mus musculus
aaacaagacaatcagggcatggctt

SEQ ID NO: 5444 - DNA, 25 bp, Mus musculus
aaacaagacaatgagggcatggctt

SEQ ID NO: 5445 - DNA, 25 bp, Mus musculus
aaacaagacagcagccactaggtac

SEQ ID NO: 5446 - DNA, 25 bp, Mus musculus
aaacaagacagctgccactaggtac

SEQ ID NO: 5447 - DNA, 25 bp, Mus musculus
aaacaagacattacatcggcaactg

SEQ ID NO: 5448 - DNA, 25 bp, Mus musculus
aaacaagacatttcatcggcaactg

SEQ ID NO: 5449 - DNA, 25 bp, Mus musculus
aaacaagagccacccattctgtgaa

SEQ ID NO: 5450 - DNA, 25 bp, Mus musculus
aaacaagagccagccattctgtgaa

SEQ ID NO: 5451 - DNA, 25 bp, Mus musculus
aaacaagagccgcatggacaccccg

SEQ ID NO: 5452 - DNA, 25 bp, Mus musculus
aaacaagagccggatggacaccccg

SEQ ID NO: 5453 - DNA, 25 bp, Mus musculus
aaacaagaggacaccttccgctagg

SEQ ID NO: 5454 - DNA, 25 bp, Mus musculus
aaacaagaggactccttccgctagg

SEQ ID NO: 5455 - DNA, 25 bp, Mus musculus
aaacaagagtctactccacacggga

SEQ ID NO: 5456 - DNA, 25 bp, Mus musculus
aaacaagagtcttctccacacggga

SEQ ID NO: 5457 - DNA, 25 bp, Mus musculus
aaacaagagtgtcctggcaccccaa

SEQ ID NO: 5458 - DNA, 25 bp, Mus musculus
aaacaagagtgtgctggcaccccaa

SEQ ID NO: 5459 - DNA, 25 bp, Mus musculus
aaacaagatgggatgggcctgctga

SEQ ID NO: 5460 - DNA, 25 bp, Mus musculus
aaacaagatgggttgggcctgctga

SEQ ID NO: 5461 - DNA, 25 bp, Mus musculus
aaacaagcaagtacggcctggctga

SEQ ID NO: 5462 - DNA, 25 bp, Mus musculus
aaacaagcaagttcggcctggctga

SEQ ID NO: 5463 - DNA, 25 bp, Mus musculus
aaacaagcacgcagaacctctctgt

SEQ ID NO: 5464 - DNA, 25 bp, Mus musculus
aaacaagcacgctgaacctctctgt

SEQ ID NO: 5465 - DNA, 25 bp, Mus musculus
aaacaagcagctacttgagggagtt

SEQ ID NO: 5466 - DNA, 25 bp, Mus musculus
aaacaagcagcttcttgagggagtt

SEQ ID NO: 5467 - DNA, 25 bp, Mus musculus
aaacaagcataaagttctttgcctc

SEQ ID NO: 5468 - DNA, 25 bp, Mus musculus
aaacaagcataatgttctttgcctc

SEQ ID NO: 5469 - DNA, 25 bp, Mus musculus
aaacaagcatgtagaccccaaaaag

SEQ ID NO: 5470 - DNA, 25 bp, Mus musculus
aaacaagcatgttgaccccaaaaag

SEQ ID NO: 5471 - DNA, 25 bp, Mus musculus
aaacaagccattccagtcatgatga

SEQ ID NO: 5472 - DNA, 25 bp, Mus musculus
aaacaagccattgcagtcatgatga

SEQ ID NO: 5473 - DNA, 25 bp, Mus musculus
aaacaagcccacacagaggctttaa

SEQ ID NO: 5474 - DNA, 25 bp, Mus musculus
aaacaagcccactcagaggctttaa

SEQ ID NO: 5475 - DNA, 25 bp, Mus musculus
aaacaagcccctctggaaactcagg

SEQ ID NO: 5476 - DNA, 25 bp, Mus musculus
aaacaagcccctgtggaaactcagg

SEQ ID NO: 5477 - DNA, 25 bp, Mus musculus
aaacaagcccttagtggtactcagc

SEQ ID NO: 5478 - DNA, 25 bp, Mus musculus
aaacaagccctttgtggtactcagc

SEQ ID NO: 5479 - DNA, 25 bp, Mus musculus
aaacaagcctgtctatgacagcagg

SEQ ID NO: 5480 - DNA, 25 bp, Mus musculus
aaacaagcctgtgtatgacagcagg

SEQ ID NO: 5481 - DNA, 25 bp, Mus musculus
aaacaagcgtgtccagctgcttggg

SEQ ID NO: 5482 - DNA, 25 bp, Mus musculus
aaacaagcgtgtgcagctgcttggg

SEQ ID NO: 5483 - DNA, 25 bp, Mus musculus
aaacaagctaatctgtctgccccta

SEQ ID NO: 5484 - DNA, 25 bp, Mus musculus
aaacaagctaatgtgtctgccccta

SEQ ID NO: 5485 - DNA, 25 bp, Mus musculus
aaacaagctacaacgctggttctgt

SEQ ID NO: 5486 - DNA, 25 bp, Mus musculus
aaacaagctacatcgctggttctgt

SEQ ID NO: 5487 - DNA, 25 bp, Mus musculus
aaacaagctcatcagtgccctgaac

SEQ ID NO: 5488 - DNA, 25 bp, Mus musculus
aaacaagctcatcgtatacaatgaa

SEQ ID NO: 5489 - DNA, 25 bp, Mus musculus
aaacaagctcatgagtgccctgaac

SEQ ID NO: 5490 - DNA, 25 bp, Mus musculus
aaacaagctcatggtatacaatgaa

SEQ ID NO: 5491 - DNA, 25 bp, Mus musculus
aaacaagctcctattgcagacgaag

SEQ ID NO: 5492 - DNA, 25 bp, Mus musculus
aaacaagctccttttgcagacgaag

SEQ ID NO: 5493 - DNA, 25 bp, Mus musculus
aaacaagctgttatgtactgggcgt

SEQ ID NO: 5494 - DNA, 25 bp, Mus musculus
aaacaagctgttttgtactgggcgt

SEQ ID NO: 5495 - DNA, 25 bp, Mus musculus
aaacaaggactgcatccaaattcca

SEQ ID NO: 5496 - DNA, 25 bp, Mus musculus
aaacaaggactggatccaaattcca

SEQ ID NO: 5497 - DNA, 25 bp, Mus musculus
aaacaaggacttcgctcagtatttg

SEQ ID NO: 5498 - DNA, 25 bp, Mus musculus
aaacaaggacttggctcagtatttg

SEQ ID NO: 5499 - DNA, 25 bp, Mus musculus
aaacaaggaggtcgacaatggcagt

SEQ ID NO: 5500 - DNA, 25 bp, Mus musculus
aaacaaggaggtggacaatggcagt

SEQ ID NO: 5501 - DNA, 25 bp, Mus musculus
aaacaaggcactccccaaaaagctg

SEQ ID NO: 5502 - DNA, 25 bp, Mus musculus
aaacaaggcactgcccaaaaagctg

SEQ ID NO: 5503 - DNA, 25 bp, Mus musculus
aaacaagggtggctacctctgccac

SEQ ID NO: 5504 - DNA, 25 bp, Mus musculus
aaacaagggtgggtacctctgccac

SEQ ID NO: 5505 - DNA, 25 bp, Mus musculus
aaacaaggtgacattctgctacaat

SEQ ID NO: 5506 - DNA, 25 bp, Mus musculus
aaacaaggtgactttctgctacaat

SEQ ID NO: 5507 - DNA, 25 bp, Mus musculus
aaacaagtacttcatcagatgtgga

SEQ ID NO: 5508 - DNA, 25 bp, Mus musculus
aaacaagtacttgatcagatgtgga

SEQ ID NO: 5509 - DNA, 25 bp, Mus musculus
aaacaagtcaatcccctacatggtg

SEQ ID NO: 5510 - DNA, 25 bp, Mus musculus
aaacaagtcaatgccctacatggtg

SEQ ID NO: 5511 - DNA, 25 bp, Mus musculus
aaacaagtctacattccctcagcat

SEQ ID NO: 5512 - DNA, 25 bp, Mus musculus
aaacaagtctactttccctcagcat

SEQ ID NO: 5513 - DNA, 25 bp, Mus musculus
aaacaagtctggctgcagtcaggat

SEQ ID NO: 5514 - DNA, 25 bp, Mus musculus
aaacaagtctgggtgcagtcaggat

SEQ ID NO: 5515 - DNA, 25 bp, Mus musculus
aaacaagtcttcagtgctctccctg

SEQ ID NO: 5516 - DNA, 25 bp, Mus musculus
aaacaagtcttctgtgctctccctg

SEQ ID NO: 5517 - DNA, 25 bp, Mus musculus
aaacaagtgcttcactatggataga

SEQ ID NO: 5518 - DNA, 25 bp, Mus musculus
aaacaagtgcttgactatggataga

SEQ ID NO: 5519 - DNA, 25 bp, Mus musculus
aaacaagtgtttacgaggtgagcaa

SEQ ID NO: 5520 - DNA, 25 bp, Mus musculus
aaacaagtgtttatccgggttgcat

SEQ ID NO: 5521 - DNA, 25 bp, Mus musculus
aaacaagtgttttcgaggtgagcaa

SEQ ID NO: 5522 - DNA, 25 bp, Mus musculus
aaacaagtgtttttccgggttgcat

SEQ ID NO: 5523 - DNA, 25 bp, Mus musculus
aaacaagttcatacactgaacctga

SEQ ID NO: 5524 - DNA, 25 bp, Mus musculus
aaacaagttcattcactgaacctga

SEQ ID NO: 5525 - DNA, 25 bp, Mus musculus
aaacaagttgtgaccctggcctagc

SEQ ID NO: 5526 - DNA, 25 bp, Mus musculus
aaacaagttgtgtccctggcctagc

SEQ ID NO: 5527 - DNA, 25 bp, Mus musculus
aaacaagttttcagaggctacccag

SEQ ID NO: 5528 - DNA, 25 bp, Mus musculus
aaacaagttttctgaggctacccag

SEQ ID NO: 5529 - DNA, 25 bp, Mus musculus
aaacaataacttaagccgcctggcg

SEQ ID NO: 5530 - DNA, 25 bp, Mus musculus
aaacaataactttagccgcctggcg

SEQ ID NO: 5531 - DNA, 25 bp, Mus musculus
aaacaataatcgctcacttacccag

SEQ ID NO: 5532 - DNA, 25 bp, Mus musculus
aaacaataatcggtcacttacccag

SEQ ID NO: 5533 - DNA, 25 bp, Mus musculus
aaacaatacaacatacccaagctgt

SEQ ID NO: 5534 - DNA, 25 bp, Mus musculus
aaacaatacaacttacccaagctgt

SEQ ID NO: 5535 - DNA, 25 bp, Mus musculus
aaacaataccccagtgtaatcccat

SEQ ID NO: 5536 - DNA, 25 bp, Mus musculus
aaacaatacccctgtgtaatcccat

SEQ ID NO: 5537 - DNA, 25 bp, Mus musculus
aaacaatacctacgacccaggctct

SEQ ID NO: 5538 - DNA, 25 bp, Mus musculus
aaacaatacctaggacccaggctct

SEQ ID NO: 5539 - DNA, 25 bp, Mus musculus
aaacaatactgacaacataccactg

SEQ ID NO: 5540 - DNA, 25 bp, Mus musculus
aaacaatactgagaacataccactg

SEQ ID NO: 5541 - DNA, 25 bp, Mus musculus
aaacaataggctacctgtgcgctat

SEQ ID NO: 5542 - DNA, 25 bp, Mus musculus
aaacaataggcttcctgtgcgctat

SEQ ID NO: 5543 - DNA, 25 bp, Mus musculus
aaacaatagtccactgctggttctg

SEQ ID NO: 5544 - DNA, 25 bp, Mus musculus
aaacaatagtcctctgctggttctg

SEQ ID NO: 5545 - DNA, 25 bp, Mus musculus
aaacaatatcagacattccaggcct

SEQ ID NO: 5546 - DNA, 25 bp, Mus musculus
aaacaatatcagtcattccaggcct

SEQ ID NO: 5547 - DNA, 25 bp, Mus musculus
aaacaatatctcactaacagtatct

SEQ ID NO: 5548 - DNA, 25 bp, Mus musculus
aaacaatatctctctaacagtatct

SEQ ID NO: 5549 - DNA, 25 bp, Mus musculus
aaacaatatttcagctgtgtaaatt

SEQ ID NO: 5550 - DNA, 25 bp, Mus musculus
aaacaatatttctgctgtgtaaatt

SEQ ID NO: 5551 - DNA, 25 bp, Mus musculus
aaacaatcaagactcggcccacgag

SEQ ID NO: 5552 - DNA, 25 bp, Mus musculus
aaacaatcaagagtcggcccacgag

SEQ ID NO: 5553 - DNA, 25 bp, Mus musculus
aaacaatcactcctcttcacaaagc

SEQ ID NO: 5554 - DNA, 25 bp, Mus musculus
aaacaatcactcgtcttcacaaagc

SEQ ID NO: 5555 - DNA, 25 bp, Mus musculus
aaacaatcagtgacccgtggcagca

SEQ ID NO: 5556 - DNA, 25 bp, Mus musculus
aaacaatcagtgtcccgtggcagca

SEQ ID NO: 5557 - DNA, 25 bp, Mus musculus
aaacaatcatttagcattcctgcaa

SEQ ID NO: 5558 - DNA, 25 bp, Mus musculus
aaacaatcattttgcattcctgcaa

SEQ ID NO: 5559 - DNA, 25 bp, Mus musculus
aaacaatcccctagaagcatgagct

SEQ ID NO: 5560 - DNA, 25 bp, Mus musculus
aaacaatccccttgaagcatgagct

SEQ ID NO: 5561 - DNA, 25 bp, Mus musculus
aaacaatcctaaacccagctgggcg

SEQ ID NO: 5562 - DNA, 25 bp, Mus musculus
aaacaatcctaatcccagctgggcg

SEQ ID NO: 5563 - DNA, 25 bp, Mus musculus
aaacaatctaccacgagtgctcttc

SEQ ID NO: 5564 - DNA, 25 bp, Mus musculus
aaacaatctacctcgagtgctcttc

SEQ ID NO: 5565 - DNA, 25 bp, Mus musculus
aaacaatctactagtgtcctcttag

SEQ ID NO: 5566 - DNA, 25 bp, Mus musculus
aaacaatctacttgtgtcctcttag

SEQ ID NO: 5567 - DNA, 25 bp, Mus musculus
aaacaatctaggactccaggagcta

SEQ ID NO: 5568 - DNA, 25 bp, Mus musculus
aaacaatctaggtctccaggagcta

SEQ ID NO: 5569 - DNA, 25 bp, Mus musculus
aaacaatctataaaggtcatgtcct

SEQ ID NO: 5570 - DNA, 25 bp, Mus musculus
aaacaatctatataggtcatgtcct

SEQ ID NO: 5571 - DNA, 25 bp, Mus musculus
aaacaatcttggaaaggctgagatc

SEQ ID NO: 5572 - DNA, 25 bp, Mus musculus
aaacaatcttggtaaggctgagatc

SEQ ID NO: 5573 - DNA, 25 bp, Mus musculus
aaacaatgatacacatattggtttg

SEQ ID NO: 5574 - DNA, 25 bp, Mus musculus
aaacaatgatactcatattggtttg

SEQ ID NO: 5575 - DNA, 25 bp, Mus musculus
aaacaatgatgaatgggcgctgaca

SEQ ID NO: 5576 - DNA, 25 bp, Mus musculus
aaacaatgatgattgggcgctgaca

SEQ ID NO: 5577 - DNA, 25 bp, Mus musculus
aaacaatgatgtccccaagggaggt

SEQ ID NO: 5578 - DNA, 25 bp, Mus musculus
aaacaatgatgtgcccaagggaggt

SEQ ID NO: 5579 - DNA, 25 bp, Mus musculus
aaacaatgcaaaatggagaccttcc

SEQ ID NO: 5580 - DNA, 25 bp, Mus musculus
aaacaatgcaaattggagaccttcc

SEQ ID NO: 5581 - DNA, 25 bp, Mus musculus
aaacaatgcaatagtctgtttcctg

SEQ ID NO: 5582 - DNA, 25 bp, Mus musculus
aaacaatgcaattgtctgtttcctg

SEQ ID NO: 5583 - DNA, 25 bp, Mus musculus
aaacaatgcctaagtgtttcctggg

SEQ ID NO: 5584 - DNA, 25 bp, Mus musculus
aaacaatgcctatgtgtttcctggg

SEQ ID NO: 5585 - DNA, 25 bp, Mus musculus
aaacaatgctgtacttatcctccga

SEQ ID NO: 5586 - DNA, 25 bp, Mus musculus
aaacaatgctgttcttatcctccga

SEQ ID NO: 5587 - DNA, 25 bp, Mus musculus
aaacaatgcttccttctctctgcga

SEQ ID NO: 5588 - DNA, 25 bp, Mus musculus
aaacaatgcttcgttctctctgcga

SEQ ID NO: 5589 - DNA, 25 bp, Mus musculus
aaacaatggctgacaaacatcaatt

SEQ ID NO: 5590 - DNA, 25 bp, Mus musculus
aaacaatggctgtcaaacatcaatt

SEQ ID NO: 5591 - DNA, 25 bp, Mus musculus
aaacaatgggctcttctgtgtggac

SEQ ID NO: 5592 - DNA, 25 bp, Mus musculus
aaacaatgggctgttctgtgtggac

SEQ ID NO: 5593 - DNA, 25 bp, Mus musculus
aaacaattatccagggctgtgtaac

SEQ ID NO: 5594 - DNA, 25 bp, Mus musculus
aaacaattatcctgggctgtgtaac

SEQ ID NO: 5595 - DNA, 25 bp, Mus musculus
aaacaattcctactgctgtcccttt

SEQ ID NO: 5596 - DNA, 25 bp, Mus musculus
aaacaattcctagtgctgtcccttt

SEQ ID NO: 5597 - DNA, 25 bp, Mus musculus
aaacaattcctcatcgactgggtca

SEQ ID NO: 5598 - DNA, 25 bp, Mus musculus
aaacaattcctcttcgactgggtca

SEQ ID NO: 5599 - DNA, 25 bp, Mus musculus
aaacaattgctgctgctcggttgca

SEQ ID NO: 5600 - DNA, 25 bp, Mus musculus
aaacaattgctggtgctcggttgca

SEQ ID NO: 5601 - DNA, 25 bp, Mus musculus
aaacaattgggcaggcttctatcct

SEQ ID NO: 5602 - DNA, 25 bp, Mus musculus
aaacaattgggctggcttctatcct

SEQ ID NO: 5603 - DNA, 25 bp, Mus musculus
aaacaattgtgtatcctgatttgaa

SEQ ID NO: 5604 - DNA, 25 bp, Mus musculus
aaacaattgtgtttcctgatttgaa

SEQ ID NO: 5605 - DNA, 25 bp, Mus musculus
aaacaatttgtcatccctggaagaa

SEQ ID NO: 5606 - DNA, 25 bp, Mus musculus
aaacaatttgtcctcctactgctga

SEQ ID NO: 5607 - DNA, 25 bp, Mus musculus
aaacaatttgtcgtcctactgctga

SEQ ID NO: 5608 - DNA, 25 bp, Mus musculus
aaacaatttgtcttccctggaagaa

SEQ ID NO: 5609 - DNA, 25 bp, Mus musculus
aaacacaaaccaaaaatctcctcac

SEQ ID NO: 5610 - DNA, 25 bp, Mus musculus
aaacacaaaccataaatctcctcac

SEQ ID NO: 5611 - DNA, 25 bp, Mus musculus
aaacacaaacctcgcagctgctctg

SEQ ID NO: 5612 - DNA, 25 bp, Mus musculus
aaacacaaacctggcagctgctctg

SEQ ID NO: 5613 - DNA, 25 bp, Mus musculus
aaacacaacaagaccgagttctcgg

SEQ ID NO: 5614 - DNA, 25 bp, Mus musculus
aaacacaacaagtccgagttctcgg

SEQ ID NO: 5615 - DNA, 25 bp, Mus musculus
aaacacaagaaaccgctgctaccag

SEQ ID NO: 5616 - DNA, 25 bp, Mus musculus
aaacacaagaaagcgctgctaccag

SEQ ID NO: 5617 - DNA, 25 bp, Mus musculus
aaacacaagccaacagcaggtctgt

SEQ ID NO: 5618 - DNA, 25 bp, Mus musculus
aaacacaagccatcagcaggtctgt

SEQ ID NO: 5619 - DNA, 25 bp, Mus musculus
aaacacaaggctctgcatgcacttt

SEQ ID NO: 5620 - DNA, 25 bp, Mus musculus
aaacacaaggctgtgcatgcacttt

SEQ ID NO: 5621 - DNA, 25 bp, Mus musculus
aaacacaagtgtcgtggtgtacacc

SEQ ID NO: 5622 - DNA, 25 bp, Mus musculus
aaacacaagtgtggtggtgtacacc

SEQ ID NO: 5623 - DNA, 25 bp, Mus musculus
aaacacaatactcaaagccacagaa

SEQ ID NO: 5624 - DNA, 25 bp, Mus musculus
aaacacaatactgaaagccacagaa

SEQ ID NO: 5625 - DNA, 25 bp, Mus musculus
aaacacaatctccacaatagcaggg

SEQ ID NO: 5626 - DNA, 25 bp, Mus musculus
aaacacaatctcgacaatagcaggg

SEQ ID NO: 5627 - DNA, 25 bp, Mus musculus
aaacacacactacgcagtggaggcc

SEQ ID NO: 5628 - DNA, 25 bp, Mus musculus
aaacacacactaggcagtggaggcc

SEQ ID NO: 5629 - DNA, 25 bp, Mus musculus
aaacacacacttcatgcacccggaa

SEQ ID NO: 5630 - DNA, 25 bp, Mus musculus
aaacacacacttgatgcacccggaa

SEQ ID NO: 5631 - DNA, 25 bp, Mus musculus
aaacacacagacaccttgcatttta

SEQ ID NO: 5632 - DNA, 25 bp, Mus musculus
aaacacacagactccttgcatttta

SEQ ID NO: 5633 - DNA, 25 bp, Mus musculus
aaacacacagctcttctgctagtaa

SEQ ID NO: 5634 - DNA, 25 bp, Mus musculus
aaacacacagctgttctgctagtaa

SEQ ID NO: 5635 - DNA, 25 bp, Mus musculus
aaacacacagggagataacaggcat

SEQ ID NO: 5636 - DNA, 25 bp, Mus musculus
aaacacacagggtgataacaggcat

SEQ ID NO: 5637 - DNA, 25 bp, Mus musculus
aaacacacatgcacgctcttgagct

SEQ ID NO: 5638 - DNA, 25 bp, Mus musculus
aaacacacatgctcgctcttgagct

SEQ ID NO: 5639 - DNA, 25 bp, Mus musculus
aaacacaccaagatcgtgcgggaca

SEQ ID NO: 5640 - DNA, 25 bp, Mus musculus
aaacacaccaagttcgtgcgggaca

SEQ ID NO: 5641 - DNA, 25 bp, Mus musculus
aaacacaccccgatctgttgttctg

SEQ ID NO: 5642 - DNA, 25 bp, Mus musculus
aaacacaccccgttctgttgttctg

SEQ ID NO: 5643 - DNA, 25 bp, Mus musculus
aaacacaccgggacatgctaagatc

SEQ ID NO: 5644 - DNA, 25 bp, Mus musculus
aaacacaccgggtcatgctaagatc

SEQ ID NO: 5645 - DNA, 25 bp, Mus musculus
aaacacacctaaagctgtcgcatct

SEQ ID NO: 5646 - DNA, 25 bp, Mus musculus
aaacacacctaatgctgtcgcatct

SEQ ID NO: 5647 - DNA, 25 bp, Mus musculus
aaacacacctgtagcttcatggcag

SEQ ID NO: 5648 - DNA, 25 bp, Mus musculus
aaacacacctgttgcttcatggcag

SEQ ID NO: 5649 - DNA, 25 bp, Mus musculus
aaacacacgcctaattttccagcat

SEQ ID NO: 5650 - DNA, 25 bp, Mus musculus
aaacacacgccttattttccagcat

SEQ ID NO: 5651 - DNA, 25 bp, Mus musculus
aaacacacggatctggtcgcactga

SEQ ID NO: 5652 - DNA, 25 bp, Mus musculus
aaacacacggatgtggtcgcactga

SEQ ID NO: 5653 - DNA, 25 bp, Mus musculus
aaacacacggccatagtcacactgt

SEQ ID NO: 5654 - DNA, 25 bp, Mus musculus
aaacacacggccttagtcacactgt

SEQ ID NO: 5655 - DNA, 25 bp, Mus musculus
aaacacacgtgcaaggtctgccagt

SEQ ID NO: 5656 - DNA, 25 bp, Mus musculus
aaacacacgtgctaggtctgccagt

SEQ ID NO: 5657 - DNA, 25 bp, Mus musculus
aaacacactcaaagtttgcgtagaa

SEQ ID NO: 5658 - DNA, 25 bp, Mus musculus
aaacacactcaatgtttgcgtagaa

SEQ ID NO: 5659 - DNA, 25 bp, Mus musculus
aaacacactcacaagcagatataat

SEQ ID NO: 5660 - DNA, 25 bp, Mus musculus
aaacacactcactagcagatataat

SEQ ID NO: 5661 - DNA, 25 bp, Mus musculus
aaacacacttccagtgttcactgcg

SEQ ID NO: 5662 - DNA, 25 bp, Mus musculus
aaacacacttcctgtgttcactgcg

SEQ ID NO: 5663 - DNA, 25 bp, Mus musculus
aaacacacttcgaagctggagagat

SEQ ID NO: 5664 - DNA, 25 bp, Mus musculus
aaacacacttcgtagctggagagat

SEQ ID NO: 5665 - DNA, 25 bp, Mus musculus
aaacacagacctaagcgattttcca

SEQ ID NO: 5666 - DNA, 25 bp, Mus musculus
aaacacagacctaccagtgagacca

SEQ ID NO: 5667 - DNA, 25 bp, Mus musculus
aaacacagaccttagcgattttcca

SEQ ID NO: 5668 - DNA, 25 bp, Mus musculus
aaacacagaccttccagtgagacca

SEQ ID NO: 5669 - DNA, 25 bp, Mus musculus
aaacacagacttatatagatgtgac

SEQ ID NO: 5670 - DNA, 25 bp, Mus musculus
aaacacagacttttatagatgtgac

SEQ ID NO: 5671 - DNA, 25 bp, Mus musculus
aaacacagattcagtgctggtcttc

SEQ ID NO: 5672 - DNA, 25 bp, Mus musculus
aaacacagattctgtgctggtcttc

SEQ ID NO: 5673 - DNA, 25 bp, Mus musculus
aaacacagcagccattcatgctaaa

SEQ ID NO: 5674 - DNA, 25 bp, Mus musculus
aaacacagcagcgattcatgctaaa

SEQ ID NO: 5675 - DNA, 25 bp, Mus musculus
aaacacagcaggctcttttggtaag

SEQ ID NO: 5676 - DNA, 25 bp, Mus musculus
aaacacagcagggtcttttggtaag

SEQ ID NO: 5677 - DNA, 25 bp, Mus musculus
aaacacagcctgaggtctttctgtc

SEQ ID NO: 5678 - DNA, 25 bp, Mus musculus
aaacacagcctgtggtctttctgtc

SEQ ID NO: 5679 - DNA, 25 bp, Mus musculus
aaacacaggagaaacacgcttgagt

SEQ ID NO: 5680 - DNA, 25 bp, Mus musculus
aaacacaggagatacacgcttgagt

SEQ ID NO: 5681 - DNA, 25 bp, Mus musculus
aaacacaggcaacagcagggtgcaa

SEQ ID NO: 5682 - DNA, 25 bp, Mus musculus
aaacacaggcaagagcagggtgcaa

SEQ ID NO: 5683 - DNA, 25 bp, Mus musculus
aaacacagggctacgtggatgctaa

SEQ ID NO: 5684 - DNA, 25 bp, Mus musculus
aaacacagggcttcgtggatgctaa

SEQ ID NO: 5685 - DNA, 25 bp, Mus musculus
aaacacaggtgcattggccccgggc

SEQ ID NO: 5686 - DNA, 25 bp, Mus musculus
aaacacaggtgctttggccccgggc

SEQ ID NO: 5687 - DNA, 25 bp, Mus musculus
aaacacaggtgtagggcatttgaca

SEQ ID NO: 5688 - DNA, 25 bp, Mus musculus
aaacacaggtgttgggcatttgaca

SEQ ID NO: 5689 - DNA, 25 bp, Mus musculus
aaacacagtcctcttctgctgtttg

SEQ ID NO: 5690 - DNA, 25 bp, Mus musculus
aaacacagtcctgttctgctgtttg

SEQ ID NO: 5691 - DNA, 25 bp, Mus musculus
aaacacagtgacaagcatctcccta

SEQ ID NO: 5692 - DNA, 25 bp, Mus musculus
aaacacagtgactagcatctcccta

SEQ ID NO: 5693 - DNA, 25 bp, Mus musculus
aaacacagtggcagcagtattattc

SEQ ID NO: 5694 - DNA, 25 bp, Mus musculus
aaacacagtggctgcagtattattc

SEQ ID NO: 5695 - DNA, 25 bp, Mus musculus
aaacacatcactatgttccctacat

SEQ ID NO: 5696 - DNA, 25 bp, Mus musculus
aaacacatcactttgttccctacat

SEQ ID NO: 5697 - DNA, 25 bp, Mus musculus
aaacacatcatacgctgaaataaag

SEQ ID NO: 5698 - DNA, 25 bp, Mus musculus
aaacacatcataggctgaaataaag

SEQ ID NO: 5699 - DNA, 25 bp, Mus musculus
aaacacatctgtacacttcaatatt

SEQ ID NO: 5700 - DNA, 25 bp, Mus musculus
aaacacatctgttcacttcaatatt

SEQ ID NO: 5701 - DNA, 25 bp, Mus musculus
aaacacatcttcattactcttttcc

SEQ ID NO: 5702 - DNA, 25 bp, Mus musculus
aaacacatcttctttactcttttcc

SEQ ID NO: 5703 - DNA, 25 bp, Mus musculus
aaacacatgactactgttgtaagaa

SEQ ID NO: 5704 - DNA, 25 bp, Mus musculus
aaacacatgacttctgttgtaagaa

SEQ ID NO: 5705 - DNA, 25 bp, Mus musculus
aaacacatgatgaggtgtgattcca

SEQ ID NO: 5706 - DNA, 25 bp, Mus musculus
aaacacatgatgtggtgtgattcca

SEQ ID NO: 5707 - DNA, 25 bp, Mus musculus
aaacacatgcatagctctgtacaag

SEQ ID NO: 5708 - DNA, 25 bp, Mus musculus
aaacacatgcattgctctgtacaag

SEQ ID NO: 5709 - DNA, 25 bp, Mus musculus
aaacacatgggaattgccttggaga

SEQ ID NO: 5710 - DNA, 25 bp, Mus musculus
aaacacatgggatttgccttggaga

SEQ ID NO: 5711 - DNA, 25 bp, Mus musculus
aaacacatggtcactcagagggcag

SEQ ID NO: 5712 - DNA, 25 bp, Mus musculus
aaacacatggtctctcagagggcag

SEQ ID NO: 5713 - DNA, 25 bp, Mus musculus
aaacacatggtgctccactgctaac

SEQ ID NO: 5714 - DNA, 25 bp, Mus musculus
aaacacatggtggtccactgctaac

SEQ ID NO: 5715 - DNA, 25 bp, Mus musculus
aaacacattcctcacctgcagtggg

SEQ ID NO: 5716 - DNA, 25 bp, Mus musculus
aaacacattcctgacctgcagtggg

SEQ ID NO: 5717 - DNA, 25 bp, Mus musculus
aaacacattggtcaccttctccagc

SEQ ID NO: 5718 - DNA, 25 bp, Mus musculus
aaacacattggtgaccttctccagc

SEQ ID NO: 5719 - DNA, 25 bp, Mus musculus
aaacacattgtaagttcccgcgtga

SEQ ID NO: 5720 - DNA, 25 bp, Mus musculus
aaacacattgtatgttcccgcgtga

SEQ ID NO: 5721 - DNA, 25 bp, Mus musculus
aaacacattgtgcagcgcaacacgg

SEQ ID NO: 5722 - DNA, 25 bp, Mus musculus
aaacacattgtggagcgcaacacgg

SEQ ID NO: 5723 - DNA, 25 bp, Mus musculus
aaacacattgttagtgaactggagt

SEQ ID NO: 5724 - DNA, 25 bp, Mus musculus
aaacacattgtttgtgaactggagt

SEQ ID NO: 5725 - DNA, 25 bp, Mus musculus
aaacacatttccacaagtgtcccaa

SEQ ID NO: 5726 - DNA, 25 bp, Mus musculus
aaacacatttcctcaagtgtcccaa

SEQ ID NO: 5727 - DNA, 25 bp, Mus musculus
aaacacatttgccaatcttcagcca

SEQ ID NO: 5728 - DNA, 25 bp, Mus musculus
aaacacatttgcgaatcttcagcca

SEQ ID NO: 5729 - DNA, 25 bp, Mus musculus
aaacaccaaggcattgtaggctaag

SEQ ID NO: 5730 - DNA, 25 bp, Mus musculus
aaacaccaaggctttgtaggctaag

SEQ ID NO: 5731 - DNA, 25 bp, Mus musculus
aaacaccaaggtatcagcccaagat

SEQ ID NO: 5732 - DNA, 25 bp, Mus musculus
aaacaccaaggtcgcatctcacata

SEQ ID NO: 5733 - DNA, 25 bp, Mus musculus
aaacaccaaggtggcatctcacata

SEQ ID NO: 5734 - DNA, 25 bp, Mus musculus
aaacaccaaggtttcagcccaagat

SEQ ID NO: 5735 - DNA, 25 bp, Mus musculus
aaacaccaagtgctattgctcacag

SEQ ID NO: 5736 - DNA, 25 bp, Mus musculus
aaacaccaagtggtattgctcacag

SEQ ID NO: 5737 - DNA, 25 bp, Mus musculus
aaacaccacattagttattcccctg

SEQ ID NO: 5738 - DNA, 25 bp, Mus musculus
aaacaccacatttgttattcccctg

SEQ ID NO: 5739 - DNA, 25 bp, Mus musculus
aaacaccaccagcaggtcatctcag

SEQ ID NO: 5740 - DNA, 25 bp, Mus musculus
aaacaccaccaggaggtcatctcag

SEQ ID NO: 5741 - DNA, 25 bp, Mus musculus
aaacaccaccgtcaatagttattgt

SEQ ID NO: 5742 - DNA, 25 bp, Mus musculus
aaacaccaccgtgaatagttattgt

SEQ ID NO: 5743 - DNA, 25 bp, Mus musculus
aaacaccactttatgcacagcctgg

SEQ ID NO: 5744 - DNA, 25 bp, Mus musculus
aaacaccactttttgcacagcctgg

SEQ ID NO: 5745 - DNA, 25 bp, Mus musculus
aaacaccagccgcaaacagcctttg

SEQ ID NO: 5746 - DNA, 25 bp, Mus musculus
aaacaccagccggaaacagcctttg

SEQ ID NO: 5747 - DNA, 25 bp, Mus musculus
aaacaccagctaatttgttacagct

SEQ ID NO: 5748 - DNA, 25 bp, Mus musculus
aaacaccagctattttgttacagct

SEQ ID NO: 5749 - DNA, 25 bp, Mus musculus
aaacaccaggcccaggagcatacac

SEQ ID NO: 5750 - DNA, 25 bp, Mus musculus
aaacaccaggccgaggagcatacac

SEQ ID NO: 5751 - DNA, 25 bp, Mus musculus
aaacaccagtaactgtgccgcatct

SEQ ID NO: 5752 - DNA, 25 bp, Mus musculus
aaacaccagtaagtgtgccgcatct

SEQ ID NO: 5753 - DNA, 25 bp, Mus musculus
aaacaccagtatccttgctcacatg

SEQ ID NO: 5754 - DNA, 25 bp, Mus musculus
aaacaccagtatgcttgctcacatg

SEQ ID NO: 5755 - DNA, 25 bp, Mus musculus
aaacaccagtgtaagcttactctta

SEQ ID NO: 5756 - DNA, 25 bp, Mus musculus
aaacaccagtgttagcttactctta

SEQ ID NO: 5757 - DNA, 25 bp, Mus musculus
aaacaccatactccaatatttccct

SEQ ID NO: 5758 - DNA, 25 bp, Mus musculus
aaacaccatactgcaatatttccct

SEQ ID NO: 5759 - DNA, 25 bp, Mus musculus
aaacaccatatgaggcatgccaagt

SEQ ID NO: 5760 - DNA, 25 bp, Mus musculus
aaacaccatatgtggcatgccaagt

SEQ ID NO: 5761 - DNA, 25 bp, Mus musculus
aaacaccatggcacacagtacttaa

SEQ ID NO: 5762 - DNA, 25 bp, Mus musculus
aaacaccatggcagtggtttcttat

SEQ ID NO: 5763 - DNA, 25 bp, Mus musculus
aaacaccatggcatgtcctttgcac

SEQ ID NO: 5764 - DNA, 25 bp, Mus musculus
aaacaccatggctcacagtacttaa

SEQ ID NO: 5765 - DNA, 25 bp, Mus musculus
aaacaccatggctgtggtttcttat

SEQ ID NO: 5766 - DNA, 25 bp, Mus musculus
aaacaccatggcttgtcctttgcac

SEQ ID NO: 5767 - DNA, 25 bp, Mus musculus
aaacaccatgggactttagagcagg

SEQ ID NO: 5768 - DNA, 25 bp, Mus musculus
aaacaccatgggtctttagagcagg

SEQ ID NO: 5769 - DNA, 25 bp, Mus musculus
aaacacccaaacagactagatccgg

SEQ ID NO: 5770 - DNA, 25 bp, Mus musculus
aaacacccaaactgactagatccgg

SEQ ID NO: 5771 - DNA, 25 bp, Mus musculus
aaacacccatttactacacacatct

SEQ ID NO: 5772 - DNA, 25 bp, Mus musculus
aaacacccattttctacacacatct

SEQ ID NO: 5773 - DNA, 25 bp, Mus musculus
aaacaccccagtccacatgaagatg

SEQ ID NO: 5774 - DNA, 25 bp, Mus musculus
aaacaccccagtgcacatgaagatg

SEQ ID NO: 5775 - DNA, 25 bp, Mus musculus
aaacaccctcaactgtgcggaagtg

SEQ ID NO: 5776 - DNA, 25 bp, Mus musculus
aaacaccctcaagtgtgcggaagtg

SEQ ID NO: 5777 - DNA, 25 bp, Mus musculus
aaacaccctcgccagcgtagagctg

SEQ ID NO: 5778 - DNA, 25 bp, Mus musculus
aaacaccctcgcgagcgtagagctg

SEQ ID NO: 5779 - DNA, 25 bp, Mus musculus
aaacaccctgaacaatcccgtagtg

SEQ ID NO: 5780 - DNA, 25 bp, Mus musculus
aaacaccctgaagaatcccgtagtg

SEQ ID NO: 5781 - DNA, 25 bp, Mus musculus
aaacaccctggtatgttcaacatgt

SEQ ID NO: 5782 - DNA, 25 bp, Mus musculus
aaacaccctggtttgttcaacatgt

SEQ ID NO: 5783 - DNA, 25 bp, Mus musculus
aaacaccctgttcaactgagagaag

SEQ ID NO: 5784 - DNA, 25 bp, Mus musculus
aaacaccctgttgaactgagagaag

SEQ ID NO: 5785 - DNA, 25 bp, Mus musculus
aaacacccttctagtgctttggctt

SEQ ID NO: 5786 - DNA, 25 bp, Mus musculus
aaacacccttcttgtgctttggctt

SEQ ID NO: 5787 - DNA, 25 bp, Mus musculus
aaacaccgagatatccttcaaactg

SEQ ID NO: 5788 - DNA, 25 bp, Mus musculus
aaacaccgagatttccttcaaactg

SEQ ID NO: 5789 - DNA, 25 bp, Mus musculus
aaacaccgatatacaggccagccag

SEQ ID NO: 5790 - DNA, 25 bp, Mus musculus
aaacaccgatattcaggccagccag

SEQ ID NO: 5791 - DNA, 25 bp, Mus musculus
aaacaccgtatcagttcttcttcca

SEQ ID NO: 5792 - DNA, 25 bp, Mus musculus
aaacaccgtatctgttcttcttcca

SEQ ID NO: 5793 - DNA, 25 bp, Mus musculus
aaacaccgtgagcttcgggtcacca

SEQ ID NO: 5794 - DNA, 25 bp, Mus musculus
aaacaccgtgaggttcgggtcacca

SEQ ID NO: 5795 - DNA, 25 bp, Mus musculus
aaacaccgtgggatcatactacatg

SEQ ID NO: 5796 - DNA, 25 bp, Mus musculus
aaacaccgtgggttcatactacatg

SEQ ID NO: 5797 - DNA, 25 bp, Mus musculus
aaacacctaaccactaagtcccatg

SEQ ID NO: 5798 - DNA, 25 bp, Mus musculus
aaacacctaacctctaagtcccatg

SEQ ID NO: 5799 - DNA, 25 bp, Mus musculus
aaacacctaggtccctgttcatcca

SEQ ID NO: 5800 - DNA, 25 bp, Mus musculus
aaacacctaggtgcctgttcatcca

SEQ ID NO: 5801 - DNA, 25 bp, Mus musculus
aaacacctcctgagctaggcttggt

SEQ ID NO: 5802 - DNA, 25 bp, Mus musculus
aaacacctcctgtgctaggcttggt

SEQ ID NO: 5803 - DNA, 25 bp, Mus musculus
aaacacctgataataccggaagaca

SEQ ID NO: 5804 - DNA, 25 bp, Mus musculus
aaacacctgatattaccggaagaca

SEQ ID NO: 5805 - DNA, 25 bp, Mus musculus
aaacacctgcccaggaggactcctt

SEQ ID NO: 5806 - DNA, 25 bp, Mus musculus
aaacacctgccctggaggactcctt

SEQ ID NO: 5807 - DNA, 25 bp, Mus musculus
aaacacctgctcaatgtgctgatgg

SEQ ID NO: 5808 - DNA, 25 bp, Mus musculus
aaacacctgctcatgccatttatgt

SEQ ID NO: 5809 - DNA, 25 bp, Mus musculus
aaacacctgctctatgtgctgatgg

SEQ ID NO: 5810 - DNA, 25 bp, Mus musculus
aaacacctgctcttgccatttatgt

SEQ ID NO: 5811 - DNA, 25 bp, Mus musculus
aaacacctggagatcaaccctgacc

SEQ ID NO: 5812 - DNA, 25 bp, Mus musculus
aaacacctggagttcaaccctgacc

SEQ ID NO: 5813 - DNA, 25 bp, Mus musculus
aaacacctggcaagcggagttggct

SEQ ID NO: 5814 - DNA, 25 bp, Mus musculus
aaacacctggcatgcggagttggct

SEQ ID NO: 5815 - DNA, 25 bp, Mus musculus
aaacacctggttctgccatatggag

SEQ ID NO: 5816 - DNA, 25 bp, Mus musculus
aaacacctggttgtgccatatggag

SEQ ID NO: 5817 - DNA, 25 bp, Mus musculus
aaacacctgtatatgcgctggacca

SEQ ID NO: 5818 - DNA, 25 bp, Mus musculus
aaacacctgtatttgcgctggacca

SEQ ID NO: 5819 - DNA, 25 bp, Mus musculus
aaacacctgtttcgttggcgctgat

SEQ ID NO: 5820 - DNA, 25 bp, Mus musculus
aaacacctgtttggttggcgctgat

SEQ ID NO: 5821 - DNA, 25 bp, Mus musculus
aaacaccttcatagacgggctcttt

SEQ ID NO: 5822 - DNA, 25 bp, Mus musculus
aaacaccttcattgacgggctcttt

SEQ ID NO: 5823 - DNA, 25 bp, Mus musculus
aaacaccttcctcggagcagcatgg

SEQ ID NO: 5824 - DNA, 25 bp, Mus musculus
aaacaccttcctgggagcagcatgg

SEQ ID NO: 5825 - DNA, 25 bp, Mus musculus
aaacaccttgagctttttgactgcc

SEQ ID NO: 5826 - DNA, 25 bp, Mus musculus
aaacaccttgaggtttttgactgcc

SEQ ID NO: 5827 - DNA, 25 bp, Mus musculus
aaacaccttttgaggcttcaagcta

SEQ ID NO: 5828 - DNA, 25 bp, Mus musculus
aaacaccttttgtggcttcaagcta

SEQ ID NO: 5829 - DNA, 25 bp, Mus musculus
aaacacgacctacgcatgcatgctg

SEQ ID NO: 5830 - DNA, 25 bp, Mus musculus
aaacacgacctaggcatgcatgctg

SEQ ID NO: 5831 - DNA, 25 bp, Mus musculus
aaacacgagatcatccttcggctct

SEQ ID NO: 5832 - DNA, 25 bp, Mus musculus
aaacacgagatcttccttcggctct

SEQ ID NO: 5833 - DNA, 25 bp, Mus musculus
aaacacgataatattcttgacatga

SEQ ID NO: 5834 - DNA, 25 bp, Mus musculus
aaacacgataattttcttgacatga

SEQ ID NO: 5835 - DNA, 25 bp, Mus musculus
aaacacgataccacctgctagctgg

SEQ ID NO: 5836 - DNA, 25 bp, Mus musculus
aaacacgatacctcctgctagctgg

SEQ ID NO: 5837 - DNA, 25 bp, Mus musculus
aaacacgatagtactgtccctcttt

SEQ ID NO: 5838 - DNA, 25 bp, Mus musculus
aaacacgatagttctgtccctcttt

SEQ ID NO: 5839 - DNA, 25 bp, Mus musculus
aaacacgccagaccctcaggtggga

SEQ ID NO: 5840 - DNA, 25 bp, Mus musculus
aaacacgccagagcctcaggtggga

SEQ ID NO: 5841 - DNA, 25 bp, Mus musculus
aaacacgctgctcacacataaataa

SEQ ID NO: 5842 - DNA, 25 bp, Mus musculus
aaacacgctgctgacacataaataa

SEQ ID NO: 5843 - DNA, 25 bp, Mus musculus
aaacacggacttctcttcagggaga

SEQ ID NO: 5844 - DNA, 25 bp, Mus musculus
aaacacggacttgtcttcagggaga

SEQ ID NO: 5845 - DNA, 25 bp, Mus musculus
aaacacggagtcatcaggaggtcaa

SEQ ID NO: 5846 - DNA, 25 bp, Mus musculus
aaacacggagtcttcaggaggtcaa

SEQ ID NO: 5847 - DNA, 25 bp, Mus musculus
aaacacgggtgcatgtggctgcttt

SEQ ID NO: 5848 - DNA, 25 bp, Mus musculus
aaacacgggtgcttgtggctgcttt

SEQ ID NO: 5849 - DNA, 25 bp, Mus musculus
aaacacggtccacccagttgactgt

SEQ ID NO: 5850 - DNA, 25 bp, Mus musculus
aaacacggtccagccagttgactgt

SEQ ID NO: 5851 - DNA, 25 bp, Mus musculus
aaacacgtacctcgtgcactgcgag

SEQ ID NO: 5852 - DNA, 25 bp, Mus musculus
aaacacgtacctggtgcactgcgag

SEQ ID NO: 5853 - DNA, 25 bp, Mus musculus
aaacacgtcatgctttattcccata

SEQ ID NO: 5854 - DNA, 25 bp, Mus musculus
aaacacgtcatggtttattcccata

SEQ ID NO: 5855 - DNA, 25 bp, Mus musculus
aaacacgtggcgaacttgtcacaca

SEQ ID NO: 5856 - DNA, 25 bp, Mus musculus
aaacacgtggcgtacttgtcacaca

SEQ ID NO: 5857 - DNA, 25 bp, Mus musculus
aaacacgtgggcagctcctgaagaa

SEQ ID NO: 5858 - DNA, 25 bp, Mus musculus
aaacacgtgggctgctcctgaagaa

SEQ ID NO: 5859 - DNA, 25 bp, Mus musculus
aaacacgttactctgtcgcgcacgg

SEQ ID NO: 5860 - DNA, 25 bp, Mus musculus
aaacacgttactgtgtcgcgcacgg

SEQ ID NO: 5861 - DNA, 25 bp, Mus musculus
aaacacgtttgcagacccaatgacc

SEQ ID NO: 5862 - DNA, 25 bp, Mus musculus
aaacacgtttgctgacccaatgacc

SEQ ID NO: 5863 - DNA, 25 bp, Mus musculus
aaacactaagctattgagcccacag

SEQ ID NO: 5864 - DNA, 25 bp, Mus musculus
aaacactaagcttttgagcccacag

SEQ ID NO: 5865 - DNA, 25 bp, Mus musculus
aaacactaagtcactgcattccagc

SEQ ID NO: 5866 - DNA, 25 bp, Mus musculus
aaacactaagtctctgcattccagc

SEQ ID NO: 5867 - DNA, 25 bp, Mus musculus
aaacactaatctattcatctcactg

SEQ ID NO: 5868 - DNA, 25 bp, Mus musculus
aaacactaatcttttcatctcactg

SEQ ID NO: 5869 - DNA, 25 bp, Mus musculus
aaacactaatgcatttccctaacct

SEQ ID NO: 5870 - DNA, 25 bp, Mus musculus
aaacactaatgcttttccctaacct

SEQ ID NO: 5871 - DNA, 25 bp, Mus musculus
aaacactacctgatggcactgcttc

SEQ ID NO: 5872 - DNA, 25 bp, Mus musculus
aaacactacctgttggcactgcttc

SEQ ID NO: 5873 - DNA, 25 bp, Mus musculus
aaacactagtggaatgtccgctact

SEQ ID NO: 5874 - DNA, 25 bp, Mus musculus
aaacactagtggtatgtccgctact

SEQ ID NO: 5875 - DNA, 25 bp, Mus musculus
aaacactatatcctgtctcttagca

SEQ ID NO: 5876 - DNA, 25 bp, Mus musculus
aaacactatatcgtgtctcttagca

SEQ ID NO: 5877 - DNA, 25 bp, Mus musculus
aaacactatgtccaaagccactttc

SEQ ID NO: 5878 - DNA, 25 bp, Mus musculus
aaacactatgtcgaaagccactttc

SEQ ID NO: 5879 - DNA, 25 bp, Mus musculus
aaacactattcacatcttacagatg

SEQ ID NO: 5880 - DNA, 25 bp, Mus musculus
aaacactattcagatcttacagatg

SEQ ID NO: 5881 - DNA, 25 bp, Mus musculus
aaacactcaagacacttgtttacat

SEQ ID NO: 5882 - DNA, 25 bp, Mus musculus
aaacactcaagagacttgtttacat

SEQ ID NO: 5883 - DNA, 25 bp, Mus musculus
aaacactcagagaaggccagcaggc

SEQ ID NO: 5884 - DNA, 25 bp, Mus musculus
aaacactcagagtaggccagcaggc

SEQ ID NO: 5885 - DNA, 25 bp, Mus musculus
aaacactcatacctagctgtgaagt

SEQ ID NO: 5886 - DNA, 25 bp, Mus musculus
aaacactcatacgtagctgtgaagt

SEQ ID NO: 5887 - DNA, 25 bp, Mus musculus
aaacactccagcatctccatgagta

SEQ ID NO: 5888 - DNA, 25 bp, Mus musculus
aaacactccagcttctccatgagta

SEQ ID NO: 5889 - DNA, 25 bp, Mus musculus
aaacactcccctctgtcactgaagg

SEQ ID NO: 5890 - DNA, 25 bp, Mus musculus
aaacactcccctgtgtcactgaagg

SEQ ID NO: 5891 - DNA, 25 bp, Mus musculus
aaacactcgggacgtggtttgtgct

SEQ ID NO: 5892 - DNA, 25 bp, Mus musculus
aaacactcgggaggtggtttgtgct

SEQ ID NO: 5893 - DNA, 25 bp, Mus musculus
aaacactcgtgacgtttgtgcctct

SEQ ID NO: 5894 - DNA, 25 bp, Mus musculus
aaacactcgtgaggtttgtgcctct

SEQ ID NO: 5895 - DNA, 25 bp, Mus musculus
aaacactctactcgtatgtgtctca

SEQ ID NO: 5896 - DNA, 25 bp, Mus musculus
aaacactctactggtatgtgtctca

SEQ ID NO: 5897 - DNA, 25 bp, Mus musculus
aaacactctgacatttaaggctgat

SEQ ID NO: 5898 - DNA, 25 bp, Mus musculus
aaacactctgacttttaaggctgat

SEQ ID NO: 5899 - DNA, 25 bp, Mus musculus
aaacactctgggagggaggcctgca

SEQ ID NO: 5900 - DNA, 25 bp, Mus musculus
aaacactctgggtgggaggcctgca

SEQ ID NO: 5901 - DNA, 25 bp, Mus musculus
aaacactgaagaagtatcctgttct

SEQ ID NO: 5902 - DNA, 25 bp, Mus musculus
aaacactgaagatgtatcctgttct

SEQ ID NO: 5903 - DNA, 25 bp, Mus musculus
aaacactgaatcagagttcccgatt

SEQ ID NO: 5904 - DNA, 25 bp, Mus musculus
aaacactgaatctgagttcccgatt

SEQ ID NO: 5905 - DNA, 25 bp, Mus musculus
aaacactgacacattgctactattt

SEQ ID NO: 5906 - DNA, 25 bp, Mus musculus
aaacactgacactttgctactattt

SEQ ID NO: 5907 - DNA, 25 bp, Mus musculus
aaacactgaccgcaagggacaccaa

SEQ ID NO: 5908 - DNA, 25 bp, Mus musculus
aaacactgaccggaagggacaccaa

SEQ ID NO: 5909 - DNA, 25 bp, Mus musculus
aaacactgacggatcatctgaaatg

SEQ ID NO: 5910 - DNA, 25 bp, Mus musculus
aaacactgacggttcatctgaaatg

SEQ ID NO: 5911 - DNA, 25 bp, Mus musculus
aaacactgagttcactgtattgcca

SEQ ID NO: 5912 - DNA, 25 bp, Mus musculus
aaacactgagttgactgtattgcca

SEQ ID NO: 5913 - DNA, 25 bp, Mus musculus
aaacactgccagagaacttattcct

SEQ ID NO: 5914 - DNA, 25 bp, Mus musculus
aaacactgccagtgaacttattcct

SEQ ID NO: 5915 - DNA, 25 bp, Mus musculus
aaacactgccttcctagatctctgt

SEQ ID NO: 5916 - DNA, 25 bp, Mus musculus
aaacactgccttgctagatctctgt

SEQ ID NO: 5917 - DNA, 25 bp, Mus musculus
aaacactgcggccagaagccctgag

SEQ ID NO: 5918 - DNA, 25 bp, Mus musculus
aaacactgcggcgagaagccctgag

SEQ ID NO: 5919 - DNA, 25 bp, Mus musculus
aaacactgcttccttctgataggca

SEQ ID NO: 5920 - DNA, 25 bp, Mus musculus
aaacactgcttcgttctgataggca

SEQ ID NO: 5921 - DNA, 25 bp, Mus musculus
aaacactggaaaatttgctaacaca

SEQ ID NO: 5922 - DNA, 25 bp, Mus musculus
aaacactggaaattttgctaacaca

SEQ ID NO: 5923 - DNA, 25 bp, Mus musculus
aaacactggatcagccaggcctagg

SEQ ID NO: 5924 - DNA, 25 bp, Mus musculus
aaacactggatctgccaggcctagg

SEQ ID NO: 5925 - DNA, 25 bp, Mus musculus
aaacactggcacaactgtgacagct

SEQ ID NO: 5926 - DNA, 25 bp, Mus musculus
aaacactggcacaggaacatctcgc

SEQ ID NO: 5927 - DNA, 25 bp, Mus musculus
aaacactggcactactgtgacagct

SEQ ID NO: 5928 - DNA, 25 bp, Mus musculus
aaacactggcactggaacatctcgc

SEQ ID NO: 5929 - DNA, 25 bp, Mus musculus
aaacactggcttatgctgaacccca

SEQ ID NO: 5930 - DNA, 25 bp, Mus musculus
aaacactggcttttgctgaacccca

SEQ ID NO: 5931 - DNA, 25 bp, Mus musculus
aaacactgggcacgagcaactcaga

SEQ ID NO: 5932 - DNA, 25 bp, Mus musculus
aaacactgggcaggagcaactcaga

SEQ ID NO: 5933 - DNA, 25 bp, Mus musculus
aaacactggtttctcattacccgag

SEQ ID NO: 5934 - DNA, 25 bp, Mus musculus
aaacactggtttgtcattacccgag

SEQ ID NO: 5935 - DNA, 25 bp, Mus musculus
aaacactgtagaccaagctttgaac

SEQ ID NO: 5936 - DNA, 25 bp, Mus musculus
aaacactgtagagcaagctttgaac

SEQ ID NO: 5937 - DNA, 25 bp, Mus musculus
aaacactgtagcattccaccctgtt

SEQ ID NO: 5938 - DNA, 25 bp, Mus musculus
aaacactgtagctttccaccctgtt

SEQ ID NO: 5939 - DNA, 25 bp, Mus musculus
aaacactgtaggccaggtcctccgg

SEQ ID NO: 5940 - DNA, 25 bp, Mus musculus
aaacactgtagggcaggtcctccgg

SEQ ID NO: 5941 - DNA, 25 bp, Mus musculus
aaacactgtatcaagttggagccaa

SEQ ID NO: 5942 - DNA, 25 bp, Mus musculus
aaacactgtatctagttggagccaa

SEQ ID NO: 5943 - DNA, 25 bp, Mus musculus
aaacactgtcatcatcctagggata

SEQ ID NO: 5944 - DNA, 25 bp, Mus musculus
aaacactgtcatgatcctagggata

SEQ ID NO: 5945 - DNA, 25 bp, Mus musculus
aaacactgtcctcgagcgggtggaa

SEQ ID NO: 5946 - DNA, 25 bp, Mus musculus
aaacactgtcctggagcgggtggaa

SEQ ID NO: 5947 - DNA, 25 bp, Mus musculus
aaacactgtgaaccccaacaggcct

SEQ ID NO: 5948 - DNA, 25 bp, Mus musculus
aaacactgtgaagcccaacaggcct

SEQ ID NO: 5949 - DNA, 25 bp, Mus musculus
aaacactgtgcacaacgaccgattg

SEQ ID NO: 5950 - DNA, 25 bp, Mus musculus
aaacactgtgcagaacgaccgattg

SEQ ID NO: 5951 - DNA, 25 bp, Mus musculus
aaacactgtgccaatttcagccata

SEQ ID NO: 5952 - DNA, 25 bp, Mus musculus
aaacactgtgcctatttcagccata

SEQ ID NO: 5953 - DNA, 25 bp, Mus musculus
aaacactgtgggaccccagtgcatt

SEQ ID NO: 5954 - DNA, 25 bp, Mus musculus
aaacactgtgggtccccagtgcatt

SEQ ID NO: 5955 - DNA, 25 bp, Mus musculus
aaacactgtggtccaggttgccgat

SEQ ID NO: 5956 - DNA, 25 bp, Mus musculus
aaacactgtggtgcaggttgccgat

SEQ ID NO: 5957 - DNA, 25 bp, Mus musculus
aaacactgttcaatagtaactcaat

SEQ ID NO: 5958 - DNA, 25 bp, Mus musculus
aaacactgttcattagtaactcaat

SEQ ID NO: 5959 - DNA, 25 bp, Mus musculus
aaacactgttgcattctttgtgaaa

SEQ ID NO: 5960 - DNA, 25 bp, Mus musculus
aaacactgttgctttctttgtgaaa

SEQ ID NO: 5961 - DNA, 25 bp, Mus musculus
aaacacttaacacgcaaagctgaac

SEQ ID NO: 5962 - DNA, 25 bp, Mus musculus
aaacacttaacaggcaaagctgaac

SEQ ID NO: 5963 - DNA, 25 bp, Mus musculus
aaacacttgacactcttgaccttga

SEQ ID NO: 5964 - DNA, 25 bp, Mus musculus
aaacacttgacagtcttgaccttga

SEQ ID NO: 5965 - DNA, 25 bp, Mus musculus
aaacacttgatgatcctatcagaca

SEQ ID NO: 5966 - DNA, 25 bp, Mus musculus
aaacacttgatgttcctatcagaca

SEQ ID NO: 5967 - DNA, 25 bp, Mus musculus
aaacactttcagcaaaaactcatat

SEQ ID NO: 5968 - DNA, 25 bp, Mus musculus
aaacactttcaggaaaaactcatat

SEQ ID NO: 5969 - DNA, 25 bp, Mus musculus
aaacactttcctctagaagtcttat

SEQ ID NO: 5970 - DNA, 25 bp, Mus musculus
aaacactttcctgtagaagtcttat

SEQ ID NO: 5971 - DNA, 25 bp, Mus musculus
aaacactttcttcagttcgactcaa

SEQ ID NO: 5972 - DNA, 25 bp, Mus musculus
aaacactttcttgagttcgactcaa

SEQ ID NO: 5973 - DNA, 25 bp, Mus musculus
aaacactttgatcttttgctctgca

SEQ ID NO: 5974 - DNA, 25 bp, Mus musculus
aaacactttgatgttttgctctgca

SEQ ID NO: 5975 - DNA, 25 bp, Mus musculus
aaacactttgctcccagaattcagt

SEQ ID NO: 5976 - DNA, 25 bp, Mus musculus
aaacactttgctgccagaattcagt

SEQ ID NO: 5977 - DNA, 25 bp, Mus musculus
aaacagaaaagacccgcccggcagc

SEQ ID NO: 5978 - DNA, 25 bp, Mus musculus
aaacagaaaagagccgcccggcagc

SEQ ID NO: 5979 - DNA, 25 bp, Mus musculus
aaacagaacaggctcccctgggttg

SEQ ID NO: 5980 - DNA, 25 bp, Mus musculus
aaacagaacagggtcccctgggttg

SEQ ID NO: 5981 - DNA, 25 bp, Mus musculus
aaacagaaccctattccagcagcag

SEQ ID NO: 5982 - DNA, 25 bp, Mus musculus
aaacagaaccctcagcggcatttct

SEQ ID NO: 5983 - DNA, 25 bp, Mus musculus
aaacagaaccctgagcggcatttct

SEQ ID NO: 5984 - DNA, 25 bp, Mus musculus
aaacagaacccttttccagcagcag

SEQ ID NO: 5985 - DNA, 25 bp, Mus musculus
aaacagaacttgcatagcccctgcc

SEQ ID NO: 5986 - DNA, 25 bp, Mus musculus
aaacagaacttggatagcccctgcc

SEQ ID NO: 5987 - DNA, 25 bp, Mus musculus
aaacagaagagtccctttgcccctg

SEQ ID NO: 5988 - DNA, 25 bp, Mus musculus
aaacagaagagtgcctttgcccctg

SEQ ID NO: 5989 - DNA, 25 bp, Mus musculus
aaacagaattccatttgcctctctg

SEQ ID NO: 5990 - DNA, 25 bp, Mus musculus
aaacagaattccttttgcctctctg

SEQ ID NO: 5991 - DNA, 25 bp, Mus musculus
aaacagaattgcactacagtcccca

SEQ ID NO: 5992 - DNA, 25 bp, Mus musculus
aaacagaattgctctacagtcccca

SEQ ID NO: 5993 - DNA, 25 bp, Mus musculus
aaacagacacacaatgttcccgact

SEQ ID NO: 5994 - DNA, 25 bp, Mus musculus
aaacagacacactatgttcccgact

SEQ ID NO: 5995 - DNA, 25 bp, Mus musculus
aaacagacacctatcagtctcaggc

SEQ ID NO: 5996 - DNA, 25 bp, Mus musculus
aaacagacacctttcagtctcaggc

SEQ ID NO: 5997 - DNA, 25 bp, Mus musculus
aaacagacactgagccaaatccaca

SEQ ID NO: 5998 - DNA, 25 bp, Mus musculus
aaacagacactgtgccaaatccaca

SEQ ID NO: 5999 - DNA, 25 bp, Mus musculus
aaacagacagaaatcgccacgaggc

SEQ ID NO: 6000 - DNA, 25 bp, Mus musculus
aaacagacagaacccacgacagata

SEQ ID NO: 6001 - DNA, 25 bp, Mus musculus
aaacagacagaagccacgacagata

SEQ ID NO: 6002 - DNA, 25 bp, Mus musculus
aaacagacagaattcgccacgaggc

SEQ ID NO: 6003 - DNA, 25 bp, Mus musculus
aaacagacatgtaggctcaggcccc

SEQ ID NO: 6004 - DNA, 25 bp, Mus musculus
aaacagacatgttggctcaggcccc

SEQ ID NO: 6005 - DNA, 25 bp, Mus musculus
aaacagaccaggacttactcagtaa

SEQ ID NO: 6006 - DNA, 25 bp, Mus musculus
aaacagaccaggtcttactcagtaa

SEQ ID NO: 6007 - DNA, 25 bp, Mus musculus
aaacagaccggcaggaggcacgaaa

SEQ ID NO: 6008 - DNA, 25 bp, Mus musculus
aaacagaccggctggaggcacgaaa

SEQ ID NO: 6009 - DNA, 25 bp, Mus musculus
aaacagactcatatctcaccatctg

SEQ ID NO: 6010 - DNA, 25 bp, Mus musculus
aaacagactcatttctcaccatctg

SEQ ID NO: 6011 - DNA, 25 bp, Mus musculus
aaacagactcctatatcgctatcaa

SEQ ID NO: 6012 - DNA, 25 bp, Mus musculus
aaacagactcctttatcgctatcaa

SEQ ID NO: 6013 - DNA, 25 bp, Mus musculus
aaacagactgcgcagagtctctgtc

SEQ ID NO: 6014 - DNA, 25 bp, Mus musculus
aaacagactgcggagagtctctgtc

SEQ ID NO: 6015 - DNA, 25 bp, Mus musculus
aaacagactggcacttgctggactc

SEQ ID NO: 6016 - DNA, 25 bp, Mus musculus
aaacagactggctcttgctggactc

SEQ ID NO: 6017 - DNA, 25 bp, Mus musculus
aaacagactgtgctcccgagcaggg

SEQ ID NO: 6018 - DNA, 25 bp, Mus musculus
aaacagactgtggtcccgagcaggg

SEQ ID NO: 6019 - DNA, 25 bp, Mus musculus
aaacagactgttagtggcacggttc

SEQ ID NO: 6020 - DNA, 25 bp, Mus musculus
aaacagactgtttgtggcacggttc

SEQ ID NO: 6021 - DNA, 25 bp, Mus musculus
aaacagagacagaggacttccaaat

SEQ ID NO: 6022 - DNA, 25 bp, Mus musculus
aaacagagacagtggacttccaaat

SEQ ID NO: 6023 - DNA, 25 bp, Mus musculus
aaacagagactaaggccatgtgagc

SEQ ID NO: 6024 - DNA, 25 bp, Mus musculus
aaacagagactatggccatgtgagc

SEQ ID NO: 6025 - DNA, 25 bp, Mus musculus
aaacagagactcaatgccatcacgc

SEQ ID NO: 6026 - DNA, 25 bp, Mus musculus
aaacagagactctatgccatcacgc

SEQ ID NO: 6027 - DNA, 25 bp, Mus musculus
aaacagagcacacaaatcggcccct

SEQ ID NO: 6028 - DNA, 25 bp, Mus musculus
aaacagagcacagaaatcggcccct

SEQ ID NO: 6029 - DNA, 25 bp, Mus musculus
aaacagagcagcactgcagaccagt

SEQ ID NO: 6030 - DNA, 25 bp, Mus musculus
aaacagagcagctctgcagaccagt

SEQ ID NO: 6031 - DNA, 25 bp, Mus musculus
aaacagagcatccagcgcaacatgt

SEQ ID NO: 6032 - DNA, 25 bp, Mus musculus
aaacagagcatcgagcgcaacatgt

SEQ ID NO: 6033 - DNA, 25 bp, Mus musculus
aaacagagcattccctgcgacttat

SEQ ID NO: 6034 - DNA, 25 bp, Mus musculus
aaacagagcattgcctgcgacttat

SEQ ID NO: 6035 - DNA, 25 bp, Mus musculus
aaacagagccaacaacagagtagag

SEQ ID NO: 6036 - DNA, 25 bp, Mus musculus
aaacagagccaagaacagagtagag

SEQ ID NO: 6037 - DNA, 25 bp, Mus musculus
aaacagagcctgacggtggatccag

SEQ ID NO: 6038 - DNA, 25 bp, Mus musculus
aaacagagcctgtcggtggatccag

SEQ ID NO: 6039 - DNA, 25 bp, Mus musculus
aaacagagcgcacagcagactggac

SEQ ID NO: 6040 - DNA, 25 bp, Mus musculus
aaacagagcgcagagcagactggac

SEQ ID NO: 6041 - DNA, 25 bp, Mus musculus
aaacagagctcaccagggcccaggc

SEQ ID NO: 6042 - DNA, 25 bp, Mus musculus
aaacagagctcagcagggcccaggc

SEQ ID NO: 6043 - DNA, 25 bp, Mus musculus
aaacagagctctcatacttcccaga

SEQ ID NO: 6044 - DNA, 25 bp, Mus musculus
aaacagagctctgatacttcccaga

SEQ ID NO: 6045 - DNA, 25 bp, Mus musculus
aaacagaggatgatcctacatcatc

SEQ ID NO: 6046 - DNA, 25 bp, Mus musculus
aaacagaggatgttcctacatcatc

SEQ ID NO: 6047 - DNA, 25 bp, Mus musculus
aaacagaggcctatcttccttagtg

SEQ ID NO: 6048 - DNA, 25 bp, Mus musculus
aaacagaggcctttcttccttagtg

SEQ ID NO: 6049 - DNA, 25 bp, Mus musculus
aaacagaggcgtctgacaggctttt

SEQ ID NO: 6050 - DNA, 25 bp, Mus musculus
aaacagaggcgtgtgacaggctttt

SEQ ID NO: 6051 - DNA, 25 bp, Mus musculus
aaacagagggctactcaggctccga

SEQ ID NO: 6052 - DNA, 25 bp, Mus musculus
aaacagagggctcggctgaccagat

SEQ ID NO: 6053 - DNA, 25 bp, Mus musculus
aaacagagggctgggctgaccagat

SEQ ID NO: 6054 - DNA, 25 bp, Mus musculus
aaacagagggcttctcaggctccga

SEQ ID NO: 6055 - DNA, 25 bp, Mus musculus
aaacagaggtcaagctcgggccaca

SEQ ID NO: 6056 - DNA, 25 bp, Mus musculus
aaacagaggtcatgctcgggccaca

SEQ ID NO: 6057 - DNA, 25 bp, Mus musculus
aaacagaggtgtcagagccagttgt

SEQ ID NO: 6058 - DNA, 25 bp, Mus musculus
aaacagaggtgtgagagccagttgt

SEQ ID NO: 6059 - DNA, 25 bp, Mus musculus
aaacagagtaacaggccttcatttc

SEQ ID NO: 6060 - DNA, 25 bp, Mus musculus
aaacagagtaactggccttcatttc

SEQ ID NO: 6061 - DNA, 25 bp, Mus musculus
aaacagagtatcaagcaactgaagg

SEQ ID NO: 6062 - DNA, 25 bp, Mus musculus
aaacagagtatctagcaactgaagg

SEQ ID NO: 6063 - DNA, 25 bp, Mus musculus
aaacagagtattacacggtctagtg

SEQ ID NO: 6064 - DNA, 25 bp, Mus musculus
aaacagagtatttcacggtctagtg

SEQ ID NO: 6065 - DNA, 25 bp, Mus musculus
aaacagagtcttactcctgtaattt

SEQ ID NO: 6066 - DNA, 25 bp, Mus musculus
aaacagagtctttctcctgtaattt

SEQ ID NO: 6067 - DNA, 25 bp, Mus musculus
aaacagatcagcaagacagatccaa

SEQ ID NO: 6068 - DNA, 25 bp, Mus musculus
aaacagatcagctagacagatccaa

SEQ ID NO: 6069 - DNA, 25 bp, Mus musculus
aaacagatcaggatccttgcacttt

SEQ ID NO: 6070 - DNA, 25 bp, Mus musculus
aaacagatcaggttccttgcacttt

SEQ ID NO: 6071 - DNA, 25 bp, Mus musculus
aaacagatcagtaggctcctctgcc

SEQ ID NO: 6072 - DNA, 25 bp, Mus musculus
aaacagatcagttggctcctctgcc

SEQ ID NO: 6073 - DNA, 25 bp, Mus musculus
aaacagatcctactgcgaggcctag

SEQ ID NO: 6074 - DNA, 25 bp, Mus musculus
aaacagatcctagtgcgaggcctag

SEQ ID NO: 6075 - DNA, 25 bp, Mus musculus
aaacagatctcacccgcgattcact

SEQ ID NO: 6076 - DNA, 25 bp, Mus musculus
aaacagatctcagccgcgattcact

SEQ ID NO: 6077 - DNA, 25 bp, Mus musculus
aaacagatgatcacatttgctgaat

SEQ ID NO: 6078 - DNA, 25 bp, Mus musculus
aaacagatgatctcatttgctgaat

SEQ ID NO: 6079 - DNA, 25 bp, Mus musculus
aaacagatgtgtccaactattttgg

SEQ ID NO: 6080 - DNA, 25 bp, Mus musculus
aaacagatgtgtgcaactattttgg

SEQ ID NO: 6081 - DNA, 25 bp, Mus musculus
aaacagattaacctttggactatgt

SEQ ID NO: 6082 - DNA, 25 bp, Mus musculus
aaacagattaacgtttggactatgt

SEQ ID NO: 6083 - DNA, 25 bp, Mus musculus
aaacagattccaatgcggcttcagc

SEQ ID NO: 6084 - DNA, 25 bp, Mus musculus
aaacagattccattgcggcttcagc

SEQ ID NO: 6085 - DNA, 25 bp, Mus musculus
aaacagattcccaaaccgtgtgcgg

SEQ ID NO: 6086 - DNA, 25 bp, Mus musculus
aaacagattccctaaccgtgtgcgg

SEQ ID NO: 6087 - DNA, 25 bp, Mus musculus
aaacagattctaccatccaccgagt

SEQ ID NO: 6088 - DNA, 25 bp, Mus musculus
aaacagattctagcatccaccgagt

SEQ ID NO: 6089 - DNA, 25 bp, Mus musculus
aaacagattctgattccagcgctcc

SEQ ID NO: 6090 - DNA, 25 bp, Mus musculus
aaacagattctgtttccagcgctcc

SEQ ID NO: 6091 - DNA, 25 bp, Mus musculus
aaacagattggtcctgctctcaaca

SEQ ID NO: 6092 - DNA, 25 bp, Mus musculus
aaacagattggtgctgctctcaaca

SEQ ID NO: 6093 - DNA, 25 bp, Mus musculus
aaacagatttagacgtagacaggaa

SEQ ID NO: 6094 - DNA, 25 bp, Mus musculus
aaacagatttagtcgtagacaggaa

SEQ ID NO: 6095 - DNA, 25 bp, Mus musculus
aaacagatttgacaccttgtgaaga

SEQ ID NO: 6096 - DNA, 25 bp, Mus musculus
aaacagatttgagaccttgtgaaga

SEQ ID NO: 6097 - DNA, 25 bp, Mus musculus
aaacagattttgactcctggtcctc

SEQ ID NO: 6098 - DNA, 25 bp, Mus musculus
aaacagattttgtctcctggtcctc

SEQ ID NO: 6099 - DNA, 25 bp, Mus musculus
aaacagcaacctatggccaagtgaa

SEQ ID NO: 6100 - DNA, 25 bp, Mus musculus
aaacagcaacctttggccaagtgaa

SEQ ID NO: 6101 - DNA, 25 bp, Mus musculus
aaacagcaactgaatacccacccat

SEQ ID NO: 6102 - DNA, 25 bp, Mus musculus
aaacagcaactgtatacccacccat

SEQ ID NO: 6103 - DNA, 25 bp, Mus musculus
aaacagcacgcaaggaggacgacct

SEQ ID NO: 6104 - DNA, 25 bp, Mus musculus
aaacagcacgcatggaggacgacct

SEQ ID NO: 6105 - DNA, 25 bp, Mus musculus
aaacagcactttcaaacccacaatt

SEQ ID NO: 6106 - DNA, 25 bp, Mus musculus
aaacagcactttgaaacccacaatt

SEQ ID NO: 6107 - DNA, 25 bp, Mus musculus
aaacagcagcatacatccacggttg

SEQ ID NO: 6108 - DNA, 25 bp, Mus musculus
aaacagcagcatcggctcaggtgcc

SEQ ID NO: 6109 - DNA, 25 bp, Mus musculus
aaacagcagcatgggctcaggtgcc

SEQ ID NO: 6110 - DNA, 25 bp, Mus musculus
aaacagcagcattcatccacggttg

SEQ ID NO: 6111 - DNA, 25 bp, Mus musculus
aaacagcagcttatcgaaacatgaa

SEQ ID NO: 6112 - DNA, 25 bp, Mus musculus
aaacagcagcttttcgaaacatgaa

SEQ ID NO: 6113 - DNA, 25 bp, Mus musculus
aaacagcaggatctgtagacccgga

SEQ ID NO: 6114 - DNA, 25 bp, Mus musculus
aaacagcaggatgtgtagacccgga

SEQ ID NO: 6115 - DNA, 25 bp, Mus musculus
aaacagcaggcacccgtgtttgctg

SEQ ID NO: 6116 - DNA, 25 bp, Mus musculus
aaacagcaggcagccgtgtttgctg

SEQ ID NO: 6117 - DNA, 25 bp, Mus musculus
aaacagcaggccctgtgaagatcct

SEQ ID NO: 6118 - DNA, 25 bp, Mus musculus
aaacagcaggccgtgtgaagatcct

SEQ ID NO: 6119 - DNA, 25 bp, Mus musculus
aaacagcagggtatgagcacaatct

SEQ ID NO: 6120 - DNA, 25 bp, Mus musculus
aaacagcagggtttgagcacaatct

SEQ ID NO: 6121 - DNA, 25 bp, Mus musculus
aaacagcagtgcacggtgcaggcag

SEQ ID NO: 6122 - DNA, 25 bp, Mus musculus
aaacagcagtgcatccgggatagaa

SEQ ID NO: 6123 - DNA, 25 bp, Mus musculus
aaacagcagtgctcggtgcaggcag

SEQ ID NO: 6124 - DNA, 25 bp, Mus musculus
aaacagcagtgcttccgggatagaa

SEQ ID NO: 6125 - DNA, 25 bp, Mus musculus
aaacagcagtgtatagcatgtgcta

SEQ ID NO: 6126 - DNA, 25 bp, Mus musculus
aaacagcagtgtctcgagtgataat

SEQ ID NO: 6127 - DNA, 25 bp, Mus musculus
aaacagcagtgtgtcgagtgataat

SEQ ID NO: 6128 - DNA, 25 bp, Mus musculus
aaacagcagtgtttagcatgtgcta

SEQ ID NO: 6129 - DNA, 25 bp, Mus musculus
aaacagcatcttagtggtccccacc

SEQ ID NO: 6130 - DNA, 25 bp, Mus musculus
aaacagcatcttccaggtctctgca

SEQ ID NO: 6131 - DNA, 25 bp, Mus musculus
aaacagcatcttgcaggtctctgca

SEQ ID NO: 6132 - DNA, 25 bp, Mus musculus
aaacagcatctttgtggtccccacc

SEQ ID NO: 6133 - DNA, 25 bp, Mus musculus
aaacagcatgctactctatagagtc

SEQ ID NO: 6134 - DNA, 25 bp, Mus musculus
aaacagcatgcttctctatagagtc

SEQ ID NO: 6135 - DNA, 25 bp, Mus musculus
aaacagcatggcactcatatgacaa

SEQ ID NO: 6136 - DNA, 25 bp, Mus musculus
aaacagcatggctctcatatgacaa

SEQ ID NO: 6137 - DNA, 25 bp, Mus musculus
aaacagcatgttctcacagcagtcc

SEQ ID NO: 6138 - DNA, 25 bp, Mus musculus
aaacagcatgttgtcacagcagtcc

SEQ ID NO: 6139 - DNA, 25 bp, Mus musculus
aaacagcattacagggtgcctgaga

SEQ ID NO: 6140 - DNA, 25 bp, Mus musculus
aaacagcattactgggtgcctgaga

SEQ ID NO: 6141 - DNA, 25 bp, Mus musculus
aaacagccaaacaccatgcaaatat

SEQ ID NO: 6142 - DNA, 25 bp, Mus musculus
aaacagccaaactccatgcaaatat

SEQ ID NO: 6143 - DNA, 25 bp, Mus musculus
aaacagccactgaagggtcttctaa

SEQ ID NO: 6144 - DNA, 25 bp, Mus musculus
aaacagccactgtagggtcttctaa

SEQ ID NO: 6145 - DNA, 25 bp, Mus musculus
aaacagccagaacctcagggctgga

SEQ ID NO: 6146 - DNA, 25 bp, Mus musculus
aaacagccagaagctcagggctgga

SEQ ID NO: 6147 - DNA, 25 bp, Mus musculus
aaacagccccagctacagcaaggta

SEQ ID NO: 6148 - DNA, 25 bp, Mus musculus
aaacagccccaggtacagcaaggta

SEQ ID NO: 6149 - DNA, 25 bp, Mus musculus
aaacagccctccattctatgttaat

SEQ ID NO: 6150 - DNA, 25 bp, Mus musculus
aaacagccctcctttctatgttaat

SEQ ID NO: 6151 - DNA, 25 bp, Mus musculus
aaacagccggatatcagattctgaa

SEQ ID NO: 6152 - DNA, 25 bp, Mus musculus
aaacagccggatttcagattctgaa

SEQ ID NO: 6153 - DNA, 25 bp, Mus musculus
aaacagccgggcagaatccacatca

SEQ ID NO: 6154 - DNA, 25 bp, Mus musculus
aaacagccgggctgaatccacatca

SEQ ID NO: 6155 - DNA, 25 bp, Mus musculus
aaacagcctagccaacatagcgcgt

SEQ ID NO: 6156 - DNA, 25 bp, Mus musculus
aaacagcctagcgaacatagcgcgt

SEQ ID NO: 6157 - DNA, 25 bp, Mus musculus
aaacagcctctaacagccattgata

SEQ ID NO: 6158 - DNA, 25 bp, Mus musculus
aaacagcctctatcagccattgata

SEQ ID NO: 6159 - DNA, 25 bp, Mus musculus
aaacagcctctgacacttctgttct

SEQ ID NO: 6160 - DNA, 25 bp, Mus musculus
aaacagcctctgtcacttctgttct

SEQ ID NO: 6161 - DNA, 25 bp, Mus musculus
aaacagcgactcagccttacactgg

SEQ ID NO: 6162 - DNA, 25 bp, Mus musculus
aaacagcgactctgccttacactgg

SEQ ID NO: 6163 - DNA, 25 bp, Mus musculus
aaacagcgccatacagctaccgtgt

SEQ ID NO: 6164 - DNA, 25 bp, Mus musculus
aaacagcgccattcagctaccgtgt

SEQ ID NO: 6165 - DNA, 25 bp, Mus musculus
aaacagcgcctcatacattcaagat

SEQ ID NO: 6166 - DNA, 25 bp, Mus musculus
aaacagcgcctcttacattcaagat

SEQ ID NO: 6167 - DNA, 25 bp, Mus musculus
aaacagcggtatcgttcgtgccaaa

SEQ ID NO: 6168 - DNA, 25 bp, Mus musculus
aaacagcggtatggttcgtgccaaa

SEQ ID NO: 6169 - DNA, 25 bp, Mus musculus
aaacagcgtcctcctgttcgattag

SEQ ID NO: 6170 - DNA, 25 bp, Mus musculus
aaacagcgtcctgctgttcgattag

SEQ ID NO: 6171 - DNA, 25 bp, Mus musculus
aaacagcgtggccatatgaccatcc

SEQ ID NO: 6172 - DNA, 25 bp, Mus musculus
aaacagcgtggcgatatgaccatcc

SEQ ID NO: 6173 - DNA, 25 bp, Mus musculus
aaacagcgttggattgatccctgtc

SEQ ID NO: 6174 - DNA, 25 bp, Mus musculus
aaacagcgttggtttgatccctgtc

SEQ ID NO: 6175 - DNA, 25 bp, Mus musculus
aaacagctactactggtccgtcaag

SEQ ID NO: 6176 - DNA, 25 bp, Mus musculus
aaacagctactagtggtccgtcaag

SEQ ID NO: 6177 - DNA, 25 bp, Mus musculus
aaacagctaggcaacacaggtgcag

SEQ ID NO: 6178 - DNA, 25 bp, Mus musculus
aaacagctaggcagatttccaggca

SEQ ID NO: 6179 - DNA, 25 bp, Mus musculus
aaacagctaggctacacaggtgcag

SEQ ID NO: 6180 - DNA, 25 bp, Mus musculus
aaacagctaggctgatttccaggca

SEQ ID NO: 6181 - DNA, 25 bp, Mus musculus
aaacagctcactatgtgtctgtgtg

SEQ ID NO: 6182 - DNA, 25 bp, Mus musculus
aaacagctcactttgtgtctgtgtg

SEQ ID NO: 6183 - DNA, 25 bp, Mus musculus
aaacagctcagtagaatgggcacct

SEQ ID NO: 6184 - DNA, 25 bp, Mus musculus
aaacagctcagttgaatgggcacct

SEQ ID NO: 6185 - DNA, 25 bp, Mus musculus
aaacagctcccaacaaaccaacgtg

SEQ ID NO: 6186 - DNA, 25 bp, Mus musculus
aaacagctcccatcaaaccaacgtg

SEQ ID NO: 6187 - DNA, 25 bp, Mus musculus
aaacagctcgctagattctaatatc

SEQ ID NO: 6188 - DNA, 25 bp, Mus musculus
aaacagctcgcttgattctaatatc

SEQ ID NO: 6189 - DNA, 25 bp, Mus musculus
aaacagctcttcatgtgaggctcct

SEQ ID NO: 6190 - DNA, 25 bp, Mus musculus
aaacagctcttcttgtgaggctcct

SEQ ID NO: 6191 - DNA, 25 bp, Mus musculus
aaacagctcttgacaggatgggtaa

SEQ ID NO: 6192 - DNA, 25 bp, Mus musculus
aaacagctcttgtcaggatgggtaa

SEQ ID NO: 6193 - DNA, 25 bp, Mus musculus
aaacagctgcgactggctgctctga

SEQ ID NO: 6194 - DNA, 25 bp, Mus musculus
aaacagctgcgagtggctgctctga

SEQ ID NO: 6195 - DNA, 25 bp, Mus musculus
aaacagctgctgactgcgacggagc

SEQ ID NO: 6196 - DNA, 25 bp, Mus musculus
aaacagctgctgaggcttcaagccc

SEQ ID NO: 6197 - DNA, 25 bp, Mus musculus
aaacagctgctgtctgcgacggagc

SEQ ID NO: 6198 - DNA, 25 bp, Mus musculus
aaacagctgctgtggcttcaagccc

SEQ ID NO: 6199 - DNA, 25 bp, Mus musculus
aaacagctgcttaacttggagaagt

SEQ ID NO: 6200 - DNA, 25 bp, Mus musculus
aaacagctgcttccttaattttatt

SEQ ID NO: 6201 - DNA, 25 bp, Mus musculus
aaacagctgcttgcttaattttatt

SEQ ID NO: 6202 - DNA, 25 bp, Mus musculus
aaacagctgctttacttggagaagt

SEQ ID NO: 6203 - DNA, 25 bp, Mus musculus
aaacagctgggcctagtagcacctg

SEQ ID NO: 6204 - DNA, 25 bp, Mus musculus
aaacagctgggcgtagtagcacctg

SEQ ID NO: 6205 - DNA, 25 bp, Mus musculus
aaacagctggttctgaccgttggcc

SEQ ID NO: 6206 - DNA, 25 bp, Mus musculus
aaacagctggttgtgaccgttggcc

SEQ ID NO: 6207 - DNA, 25 bp, Mus musculus
aaacagctgtacctcacatcctgct

SEQ ID NO: 6208 - DNA, 25 bp, Mus musculus
aaacagctgtacgtcacatcctgct

SEQ ID NO: 6209 - DNA, 25 bp, Mus musculus
aaacagctgtccctgttacccaatt

SEQ ID NO: 6210 - DNA, 25 bp, Mus musculus
aaacagctgtccgtgttacccaatt

SEQ ID NO: 6211 - DNA, 25 bp, Mus musculus
aaacagcttcatagagcctgacccc

SEQ ID NO: 6212 - DNA, 25 bp, Mus musculus
aaacagcttcattgagcctgacccc

SEQ ID NO: 6213 - DNA, 25 bp, Mus musculus
aaacagcttgaccagccccacagat

SEQ ID NO: 6214 - DNA, 25 bp, Mus musculus
aaacagcttgacgagccccacagat

SEQ ID NO: 6215 - DNA, 25 bp, Mus musculus
aaacagcttgtcaggctaagatgtg

SEQ ID NO: 6216 - DNA, 25 bp, Mus musculus
aaacagcttgtctggctaagatgtg

SEQ ID NO: 6217 - DNA, 25 bp, Mus musculus
aaacagcttgttccacaagcctcag

SEQ ID NO: 6218 - DNA, 25 bp, Mus musculus
aaacagcttgttgcacaagcctcag

SEQ ID NO: 6219 - DNA, 25 bp, Mus musculus
aaacagctttggcattttccagcat

SEQ ID NO: 6220 - DNA, 25 bp, Mus musculus
aaacagctttgggattttccagcat

SEQ ID NO: 6221 - DNA, 25 bp, Mus musculus
aaacaggaaactccttcttgacaat

SEQ ID NO: 6222 - DNA, 25 bp, Mus musculus
aaacaggaaactgcttcttgacaat

SEQ ID NO: 6223 - DNA, 25 bp, Mus musculus
aaacaggaacgaattattctggctc

SEQ ID NO: 6224 - DNA, 25 bp, Mus musculus
aaacaggaacgatttattctggctc

SEQ ID NO: 6225 - DNA, 25 bp, Mus musculus
aaacaggaactgatgactaggcagc

SEQ ID NO: 6226 - DNA, 25 bp, Mus musculus
aaacaggaactgttgactaggcagc

SEQ ID NO: 6227 - DNA, 25 bp, Mus musculus
aaacaggaagagatagatacaaaca

SEQ ID NO: 6228 - DNA, 25 bp, Mus musculus
aaacaggaagagttagatacaaaca

SEQ ID NO: 6229 - DNA, 25 bp, Mus musculus
aaacaggaatcccaaggcctccgca

SEQ ID NO: 6230 - DNA, 25 bp, Mus musculus
aaacaggaatccgaaggcctccgca

SEQ ID NO: 6231 - DNA, 25 bp, Mus musculus
aaacaggaatctccatactggaaaa

SEQ ID NO: 6232 - DNA, 25 bp, Mus musculus
aaacaggaatctgcatactggaaaa

SEQ ID NO: 6233 - DNA, 25 bp, Mus musculus
aaacaggacaacattcaacagcagc

SEQ ID NO: 6234 - DNA, 25 bp, Mus musculus
aaacaggacaactttcaacagcagc

SEQ ID NO: 6235 - DNA, 25 bp, Mus musculus
aaacaggacacaatctcatggcaaa

SEQ ID NO: 6236 - DNA, 25 bp, Mus musculus
aaacaggacacattctcatggcaaa

SEQ ID NO: 6237 - DNA, 25 bp, Mus musculus
aaacaggacagtctatggactgaaa

SEQ ID NO: 6238 - DNA, 25 bp, Mus musculus
aaacaggacagtgtatggactgaaa

SEQ ID NO: 6239 - DNA, 25 bp, Mus musculus
aaacaggacatactgcccagcgcag

SEQ ID NO: 6240 - DNA, 25 bp, Mus musculus
aaacaggacatagtgcccagcgcag

SEQ ID NO: 6241 - DNA, 25 bp, Mus musculus
aaacaggacatcactatcacactca

SEQ ID NO: 6242 - DNA, 25 bp, Mus musculus
aaacaggacatctctatcacactca

SEQ ID NO: 6243 - DNA, 25 bp, Mus musculus
aaacaggacccacctctcaggtgtg

SEQ ID NO: 6244 - DNA, 25 bp, Mus musculus
aaacaggacccagctctcaggtgtg

SEQ ID NO: 6245 - DNA, 25 bp, Mus musculus
aaacaggactgacgagctggacaca

SEQ ID NO: 6246 - DNA, 25 bp, Mus musculus
aaacaggactgaggagctggacaca

SEQ ID NO: 6247 - DNA, 25 bp, Mus musculus
aaacaggacttcattcaccttctca

SEQ ID NO: 6248 - DNA, 25 bp, Mus musculus
aaacaggacttctttcaccttctca

SEQ ID NO: 6249 - DNA, 25 bp, Mus musculus
aaacaggagcctcctaaggaacaat

SEQ ID NO: 6250 - DNA, 25 bp, Mus musculus
aaacaggagcctgctaaggaacaat

SEQ ID NO: 6251 - DNA, 25 bp, Mus musculus
aaacaggagtcgctcggagtccatg

SEQ ID NO: 6252 - DNA, 25 bp, Mus musculus
aaacaggagtcggtcggagtccatg

SEQ ID NO: 6253 - DNA, 25 bp, Mus musculus
aaacaggagtctagcatggctgtcc

SEQ ID NO: 6254 - DNA, 25 bp, Mus musculus
aaacaggagtcttgcatggctgtcc

SEQ ID NO: 6255 - DNA, 25 bp, Mus musculus
aaacaggatcaacgcccttcttgga

SEQ ID NO: 6256 - DNA, 25 bp, Mus musculus
aaacaggatcaaggcccttcttgga

SEQ ID NO: 6257 - DNA, 25 bp, Mus musculus
aaacaggatcagagcctttggctac

SEQ ID NO: 6258 - DNA, 25 bp, Mus musculus
aaacaggatcagtgcctttggctac

SEQ ID NO: 6259 - DNA, 25 bp, Mus musculus
aaacaggatcgcactatgtagctct

SEQ ID NO: 6260 - DNA, 25 bp, Mus musculus
aaacaggatcgctctatgtagctct

SEQ ID NO: 6261 - DNA, 25 bp, Mus musculus
aaacaggattccaacaagtcgattt

SEQ ID NO: 6262 - DNA, 25 bp, Mus musculus
aaacaggattcctacaagtcgattt

SEQ ID NO: 6263 - DNA, 25 bp, Mus musculus
aaacaggcaaccatcgagtgcatat

SEQ ID NO: 6264 - DNA, 25 bp, Mus musculus
aaacaggcaaccttcgagtgcatat

SEQ ID NO: 6265 - DNA, 25 bp, Mus musculus
aaacaggcaatactcggcgcaattt

SEQ ID NO: 6266 - DNA, 25 bp, Mus musculus
aaacaggcaatagtcggcgcaattt

SEQ ID NO: 6267 - DNA, 25 bp, Mus musculus
aaacaggcacacaatgcaccaggca

SEQ ID NO: 6268 - DNA, 25 bp, Mus musculus
aaacaggcacactatgcaccaggca

SEQ ID NO: 6269 - DNA, 25 bp, Mus musculus
aaacaggcaccactggtcccaagtt

SEQ ID NO: 6270 - DNA, 25 bp, Mus musculus
aaacaggcaccagtggtcccaagtt

SEQ ID NO: 6271 - DNA, 25 bp, Mus musculus
aaacaggcagacactgtagcaagct

SEQ ID NO: 6272 - DNA, 25 bp, Mus musculus
aaacaggcagactctgtagcaagct

SEQ ID NO: 6273 - DNA, 25 bp, Mus musculus
aaacaggcagagagcatccacctcc

SEQ ID NO: 6274 - DNA, 25 bp, Mus musculus
aaacaggcagagtgcatccacctcc

SEQ ID NO: 6275 - DNA, 25 bp, Mus musculus
aaacaggcatgcagaagtccctcca

SEQ ID NO: 6276 - DNA, 25 bp, Mus musculus
aaacaggcatgctgaagtccctcca

SEQ ID NO: 6277 - DNA, 25 bp, Mus musculus
aaacaggccaagaggtgcccctgtc

SEQ ID NO: 6278 - DNA, 25 bp, Mus musculus
aaacaggccaagtggtgcccctgtc

SEQ ID NO: 6279 - DNA, 25 bp, Mus musculus
aaacaggccattcaaagacagttat

SEQ ID NO: 6280 - DNA, 25 bp, Mus musculus
aaacaggccattgaaagacagttat

SEQ ID NO: 6281 - DNA, 25 bp, Mus musculus
aaacaggcccagaagaacctcagga

SEQ ID NO: 6282 - DNA, 25 bp, Mus musculus
aaacaggcccagtagaacctcagga

SEQ ID NO: 6283 - DNA, 25 bp, Mus musculus
aaacaggcccttcgtatgtagtcag

SEQ ID NO: 6284 - DNA, 25 bp, Mus musculus
aaacaggcccttggtatgtagtcag

SEQ ID NO: 6285 - DNA, 25 bp, Mus musculus
aaacaggcgcagaagcgttagctcc

SEQ ID NO: 6286 - DNA, 25 bp, Mus musculus
aaacaggcgcagtagcgttagctcc

SEQ ID NO: 6287 - DNA, 25 bp, Mus musculus
aaacaggcgtgcagccacaggaaca

SEQ ID NO: 6288 - DNA, 25 bp, Mus musculus
aaacaggcgtgctgccacaggaaca

SEQ ID NO: 6289 - DNA, 25 bp, Mus musculus
aaacaggctaccattgtgtcttggt

SEQ ID NO: 6290 - DNA, 25 bp, Mus musculus
aaacaggctacctttgtgtcttggt

SEQ ID NO: 6291 - DNA, 25 bp, Mus musculus
aaacaggctatgatgggccattcaa

SEQ ID NO: 6292 - DNA, 25 bp, Mus musculus
aaacaggctatgttgggccattcaa

SEQ ID NO: 6293 - DNA, 25 bp, Mus musculus
aaacaggctgatagtatctgtccct

SEQ ID NO: 6294 - DNA, 25 bp, Mus musculus
aaacaggctgattgtatctgtccct

SEQ ID NO: 6295 - DNA, 25 bp, Mus musculus
aaacaggctgccatttactggaagt

SEQ ID NO: 6296 - DNA, 25 bp, Mus musculus
aaacaggctgccttttactggaagt

SEQ ID NO: 6297 - DNA, 25 bp, Mus musculus
aaacaggctgtaagtccatcaccac

SEQ ID NO: 6298 - DNA, 25 bp, Mus musculus
aaacaggctgtaccacaaacaccat

SEQ ID NO: 6299 - DNA, 25 bp, Mus musculus
aaacaggctgtagcacaaacaccat

SEQ ID NO: 6300 - DNA, 25 bp, Mus musculus
aaacaggctgtatgtccatcaccac

SEQ ID NO: 6301 - DNA, 25 bp, Mus musculus
aaacagggaatgaggcagagcagct

SEQ ID NO: 6302 - DNA, 25 bp, Mus musculus
aaacagggaatgtggcagagcagct

SEQ ID NO: 6303 - DNA, 25 bp, Mus musculus
aaacagggcaaaccggtgacgtcat

SEQ ID NO: 6304 - DNA, 25 bp, Mus musculus
aaacagggcaaagcggtgacgtcat

SEQ ID NO: 6305 - DNA, 25 bp, Mus musculus
aaacagggcaacaggctgaaccatt

SEQ ID NO: 6306 - DNA, 25 bp, Mus musculus
aaacagggcaactggctgaaccatt

SEQ ID NO: 6307 - DNA, 25 bp, Mus musculus
aaacagggctcaaatggctcataga

SEQ ID NO: 6308 - DNA, 25 bp, Mus musculus
aaacagggctcatatggctcataga

SEQ ID NO: 6309 - DNA, 25 bp, Mus musculus
aaacagggctcgagcttgtggcctg

SEQ ID NO: 6310 - DNA, 25 bp, Mus musculus
aaacagggctcgtgcttgtggcctg

SEQ ID NO: 6311 - DNA, 25 bp, Mus musculus
aaacagggtattctaacacatgagt

SEQ ID NO: 6312 - DNA, 25 bp, Mus musculus
aaacagggtattgtaacacatgagt

SEQ ID NO: 6313 - DNA, 25 bp, Mus musculus
aaacagggtgagagttcctcccgct

SEQ ID NO: 6314 - DNA, 25 bp, Mus musculus
aaacagggtgagtgttcctcccgct

SEQ ID NO: 6315 - DNA, 25 bp, Mus musculus
aaacagggtggcaagacgctattct

SEQ ID NO: 6316 - DNA, 25 bp, Mus musculus
aaacagggtggctagacgctattct

SEQ ID NO: 6317 - DNA, 25 bp, Mus musculus
aaacagggttgcctgctccagccaa

SEQ ID NO: 6318 - DNA, 25 bp, Mus musculus
aaacagggttgcgtgctccagccaa

SEQ ID NO: 6319 - DNA, 25 bp, Mus musculus
aaacagggtttcacgtagcccagcg

SEQ ID NO: 6320 - DNA, 25 bp, Mus musculus
aaacagggtttcatgtggcactgct

SEQ ID NO: 6321 - DNA, 25 bp, Mus musculus
aaacagggtttctcgtagcccagcg

SEQ ID NO: 6322 - DNA, 25 bp, Mus musculus
aaacagggtttcttgtggcactgct

SEQ ID NO: 6323 - DNA, 25 bp, Mus musculus
aaacaggtagctctccataaggaaa

SEQ ID NO: 6324 - DNA, 25 bp, Mus musculus
aaacaggtagctgtccataaggaaa

SEQ ID NO: 6325 - DNA, 25 bp, Mus musculus
aaacaggtagtcaagctgaagacaa

SEQ ID NO: 6326 - DNA, 25 bp, Mus musculus
aaacaggtagtctagctgaagacaa

SEQ ID NO: 6327 - DNA, 25 bp, Mus musculus
aaacaggtcctgcatggttcatttg

SEQ ID NO: 6328 - DNA, 25 bp, Mus musculus
aaacaggtcctggatggttcatttg

SEQ ID NO: 6329 - DNA, 25 bp, Mus musculus
aaacaggtgagaactgcagcagggc

SEQ ID NO: 6330 - DNA, 25 bp, Mus musculus
aaacaggtgagatctgcagcagggc

SEQ ID NO: 6331 - DNA, 25 bp, Mus musculus
aaacaggtgccaactttgtttgggt

SEQ ID NO: 6332 - DNA, 25 bp, Mus musculus
aaacaggtgccatctttgtttgggt

SEQ ID NO: 6333 - DNA, 25 bp, Mus musculus
aaacaggtggcaacaggtcaccgct

SEQ ID NO: 6334 - DNA, 25 bp, Mus musculus
aaacaggtggcatcaggtcaccgct

SEQ ID NO: 6335 - DNA, 25 bp, Mus musculus
aaacaggtggctagatggcactcct

SEQ ID NO: 6336 - DNA, 25 bp, Mus musculus
aaacaggtggcttgatggcactcct

SEQ ID NO: 6337 - DNA, 25 bp, Mus musculus
aaacaggtgtatcaccatccctacc

SEQ ID NO: 6338 - DNA, 25 bp, Mus musculus
aaacaggtgtatgaccatccctacc

SEQ ID NO: 6339 - DNA, 25 bp, Mus musculus
aaacaggtgtttacatggcccaggg

SEQ ID NO: 6340 - DNA, 25 bp, Mus musculus
aaacaggtgttttcatggcccaggg

SEQ ID NO: 6341 - DNA, 25 bp, Mus musculus
aaacaggttcgccaggcccaaaatg

SEQ ID NO: 6342 - DNA, 25 bp, Mus musculus
aaacaggttcgcgaggcccaaaatg

SEQ ID NO: 6343 - DNA, 25 bp, Mus musculus
aaacaggtttgactttctaatgttg

SEQ ID NO: 6344 - DNA, 25 bp, Mus musculus
aaacaggtttgagtttctaatgttg

SEQ ID NO: 6345 - DNA, 25 bp, Mus musculus
aaacaggttttcattttgatggtag

SEQ ID NO: 6346 - DNA, 25 bp, Mus musculus
aaacaggttttctttttgatggtag

SEQ ID NO: 6347 - DNA, 25 bp, Mus musculus
aaacagtaatgaagacctacagact

SEQ ID NO: 6348 - DNA, 25 bp, Mus musculus
aaacagtaatgatgacctacagact

SEQ ID NO: 6349 - DNA, 25 bp, Mus musculus
aaacagtacccgaagatggcaacta

SEQ ID NO: 6350 - DNA, 25 bp, Mus musculus
aaacagtacccgtagatggcaacta

SEQ ID NO: 6351 - DNA, 25 bp, Mus musculus
aaacagtaccctcctttgccagaga

SEQ ID NO: 6352 - DNA, 25 bp, Mus musculus
aaacagtaccctgctttgccagaga

SEQ ID NO: 6353 - DNA, 25 bp, Mus musculus
aaacagtagcagaaacagtcaacat

SEQ ID NO: 6354 - DNA, 25 bp, Mus musculus
aaacagtagcagtaacagtcaacat

SEQ ID NO: 6355 - DNA, 25 bp, Mus musculus
aaacagtagctgaggtatgcactca

SEQ ID NO: 6356 - DNA, 25 bp, Mus musculus
aaacagtagctgtggtatgcactca

SEQ ID NO: 6357 - DNA, 25 bp, Mus musculus
aaacagtaggataccactccagatg

SEQ ID NO: 6358 - DNA, 25 bp, Mus musculus
aaacagtaggattccactccagatg

SEQ ID NO: 6359 - DNA, 25 bp, Mus musculus
aaacagtagtaccaagaagctcttt

SEQ ID NO: 6360 - DNA, 25 bp, Mus musculus
aaacagtagtacgaagaagctcttt

SEQ ID NO: 6361 - DNA, 25 bp, Mus musculus
aaacagtatagtccaaccttcacca

SEQ ID NO: 6362 - DNA, 25 bp, Mus musculus
aaacagtatagtgcaaccttcacca

SEQ ID NO: 6363 - DNA, 25 bp, Mus musculus
aaacagtatcttactgtcttgaaaa

SEQ ID NO: 6364 - DNA, 25 bp, Mus musculus
aaacagtatctttctgtcttgaaaa

SEQ ID NO: 6365 - DNA, 25 bp, Mus musculus
aaacagtatggcattgaatgctcaa

SEQ ID NO: 6366 - DNA, 25 bp, Mus musculus
aaacagtatggctttgaatgctcaa

SEQ ID NO: 6367 - DNA, 25 bp, Mus musculus
aaacagtcaagtccagtatttctct

SEQ ID NO: 6368 - DNA, 25 bp, Mus musculus
aaacagtcaagtgcagtatttctct

SEQ ID NO: 6369 - DNA, 25 bp, Mus musculus
aaacagtcacttaccttgttctctg

SEQ ID NO: 6370 - DNA, 25 bp, Mus musculus
aaacagtcactttccttgttctctg

SEQ ID NO: 6371 - DNA, 25 bp, Mus musculus
aaacagtcagggacctaatcagtag

SEQ ID NO: 6372 - DNA, 25 bp, Mus musculus
aaacagtcagggtcctaatcagtag

SEQ ID NO: 6373 - DNA, 25 bp, Mus musculus
aaacagtcatctacataagcatgaa

SEQ ID NO: 6374 - DNA, 25 bp, Mus musculus
aaacagtcatcttcataagcatgaa

SEQ ID NO: 6375 - DNA, 25 bp, Mus musculus
aaacagtccaggcagtgtgtgacct

SEQ ID NO: 6376 - DNA, 25 bp, Mus musculus
aaacagtccagggagtgtgtgacct

SEQ ID NO: 6377 - DNA, 25 bp, Mus musculus
aaacagtccagtctaggctagtccc

SEQ ID NO: 6378 - DNA, 25 bp, Mus musculus
aaacagtccagtgtaggctagtccc

SEQ ID NO: 6379 - DNA, 25 bp, Mus musculus
aaacagtcccagaagcagtgcgccc

SEQ ID NO: 6380 - DNA, 25 bp, Mus musculus
aaacagtcccagtagcagtgcgccc

SEQ ID NO: 6381 - DNA, 25 bp, Mus musculus
aaacagtcccatctctcagagcttc

SEQ ID NO: 6382 - DNA, 25 bp, Mus musculus
aaacagtcccatgtctcagagcttc

SEQ ID NO: 6383 - DNA, 25 bp, Mus musculus
aaacagtcctccaagggttcaccat

SEQ ID NO: 6384 - DNA, 25 bp, Mus musculus
aaacagtcctcctagggttcaccat

SEQ ID NO: 6385 - DNA, 25 bp, Mus musculus
aaacagtcctgaaccaggcgacctc

SEQ ID NO: 6386 - DNA, 25 bp, Mus musculus
aaacagtcctgatccaggcgacctc

SEQ ID NO: 6387 - DNA, 25 bp, Mus musculus
aaacagtcctgtctaatgtctccat

SEQ ID NO: 6388 - DNA, 25 bp, Mus musculus
aaacagtcctgtgtaatgtctccat

SEQ ID NO: 6389 - DNA, 25 bp, Mus musculus
aaacagtctaaccacacaacctggg

SEQ ID NO: 6390 - DNA, 25 bp, Mus musculus
aaacagtctaacgacacaacctggg

SEQ ID NO: 6391 - DNA, 25 bp, Mus musculus
aaacagtctggacgctcagtggtca

SEQ ID NO: 6392 - DNA, 25 bp, Mus musculus
aaacagtctggaggctcagtggtca

SEQ ID NO: 6393 - DNA, 25 bp, Mus musculus
aaacagtctgtgaggtcctacatcc

SEQ ID NO: 6394 - DNA, 25 bp, Mus musculus
aaacagtctgtgtggtcctacatcc

SEQ ID NO: 6395 - DNA, 25 bp, Mus musculus
aaacagtctgttacccgctgttgac

SEQ ID NO: 6396 - DNA, 25 bp, Mus musculus
aaacagtctgtttcccgctgttgac

SEQ ID NO: 6397 - DNA, 25 bp, Mus musculus
aaacagtgaacccaggctgcagcct

SEQ ID NO: 6398 - DNA, 25 bp, Mus musculus
aaacagtgaaccgaggctgcagcct

SEQ ID NO: 6399 - DNA, 25 bp, Mus musculus
aaacagtgacaccacacacatgaaa

SEQ ID NO: 6400 - DNA, 25 bp, Mus musculus
aaacagtgacacgacacacatgaaa

SEQ ID NO: 6401 - DNA, 25 bp, Mus musculus
aaacagtgagtgatgtaaccccaat

SEQ ID NO: 6402 - DNA, 25 bp, Mus musculus
aaacagtgagtgttgtaaccccaat

SEQ ID NO: 6403 - DNA, 25 bp, Mus musculus
aaacagtgcacgctctctctgtgta

SEQ ID NO: 6404 - DNA, 25 bp, Mus musculus
aaacagtgcacggtctctctgtgta

SEQ ID NO: 6405 - DNA, 25 bp, Mus musculus
aaacagtgcagacggccgttgttcc

SEQ ID NO: 6406 - DNA, 25 bp, Mus musculus
aaacagtgcagagggccgttgttcc

SEQ ID NO: 6407 - DNA, 25 bp, Mus musculus
aaacagtgcataccattttatttta

SEQ ID NO: 6408 - DNA, 25 bp, Mus musculus
aaacagtgcatagcattttatttta

SEQ ID NO: 6409 - DNA, 25 bp, Mus musculus
aaacagtgcccacttttctataggg

SEQ ID NO: 6410 - DNA, 25 bp, Mus musculus
aaacagtgcccagttttctataggg

SEQ ID NO: 6411 - DNA, 25 bp, Mus musculus
aaacagtgcctgagtgtaccattca

SEQ ID NO: 6412 - DNA, 25 bp, Mus musculus
aaacagtgcctgtgtgtaccattca

SEQ ID NO: 6413 - DNA, 25 bp, Mus musculus
aaacagtgcgcaagccagacccggc

SEQ ID NO: 6414 - DNA, 25 bp, Mus musculus
aaacagtgcgcatgccagacccggc

SEQ ID NO: 6415 - DNA, 25 bp, Mus musculus
aaacagtgcgttcatttttctgtct

SEQ ID NO: 6416 - DNA, 25 bp, Mus musculus
aaacagtgcgttgatttttctgtct

SEQ ID NO: 6417 - DNA, 25 bp, Mus musculus
aaacagtgcttcaccaacatgacag

SEQ ID NO: 6418 - DNA, 25 bp, Mus musculus
aaacagtgcttctccaacatgacag

SEQ ID NO: 6419 - DNA, 25 bp, Mus musculus
aaacagtgctttacatattgtaact

SEQ ID NO: 6420 - DNA, 25 bp, Mus musculus
aaacagtgctttactttagcatcat

SEQ ID NO: 6421 - DNA, 25 bp, Mus musculus
aaacagtgctttctgccatgctttt

SEQ ID NO: 6422 - DNA, 25 bp, Mus musculus
aaacagtgctttgtgccatgctttt

SEQ ID NO: 6423 - DNA, 25 bp, Mus musculus
aaacagtgcttttcatattgtaact

SEQ ID NO: 6424 - DNA, 25 bp, Mus musculus
aaacagtgcttttctttagcatcat

SEQ ID NO: 6425 - DNA, 25 bp, Mus musculus
aaacagtggcatagataatagtctc

SEQ ID NO: 6426 - DNA, 25 bp, Mus musculus
aaacagtggcattgataatagtctc

SEQ ID NO: 6427 - DNA, 25 bp, Mus musculus
aaacagtggccaagatatgtgtcaa

SEQ ID NO: 6428 - DNA, 25 bp, Mus musculus
aaacagtggccatgatatgtgtcaa

SEQ ID NO: 6429 - DNA, 25 bp, Mus musculus
aaacagtgtattagcctgggccttt

SEQ ID NO: 6430 - DNA, 25 bp, Mus musculus
aaacagtgtatttgcctgggccttt

SEQ ID NO: 6431 - DNA, 25 bp, Mus musculus
aaacagtgtcaaaatctccagaaag

SEQ ID NO: 6432 - DNA, 25 bp, Mus musculus
aaacagtgtcaatatctccagaaag

SEQ ID NO: 6433 - DNA, 25 bp, Mus musculus
aaacagtgtcacactgggccccgaa

SEQ ID NO: 6434 - DNA, 25 bp, Mus musculus
aaacagtgtcactctgggccccgaa

SEQ ID NO: 6435 - DNA, 25 bp, Mus musculus
aaacagtgtttccagcccaacgcta

SEQ ID NO: 6436 - DNA, 25 bp, Mus musculus
aaacagtgtttcgagcccaacgcta

SEQ ID NO: 6437 - DNA, 25 bp, Mus musculus
aaacagttactactgagcatttcaa

SEQ ID NO: 6438 - DNA, 25 bp, Mus musculus
aaacagttactagtgagcatttcaa

SEQ ID NO: 6439 - DNA, 25 bp, Mus musculus
aaacagttatcacattcccacaaca

SEQ ID NO: 6440 - DNA, 25 bp, Mus musculus
aaacagttatcagattcccacaaca

SEQ ID NO: 6441 - DNA, 25 bp, Mus musculus
aaacagttcaaacaaattgccgctg

SEQ ID NO: 6442 - DNA, 25 bp, Mus musculus
aaacagttcaaagaaattgccgctg

SEQ ID NO: 6443 - DNA, 25 bp, Mus musculus
aaacagttcagcatacttgcaaaca

SEQ ID NO: 6444 - DNA, 25 bp, Mus musculus
aaacagttcagcttacttgcaaaca

SEQ ID NO: 6445 - DNA, 25 bp, Mus musculus
aaacagttcaggagtcttcagttgc

SEQ ID NO: 6446 - DNA, 25 bp, Mus musculus
aaacagttcaggtgtcttcagttgc

SEQ ID NO: 6447 - DNA, 25 bp, Mus musculus
aaacagttcatcatttgggaaatca

SEQ ID NO: 6448 - DNA, 25 bp, Mus musculus
aaacagttcatcttttgggaaatca

SEQ ID NO: 6449 - DNA, 25 bp, Mus musculus
aaacagttccaacaagccagagagt

SEQ ID NO: 6450 - DNA, 25 bp, Mus musculus
aaacagttccaagaagccagagagt

SEQ ID NO: 6451 - DNA, 25 bp, Mus musculus
aaacagttccacaccttggtgatga

SEQ ID NO: 6452 - DNA, 25 bp, Mus musculus
aaacagttccacaggatcaaaggga

SEQ ID NO: 6453 - DNA, 25 bp, Mus musculus
aaacagttccactccttggtgatga

SEQ ID NO: 6454 - DNA, 25 bp, Mus musculus
aaacagttccactggatcaaaggga

SEQ ID NO: 6455 - DNA, 25 bp, Mus musculus
aaacagttgaggctcgatccccgtg

SEQ ID NO: 6456 - DNA, 25 bp, Mus musculus
aaacagttgagggtcgatccccgtg

SEQ ID NO: 6457 - DNA, 25 bp, Mus musculus
aaacagttgcagaggtcctggacat

SEQ ID NO: 6458 - DNA, 25 bp, Mus musculus
aaacagttgcagtggtcctggacat

SEQ ID NO: 6459 - DNA, 25 bp, Mus musculus
aaacagttgcgcagcagcaccgcga

SEQ ID NO: 6460 - DNA, 25 bp, Mus musculus
aaacagttgcgctgcagcaccgcga

SEQ ID NO: 6461 - DNA, 25 bp, Mus musculus
aaacagttgctgagccagcctgata

SEQ ID NO: 6462 - DNA, 25 bp, Mus musculus
aaacagttgctgaggcagtctggaa

SEQ ID NO: 6463 - DNA, 25 bp, Mus musculus
aaacagttgctgtgccagcctgata

SEQ ID NO: 6464 - DNA, 25 bp, Mus musculus
aaacagttgctgtggcagtctggaa

SEQ ID NO: 6465 - DNA, 25 bp, Mus musculus
aaacagttggcccttgctaagaaga

SEQ ID NO: 6466 - DNA, 25 bp, Mus musculus
aaacagttggccgttgctaagaaga

SEQ ID NO: 6467 - DNA, 25 bp, Mus musculus
aaacagttgggcaggctcactgcat

SEQ ID NO: 6468 - DNA, 25 bp, Mus musculus
aaacagttgggctggctcactgcat

SEQ ID NO: 6469 - DNA, 25 bp, Mus musculus
aaacagttgtatacctacattcaaa

SEQ ID NO: 6470 - DNA, 25 bp, Mus musculus
aaacagttgtattcctacattcaaa

SEQ ID NO: 6471 - DNA, 25 bp, Mus musculus
aaacagttgtttaccgatctctgcc

SEQ ID NO: 6472 - DNA, 25 bp, Mus musculus
aaacagttgtttctggccagaagtg

SEQ ID NO: 6473 - DNA, 25 bp, Mus musculus
aaacagttgtttgtggccagaagtg

SEQ ID NO: 6474 - DNA, 25 bp, Mus musculus
aaacagttgttttccgatctctgcc

SEQ ID NO: 6475 - DNA, 25 bp, Mus musculus
aaacagtttaatcctgtctcagtat

SEQ ID NO: 6476 - DNA, 25 bp, Mus musculus
aaacagtttaatgctgtctcagtat

SEQ ID NO: 6477 - DNA, 25 bp, Mus musculus
aaacagtttctaattcattccacag

SEQ ID NO: 6478 - DNA, 25 bp, Mus musculus
aaacagtttctatttcattccacag

SEQ ID NO: 6479 - DNA, 25 bp, Mus musculus
aaacagtttctcagacggcataaat

SEQ ID NO: 6480 - DNA, 25 bp, Mus musculus
aaacagtttctctgacggcataaat

SEQ ID NO: 6481 - DNA, 25 bp, Mus musculus
aaacagtttgatacacttcttgctt

SEQ ID NO: 6482 - DNA, 25 bp, Mus musculus
aaacagtttgattcacttcttgctt

SEQ ID NO: 6483 - DNA, 25 bp, Mus musculus
aaacagttttagcagtcgaaatgac

SEQ ID NO: 6484 - DNA, 25 bp, Mus musculus
aaacagttttaggagtcgaaatgac

SEQ ID NO: 6485 - DNA, 25 bp, Mus musculus
aaacagttttcactggctccttaag

SEQ ID NO: 6486 - DNA, 25 bp, Mus musculus
aaacagttttcagtggctccttaag

SEQ ID NO: 6487 - DNA, 25 bp, Mus musculus
aaacagttttgtacatttgaggatt

SEQ ID NO: 6488 - DNA, 25 bp, Mus musculus
aaacagttttgttcatttgaggatt

SEQ ID NO: 6489 - DNA, 25 bp, Mus musculus
aaacagtttttgacttgacatagag

SEQ ID NO: 6490 - DNA, 25 bp, Mus musculus
aaacagtttttgtcttgacatagag

SEQ ID NO: 6491 - DNA, 25 bp, Mus musculus
aaacataaatgtcgccggacgtggt

SEQ ID NO: 6492 - DNA, 25 bp, Mus musculus
aaacataaatgtggccggacgtggt

SEQ ID NO: 6493 - DNA, 25 bp, Mus musculus
aaacataacactagtcttcctgcct

SEQ ID NO: 6494 - DNA, 25 bp, Mus musculus
aaacataacacttgtcttcctgcct

SEQ ID NO: 6495 - DNA, 25 bp, Mus musculus
aaacataaggcaacgttttcaatga

SEQ ID NO: 6496 - DNA, 25 bp, Mus musculus
aaacataaggcatcgttttcaatga

SEQ ID NO: 6497 - DNA, 25 bp, Mus musculus
aaacataagtgcagactggctccag

SEQ ID NO: 6498 - DNA, 25 bp, Mus musculus
aaacataagtgctgactggctccag

SEQ ID NO: 6499 - DNA, 25 bp, Mus musculus
aaacataatgttcggccaggcggtg

SEQ ID NO: 6500 - DNA, 25 bp, Mus musculus
aaacataatgttgggccaggcggtg

SEQ ID NO: 6501 - DNA, 25 bp, Mus musculus
aaacatacactcaaatacacttcag

SEQ ID NO: 6502 - DNA, 25 bp, Mus musculus
aaacatacactctaatacacttcag

SEQ ID NO: 6503 - DNA, 25 bp, Mus musculus
aaacatacaggcctaccacttggta

SEQ ID NO: 6504 - DNA, 25 bp, Mus musculus
aaacatacaggcgtaccacttggta

SEQ ID NO: 6505 - DNA, 25 bp, Mus musculus
aaacatacatgactacccatgccag

SEQ ID NO: 6506 - DNA, 25 bp, Mus musculus
aaacatacatgagtacccatgccag

SEQ ID NO: 6507 - DNA, 25 bp, Mus musculus
aaacatacctgcagcttcggtgaga

SEQ ID NO: 6508 - DNA, 25 bp, Mus musculus
aaacatacctgctgcttcggtgaga

SEQ ID NO: 6509 - DNA, 25 bp, Mus musculus
aaacatacgttgaccaccttgctcc

SEQ ID NO: 6510 - DNA, 25 bp, Mus musculus
aaacatacgttgtccaccttgctcc

SEQ ID NO: 6511 - DNA, 25 bp, Mus musculus
aaacatactaacactgccgagcaat

SEQ ID NO: 6512 - DNA, 25 bp, Mus musculus
aaacatactaactctgccgagcaat

SEQ ID NO: 6513 - DNA, 25 bp, Mus musculus
aaacatactcacaggtactctcgtt

SEQ ID NO: 6514 - DNA, 25 bp, Mus musculus
aaacatactcactggtactctcgtt

SEQ ID NO: 6515 - DNA, 25 bp, Mus musculus
aaacatactctcatgccatgtaggt

SEQ ID NO: 6516 - DNA, 25 bp, Mus musculus
aaacatactctcttgccatgtaggt

SEQ ID NO: 6517 - DNA, 25 bp, Mus musculus
aaacatacttgcaaggtcctgatgg

SEQ ID NO: 6518 - DNA, 25 bp, Mus musculus
aaacatacttgctaggtcctgatgg

SEQ ID NO: 6519 - DNA, 25 bp, Mus musculus
aaacatacttttcccagttcagaat

SEQ ID NO: 6520 - DNA, 25 bp, Mus musculus
aaacatacttttgccagttcagaat

SEQ ID NO: 6521 - DNA, 25 bp, Mus musculus
aaacatagacaaagccaggtggtgg

SEQ ID NO: 6522 - DNA, 25 bp, Mus musculus
aaacatagacaatgccaggtggtgg

SEQ ID NO: 6523 - DNA, 25 bp, Mus musculus
aaacatagatcaacaaccgccgcaa

SEQ ID NO: 6524 - DNA, 25 bp, Mus musculus
aaacatagatcaacagccgcctcag

SEQ ID NO: 6525 - DNA, 25 bp, Mus musculus
aaacatagatcatcaaccgccgcaa

SEQ ID NO: 6526 - DNA, 25 bp, Mus musculus
aaacatagatcatcagccgcctcag

SEQ ID NO: 6527 - DNA, 25 bp, Mus musculus
aaacatagatttctgtctccttaga

SEQ ID NO: 6528 - DNA, 25 bp, Mus musculus
aaacatagatttgtgtctccttaga

SEQ ID NO: 6529 - DNA, 25 bp, Mus musculus
aaacatagccatagagttccttacc

SEQ ID NO: 6530 - DNA, 25 bp, Mus musculus
aaacatagccattgagttccttacc

SEQ ID NO: 6531 - DNA, 25 bp, Mus musculus
aaacatagctcacggcattggcttc

SEQ ID NO: 6532 - DNA, 25 bp, Mus musculus
aaacatagctcagggcattggcttc

SEQ ID NO: 6533 - DNA, 25 bp, Mus musculus
aaacataggcaccatatccggcttt

SEQ ID NO: 6534 - DNA, 25 bp, Mus musculus
aaacataggcacgatatccggcttt

SEQ ID NO: 6535 - DNA, 25 bp, Mus musculus
aaacataggcctatgtgctggttag

SEQ ID NO: 6536 - DNA, 25 bp, Mus musculus
aaacataggcctttgtgctggttag

SEQ ID NO: 6537 - DNA, 25 bp, Mus musculus
aaacatagtgccctgctgctgaaga

SEQ ID NO: 6538 - DNA, 25 bp, Mus musculus
aaacatagtgccgtgctgctgaaga

SEQ ID NO: 6539 - DNA, 25 bp, Mus musculus
aaacatatacagatacaccagtagt

SEQ ID NO: 6540 - DNA, 25 bp, Mus musculus
aaacatatacagttacaccagtagt

SEQ ID NO: 6541 - DNA, 25 bp, Mus musculus
aaacatatagtaaatactgcctgcc

SEQ ID NO: 6542 - DNA, 25 bp, Mus musculus
aaacatatagtatatactgcctgcc

SEQ ID NO: 6543 - DNA, 25 bp, Mus musculus
aaacatatcagaccccagttgacgc

SEQ ID NO: 6544 - DNA, 25 bp, Mus musculus
aaacatatcagagcccagttgacgc

SEQ ID NO: 6545 - DNA, 25 bp, Mus musculus
aaacatatcaggatccgtgtgtcac

SEQ ID NO: 6546 - DNA, 25 bp, Mus musculus
aaacatatcaggttccgtgtgtcac

SEQ ID NO: 6547 - DNA, 25 bp, Mus musculus
aaacatatcccacatatccacatat

SEQ ID NO: 6548 - DNA, 25 bp, Mus musculus
aaacatatcccagatatccacatat

SEQ ID NO: 6549 - DNA, 25 bp, Mus musculus
aaacatatccccaagaccggttcag

SEQ ID NO: 6550 - DNA, 25 bp, Mus musculus
aaacatatcccctagaccggttcag

SEQ ID NO: 6551 - DNA, 25 bp, Mus musculus
aaacatatcctgagactttcttcac

SEQ ID NO: 6552 - DNA, 25 bp, Mus musculus
aaacatatcctgtgactttcttcac

SEQ ID NO: 6553 - DNA, 25 bp, Mus musculus
aaacatatctcacgcttctttttct

SEQ ID NO: 6554 - DNA, 25 bp, Mus musculus
aaacatatctcaggcttctttttct

SEQ ID NO: 6555 - DNA, 25 bp, Mus musculus
aaacatatctccattgtgcctccca

SEQ ID NO: 6556 - DNA, 25 bp, Mus musculus
aaacatatctcctttgtgcctccca

SEQ ID NO: 6557 - DNA, 25 bp, Mus musculus
aaacatatgaacactgccggtgtcc

SEQ ID NO: 6558 - DNA, 25 bp, Mus musculus
aaacatatgaactctgccggtgtcc

SEQ ID NO: 6559 - DNA, 25 bp, Mus musculus
aaacatatgaggcatttttccttta

SEQ ID NO: 6560 - DNA, 25 bp, Mus musculus
aaacatatgagggatttttccttta

SEQ ID NO: 6561 - DNA, 25 bp, Mus musculus
aaacatatgggtcggtctctttcag

SEQ ID NO: 6562 - DNA, 25 bp, Mus musculus
aaacatatgggtgggtctctttcag

SEQ ID NO: 6563 - DNA, 25 bp, Mus musculus
aaacatattccccagtatcctcaag

SEQ ID NO: 6564 - DNA, 25 bp, Mus musculus
aaacatattcccgagtatcctcaag

SEQ ID NO: 6565 - DNA, 25 bp, Mus musculus
aaacatatttctcattcctacagga

SEQ ID NO: 6566 - DNA, 25 bp, Mus musculus
aaacatatttctgattcctacagga

SEQ ID NO: 6567 - DNA, 25 bp, Mus musculus
aaacatatttgaatactgcagggaa

SEQ ID NO: 6568 - DNA, 25 bp, Mus musculus
aaacatatttgattactgcagggaa

SEQ ID NO: 6569 - DNA, 25 bp, Mus musculus
aaacatatttttctgggtgctccta

SEQ ID NO: 6570 - DNA, 25 bp, Mus musculus
aaacatatttttgtgggtgctccta

SEQ ID NO: 6571 - DNA, 25 bp, Mus musculus
aaacatcaacatatatggagtgcct

SEQ ID NO: 6572 - DNA, 25 bp, Mus musculus
aaacatcaacatttatggagtgcct

SEQ ID NO: 6573 - DNA, 25 bp, Mus musculus
aaacatcaacccaagcattttcctt

SEQ ID NO: 6574 - DNA, 25 bp, Mus musculus
aaacatcaaccctagcattttcctt

SEQ ID NO: 6575 - DNA, 25 bp, Mus musculus
aaacatcaagttatgccccggttca

SEQ ID NO: 6576 - DNA, 25 bp, Mus musculus
aaacatcaagttttgccccggttca

SEQ ID NO: 6577 - DNA, 25 bp, Mus musculus
aaacatcacattatcacttcctctc

SEQ ID NO: 6578 - DNA, 25 bp, Mus musculus
aaacatcacattttcacttcctctc

SEQ ID NO: 6579 - DNA, 25 bp, Mus musculus
aaacatcaccaaatgctactgcata

SEQ ID NO: 6580 - DNA, 25 bp, Mus musculus
aaacatcaccaattgctactgcata

SEQ ID NO: 6581 - DNA, 25 bp, Mus musculus
aaacatcaccttacatagagcgaat

SEQ ID NO: 6582 - DNA, 25 bp, Mus musculus
aaacatcacctttcatagagcgaat

SEQ ID NO: 6583 - DNA, 25 bp, Mus musculus
aaacatcacgtgagaccaagagaca

SEQ ID NO: 6584 - DNA, 25 bp, Mus musculus
aaacatcacgtgtgaccaagagaca

SEQ ID NO: 6585 - DNA, 25 bp, Mus musculus
aaacatcactaacagtttcactgat

SEQ ID NO: 6586 - DNA, 25 bp, Mus musculus
aaacatcactaagagtttcactgat

SEQ ID NO: 6587 - DNA, 25 bp, Mus musculus
aaacatcactgtaccttcttcagta

SEQ ID NO: 6588 - DNA, 25 bp, Mus musculus
aaacatcactgttccttcttcagta

SEQ ID NO: 6589 - DNA, 25 bp, Mus musculus
aaacatcagaatctcctcttctaag

SEQ ID NO: 6590 - DNA, 25 bp, Mus musculus
aaacatcagaatgtcctcttctaag

SEQ ID NO: 6591 - DNA, 25 bp, Mus musculus
aaacatcagaccacattcctagaac

SEQ ID NO: 6592 - DNA, 25 bp, Mus musculus
aaacatcagacctcattcctagaac

SEQ ID NO: 6593 - DNA, 25 bp, Mus musculus
aaacatcagattctctctttttgct

SEQ ID NO: 6594 - DNA, 25 bp, Mus musculus
aaacatcagattgtctctttttgct

SEQ ID NO: 6595 - DNA, 25 bp, Mus musculus
aaacatcagcgcactttgctctttg

SEQ ID NO: 6596 - DNA, 25 bp, Mus musculus
aaacatcagcgctctttgctctttg

SEQ ID NO: 6597 - DNA, 25 bp, Mus musculus
aaacatcaggacaccctagtgctgg

SEQ ID NO: 6598 - DNA, 25 bp, Mus musculus
aaacatcaggaccagcctaggccca

SEQ ID NO: 6599 - DNA, 25 bp, Mus musculus
aaacatcaggacgagcctaggccca

SEQ ID NO: 6600 - DNA, 25 bp, Mus musculus
aaacatcaggactccctagtgctgg

SEQ ID NO: 6601 - DNA, 25 bp, Mus musculus
aaacatcaggctcgaactcagcgtt

SEQ ID NO: 6602 - DNA, 25 bp, Mus musculus
aaacatcaggctggaactcagcgtt

SEQ ID NO: 6603 - DNA, 25 bp, Mus musculus
aaacatcaggtgagggcacgcctta

SEQ ID NO: 6604 - DNA, 25 bp, Mus musculus
aaacatcaggtgtgggcacgcctta

SEQ ID NO: 6605 - DNA, 25 bp, Mus musculus
aaacatcagtgcagtaccttcaata

SEQ ID NO: 6606 - DNA, 25 bp, Mus musculus
aaacatcagtgctgtaccttcaata

SEQ ID NO: 6607 - DNA, 25 bp, Mus musculus
aaacatcatcacaggagccctgaaa

SEQ ID NO: 6608 - DNA, 25 bp, Mus musculus
aaacatcatcactggagccctgaaa

SEQ ID NO: 6609 - DNA, 25 bp, Mus musculus
aaacatcatgtacccgagcactagc

SEQ ID NO: 6610 - DNA, 25 bp, Mus musculus
aaacatcatgtagccgagcactagc

SEQ ID NO: 6611 - DNA, 25 bp, Mus musculus
aaacatcatgtcatccattttttgg

SEQ ID NO: 6612 - DNA, 25 bp, Mus musculus
aaacatcatgtcttccattttttgg

SEQ ID NO: 6613 - DNA, 25 bp, Mus musculus
aaacatcatgttcacatgctgtctg

SEQ ID NO: 6614 - DNA, 25 bp, Mus musculus
aaacatcatgttgacatgctgtctg

SEQ ID NO: 6615 - DNA, 25 bp, Mus musculus
aaacatccaggacggcatcagcaca

SEQ ID NO: 6616 - DNA, 25 bp, Mus musculus
aaacatccaggagggcatcagcaca

SEQ ID NO: 6617 - DNA, 25 bp, Mus musculus
aaacatccatacctttgtccatttg

SEQ ID NO: 6618 - DNA, 25 bp, Mus musculus
aaacatccatacgtttgtccatttg

SEQ ID NO: 6619 - DNA, 25 bp, Mus musculus
aaacatccattcataagactatcag

SEQ ID NO: 6620 - DNA, 25 bp, Mus musculus
aaacatccattcttaagactatcag

SEQ ID NO: 6621 - DNA, 25 bp, Mus musculus
aaacatcccaataatgtgagtgtac

SEQ ID NO: 6622 - DNA, 25 bp, Mus musculus
aaacatcccaattatgtgagtgtac

SEQ ID NO: 6623 - DNA, 25 bp, Mus musculus
aaacatccctggattcccttctaat

SEQ ID NO: 6624 - DNA, 25 bp, Mus musculus
aaacatccctggctcagagagactc

SEQ ID NO: 6625 - DNA, 25 bp, Mus musculus
aaacatccctgggtcagagagactc

SEQ ID NO: 6626 - DNA, 25 bp, Mus musculus
aaacatccctggtttcccttctaat

SEQ ID NO: 6627 - DNA, 25 bp, Mus musculus
aaacatccgactaccttaaggtgct

SEQ ID NO: 6628 - DNA, 25 bp, Mus musculus
aaacatccgacttccttaaggtgct

SEQ ID NO: 6629 - DNA, 25 bp, Mus musculus
aaacatccgagcaatttattgccgc

SEQ ID NO: 6630 - DNA, 25 bp, Mus musculus
aaacatccgagctatttattgccgc

SEQ ID NO: 6631 - DNA, 25 bp, Mus musculus
aaacatcctcagactttgtagttct

SEQ ID NO: 6632 - DNA, 25 bp, Mus musculus
aaacatcctcagtctttgtagttct

SEQ ID NO: 6633 - DNA, 25 bp, Mus musculus
aaacatcctgtaagctgagctggta

SEQ ID NO: 6634 - DNA, 25 bp, Mus musculus
aaacatcctgtatgctgagctggta

SEQ ID NO: 6635 - DNA, 25 bp, Mus musculus
aaacatccttcactcttaatttcaa

SEQ ID NO: 6636 - DNA, 25 bp, Mus musculus
aaacatccttcagtcttaatttcaa

SEQ ID NO: 6637 - DNA, 25 bp, Mus musculus
aaacatccttttcatagacgctcaa

SEQ ID NO: 6638 - DNA, 25 bp, Mus musculus
aaacatccttttgatagacgctcaa

SEQ ID NO: 6639 - DNA, 25 bp, Mus musculus
aaacatcgaacacccaggattctgg

SEQ ID NO: 6640 - DNA, 25 bp, Mus musculus
aaacatcgaacagccaggattctgg

SEQ ID NO: 6641 - DNA, 25 bp, Mus musculus
aaacatcgggttaggagtctggact

SEQ ID NO: 6642 - DNA, 25 bp, Mus musculus
aaacatcgggtttggagtctggact

SEQ ID NO: 6643 - DNA, 25 bp, Mus musculus
aaacatcgttgtagacaggttgaat

SEQ ID NO: 6644 - DNA, 25 bp, Mus musculus
aaacatcgttgttgacaggttgaat

SEQ ID NO: 6645 - DNA, 25 bp, Mus musculus
aaacatctagctcgatctcgcagcc

SEQ ID NO: 6646 - DNA, 25 bp, Mus musculus
aaacatctagctggatctcgcagcc

SEQ ID NO: 6647 - DNA, 25 bp, Mus musculus
aaacatctatctcctagttcctcct

SEQ ID NO: 6648 - DNA, 25 bp, Mus musculus
aaacatctatctgctagttcctcct

SEQ ID NO: 6649 - DNA, 25 bp, Mus musculus
aaacatctattcataggctgcccta

SEQ ID NO: 6650 - DNA, 25 bp, Mus musculus
aaacatctattcttaggctgcccta

SEQ ID NO: 6651 - DNA, 25 bp, Mus musculus
aaacatctcagccaagcatttacct

SEQ ID NO: 6652 - DNA, 25 bp, Mus musculus
aaacatctcagcgaagcatttacct

SEQ ID NO: 6653 - DNA, 25 bp, Mus musculus
aaacatctcatcaacgtagaaggaa

SEQ ID NO: 6654 - DNA, 25 bp, Mus musculus
aaacatctcatctacgtagaaggaa

SEQ ID NO: 6655 - DNA, 25 bp, Mus musculus
aaacatctcctgacacacctatagt

SEQ ID NO: 6656 - DNA, 25 bp, Mus musculus
aaacatctcctgtcacacctatagt

SEQ ID NO: 6657 - DNA, 25 bp, Mus musculus
aaacatctccttccatttttattgg

SEQ ID NO: 6658 - DNA, 25 bp, Mus musculus
aaacatctccttgcatttttattgg

SEQ ID NO: 6659 - DNA, 25 bp, Mus musculus
aaacatctcgttatatgacctgata

SEQ ID NO: 6660 - DNA, 25 bp, Mus musculus
aaacatctcgttttatgacctgata

SEQ ID NO: 6661 - DNA, 25 bp, Mus musculus
aaacatctgagaatggctttcccat

SEQ ID NO: 6662 - DNA, 25 bp, Mus musculus
aaacatctgagattggctttcccat

SEQ ID NO: 6663 - DNA, 25 bp, Mus musculus
aaacatctgataagcactgctcaaa

SEQ ID NO: 6664 - DNA, 25 bp, Mus musculus
aaacatctgatatgcactgctcaaa

SEQ ID NO: 6665 - DNA, 25 bp, Mus musculus
aaacatctgattactggcctcacat

SEQ ID NO: 6666 - DNA, 25 bp, Mus musculus
aaacatctgatttctggcctcacat

SEQ ID NO: 6667 - DNA, 25 bp, Mus musculus
aaacatctgcccctatgcatttgcc

SEQ ID NO: 6668 - DNA, 25 bp, Mus musculus
aaacatctgcccgtatgcatttgcc

SEQ ID NO: 6669 - DNA, 25 bp, Mus musculus
aaacatctgcggctgtgcgcatcca

SEQ ID NO: 6670 - DNA, 25 bp, Mus musculus
aaacatctgcgggtgtgcgcatcca

SEQ ID NO: 6671 - DNA, 25 bp, Mus musculus
aaacatctgctcactaaccacaatt

SEQ ID NO: 6672 - DNA, 25 bp, Mus musculus
aaacatctgctctctaaccacaatt

SEQ ID NO: 6673 - DNA, 25 bp, Mus musculus
aaacatctgtaaaccagcttactgt

SEQ ID NO: 6674 - DNA, 25 bp, Mus musculus
aaacatctgtaatccagcttactgt

SEQ ID NO: 6675 - DNA, 25 bp, Mus musculus
aaacatcttaacatgactgctgccc

SEQ ID NO: 6676 - DNA, 25 bp, Mus musculus
aaacatcttaacttgactgctgccc

SEQ ID NO: 6677 - DNA, 25 bp, Mus musculus
aaacatcttaccaaacctctcattc

SEQ ID NO: 6678 - DNA, 25 bp, Mus musculus
aaacatcttacctaacctctcattc

SEQ ID NO: 6679 - DNA, 25 bp, Mus musculus
aaacatctttatactttgggcagaa

SEQ ID NO: 6680 - DNA, 25 bp, Mus musculus
aaacatctttattctttgggcagaa

SEQ ID NO: 6681 - DNA, 25 bp, Mus musculus
aaacatctttctcattcttggtcaa

SEQ ID NO: 6682 - DNA, 25 bp, Mus musculus
aaacatctttctgattcttggtcaa

SEQ ID NO: 6683 - DNA, 25 bp, Mus musculus
aaacatctttgtccccttaggtcag

SEQ ID NO: 6684 - DNA, 25 bp, Mus musculus
aaacatctttgtgcccttaggtcag

SEQ ID NO: 6685 - DNA, 25 bp, Mus musculus
aaacatcttttgatcaggattcaga

SEQ ID NO: 6686 - DNA, 25 bp, Mus musculus
aaacatcttttgttcaggattcaga

SEQ ID NO: 6687 - DNA, 25 bp, Mus musculus
aaacatgaactaacactctgtcccg

SEQ ID NO: 6688 - DNA, 25 bp, Mus musculus
aaacatgaactatcactctgtcccg

SEQ ID NO: 6689 - DNA, 25 bp, Mus musculus
aaacatgaagacacaactaacgaga

SEQ ID NO: 6690 - DNA, 25 bp, Mus musculus
aaacatgaagactcaactaacgaga

SEQ ID NO: 6691 - DNA, 25 bp, Mus musculus
aaacatgaatgaaggccagccccag

SEQ ID NO: 6692 - DNA, 25 bp, Mus musculus
aaacatgaatgatggccagccccag

SEQ ID NO: 6693 - DNA, 25 bp, Mus musculus
aaacatgacagaatggaatcctcct

SEQ ID NO: 6694 - DNA, 25 bp, Mus musculus
aaacatgacagattggaatcctcct

SEQ ID NO: 6695 - DNA, 25 bp, Mus musculus
aaacatgacgttatacttctgaata

SEQ ID NO: 6696 - DNA, 25 bp, Mus musculus
aaacatgacgttttacttctgaata

SEQ ID NO: 6697 - DNA, 25 bp, Mus musculus
aaacatgactggatgtccctgtact

SEQ ID NO: 6698 - DNA, 25 bp, Mus musculus
aaacatgactggttgtccctgtact

SEQ ID NO: 6699 - DNA, 25 bp, Mus musculus
aaacatgagattcccgatgcctgtg

SEQ ID NO: 6700 - DNA, 25 bp, Mus musculus
aaacatgagattgccgatgcctgtg

SEQ ID NO: 6701 - DNA, 25 bp, Mus musculus
aaacatgagcctcgtctgcgggcag

SEQ ID NO: 6702 - DNA, 25 bp, Mus musculus
aaacatgagcctggtctgcgggcag

SEQ ID NO: 6703 - DNA, 25 bp, Mus musculus
aaacatgagcggattcatctgcccc

SEQ ID NO: 6704 - DNA, 25 bp, Mus musculus
aaacatgagcggtttcatctgcccc

SEQ ID NO: 6705 - DNA, 25 bp, Mus musculus
aaacatgagtagagtctaggcccca

SEQ ID NO: 6706 - DNA, 25 bp, Mus musculus
aaacatgagtagtgtctaggcccca

SEQ ID NO: 6707 - DNA, 25 bp, Mus musculus
aaacatgagtgtcttccagtgtcca

SEQ ID NO: 6708 - DNA, 25 bp, Mus musculus
aaacatgagtgtgttccagtgtcca

SEQ ID NO: 6709 - DNA, 25 bp, Mus musculus
aaacatgattcgaaagctccctttc

SEQ ID NO: 6710 - DNA, 25 bp, Mus musculus
aaacatgattcgtaagctccctttc

SEQ ID NO: 6711 - DNA, 25 bp, Mus musculus
aaacatgattgtcattctggaagga

SEQ ID NO: 6712 - DNA, 25 bp, Mus musculus
aaacatgattgtgattctggaagga

SEQ ID NO: 6713 - DNA, 25 bp, Mus musculus
aaacatgatttcacgcacactgcag

SEQ ID NO: 6714 - DNA, 25 bp, Mus musculus
aaacatgatttctcgcacactgcag

SEQ ID NO: 6715 - DNA, 25 bp, Mus musculus
aaacatgcaaacagacatacggaca

SEQ ID NO: 6716 - DNA, 25 bp, Mus musculus
aaacatgcaaactgacatacggaca

SEQ ID NO: 6717 - DNA, 25 bp, Mus musculus
aaacatgcacttagaggtctgcccc

SEQ ID NO: 6718 - DNA, 25 bp, Mus musculus
aaacatgcactttgaggtctgcccc

SEQ ID NO: 6719 - DNA, 25 bp, Mus musculus
aaacatgcagctcagtaacacacct

SEQ ID NO: 6720 - DNA, 25 bp, Mus musculus
aaacatgcagctgagtaacacacct

SEQ ID NO: 6721 - DNA, 25 bp, Mus musculus
aaacatgcaggaaggtcttaggtga

SEQ ID NO: 6722 - DNA, 25 bp, Mus musculus
aaacatgcaggaatggagcttgaaa

SEQ ID NO: 6723 - DNA, 25 bp, Mus musculus
aaacatgcaggatggtcttaggtga

SEQ ID NO: 6724 - DNA, 25 bp, Mus musculus
aaacatgcaggattggagcttgaaa

SEQ ID NO: 6725 - DNA, 25 bp, Mus musculus
aaacatgcaggcatgtcactacaac

SEQ ID NO: 6726 - DNA, 25 bp, Mus musculus
aaacatgcaggcttgtcactacaac

SEQ ID NO: 6727 - DNA, 25 bp, Mus musculus
aaacatgccacgagtctgcaaagga

SEQ ID NO: 6728 - DNA, 25 bp, Mus musculus
aaacatgccacgtgtctgcaaagga

SEQ ID NO: 6729 - DNA, 25 bp, Mus musculus
aaacatgccccacaaagcagcaagt

SEQ ID NO: 6730 - DNA, 25 bp, Mus musculus
aaacatgccccagaaagcagcaagt

SEQ ID NO: 6731 - DNA, 25 bp, Mus musculus
aaacatgccttaactctggtaatag

SEQ ID NO: 6732 - DNA, 25 bp, Mus musculus
aaacatgccttatctctggtaatag

SEQ ID NO: 6733 - DNA, 25 bp, Mus musculus
aaacatgcgttcatgtggaactggt

SEQ ID NO: 6734 - DNA, 25 bp, Mus musculus
aaacatgcgttcttgtggaactggt

SEQ ID NO: 6735 - DNA, 25 bp, Mus musculus
aaacatgcgtttactctggttcctt

SEQ ID NO: 6736 - DNA, 25 bp, Mus musculus
aaacatgcgttttctctggttcctt

SEQ ID NO: 6737 - DNA, 25 bp, Mus musculus
aaacatgctccgctggcattgcaac

SEQ ID NO: 6738 - DNA, 25 bp, Mus musculus
aaacatgctccggtggcattgcaac

SEQ ID NO: 6739 - DNA, 25 bp, Mus musculus
aaacatgctctcagaatttattcat

SEQ ID NO: 6740 - DNA, 25 bp, Mus musculus
aaacatgctctctgaatttattcat

SEQ ID NO: 6741 - DNA, 25 bp, Mus musculus
aaacatgctcttctgagtgtgaaat

SEQ ID NO: 6742 - DNA, 25 bp, Mus musculus
aaacatgctcttgtgagtgtgaaat

SEQ ID NO: 6743 - DNA, 25 bp, Mus musculus
aaacatgctgacagagacccgggct

SEQ ID NO: 6744 - DNA, 25 bp, Mus musculus
aaacatgctgactgagacccgggct

SEQ ID NO: 6745 - DNA, 25 bp, Mus musculus
aaacatgctgttaccatatatgcgc

SEQ ID NO: 6746 - DNA, 25 bp, Mus musculus
aaacatgctgtttccatatatgcgc

SEQ ID NO: 6747 - DNA, 25 bp, Mus musculus
aaacatgcttcaccttccatcggtt

SEQ ID NO: 6748 - DNA, 25 bp, Mus musculus
aaacatgcttcagcttccatcggtt

SEQ ID NO: 6749 - DNA, 25 bp, Mus musculus
aaacatgcttggctaccttcataag

SEQ ID NO: 6750 - DNA, 25 bp, Mus musculus
aaacatgcttgggtaccttcataag

SEQ ID NO: 6751 - DNA, 25 bp, Mus musculus
aaacatgctttgacactgttgcaaa

SEQ ID NO: 6752 - DNA, 25 bp, Mus musculus
aaacatgctttgtcactgttgcaaa

SEQ ID NO: 6753 - DNA, 25 bp, Mus musculus
aaacatggagccagtggctgaccgg

SEQ ID NO: 6754 - DNA, 25 bp, Mus musculus
aaacatggagcctgtggctgaccgg

SEQ ID NO: 6755 - DNA, 25 bp, Mus musculus
aaacatggcatgagccttggctaat

SEQ ID NO: 6756 - DNA, 25 bp, Mus musculus
aaacatggcatgtgccttggctaat

SEQ ID NO: 6757 - DNA, 25 bp, Mus musculus
aaacatggccgtatactctgaggca

SEQ ID NO: 6758 - DNA, 25 bp, Mus musculus
aaacatggccgtttactctgaggca

SEQ ID NO: 6759 - DNA, 25 bp, Mus musculus
aaacatggcgttcttcctttggcca

SEQ ID NO: 6760 - DNA, 25 bp, Mus musculus
aaacatggcgttgttcctttggcca

SEQ ID NO: 6761 - DNA, 25 bp, Mus musculus
aaacatggctgcacttttcctaagg

SEQ ID NO: 6762 - DNA, 25 bp, Mus musculus
aaacatggctgctcttttcctaagg

SEQ ID NO: 6763 - DNA, 25 bp, Mus musculus
aaacatgggcagatccgagccagat

SEQ ID NO: 6764 - DNA, 25 bp, Mus musculus
aaacatgggcagttccgagccagat

SEQ ID NO: 6765 - DNA, 25 bp, Mus musculus
aaacatgggtctaatttatttactg

SEQ ID NO: 6766 - DNA, 25 bp, Mus musculus
aaacatgggtctacccaggctaagt

SEQ ID NO: 6767 - DNA, 25 bp, Mus musculus
aaacatgggtcttatttatttactg

SEQ ID NO: 6768 - DNA, 25 bp, Mus musculus
aaacatgggtcttcccaggctaagt

SEQ ID NO: 6769 - DNA, 25 bp, Mus musculus
aaacatggtacgaaggtgtggctgt

SEQ ID NO: 6770 - DNA, 25 bp, Mus musculus
aaacatggtacgtaggtgtggctgt

SEQ ID NO: 6771 - DNA, 25 bp, Mus musculus
aaacatggtagcacgtgcacaccac

SEQ ID NO: 6772 - DNA, 25 bp, Mus musculus
aaacatggtagctcgtgcacaccac

SEQ ID NO: 6773 - DNA, 25 bp, Mus musculus
aaacatggtgtgatggagctgctga

SEQ ID NO: 6774 - DNA, 25 bp, Mus musculus
aaacatggtgtgttggagctgctga

SEQ ID NO: 6775 - DNA, 25 bp, Mus musculus
aaacatggtttcacttatccctttg

SEQ ID NO: 6776 - DNA, 25 bp, Mus musculus
aaacatggtttctcttatccctttg

SEQ ID NO: 6777 - DNA, 25 bp, Mus musculus
aaacatgtacataccaaggctgagc

SEQ ID NO: 6778 - DNA, 25 bp, Mus musculus
aaacatgtacattccaaggctgagc

SEQ ID NO: 6779 - DNA, 25 bp, Mus musculus
aaacatgtacgtctcaccatcctta

SEQ ID NO: 6780 - DNA, 25 bp, Mus musculus
aaacatgtacgtgtcaccatcctta

SEQ ID NO: 6781 - DNA, 25 bp, Mus musculus
aaacatgtactgctgtgatcttgta

SEQ ID NO: 6782 - DNA, 25 bp, Mus musculus
aaacatgtactggtgtgatcttgta

SEQ ID NO: 6783 - DNA, 25 bp, Mus musculus
aaacatgtacttcaagcagctggca

SEQ ID NO: 6784 - DNA, 25 bp, Mus musculus
aaacatgtacttgaagcagctggca

SEQ ID NO: 6785 - DNA, 25 bp, Mus musculus
aaacatgtataacctgctgtctttg

SEQ ID NO: 6786 - DNA, 25 bp, Mus musculus
aaacatgtataagctgctgtctttg

SEQ ID NO: 6787 - DNA, 25 bp, Mus musculus
aaacatgtatccacctagactttaa

SEQ ID NO: 6788 - DNA, 25 bp, Mus musculus
aaacatgtatcctcctagactttaa

SEQ ID NO: 6789 - DNA, 25 bp, Mus musculus
aaacatgtatgcaaccccaccataa

SEQ ID NO: 6790 - DNA, 25 bp, Mus musculus
aaacatgtatgctaccccaccataa

SEQ ID NO: 6791 - DNA, 25 bp, Mus musculus
aaacatgtcattaccctatctgtag

SEQ ID NO: 6792 - DNA, 25 bp, Mus musculus
aaacatgtcattctgggctatccag

SEQ ID NO: 6793 - DNA, 25 bp, Mus musculus
aaacatgtcattgtgggctatccag

SEQ ID NO: 6794 - DNA, 25 bp, Mus musculus
aaacatgtcatttccctatctgtag

SEQ ID NO: 6795 - DNA, 25 bp, Mus musculus
aaacatgtcctgaagtgtcaaccac

SEQ ID NO: 6796 - DNA, 25 bp, Mus musculus
aaacatgtcctgtagtgtcaaccac

SEQ ID NO: 6797 - DNA, 25 bp, Mus musculus
aaacatgtcgtacctatgcagtata

SEQ ID NO: 6798 - DNA, 25 bp, Mus musculus
aaacatgtcgtagctatgcagtata

SEQ ID NO: 6799 - DNA, 25 bp, Mus musculus
aaacatgtcgttatgtcttctccag

SEQ ID NO: 6800 - DNA, 25 bp, Mus musculus
aaacatgtcgttttgtcttctccag

SEQ ID NO: 6801 - DNA, 25 bp, Mus musculus
aaacatgtctatctcttctttgcca

SEQ ID NO: 6802 - DNA, 25 bp, Mus musculus
aaacatgtctatgtcttctttgcca

SEQ ID NO: 6803 - DNA, 25 bp, Mus musculus
aaacatgtcttcaagctactgatca

SEQ ID NO: 6804 - DNA, 25 bp, Mus musculus
aaacatgtcttctagctactgatca

SEQ ID NO: 6805 - DNA, 25 bp, Mus musculus
aaacatgtctttaccttttcaggct

SEQ ID NO: 6806 - DNA, 25 bp, Mus musculus
aaacatgtctttctctattagcact

SEQ ID NO: 6807 - DNA, 25 bp, Mus musculus
aaacatgtctttgtctattagcact

SEQ ID NO: 6808 - DNA, 25 bp, Mus musculus
aaacatgtcttttccttttcaggct

SEQ ID NO: 6809 - DNA, 25 bp, Mus musculus
aaacatgtgaagacctttggcttag

SEQ ID NO: 6810 - DNA, 25 bp, Mus musculus
aaacatgtgaagtcctttggcttag

SEQ ID NO: 6811 - DNA, 25 bp, Mus musculus
aaacatgtgattagccccagacatt

SEQ ID NO: 6812 - DNA, 25 bp, Mus musculus
aaacatgtgatttgccccagacatt

SEQ ID NO: 6813 - DNA, 25 bp, Mus musculus
aaacatgtggttaccttagtgccga

SEQ ID NO: 6814 - DNA, 25 bp, Mus musculus
aaacatgtggtttccttagtgccga

SEQ ID NO: 6815 - DNA, 25 bp, Mus musculus
aaacatgttattagtgacacagttc

SEQ ID NO: 6816 - DNA, 25 bp, Mus musculus
aaacatgttatttgtgacacagttc

SEQ ID NO: 6817 - DNA, 25 bp, Mus musculus
aaacatgttcacattgtaggacaaa

SEQ ID NO: 6818 - DNA, 25 bp, Mus musculus
aaacatgttcactttgtaggacaaa

SEQ ID NO: 6819 - DNA, 25 bp, Mus musculus
aaacatgttcctccttttctaagtg

SEQ ID NO: 6820 - DNA, 25 bp, Mus musculus
aaacatgttcctgcttttctaagtg

SEQ ID NO: 6821 - DNA, 25 bp, Mus musculus
aaacatgttcttccgtactgctgtt

SEQ ID NO: 6822 - DNA, 25 bp, Mus musculus
aaacatgttcttgcgtactgctgtt

SEQ ID NO: 6823 - DNA, 25 bp, Mus musculus
aaacatgttgtgaggctttgcttcc

SEQ ID NO: 6824 - DNA, 25 bp, Mus musculus
aaacatgttgtgtggctttgcttcc

SEQ ID NO: 6825 - DNA, 25 bp, Mus musculus
aaacatgttttgacttttgtgtaag

SEQ ID NO: 6826 - DNA, 25 bp, Mus musculus
aaacatgttttgtcttttgtgtaag

SEQ ID NO: 6827 - DNA, 25 bp, Mus musculus
aaacattaaactagccatggcgatt

SEQ ID NO: 6828 - DNA, 25 bp, Mus musculus
aaacattaaacttgccatggcgatt

SEQ ID NO: 6829 - DNA, 25 bp, Mus musculus
aaacattacccacggctgatgggaa

SEQ ID NO: 6830 - DNA, 25 bp, Mus musculus
aaacattacccagggctgatgggaa

SEQ ID NO: 6831 - DNA, 25 bp, Mus musculus
aaacattaccccaaactcatactag

SEQ ID NO: 6832 - DNA, 25 bp, Mus musculus
aaacattacccctaactcatactag

SEQ ID NO: 6833 - DNA, 25 bp, Mus musculus
aaacattagacaaagtggcacttac

SEQ ID NO: 6834 - DNA, 25 bp, Mus musculus
aaacattagacatagtggcacttac

SEQ ID NO: 6835 - DNA, 25 bp, Mus musculus
aaacattagagacacttgctgcccc

SEQ ID NO: 6836 - DNA, 25 bp, Mus musculus
aaacattagagagacttgctgcccc

SEQ ID NO: 6837 - DNA, 25 bp, Mus musculus
aaacattagctaccctcctttggag

SEQ ID NO: 6838 - DNA, 25 bp, Mus musculus
aaacattagctagcctcctttggag

SEQ ID NO: 6839 - DNA, 25 bp, Mus musculus
aaacattcaataatcgaggtacaga

SEQ ID NO: 6840 - DNA, 25 bp, Mus musculus
aaacattcaatattcgaggtacaga

SEQ ID NO: 6841 - DNA, 25 bp, Mus musculus
aaacattcactcctgggctagagag

SEQ ID NO: 6842 - DNA, 25 bp, Mus musculus
aaacattcactcgtgggctagagag

SEQ ID NO: 6843 - DNA, 25 bp, Mus musculus
aaacattcagctcctggttttacaa

SEQ ID NO: 6844 - DNA, 25 bp, Mus musculus
aaacattcagctgctggttttacaa

SEQ ID NO: 6845 - DNA, 25 bp, Mus musculus
aaacattcagggacctctcatttct

SEQ ID NO: 6846 - DNA, 25 bp, Mus musculus
aaacattcagggtcctctcatttct

SEQ ID NO: 6847 - DNA, 25 bp, Mus musculus
aaacattcatcacatggcttggcaa

SEQ ID NO: 6848 - DNA, 25 bp, Mus musculus
aaacattcatcagatggcttggcaa

SEQ ID NO: 6849 - DNA, 25 bp, Mus musculus
aaacattcattgctgaaccactggg

SEQ ID NO: 6850 - DNA, 25 bp, Mus musculus
aaacattcattggtgaaccactggg

SEQ ID NO: 6851 - DNA, 25 bp, Mus musculus
aaacattccaagaagcccagtcaga

SEQ ID NO: 6852 - DNA, 25 bp, Mus musculus
aaacattccaagatctccacatact

SEQ ID NO: 6853 - DNA, 25 bp, Mus musculus
aaacattccaagtagcccagtcaga

SEQ ID NO: 6854 - DNA, 25 bp, Mus musculus
aaacattccaagttctccacatact

SEQ ID NO: 6855 - DNA, 25 bp, Mus musculus
aaacattcctcacattttttacctg

SEQ ID NO: 6856 - DNA, 25 bp, Mus musculus
aaacattcctcagattttttacctg

SEQ ID NO: 6857 - DNA, 25 bp, Mus musculus
aaacattcctggcagagcatccgct

SEQ ID NO: 6858 - DNA, 25 bp, Mus musculus
aaacattcctgggagagcatccgct

SEQ ID NO: 6859 - DNA, 25 bp, Mus musculus
aaacattcctgtaagcatggcaatt

SEQ ID NO: 6860 - DNA, 25 bp, Mus musculus
aaacattcctgttagcatggcaatt

SEQ ID NO: 6861 - DNA, 25 bp, Mus musculus
aaacattcgctgactatatctgcca

SEQ ID NO: 6862 - DNA, 25 bp, Mus musculus
aaacattcgctgtctatatctgcca

SEQ ID NO: 6863 - DNA, 25 bp, Mus musculus
aaacattctacaacccactccgaat

SEQ ID NO: 6864 - DNA, 25 bp, Mus musculus
aaacattctacatcccactccgaat

SEQ ID NO: 6865 - DNA, 25 bp, Mus musculus
aaacattctagacctcttcggatct

SEQ ID NO: 6866 - DNA, 25 bp, Mus musculus
aaacattctagagctcttcggatct

SEQ ID NO: 6867 - DNA, 25 bp, Mus musculus
aaacattctcgcagtctatgactta

SEQ ID NO: 6868 - DNA, 25 bp, Mus musculus
aaacattctcgctgtctatgactta

SEQ ID NO: 6869 - DNA, 25 bp, Mus musculus
aaacattctctacatttctccaaat

SEQ ID NO: 6870 - DNA, 25 bp, Mus musculus
aaacattctctagatttctccaaat

SEQ ID NO: 6871 - DNA, 25 bp, Mus musculus
aaacattctctcaggtggctgctga

SEQ ID NO: 6872 - DNA, 25 bp, Mus musculus
aaacattctctctggtggctgctga

SEQ ID NO: 6873 - DNA, 25 bp, Mus musculus
aaacattctcttaggctgcagataa

SEQ ID NO: 6874 - DNA, 25 bp, Mus musculus
aaacattctctttggctgcagataa

SEQ ID NO: 6875 - DNA, 25 bp, Mus musculus
aaacattctgttaagctatcaatat

SEQ ID NO: 6876 - DNA, 25 bp, Mus musculus
aaacattctgtttagctatcaatat

SEQ ID NO: 6877 - DNA, 25 bp, Mus musculus
aaacattcttacaagactgtacatt

SEQ ID NO: 6878 - DNA, 25 bp, Mus musculus
aaacattcttactagactgtacatt

SEQ ID NO: 6879 - DNA, 25 bp, Mus musculus
aaacattcttcaactgtctgctctg

SEQ ID NO: 6880 - DNA, 25 bp, Mus musculus
aaacattcttcatctgtctgctctg

SEQ ID NO: 6881 - DNA, 25 bp, Mus musculus
aaacattcttgcataggtcccctga

SEQ ID NO: 6882 - DNA, 25 bp, Mus musculus
aaacattcttgcttaggtcccctga

SEQ ID NO: 6883 - DNA, 25 bp, Mus musculus
aaacattgaaggcactctgtgccaa

SEQ ID NO: 6884 - DNA, 25 bp, Mus musculus
aaacattgaagggactctgtgccaa

SEQ ID NO: 6885 - DNA, 25 bp, Mus musculus
aaacattgacgccaatcaccgccaa

SEQ ID NO: 6886 - DNA, 25 bp, Mus musculus
aaacattgacgcgaatcaccgccaa

SEQ ID NO: 6887 - DNA, 25 bp, Mus musculus
aaacattgatgtaacctcttctgta

SEQ ID NO: 6888 - DNA, 25 bp, Mus musculus
aaacattgatgttacctcttctgta

SEQ ID NO: 6889 - DNA, 25 bp, Mus musculus
aaacattgctacaacagacctttcc

SEQ ID NO: 6890 - DNA, 25 bp, Mus musculus
aaacattgctactacagacctttcc

SEQ ID NO: 6891 - DNA, 25 bp, Mus musculus
aaacattgctctctttagtctggct

SEQ ID NO: 6892 - DNA, 25 bp, Mus musculus
aaacattgctctgtttagtctggct

SEQ ID NO: 6893 - DNA, 25 bp, Mus musculus
aaacattggattaacagacttgaga

SEQ ID NO: 6894 - DNA, 25 bp, Mus musculus
aaacattggattcatatttcctgtt

SEQ ID NO: 6895 - DNA, 25 bp, Mus musculus
aaacattggattgatatttcctgtt

SEQ ID NO: 6896 - DNA, 25 bp, Mus musculus
aaacattggatttacagacttgaga

SEQ ID NO: 6897 - DNA, 25 bp, Mus musculus
aaacattggctaatcctttggaggc

SEQ ID NO: 6898 - DNA, 25 bp, Mus musculus
aaacattggctattcctttggaggc

SEQ ID NO: 6899 - DNA, 25 bp, Mus musculus
aaacattggtggacatctgcagcct

SEQ ID NO: 6900 - DNA, 25 bp, Mus musculus
aaacattggtggtcatctgcagcct

SEQ ID NO: 6901 - DNA, 25 bp, Mus musculus
aaacattgtagaccattttgtagag

SEQ ID NO: 6902 - DNA, 25 bp, Mus musculus
aaacattgtagagcattttgtagag

SEQ ID NO: 6903 - DNA, 25 bp, Mus musculus
aaacattgtagtctagtttctggaa

SEQ ID NO: 6904 - DNA, 25 bp, Mus musculus
aaacattgtagtgtagtttctggaa

SEQ ID NO: 6905 - DNA, 25 bp, Mus musculus
aaacattgtcttcatttgtagccaa

SEQ ID NO: 6906 - DNA, 25 bp, Mus musculus
aaacattgtcttgatttgtagccaa

SEQ ID NO: 6907 - DNA, 25 bp, Mus musculus
aaacattgtggaacttcattaagga

SEQ ID NO: 6908 - DNA, 25 bp, Mus musculus
aaacattgtggacctgaagaccgag

SEQ ID NO: 6909 - DNA, 25 bp, Mus musculus
aaacattgtggagctgaagaccgag

SEQ ID NO: 6910 - DNA, 25 bp, Mus musculus
aaacattgtggatcttcattaagga

SEQ ID NO: 6911 - DNA, 25 bp, Mus musculus
aaacatttacagattacagcctttt

SEQ ID NO: 6912 - DNA, 25 bp, Mus musculus
aaacatttacagtttacagcctttt

SEQ ID NO: 6913 - DNA, 25 bp, Mus musculus
aaacatttatgcctcccttttgtgt

SEQ ID NO: 6914 - DNA, 25 bp, Mus musculus
aaacatttatgcgtcccttttgtgt

SEQ ID NO: 6915 - DNA, 25 bp, Mus musculus
aaacatttcagtctctcctggacct

SEQ ID NO: 6916 - DNA, 25 bp, Mus musculus
aaacatttcagtgtctcctggacct

SEQ ID NO: 6917 - DNA, 25 bp, Mus musculus
aaacatttccacaaagacttcctga

SEQ ID NO: 6918 - DNA, 25 bp, Mus musculus
aaacatttccacatgcttgctattt

SEQ ID NO: 6919 - DNA, 25 bp, Mus musculus
aaacatttccactaagacttcctga

SEQ ID NO: 6920 - DNA, 25 bp, Mus musculus
aaacatttccacttgcttgctattt

SEQ ID NO: 6921 - DNA, 25 bp, Mus musculus
aaacatttccataccatctgtcaaa

SEQ ID NO: 6922 - DNA, 25 bp, Mus musculus
aaacatttccattccatctgtcaaa

SEQ ID NO: 6923 - DNA, 25 bp, Mus musculus
aaacatttcggaagccagcatcctg

SEQ ID NO: 6924 - DNA, 25 bp, Mus musculus
aaacatttcggatgccagcatcctg

SEQ ID NO: 6925 - DNA, 25 bp, Mus musculus
aaacatttctacaacgcagcggtgc

SEQ ID NO: 6926 - DNA, 25 bp, Mus musculus
aaacatttctactacgcagcggtgc

SEQ ID NO: 6927 - DNA, 25 bp, Mus musculus
aaacatttctgaataacagtggcaa

SEQ ID NO: 6928 - DNA, 25 bp, Mus musculus
aaacatttctgattaacagtggcaa

SEQ ID NO: 6929 - DNA, 25 bp, Mus musculus
aaacatttctgtcgactcagtggac

SEQ ID NO: 6930 - DNA, 25 bp, Mus musculus
aaacatttctgtggactcagtggac

SEQ ID NO: 6931 - DNA, 25 bp, Mus musculus
aaacatttgactcgaagcacagcca

SEQ ID NO: 6932 - DNA, 25 bp, Mus musculus
aaacatttgactggaagcacagcca

SEQ ID NO: 6933 - DNA, 25 bp, Mus musculus
aaacatttgcatatgctgggcaatt

SEQ ID NO: 6934 - DNA, 25 bp, Mus musculus
aaacatttgcatcgattaatctgaa

SEQ ID NO: 6935 - DNA, 25 bp, Mus musculus
aaacatttgcatggattaatctgaa

SEQ ID NO: 6936 - DNA, 25 bp, Mus musculus
aaacatttgcatttgctgggcaatt

SEQ ID NO: 6937 - DNA, 25 bp, Mus musculus
aaacatttgcttagatctgtataaa

SEQ ID NO: 6938 - DNA, 25 bp, Mus musculus
aaacatttgcttatatggtccccag

SEQ ID NO: 6939 - DNA, 25 bp, Mus musculus
aaacatttgctttgatctgtataaa

SEQ ID NO: 6940 - DNA, 25 bp, Mus musculus
aaacatttgcttttatggtccccag

SEQ ID NO: 6941 - DNA, 25 bp, Mus musculus
aaacatttggaaaggcctggtcagg

SEQ ID NO: 6942 - DNA, 25 bp, Mus musculus
aaacatttggaatggcctggtcagg

SEQ ID NO: 6943 - DNA, 25 bp, Mus musculus
aaacatttggatcgcatgactccat

SEQ ID NO: 6944 - DNA, 25 bp, Mus musculus
aaacatttggatggcatgactccat

SEQ ID NO: 6945 - DNA, 25 bp, Mus musculus
aaacatttggctctggttatcttca

SEQ ID NO: 6946 - DNA, 25 bp, Mus musculus
aaacatttggctgtggttatcttca

SEQ ID NO: 6947 - DNA, 25 bp, Mus musculus
aaacatttggtcacagctgtcacct

SEQ ID NO: 6948 - DNA, 25 bp, Mus musculus
aaacatttggtctcagctgtcacct

SEQ ID NO: 6949 - DNA, 25 bp, Mus musculus
aaacatttgtcacggagctcaggtc

SEQ ID NO: 6950 - DNA, 25 bp, Mus musculus
aaacatttgtcagggagctcaggtc

SEQ ID NO: 6951 - DNA, 25 bp, Mus musculus
aaacatttgttgagtccatgtctaa

SEQ ID NO: 6952 - DNA, 25 bp, Mus musculus
aaacatttgttgtgtccatgtctaa

SEQ ID NO: 6953 - DNA, 25 bp, Mus musculus
aaacattttattcatccaacaacta

SEQ ID NO: 6954 - DNA, 25 bp, Mus musculus
aaacattttattgatccaacaacta

SEQ ID NO: 6955 - DNA, 25 bp, Mus musculus
aaacattttcatagtccacgtggga

SEQ ID NO: 6956 - DNA, 25 bp, Mus musculus
aaacattttcattgtccacgtggga

SEQ ID NO: 6957 - DNA, 25 bp, Mus musculus
aaacattttctgatctatacgtaga

SEQ ID NO: 6958 - DNA, 25 bp, Mus musculus
aaacattttctgttctatacgtaga

SEQ ID NO: 6959 - DNA, 25 bp, Mus musculus
aaacattttggtatctcacattcca

SEQ ID NO: 6960 - DNA, 25 bp, Mus musculus
aaacattttggtttctcacattcca

SEQ ID NO: 6961 - DNA, 25 bp, Mus musculus
aaacatttttaccttatgcacatta

SEQ ID NO: 6962 - DNA, 25 bp, Mus musculus
aaacatttttacgttatgcacatta

SEQ ID NO: 6963 - DNA, 25 bp, Mus musculus
aaacatttttcacccatgtaagcat

SEQ ID NO: 6964 - DNA, 25 bp, Mus musculus
aaacatttttcagccatgtaagcat

SEQ ID NO: 6965 - DNA, 25 bp, Mus musculus
aaacatttttgcacagtctgagtct

SEQ ID NO: 6966 - DNA, 25 bp, Mus musculus
aaacatttttgctcagtctgagtct

SEQ ID NO: 6967 - DNA, 25 bp, Mus musculus
aaacatttttgtcgtcctggagact

SEQ ID NO: 6968 - DNA, 25 bp, Mus musculus
aaacatttttgtggtcctggagact

SEQ ID NO: 6969 - DNA, 25 bp, Mus musculus
aaaccaaaacatactcagcttcctg

SEQ ID NO: 6970 - DNA, 25 bp, Mus musculus
aaaccaaaacattctcagcttcctg

SEQ ID NO: 6971 - DNA, 25 bp, Mus musculus
aaaccaaaagtcaagccaagtgcag

SEQ ID NO: 6972 - DNA, 25 bp, Mus musculus
aaaccaaaagtctagccaagtgcag

SEQ ID NO: 6973 - DNA, 25 bp, Mus musculus
aaaccaaacactacatctacttcta

SEQ ID NO: 6974 - DNA, 25 bp, Mus musculus
aaaccaaacacttcatctacttcta

SEQ ID NO: 6975 - DNA, 25 bp, Mus musculus
aaaccaaagaacctgctgggcattg

SEQ ID NO: 6976 - DNA, 25 bp, Mus musculus
aaaccaaagaacgtgctgggcattg

SEQ ID NO: 6977 - DNA, 25 bp, Mus musculus
aaaccaaagattcctatcctctaag

SEQ ID NO: 6978 - DNA, 25 bp, Mus musculus
aaaccaaagattgctatcctctaag

SEQ ID NO: 6979 - DNA, 25 bp, Mus musculus
aaaccaaagcctactgaccaagctt

SEQ ID NO: 6980 - DNA, 25 bp, Mus musculus
aaaccaaagccttctgaccaagctt

SEQ ID NO: 6981 - DNA, 25 bp, Mus musculus
aaaccaaagctaactgactccagaa

SEQ ID NO: 6982 - DNA, 25 bp, Mus musculus
aaaccaaagctatctgactccagaa

SEQ ID NO: 6983 - DNA, 25 bp, Mus musculus
aaaccaaaggtcaatccttatgtat

SEQ ID NO: 6984 - DNA, 25 bp, Mus musculus
aaaccaaaggtctatccttatgtat

SEQ ID NO: 6985 - DNA, 25 bp, Mus musculus
aaaccaaataatctgtgcctgctaa

SEQ ID NO: 6986 - DNA, 25 bp, Mus musculus
aaaccaaataatgtgtgcctgctaa

SEQ ID NO: 6987 - DNA, 25 bp, Mus musculus
aaaccaaatactcaaactggagatc

SEQ ID NO: 6988 - DNA, 25 bp, Mus musculus
aaaccaaatactgaaactggagatc

SEQ ID NO: 6989 - DNA, 25 bp, Mus musculus
aaaccaaatagccaggtgtcagcag

SEQ ID NO: 6990 - DNA, 25 bp, Mus musculus
aaaccaaatagcgaggtgtcagcag

SEQ ID NO: 6991 - DNA, 25 bp, Mus musculus
aaaccaaatatcagtgctatgacta

SEQ ID NO: 6992 - DNA, 25 bp, Mus musculus
aaaccaaatatctgtgctatgacta

SEQ ID NO: 6993 - DNA, 25 bp, Mus musculus
aaaccaaatcatattcacctacttt

SEQ ID NO: 6994 - DNA, 25 bp, Mus musculus
aaaccaaatcattttcacctacttt

SEQ ID NO: 6995 - DNA, 25 bp, Mus musculus
aaaccaaatgttattcttgcgtctg

SEQ ID NO: 6996 - DNA, 25 bp, Mus musculus
aaaccaaatgtttttcttgcgtctg

SEQ ID NO: 6997 - DNA, 25 bp, Mus musculus
aaaccaaattcaaggccccagacag

SEQ ID NO: 6998 - DNA, 25 bp, Mus musculus
aaaccaaattcatggccccagacag

SEQ ID NO: 6999 - DNA, 25 bp, Mus musculus
aaaccaacaaatactgcactccaaa

SEQ ID NO: 7000 - DNA, 25 bp, Mus musculus
aaaccaacaaattctgcactccaaa

SEQ ID NO: 7001 - DNA, 25 bp, Mus musculus
aaaccaacaactaacttatcagagg

SEQ ID NO: 7002 - DNA, 25 bp, Mus musculus
aaaccaacaacttacttatcagagg

SEQ ID NO: 7003 - DNA, 25 bp, Mus musculus
aaaccaacactgcttttaatcctct

SEQ ID NO: 7004 - DNA, 25 bp, Mus musculus
aaaccaacactggttttaatcctct

SEQ ID NO: 7005 - DNA, 25 bp, Mus musculus
aaaccaacagagcaattcatcagag

SEQ ID NO: 7006 - DNA, 25 bp, Mus musculus
aaaccaacagaggaattcatcagag

SEQ ID NO: 7007 - DNA, 25 bp, Mus musculus
aaaccaacagcaaggatggtccctc

SEQ ID NO: 7008 - DNA, 25 bp, Mus musculus
aaaccaacagcatggatggtccctc

SEQ ID NO: 7009 - DNA, 25 bp, Mus musculus
aaaccaacaggacaggcctgtgggc

SEQ ID NO: 7010 - DNA, 25 bp, Mus musculus
aaaccaacaggagaggcctgtgggc

SEQ ID NO: 7011 - DNA, 25 bp, Mus musculus
aaaccaacaggtaactcatccgtgt

SEQ ID NO: 7012 - DNA, 25 bp, Mus musculus
aaaccaacaggttactcatccgtgt

SEQ ID NO: 7013 - DNA, 25 bp, Mus musculus
aaaccaacagtcataccattcacaa

SEQ ID NO: 7014 - DNA, 25 bp, Mus musculus
aaaccaacagtcttaccattcacaa

SEQ ID NO: 7015 - DNA, 25 bp, Mus musculus
aaaccaacagttccgcgatcctgtc

SEQ ID NO: 7016 - DNA, 25 bp, Mus musculus
aaaccaacagttgcgcgatcctgtc

SEQ ID NO: 7017 - DNA, 25 bp, Mus musculus
aaaccaacatgcctccgaatcgggc

SEQ ID NO: 7018 - DNA, 25 bp, Mus musculus
aaaccaacatgcgtccgaatcgggc

SEQ ID NO: 7019 - DNA, 25 bp, Mus musculus
aaaccaaccaaaatagcttgacatg

SEQ ID NO: 7020 - DNA, 25 bp, Mus musculus
aaaccaaccaaattagcttgacatg

SEQ ID NO: 7021 - DNA, 25 bp, Mus musculus
aaaccaaccagcaaggagccgggcg

SEQ ID NO: 7022 - DNA, 25 bp, Mus musculus
aaaccaaccagctaggagccgggcg

SEQ ID NO: 7023 - DNA, 25 bp, Mus musculus
aaaccaacccaccagagctttgtat

SEQ ID NO: 7024 - DNA, 25 bp, Mus musculus
aaaccaacccacgagagctttgtat

SEQ ID NO: 7025 - DNA, 25 bp, Mus musculus
aaaccaaccctgatgacagaagaat

SEQ ID NO: 7026 - DNA, 25 bp, Mus musculus
aaaccaaccctgttgacagaagaat

SEQ ID NO: 7027 - DNA, 25 bp, Mus musculus
aaaccaacgaggaatccactggagt

SEQ ID NO: 7028 - DNA, 25 bp, Mus musculus
aaaccaacgaggtatccactggagt

SEQ ID NO: 7029 - DNA, 25 bp, Mus musculus
aaaccaacgctcaggaatgggcact

SEQ ID NO: 7030 - DNA, 25 bp, Mus musculus
aaaccaacgctctggaatgggcact

SEQ ID NO: 7031 - DNA, 25 bp, Mus musculus
aaaccaacgctgattgtctcctgat

SEQ ID NO: 7032 - DNA, 25 bp, Mus musculus
aaaccaacgctgtttgtctcctgat

SEQ ID NO: 7033 - DNA, 25 bp, Mus musculus
aaaccaacgggcagtccagttatag

SEQ ID NO: 7034 - DNA, 25 bp, Mus musculus
aaaccaacgggctgtccagttatag

SEQ ID NO: 7035 - DNA, 25 bp, Mus musculus
aaaccaactctaatattgcttcttg

SEQ ID NO: 7036 - DNA, 25 bp, Mus musculus
aaaccaactctattattgcttcttg

SEQ ID NO: 7037 - DNA, 25 bp, Mus musculus
aaaccaactgacctatacacaaaca

SEQ ID NO: 7038 - DNA, 25 bp, Mus musculus
aaaccaactgacgtatacacaaaca

SEQ ID NO: 7039 - DNA, 25 bp, Mus musculus
aaaccaactgcacagtgctgtaaca

SEQ ID NO: 7040 - DNA, 25 bp, Mus musculus
aaaccaactgcacggctgatgacat

SEQ ID NO: 7041 - DNA, 25 bp, Mus musculus
aaaccaactgcagagtgctgtaaca

SEQ ID NO: 7042 - DNA, 25 bp, Mus musculus
aaaccaactgcagggctgatgacat

SEQ ID NO: 7043 - DNA, 25 bp, Mus musculus
aaaccaactggcctcgtgggactga

SEQ ID NO: 7044 - DNA, 25 bp, Mus musculus
aaaccaactggcgtcgtgggactga

SEQ ID NO: 7045 - DNA, 25 bp, Mus musculus
aaaccaactgtaatatctaagggct

SEQ ID NO: 7046 - DNA, 25 bp, Mus musculus
aaaccaactgtattatctaagggct

SEQ ID NO: 7047 - DNA, 25 bp, Mus musculus
aaaccaactgttaatcatctctgaa

SEQ ID NO: 7048 - DNA, 25 bp, Mus musculus
aaaccaactgtttatcatctctgaa

SEQ ID NO: 7049 - DNA, 25 bp, Mus musculus
aaaccaacttgaaacttcagacctt

SEQ ID NO: 7050 - DNA, 25 bp, Mus musculus
aaaccaacttgatacttcagacctt

SEQ ID NO: 7051 - DNA, 25 bp, Mus musculus
aaaccaacttgcatctgatctttct

SEQ ID NO: 7052 - DNA, 25 bp, Mus musculus
aaaccaacttgcttctgatctttct

SEQ ID NO: 7053 - DNA, 25 bp, Mus musculus
aaaccaacttttaccatactgatgt

SEQ ID NO: 7054 - DNA, 25 bp, Mus musculus
aaaccaactttttccatactgatgt

SEQ ID NO: 7055 - DNA, 25 bp, Mus musculus
aaaccaagactcatgccagagtgac

SEQ ID NO: 7056 - DNA, 25 bp, Mus musculus
aaaccaagactcttgccagagtgac

SEQ ID NO: 7057 - DNA, 25 bp, Mus musculus
aaaccaagagtcacagcgcttgagg

SEQ ID NO: 7058 - DNA, 25 bp, Mus musculus
aaaccaagagtctcagcgcttgagg

SEQ ID NO: 7059 - DNA, 25 bp, Mus musculus
aaaccaagataaagctgcctggcat

SEQ ID NO: 7060 - DNA, 25 bp, Mus musculus
aaaccaagataatgctgcctggcat

SEQ ID NO: 7061 - DNA, 25 bp, Mus musculus
aaaccaagatcgagctgcttttccc

SEQ ID NO: 7062 - DNA, 25 bp, Mus musculus
aaaccaagatcgtgctgcttttccc

SEQ ID NO: 7063 - DNA, 25 bp, Mus musculus
aaaccaagatttccatatactgtat

SEQ ID NO: 7064 - DNA, 25 bp, Mus musculus
aaaccaagatttgcatatactgtat

SEQ ID NO: 7065 - DNA, 25 bp, Mus musculus
aaaccaagcccaagtctgtaaagca

SEQ ID NO: 7066 - DNA, 25 bp, Mus musculus
aaaccaagcccatgtctgtaaagca

SEQ ID NO: 7067 - DNA, 25 bp, Mus musculus
aaaccaagcctcacttggattctgg

SEQ ID NO: 7068 - DNA, 25 bp, Mus musculus
aaaccaagcctctcttggattctgg

SEQ ID NO: 7069 - DNA, 25 bp, Mus musculus
aaaccaagccttaagcagatgagcc

SEQ ID NO: 7070 - DNA, 25 bp, Mus musculus
aaaccaagcctttagcagatgagcc

SEQ ID NO: 7071 - DNA, 25 bp, Mus musculus
aaaccaaggtctcgttctgtccatt

SEQ ID NO: 7072 - DNA, 25 bp, Mus musculus
aaaccaaggtctggttctgtccatt

SEQ ID NO: 7073 - DNA, 25 bp, Mus musculus
aaaccaatacagacatcgctgcgtc

SEQ ID NO: 7074 - DNA, 25 bp, Mus musculus
aaaccaatacagtcatcgctgcgtc

SEQ ID NO: 7075 - DNA, 25 bp, Mus musculus
aaaccaatattgaaaacgcccagag

SEQ ID NO: 7076 - DNA, 25 bp, Mus musculus
aaaccaatattgtaaacgcccagag

SEQ ID NO: 7077 - DNA, 25 bp, Mus musculus
aaaccaatgccacatctgggatgat

SEQ ID NO: 7078 - DNA, 25 bp, Mus musculus
aaaccaatgccagatctgggatgat

SEQ ID NO: 7079 - DNA, 25 bp, Mus musculus
aaaccaatgctgaggatgtccccta

SEQ ID NO: 7080 - DNA, 25 bp, Mus musculus
aaaccaatgctgtggatgtccccta

SEQ ID NO: 7081 - DNA, 25 bp, Mus musculus
aaaccaatggtcaacttggtgaatc

SEQ ID NO: 7082 - DNA, 25 bp, Mus musculus
aaaccaatggtctacttggtgaatc

SEQ ID NO: 7083 - DNA, 25 bp, Mus musculus
aaaccaatgtcccatgctggcaaga

SEQ ID NO: 7084 - DNA, 25 bp, Mus musculus
aaaccaatgtccgatgctggcaaga

SEQ ID NO: 7085 - DNA, 25 bp, Mus musculus
aaaccaatttgtccctctctacact

SEQ ID NO: 7086 - DNA, 25 bp, Mus musculus
aaaccaatttgtgcctctctacact

SEQ ID NO: 7087 - DNA, 25 bp, Mus musculus
aaaccaatttttacagtctgtacag

SEQ ID NO: 7088 - DNA, 25 bp, Mus musculus
aaaccaattttttcagtctgtacag

SEQ ID NO: 7089 - DNA, 25 bp, Mus musculus
aaaccacaagcaatgatacatcagt

SEQ ID NO: 7090 - DNA, 25 bp, Mus musculus
aaaccacaagcattgatacatcagt

SEQ ID NO: 7091 - DNA, 25 bp, Mus musculus
aaaccacaaggtagcaggtagcaca

SEQ ID NO: 7092 - DNA, 25 bp, Mus musculus
aaaccacaaggttgcaggtagcaca

SEQ ID NO: 7093 - DNA, 25 bp, Mus musculus
aaaccacaagtgagcatttagcaaa

SEQ ID NO: 7094 - DNA, 25 bp, Mus musculus
aaaccacaagtgtgcatttagcaaa

SEQ ID NO: 7095 - DNA, 25 bp, Mus musculus
aaaccacacgcacgcatttggggtg

SEQ ID NO: 7096 - DNA, 25 bp, Mus musculus
aaaccacacgcaggcatttggggtg

SEQ ID NO: 7097 - DNA, 25 bp, Mus musculus
aaaccacacgccctctgtggatgga

SEQ ID NO: 7098 - DNA, 25 bp, Mus musculus
aaaccacacgccgtctgtggatgga

SEQ ID NO: 7099 - DNA, 25 bp, Mus musculus
aaaccacacggcagatgaacaacct

SEQ ID NO: 7100 - DNA, 25 bp, Mus musculus
aaaccacacggctgatgaacaacct

SEQ ID NO: 7101 - DNA, 25 bp, Mus musculus
aaaccacactatcagagtgttcccc

SEQ ID NO: 7102 - DNA, 25 bp, Mus musculus
aaaccacactatgagagtgttcccc

SEQ ID NO: 7103 - DNA, 25 bp, Mus musculus
aaaccacactcgagccatgcggaag

SEQ ID NO: 7104 - DNA, 25 bp, Mus musculus
aaaccacactcgtgccatgcggaag

SEQ ID NO: 7105 - DNA, 25 bp, Mus musculus
aaaccacagaataagatccaggaaa

SEQ ID NO: 7106 - DNA, 25 bp, Mus musculus
aaaccacagaattagatccaggaaa

SEQ ID NO: 7107 - DNA, 25 bp, Mus musculus
aaaccacagcccatgtgaagccaag

SEQ ID NO: 7108 - DNA, 25 bp, Mus musculus
aaaccacagcccttgtgaagccaag

SEQ ID NO: 7109 - DNA, 25 bp, Mus musculus
aaaccacagcgccattttgtaggaa

SEQ ID NO: 7110 - DNA, 25 bp, Mus musculus
aaaccacagcgcgattttgtaggaa

SEQ ID NO: 7111 - DNA, 25 bp, Mus musculus
aaaccacagctcacactatgatatc

SEQ ID NO: 7112 - DNA, 25 bp, Mus musculus
aaaccacagctctcactatgatatc

SEQ ID NO: 7113 - DNA, 25 bp, Mus musculus
aaaccacagtctatcttcagcacaa

SEQ ID NO: 7114 - DNA, 25 bp, Mus musculus
aaaccacagtctttcttcagcacaa

SEQ ID NO: 7115 - DNA, 25 bp, Mus musculus
aaaccacagtgacttctcagctcaa

SEQ ID NO: 7116 - DNA, 25 bp, Mus musculus
aaaccacagtgagttctcagctcaa

SEQ ID NO: 7117 - DNA, 25 bp, Mus musculus
aaaccacatcaaatcaaactccact

SEQ ID NO: 7118 - DNA, 25 bp, Mus musculus
aaaccacatcaattcaaactccact

SEQ ID NO: 7119 - DNA, 25 bp, Mus musculus
aaaccacatcagatctcttgcttgt

SEQ ID NO: 7120 - DNA, 25 bp, Mus musculus
aaaccacatcagttctcttgcttgt

SEQ ID NO: 7121 - DNA, 25 bp, Mus musculus
aaaccacatctgaacattagtcccc

SEQ ID NO: 7122 - DNA, 25 bp, Mus musculus
aaaccacatctgtacattagtcccc

SEQ ID NO: 7123 - DNA, 25 bp, Mus musculus
aaaccacattcaacggcatgctcat

SEQ ID NO: 7124 - DNA, 25 bp, Mus musculus
aaaccacattcatcggcatgctcat

SEQ ID NO: 7125 - DNA, 25 bp, Mus musculus
aaaccacattgtctctgaaactcca

SEQ ID NO: 7126 - DNA, 25 bp, Mus musculus
aaaccacattgtgtctgaaactcca

SEQ ID NO: 7127 - DNA, 25 bp, Mus musculus
aaaccacattttcactccagaggct

SEQ ID NO: 7128 - DNA, 25 bp, Mus musculus
aaaccacattttgactccagaggct

SEQ ID NO: 7129 - DNA, 25 bp, Mus musculus
aaaccaccaaccagagagcatgcat

SEQ ID NO: 7130 - DNA, 25 bp, Mus musculus
aaaccaccaacctgagagcatgcat

SEQ ID NO: 7131 - DNA, 25 bp, Mus musculus
aaaccaccacaacagcttacaaata

SEQ ID NO: 7132 - DNA, 25 bp, Mus musculus
aaaccaccacaagagcttacaaata

SEQ ID NO: 7133 - DNA, 25 bp, Mus musculus
aaaccaccagccatacttggaaaga

SEQ ID NO: 7134 - DNA, 25 bp, Mus musculus
aaaccaccagccttacttggaaaga

SEQ ID NO: 7135 - DNA, 25 bp, Mus musculus
aaaccaccagtgaccaattgaagaa

SEQ ID NO: 7136 - DNA, 25 bp, Mus musculus
aaaccaccagtgtccaattgaagaa

SEQ ID NO: 7137 - DNA, 25 bp, Mus musculus
aaaccaccatctcaaggacttattt

SEQ ID NO: 7138 - DNA, 25 bp, Mus musculus
aaaccaccatctgaaggacttattt

SEQ ID NO: 7139 - DNA, 25 bp, Mus musculus
aaaccaccatgaacttgatcaccac

SEQ ID NO: 7140 - DNA, 25 bp, Mus musculus
aaaccaccatgatcttgatcaccac

SEQ ID NO: 7141 - DNA, 25 bp, Mus musculus
aaaccaccctgcctttggctgtgag

SEQ ID NO: 7142 - DNA, 25 bp, Mus musculus
aaaccaccctgcgtttggctgtgag

SEQ ID NO: 7143 - DNA, 25 bp, Mus musculus
aaaccaccgtggagtcaggccagta

SEQ ID NO: 7144 - DNA, 25 bp, Mus musculus
aaaccaccgtggtgtcaggccagta

SEQ ID NO: 7145 - DNA, 25 bp, Mus musculus
aaaccacctcctaatggctgtttag

SEQ ID NO: 7146 - DNA, 25 bp, Mus musculus
aaaccacctccttatggctgtttag

SEQ ID NO: 7147 - DNA, 25 bp, Mus musculus
aaaccacctctcaggtcttctaaat

SEQ ID NO: 7148 - DNA, 25 bp, Mus musculus
aaaccacctctctggtcttctaaat

SEQ ID NO: 7149 - DNA, 25 bp, Mus musculus
aaaccacgactactgtttacagact

SEQ ID NO: 7150 - DNA, 25 bp, Mus musculus
aaaccacgactagtgtttacagact

SEQ ID NO: 7151 - DNA, 25 bp, Mus musculus
aaaccacgagctcttttccaagagc

SEQ ID NO: 7152 - DNA, 25 bp, Mus musculus
aaaccacgagctgttttccaagagc

SEQ ID NO: 7153 - DNA, 25 bp, Mus musculus
aaaccacgaggaacctaagacgcat

SEQ ID NO: 7154 - DNA, 25 bp, Mus musculus
aaaccacgaggatcctaagacgcat

SEQ ID NO: 7155 - DNA, 25 bp, Mus musculus
aaaccacgccgaccacagtgactgt

SEQ ID NO: 7156 - DNA, 25 bp, Mus musculus
aaaccacgccgagcacagtgactgt

SEQ ID NO: 7157 - DNA, 25 bp, Mus musculus
aaaccacggtatatgttgtgacaat

SEQ ID NO: 7158 - DNA, 25 bp, Mus musculus
aaaccacggtatttgttgtgacaat

SEQ ID NO: 7159 - DNA, 25 bp, Mus musculus
aaaccacgttacactgagaacactt

SEQ ID NO: 7160 - DNA, 25 bp, Mus musculus
aaaccacgttactctgagaacactt

SEQ ID NO: 7161 - DNA, 25 bp, Mus musculus
aaaccactaaggagaagatgacatg

SEQ ID NO: 7162 - DNA, 25 bp, Mus musculus
aaaccactaaggtgaagatgacatg

SEQ ID NO: 7163 - DNA, 25 bp, Mus musculus
aaaccactactcagctactctgctt

SEQ ID NO: 7164 - DNA, 25 bp, Mus musculus
aaaccactactctgctactctgctt

SEQ ID NO: 7165 - DNA, 25 bp, Mus musculus
aaaccactagacatcttttgctgaa

SEQ ID NO: 7166 - DNA, 25 bp, Mus musculus
aaaccactagacttcttttgctgaa

SEQ ID NO: 7167 - DNA, 25 bp, Mus musculus
aaaccactcaacacagattgggaga

SEQ ID NO: 7168 - DNA, 25 bp, Mus musculus
aaaccactcaactcagattgggaga

SEQ ID NO: 7169 - DNA, 25 bp, Mus musculus
aaaccactcactattctgatgcctt

SEQ ID NO: 7170 - DNA, 25 bp, Mus musculus
aaaccactcacttttctgatgcctt

SEQ ID NO: 7171 - DNA, 25 bp, Mus musculus
aaaccactccatagtcttgactctt

SEQ ID NO: 7172 - DNA, 25 bp, Mus musculus
aaaccactccattgtcttgactctt

SEQ ID NO: 7173 - DNA, 25 bp, Mus musculus
aaaccactgattagccagaagcgaa

SEQ ID NO: 7174 - DNA, 25 bp, Mus musculus
aaaccactgatttgccagaagcgaa

SEQ ID NO: 7175 - DNA, 25 bp, Mus musculus
aaaccactggctctataatattaat

SEQ ID NO: 7176 - DNA, 25 bp, Mus musculus
aaaccactggctgtataatattaat

SEQ ID NO: 7177 - DNA, 25 bp, Mus musculus
aaaccactggttaggcaggcactga

SEQ ID NO: 7178 - DNA, 25 bp, Mus musculus
aaaccactggtttggcaggcactga

SEQ ID NO: 7179 - DNA, 25 bp, Mus musculus
aaaccacttatacggtctcttctgg

SEQ ID NO: 7180 - DNA, 25 bp, Mus musculus
aaaccacttatagggtctcttctgg

SEQ ID NO: 7181 - DNA, 25 bp, Mus musculus
aaaccacttatcagataccactgtg

SEQ ID NO: 7182 - DNA, 25 bp, Mus musculus
aaaccacttatctgataccactgtg

SEQ ID NO: 7183 - DNA, 25 bp, Mus musculus
aaaccacttcatccccgataatatt

SEQ ID NO: 7184 - DNA, 25 bp, Mus musculus
aaaccacttcatgcccgataatatt

SEQ ID NO: 7185 - DNA, 25 bp, Mus musculus
aaaccacttcctacagctgggaatc

SEQ ID NO: 7186 - DNA, 25 bp, Mus musculus
aaaccacttccttcagctgggaatc

SEQ ID NO: 7187 - DNA, 25 bp, Mus musculus
aaaccacttctaagtcatccacata

SEQ ID NO: 7188 - DNA, 25 bp, Mus musculus
aaaccacttctatgtcatccacata

SEQ ID NO: 7189 - DNA, 25 bp, Mus musculus
aaaccacttctgatctttggatgag

SEQ ID NO: 7190 - DNA, 25 bp, Mus musculus
aaaccacttctgttctttggatgag

SEQ ID NO: 7191 - DNA, 25 bp, Mus musculus
aaaccacttgcaacatgtgttcctc

SEQ ID NO: 7192 - DNA, 25 bp, Mus musculus
aaaccacttgcatcatgtgttcctc

SEQ ID NO: 7193 - DNA, 25 bp, Mus musculus
aaaccacttgccagggagcctgaaa

SEQ ID NO: 7194 - DNA, 25 bp, Mus musculus
aaaccacttgcctgggagcctgaaa

SEQ ID NO: 7195 - DNA, 25 bp, Mus musculus
aaaccacttggaaaagacgtctcaa

SEQ ID NO: 7196 - DNA, 25 bp, Mus musculus
aaaccacttggataagacgtctcaa

SEQ ID NO: 7197 - DNA, 25 bp, Mus musculus
aaaccagaaataatggccccatcca

SEQ ID NO: 7198 - DNA, 25 bp, Mus musculus
aaaccagaaatattggccccatcca

SEQ ID NO: 7199 - DNA, 25 bp, Mus musculus
aaaccagaagatctcacaccttgtt

SEQ ID NO: 7200 - DNA, 25 bp, Mus musculus
aaaccagaagatgtcacaccttgtt

SEQ ID NO: 7201 - DNA, 25 bp, Mus musculus
aaaccagaagcaacagtgtgtctat

SEQ ID NO: 7202 - DNA, 25 bp, Mus musculus
aaaccagaagcatcagtgtgtctat

SEQ ID NO: 7203 - DNA, 25 bp, Mus musculus
aaaccagaatccatttcagcactac

SEQ ID NO: 7204 - DNA, 25 bp, Mus musculus
aaaccagaatccttttcagcactac

SEQ ID NO: 7205 - DNA, 25 bp, Mus musculus
aaaccagaatgtcacatgcctgtgg

SEQ ID NO: 7206 - DNA, 25 bp, Mus musculus
aaaccagaatgtgacatgcctgtgg

SEQ ID NO: 7207 - DNA, 25 bp, Mus musculus
aaaccagaattcagccatgtcaaag

SEQ ID NO: 7208 - DNA, 25 bp, Mus musculus
aaaccagaattctgccatgtcaaag

SEQ ID NO: 7209 - DNA, 25 bp, Mus musculus
aaaccagacagtaccttttctagag

SEQ ID NO: 7210 - DNA, 25 bp, Mus musculus
aaaccagacagttccttttctagag

SEQ ID NO: 7211 - DNA, 25 bp, Mus musculus
aaaccagacatcattgaagatcttt

SEQ ID NO: 7212 - DNA, 25 bp, Mus musculus
aaaccagacatctttgaagatcttt

SEQ ID NO: 7213 - DNA, 25 bp, Mus musculus
aaaccagaccatcaggaggtagctt

SEQ ID NO: 7214 - DNA, 25 bp, Mus musculus
aaaccagaccatgaggaggtagctt

SEQ ID NO: 7215 - DNA, 25 bp, Mus musculus
aaaccagactgcaaagccacttgtg

SEQ ID NO: 7216 - DNA, 25 bp, Mus musculus
aaaccagactgctaagccacttgtg

SEQ ID NO: 7217 - DNA, 25 bp, Mus musculus
aaaccagactttctcctactcagag

SEQ ID NO: 7218 - DNA, 25 bp, Mus musculus
aaaccagactttgtcctactcagag

SEQ ID NO: 7219 - DNA, 25 bp, Mus musculus
aaaccagagcagctgtctattcaga

SEQ ID NO: 7220 - DNA, 25 bp, Mus musculus
aaaccagagcaggtgtctattcaga

SEQ ID NO: 7221 - DNA, 25 bp, Mus musculus
aaaccagaggctcccggcgaagacg

SEQ ID NO: 7222 - DNA, 25 bp, Mus musculus
aaaccagaggctgccggcgaagacg

SEQ ID NO: 7223 - DNA, 25 bp, Mus musculus
aaaccagaggtaatttccaaggcat

SEQ ID NO: 7224 - DNA, 25 bp, Mus musculus
aaaccagaggtattttccaaggcat

SEQ ID NO: 7225 - DNA, 25 bp, Mus musculus
aaaccagaggtgaatgtttctattc

SEQ ID NO: 7226 - DNA, 25 bp, Mus musculus
aaaccagaggtgtatgtttctattc

SEQ ID NO: 7227 - DNA, 25 bp, Mus musculus
aaaccagagtaccagccgcattatg

SEQ ID NO: 7228 - DNA, 25 bp, Mus musculus
aaaccagagtacgagccgcattatg

SEQ ID NO: 7229 - DNA, 25 bp, Mus musculus
aaaccagagtcccacgaaagcagcc

SEQ ID NO: 7230 - DNA, 25 bp, Mus musculus
aaaccagagtccgacgaaagcagcc

SEQ ID NO: 7231 - DNA, 25 bp, Mus musculus
aaaccagagttcacgatcgctttcc

SEQ ID NO: 7232 - DNA, 25 bp, Mus musculus
aaaccagagttctcgatcgctttcc

SEQ ID NO: 7233 - DNA, 25 bp, Mus musculus
aaaccagatatcctgaacctgatag

SEQ ID NO: 7234 - DNA, 25 bp, Mus musculus
aaaccagatatcgtgaacctgatag

SEQ ID NO: 7235 - DNA, 25 bp, Mus musculus
aaaccagatcctatctttcgagatc

SEQ ID NO: 7236 - DNA, 25 bp, Mus musculus
aaaccagatcctcacagatgggaca

SEQ ID NO: 7237 - DNA, 25 bp, Mus musculus
aaaccagatcctgacagatgggaca

SEQ ID NO: 7238 - DNA, 25 bp, Mus musculus
aaaccagatcctttctttcgagatc

SEQ ID NO: 7239 - DNA, 25 bp, Mus musculus
aaaccagatctcagaacaccaaaaa

SEQ ID NO: 7240 - DNA, 25 bp, Mus musculus
aaaccagatctctgaacaccaaaaa

SEQ ID NO: 7241 - DNA, 25 bp, Mus musculus
aaaccagatgcacagttaacgtgtt

SEQ ID NO: 7242 - DNA, 25 bp, Mus musculus
aaaccagatgcagagttaacgtgtt

SEQ ID NO: 7243 - DNA, 25 bp, Mus musculus
aaaccagatgccatccaggacgaac

SEQ ID NO: 7244 - DNA, 25 bp, Mus musculus
aaaccagatgccttccaggacgaac

SEQ ID NO: 7245 - DNA, 25 bp, Mus musculus
aaaccagatgctcaggttgatacct

SEQ ID NO: 7246 - DNA, 25 bp, Mus musculus
aaaccagatgctgaggttgatacct

SEQ ID NO: 7247 - DNA, 25 bp, Mus musculus
aaaccagatggacaagggaagagct

SEQ ID NO: 7248 - DNA, 25 bp, Mus musculus
aaaccagatggagaagggaagagct

SEQ ID NO: 7249 - DNA, 25 bp, Mus musculus
aaaccagatgttccattctattaaa

SEQ ID NO: 7250 - DNA, 25 bp, Mus musculus
aaaccagatgttgcattctattaaa

SEQ ID NO: 7251 - DNA, 25 bp, Mus musculus
aaaccagatttcacatcagccgaaa

SEQ ID NO: 7252 - DNA, 25 bp, Mus musculus
aaaccagatttctcatcagccgaaa

SEQ ID NO: 7253 - DNA, 25 bp, Mus musculus
aaaccagcaacccaactgaaggtgt

SEQ ID NO: 7254 - DNA, 25 bp, Mus musculus
aaaccagcaaccgaactgaaggtgt

SEQ ID NO: 7255 - DNA, 25 bp, Mus musculus
aaaccagcacctcctactgagttgt

SEQ ID NO: 7256 - DNA, 25 bp, Mus musculus
aaaccagcacctgctactgagttgt

SEQ ID NO: 7257 - DNA, 25 bp, Mus musculus
aaaccagcagatcccttctcttttg

SEQ ID NO: 7258 - DNA, 25 bp, Mus musculus
aaaccagcagatgccttctcttttg

SEQ ID NO: 7259 - DNA, 25 bp, Mus musculus
aaaccagcagccattctgacgaagt

SEQ ID NO: 7260 - DNA, 25 bp, Mus musculus
aaaccagcagcctttctgacgaagt

SEQ ID NO: 7261 - DNA, 25 bp, Mus musculus
aaaccagcagctcccataataatct

SEQ ID NO: 7262 - DNA, 25 bp, Mus musculus
aaaccagcagctgccataataatct

SEQ ID NO: 7263 - DNA, 25 bp, Mus musculus
aaaccagccaagaccagagactgaa

SEQ ID NO: 7264 - DNA, 25 bp, Mus musculus
aaaccagccaagacccgagagtgag

SEQ ID NO: 7265 - DNA, 25 bp, Mus musculus
aaaccagccaagtccagagactgaa

SEQ ID NO: 7266 - DNA, 25 bp, Mus musculus
aaaccagccaagtcccgagagtgag

SEQ ID NO: 7267 - DNA, 25 bp, Mus musculus
aaaccagccagaagcactaatgcag

SEQ ID NO: 7268 - DNA, 25 bp, Mus musculus
aaaccagccagatgcactaatgcag

SEQ ID NO: 7269 - DNA, 25 bp, Mus musculus
aaaccagccatcaaaaggcccatgg

SEQ ID NO: 7270 - DNA, 25 bp, Mus musculus
aaaccagccatctaaaggcccatgg

SEQ ID NO: 7271 - DNA, 25 bp, Mus musculus
aaaccagcctggaagtggagcacac

SEQ ID NO: 7272 - DNA, 25 bp, Mus musculus
aaaccagcctggtagtggagcacac

SEQ ID NO: 7273 - DNA, 25 bp, Mus musculus
aaaccagccttcagagcgttttctg

SEQ ID NO: 7274 - DNA, 25 bp, Mus musculus
aaaccagccttctgagcgttttctg

SEQ ID NO: 7275 - DNA, 25 bp, Mus musculus
aaaccagcgcctcactctagggtag

SEQ ID NO: 7276 - DNA, 25 bp, Mus musculus
aaaccagcgcctgactctagggtag

SEQ ID NO: 7277 - DNA, 25 bp, Mus musculus
aaaccagcggtcataatgaacacta

SEQ ID NO: 7278 - DNA, 25 bp, Mus musculus
aaaccagcggtcttaatgaacacta

SEQ ID NO: 7279 - DNA, 25 bp, Mus musculus
aaaccagcggttagcaggctctgcg

SEQ ID NO: 7280 - DNA, 25 bp, Mus musculus
aaaccagcggtttgcaggctctgcg

SEQ ID NO: 7281 - DNA, 25 bp, Mus musculus
aaaccagcgtttacaacaaatactg

SEQ ID NO: 7282 - DNA, 25 bp, Mus musculus
aaaccagcgttttcaacaaatactg

SEQ ID NO: 7283 - DNA, 25 bp, Mus musculus
aaaccagctaacactgtaacagtga

SEQ ID NO: 7284 - DNA, 25 bp, Mus musculus
aaaccagctaactctgtaacagtga

SEQ ID NO: 7285 - DNA, 25 bp, Mus musculus
aaaccagctcgaagactccttgcaa

SEQ ID NO: 7286 - DNA, 25 bp, Mus musculus
aaaccagctcgatgactccttgcaa

SEQ ID NO: 7287 - DNA, 25 bp, Mus musculus
aaaccagctctaaacttgctgtccc

SEQ ID NO: 7288 - DNA, 25 bp, Mus musculus
aaaccagctctatacttgctgtccc

SEQ ID NO: 7289 - DNA, 25 bp, Mus musculus
aaaccagctgctatgtggttgcctc

SEQ ID NO: 7290 - DNA, 25 bp, Mus musculus
aaaccagctgctttgtggttgcctc

SEQ ID NO: 7291 - DNA, 25 bp, Mus musculus
aaaccagctgggagtgatatcccat

SEQ ID NO: 7292 - DNA, 25 bp, Mus musculus
aaaccagctgggtgtgatatcccat

SEQ ID NO: 7293 - DNA, 25 bp, Mus musculus
aaaccagcttaaaccattctccata

SEQ ID NO: 7294 - DNA, 25 bp, Mus musculus
aaaccagcttaatccattctccata

SEQ ID NO: 7295 - DNA, 25 bp, Mus musculus
aaaccagctttcatctgtataactc

SEQ ID NO: 7296 - DNA, 25 bp, Mus musculus
aaaccagctttcttctgtataactc

SEQ ID NO: 7297 - DNA, 25 bp, Mus musculus
aaaccagctttgactcggaggcgag

SEQ ID NO: 7298 - DNA, 25 bp, Mus musculus
aaaccagctttgtctcggaggcgag

SEQ ID NO: 7299 - DNA, 25 bp, Mus musculus
aaaccaggaagaaccgatcaccagc

SEQ ID NO: 7300 - DNA, 25 bp, Mus musculus
aaaccaggaagatccgatcaccagc

SEQ ID NO: 7301 - DNA, 25 bp, Mus musculus
aaaccaggacacatcatgactgcct

SEQ ID NO: 7302 - DNA, 25 bp, Mus musculus
aaaccaggacacttcatgactgcct

SEQ ID NO: 7303 - DNA, 25 bp, Mus musculus
aaaccaggacagctcttgaaaggcc

SEQ ID NO: 7304 - DNA, 25 bp, Mus musculus
aaaccaggacaggtcttgaaaggcc

SEQ ID NO: 7305 - DNA, 25 bp, Mus musculus
aaaccaggagaaccattattttgaa

SEQ ID NO: 7306 - DNA, 25 bp, Mus musculus
aaaccaggagaagcattattttgaa

SEQ ID NO: 7307 - DNA, 25 bp, Mus musculus
aaaccaggagcaaagtgagacccca

SEQ ID NO: 7308 - DNA, 25 bp, Mus musculus
aaaccaggagcatagtgagacccca

SEQ ID NO: 7309 - DNA, 25 bp, Mus musculus
aaaccaggagccaatcataagtgag

SEQ ID NO: 7310 - DNA, 25 bp, Mus musculus
aaaccaggagccaggtcgtgccatg

SEQ ID NO: 7311 - DNA, 25 bp, Mus musculus
aaaccaggagcctatcataagtgag

SEQ ID NO: 7312 - DNA, 25 bp, Mus musculus
aaaccaggagcctggtcgtgccatg

SEQ ID NO: 7313 - DNA, 25 bp, Mus musculus
aaaccaggaggtacttgctgaccca

SEQ ID NO: 7314 - DNA, 25 bp, Mus musculus
aaaccaggaggtcgtgacgcaagcc

SEQ ID NO: 7315 - DNA, 25 bp, Mus musculus
aaaccaggaggtggtgacgcaagcc

SEQ ID NO: 7316 - DNA, 25 bp, Mus musculus
aaaccaggaggttcttgctgaccca

SEQ ID NO: 7317 - DNA, 25 bp, Mus musculus
aaaccaggagtactgtgaagcacct

SEQ ID NO: 7318 - DNA, 25 bp, Mus musculus
aaaccaggagtagtgtgaagcacct

SEQ ID NO: 7319 - DNA, 25 bp, Mus musculus
aaaccaggagtgacgcaagcaagat

SEQ ID NO: 7320 - DNA, 25 bp, Mus musculus
aaaccaggagtgattcctccagaag

SEQ ID NO: 7321 - DNA, 25 bp, Mus musculus
aaaccaggagtgtcgcaagcaagat

SEQ ID NO: 7322 - DNA, 25 bp, Mus musculus
aaaccaggagtgtttcctccagaag

SEQ ID NO: 7323 - DNA, 25 bp, Mus musculus
aaaccaggcacacaagtgacataca

SEQ ID NO: 7324 - DNA, 25 bp, Mus musculus
aaaccaggcacagaagtgacataca

SEQ ID NO: 7325 - DNA, 25 bp, Mus musculus
aaaccaggcagtccggtgctttaca

SEQ ID NO: 7326 - DNA, 25 bp, Mus musculus
aaaccaggcagtgcggtgctttaca

SEQ ID NO: 7327 - DNA, 25 bp, Mus musculus
aaaccaggccataggtagctgctca

SEQ ID NO: 7328 - DNA, 25 bp, Mus musculus
aaaccaggccattggtagctgctca

SEQ ID NO: 7329 - DNA, 25 bp, Mus musculus
aaaccaggcctgcagagcaaatatg

SEQ ID NO: 7330 - DNA, 25 bp, Mus musculus
aaaccaggcctggagagcaaatatg

SEQ ID NO: 7331 - DNA, 25 bp, Mus musculus
aaaccaggctcacccatgtgtgtct

SEQ ID NO: 7332 - DNA, 25 bp, Mus musculus
aaaccaggctcagccatgtgtgtct

SEQ ID NO: 7333 - DNA, 25 bp, Mus musculus
aaaccaggcttgattttattagaat

SEQ ID NO: 7334 - DNA, 25 bp, Mus musculus
aaaccaggcttgtttttattagaat

SEQ ID NO: 7335 - DNA, 25 bp, Mus musculus
aaaccagggcaaattcggaggctct

SEQ ID NO: 7336 - DNA, 25 bp, Mus musculus
aaaccagggcaatttcggaggctct

SEQ ID NO: 7337 - DNA, 25 bp, Mus musculus
aaaccagggctgacagtagctctga

SEQ ID NO: 7338 - DNA, 25 bp, Mus musculus
aaaccagggctgtcagtagctctga

SEQ ID NO: 7339 - DNA, 25 bp, Mus musculus
aaaccagggtcaagagccggatact

SEQ ID NO: 7340 - DNA, 25 bp, Mus musculus
aaaccagggtcatgagccggatact

SEQ ID NO: 7341 - DNA, 25 bp, Mus musculus
aaaccagggtgaacgaagctctcta

SEQ ID NO: 7342 - DNA, 25 bp, Mus musculus
aaaccagggtgatcgaagctctcta

SEQ ID NO: 7343 - DNA, 25 bp, Mus musculus
aaaccaggtaatccaaattctctac

SEQ ID NO: 7344 - DNA, 25 bp, Mus musculus
aaaccaggtaatgcaaattctctac

SEQ ID NO: 7345 - DNA, 25 bp, Mus musculus
aaaccaggtcccacgatggtccaat

SEQ ID NO: 7346 - DNA, 25 bp, Mus musculus
aaaccaggtccctcgatggtccaat

SEQ ID NO: 7347 - DNA, 25 bp, Mus musculus
aaaccaggtgagctgctgtgagtct

SEQ ID NO: 7348 - DNA, 25 bp, Mus musculus
aaaccaggtgaggtgctgtgagtct

SEQ ID NO: 7349 - DNA, 25 bp, Mus musculus
aaaccaggtgccaggacaatgtgga

SEQ ID NO: 7350 - DNA, 25 bp, Mus musculus
aaaccaggtgcctggacaatgtgga

SEQ ID NO: 7351 - DNA, 25 bp, Mus musculus
aaaccaggtggtacatacatgccaa

SEQ ID NO: 7352 - DNA, 25 bp, Mus musculus
aaaccaggtggttcatacatgccaa

SEQ ID NO: 7353 - DNA, 25 bp, Mus musculus
aaaccaggttgtcgtctgtaatata

SEQ ID NO: 7354 - DNA, 25 bp, Mus musculus
aaaccaggttgtggtctgtaatata

SEQ ID NO: 7355 - DNA, 25 bp, Mus musculus
aaaccagtaagcatattcctaacac

SEQ ID NO: 7356 - DNA, 25 bp, Mus musculus
aaaccagtaagcttattcctaacac

SEQ ID NO: 7357 - DNA, 25 bp, Mus musculus
aaaccagtatatcgtcagtgtgagc

SEQ ID NO: 7358 - DNA, 25 bp, Mus musculus
aaaccagtatatggtcagtgtgagc

SEQ ID NO: 7359 - DNA, 25 bp, Mus musculus
aaaccagtattcatttaggctacag

SEQ ID NO: 7360 - DNA, 25 bp, Mus musculus
aaaccagtattcttttaggctacag

SEQ ID NO: 7361 - DNA, 25 bp, Mus musculus
aaaccagtcaagatattaatgtcaa

SEQ ID NO: 7362 - DNA, 25 bp, Mus musculus
aaaccagtcaagttattaatgtcaa

SEQ ID NO: 7363 - DNA, 25 bp, Mus musculus
aaaccagtcagcaaatgttgggtcc

SEQ ID NO: 7364 - DNA, 25 bp, Mus musculus
aaaccagtcagctaatgttgggtcc

SEQ ID NO: 7365 - DNA, 25 bp, Mus musculus
aaaccagtccctacgctcagtgaat

SEQ ID NO: 7366 - DNA, 25 bp, Mus musculus
aaaccagtcccttcgctcagtgaat

SEQ ID NO: 7367 - DNA, 25 bp, Mus musculus
aaaccagtcggacgtcttggctata

SEQ ID NO: 7368 - DNA, 25 bp, Mus musculus
aaaccagtcggaggtcttggctata

SEQ ID NO: 7369 - DNA, 25 bp, Mus musculus
aaaccagtctcaattgggcttctca

SEQ ID NO: 7370 - DNA, 25 bp, Mus musculus
aaaccagtctcatttgggcttctca

SEQ ID NO: 7371 - DNA, 25 bp, Mus musculus
aaaccagtgatcagagctagtgcta

SEQ ID NO: 7372 - DNA, 25 bp, Mus musculus
aaaccagtgatctgagctagtgcta

SEQ ID NO: 7373 - DNA, 25 bp, Mus musculus
aaaccagtgcatcctgagacggcag

SEQ ID NO: 7374 - DNA, 25 bp, Mus musculus
aaaccagtgcatgctgagacggcag

SEQ ID NO: 7375 - DNA, 25 bp, Mus musculus
aaaccagtgcgtctgtgcagaacgt

SEQ ID NO: 7376 - DNA, 25 bp, Mus musculus
aaaccagtgcgtgtgtgcagaacgt

SEQ ID NO: 7377 - DNA, 25 bp, Mus musculus
aaaccagtgctcaggttgggcagca

SEQ ID NO: 7378 - DNA, 25 bp, Mus musculus
aaaccagtgctctggttgggcagca

SEQ ID NO: 7379 - DNA, 25 bp, Mus musculus
aaaccagtgggaagttggtgtccat

SEQ ID NO: 7380 - DNA, 25 bp, Mus musculus
aaaccagtgggatgttggtgtccat

SEQ ID NO: 7381 - DNA, 25 bp, Mus musculus
aaaccagtgtatctgaagtctcatg

SEQ ID NO: 7382 - DNA, 25 bp, Mus musculus
aaaccagtgtatgtgaagtctcatg

SEQ ID NO: 7383 - DNA, 25 bp, Mus musculus
aaaccagtgtccactggattcctct

SEQ ID NO: 7384 - DNA, 25 bp, Mus musculus
aaaccagtgtcctctggattcctct

SEQ ID NO: 7385 - DNA, 25 bp, Mus musculus
aaaccagtgtgcagctgattccagg

SEQ ID NO: 7386 - DNA, 25 bp, Mus musculus
aaaccagtgtgctgctgattccagg

SEQ ID NO: 7387 - DNA, 25 bp, Mus musculus
aaaccagttagccagcatctatgga

SEQ ID NO: 7388 - DNA, 25 bp, Mus musculus
aaaccagttagcgagcatctatgga

SEQ ID NO: 7389 - DNA, 25 bp, Mus musculus
aaaccagttccactggcagtactgc

SEQ ID NO: 7390 - DNA, 25 bp, Mus musculus
aaaccagttccagtggcagtactgc

SEQ ID NO: 7391 - DNA, 25 bp, Mus musculus
aaaccagttctgcttttgctaagta

SEQ ID NO: 7392 - DNA, 25 bp, Mus musculus
aaaccagttctggttttgctaagta

SEQ ID NO: 7393 - DNA, 25 bp, Mus musculus
aaaccagtttagatcttcacctatg

SEQ ID NO: 7394 - DNA, 25 bp, Mus musculus
aaaccagtttagttcttcacctatg

SEQ ID NO: 7395 - DNA, 25 bp, Mus musculus
aaaccagtttccaattcgagataat

SEQ ID NO: 7396 - DNA, 25 bp, Mus musculus
aaaccagtttcctattcgagataat

SEQ ID NO: 7397 - DNA, 25 bp, Mus musculus
aaaccataatctccagttctgtgta

SEQ ID NO: 7398 - DNA, 25 bp, Mus musculus
aaaccataatctgcagttctgtgta

SEQ ID NO: 7399 - DNA, 25 bp, Mus musculus
aaaccataattccaggtctgtggac

SEQ ID NO: 7400 - DNA, 25 bp, Mus musculus
aaaccataattcgaggtctgtggac

SEQ ID NO: 7401 - DNA, 25 bp, Mus musculus
aaaccatagtaaccttatgtgtaca

SEQ ID NO: 7402 - DNA, 25 bp, Mus musculus
aaaccatagtaagcttatgtgtaca

SEQ ID NO: 7403 - DNA, 25 bp, Mus musculus
aaaccatagtggaggcatgctggaa

SEQ ID NO: 7404 - DNA, 25 bp, Mus musculus
aaaccatagtggtggcatgctggaa

SEQ ID NO: 7405 - DNA, 25 bp, Mus musculus
aaaccatatatgcttcctagtcata

SEQ ID NO: 7406 - DNA, 25 bp, Mus musculus
aaaccatatatggttcctagtcata

SEQ ID NO: 7407 - DNA, 25 bp, Mus musculus
aaaccatattatacacagtcacaca

SEQ ID NO: 7408 - DNA, 25 bp, Mus musculus
aaaccatattattcacagtcacaca

SEQ ID NO: 7409 - DNA, 25 bp, Mus musculus
aaaccatcaaagctttcgggccctg

SEQ ID NO: 7410 - DNA, 25 bp, Mus musculus
aaaccatcaaaggtttcgggccctg

SEQ ID NO: 7411 - DNA, 25 bp, Mus musculus
aaaccatcagacctcaattgtacaa

SEQ ID NO: 7412 - DNA, 25 bp, Mus musculus
aaaccatcagacgtcaattgtacaa

SEQ ID NO: 7413 - DNA, 25 bp, Mus musculus
aaaccatcagctcttctataaatag

SEQ ID NO: 7414 - DNA, 25 bp, Mus musculus
aaaccatcagctgttctataaatag

SEQ ID NO: 7415 - DNA, 25 bp, Mus musculus
aaaccatcatacattctcacattgc

SEQ ID NO: 7416 - DNA, 25 bp, Mus musculus
aaaccatcatactttctcacattgc

SEQ ID NO: 7417 - DNA, 25 bp, Mus musculus
aaaccatcatcgattctccagagtt

SEQ ID NO: 7418 - DNA, 25 bp, Mus musculus
aaaccatcatcgtttctccagagtt

SEQ ID NO: 7419 - DNA, 25 bp, Mus musculus
aaaccatcatgccatgtatggagag

SEQ ID NO: 7420 - DNA, 25 bp, Mus musculus
aaaccatcatgcgatgtatggagag

SEQ ID NO: 7421 - DNA, 25 bp, Mus musculus
aaaccatccagcattcattaaacca

SEQ ID NO: 7422 - DNA, 25 bp, Mus musculus
aaaccatccagctttcattaaacca

SEQ ID NO: 7423 - DNA, 25 bp, Mus musculus
aaaccatccccaaaaagtgcttcta

SEQ ID NO: 7424 - DNA, 25 bp, Mus musculus
aaaccatccccataaagtgcttcta

SEQ ID NO: 7425 - DNA, 25 bp, Mus musculus
aaaccatcctaccaagttcctgctt

SEQ ID NO: 7426 - DNA, 25 bp, Mus musculus
aaaccatcctacgaagttcctgctt

SEQ ID NO: 7427 - DNA, 25 bp, Mus musculus
aaaccatcctcacctggattctcag

SEQ ID NO: 7428 - DNA, 25 bp, Mus musculus
aaaccatcctcactttttatacatg

SEQ ID NO: 7429 - DNA, 25 bp, Mus musculus
aaaccatcctcagctggattctcag

SEQ ID NO: 7430 - DNA, 25 bp, Mus musculus
aaaccatcctcagtttttatacatg

SEQ ID NO: 7431 - DNA, 25 bp, Mus musculus
aaaccatctcacagcgtgtgcggag

SEQ ID NO: 7432 - DNA, 25 bp, Mus musculus
aaaccatctcactgcgtgtgcggag

SEQ ID NO: 7433 - DNA, 25 bp, Mus musculus
aaaccatctcatcctttatactgtg

SEQ ID NO: 7434 - DNA, 25 bp, Mus musculus
aaaccatctcatgctttatactgtg

SEQ ID NO: 7435 - DNA, 25 bp, Mus musculus
aaaccatctccaccaaatggctgtg

SEQ ID NO: 7436 - DNA, 25 bp, Mus musculus
aaaccatctccacgtcggtgaaaga

SEQ ID NO: 7437 - DNA, 25 bp, Mus musculus
aaaccatctccagcaaatggctgtg

SEQ ID NO: 7438 - DNA, 25 bp, Mus musculus
aaaccatctccaggtcggtgaaaga

SEQ ID NO: 7439 - DNA, 25 bp, Mus musculus
aaaccatctcctaaggtatcgtgaa

SEQ ID NO: 7440 - DNA, 25 bp, Mus musculus
aaaccatctccttaggtatcgtgaa

SEQ ID NO: 7441 - DNA, 25 bp, Mus musculus
aaaccatctctcagaacacttgtct

SEQ ID NO: 7442 - DNA, 25 bp, Mus musculus
aaaccatctctctgaacacttgtct

SEQ ID NO: 7443 - DNA, 25 bp, Mus musculus
aaaccatctgacaggagggcccggg

SEQ ID NO: 7444 - DNA, 25 bp, Mus musculus
aaaccatctgactggagggcccggg

SEQ ID NO: 7445 - DNA, 25 bp, Mus musculus
aaaccatctgatccatggcgctgtt

SEQ ID NO: 7446 - DNA, 25 bp, Mus musculus
aaaccatctgatgcatggcgctgtt

SEQ ID NO: 7447 - DNA, 25 bp, Mus musculus
aaaccatctgctctgctctacaagt

SEQ ID NO: 7448 - DNA, 25 bp, Mus musculus
aaaccatctgctgtgctctacaagt

SEQ ID NO: 7449 - DNA, 25 bp, Mus musculus
aaaccatctttgcatcccatttata

SEQ ID NO: 7450 - DNA, 25 bp, Mus musculus
aaaccatctttggatcccatttata

SEQ ID NO: 7451 - DNA, 25 bp, Mus musculus
aaaccatgactcagacatctttata

SEQ ID NO: 7452 - DNA, 25 bp, Mus musculus
aaaccatgactcatagcttttttgt

SEQ ID NO: 7453 - DNA, 25 bp, Mus musculus
aaaccatgactctgacatctttata

SEQ ID NO: 7454 - DNA, 25 bp, Mus musculus
aaaccatgactcttagcttttttgt

SEQ ID NO: 7455 - DNA, 25 bp, Mus musculus
aaaccatgagccaaagtcgaccctt

SEQ ID NO: 7456 - DNA, 25 bp, Mus musculus
aaaccatgagcctaagtcgaccctt

SEQ ID NO: 7457 - DNA, 25 bp, Mus musculus
aaaccatgaggactgtccccatcat

SEQ ID NO: 7458 - DNA, 25 bp, Mus musculus
aaaccatgaggagtgtccccatcat

SEQ ID NO: 7459 - DNA, 25 bp, Mus musculus
aaaccatgagtgaacgcctcaggaa

SEQ ID NO: 7460 - DNA, 25 bp, Mus musculus
aaaccatgagtgtacgcctcaggaa

SEQ ID NO: 7461 - DNA, 25 bp, Mus musculus
aaaccatgagttctggcttcgagcc

SEQ ID NO: 7462 - DNA, 25 bp, Mus musculus
aaaccatgagttgtggcttcgagcc

SEQ ID NO: 7463 - DNA, 25 bp, Mus musculus
aaaccatgcaacaagaaaccagaat

SEQ ID NO: 7464 - DNA, 25 bp, Mus musculus
aaaccatgcaactagaaaccagaat

SEQ ID NO: 7465 - DNA, 25 bp, Mus musculus
aaaccatgcagcatcatcaattttt

SEQ ID NO: 7466 - DNA, 25 bp, Mus musculus
aaaccatgcagcttcatcaattttt

SEQ ID NO: 7467 - DNA, 25 bp, Mus musculus
aaaccatgcatcatttcttcagaag

SEQ ID NO: 7468 - DNA, 25 bp, Mus musculus
aaaccatgcatcttttcttcagaag

SEQ ID NO: 7469 - DNA, 25 bp, Mus musculus
aaaccatgcccaatggtacagggaa

SEQ ID NO: 7470 - DNA, 25 bp, Mus musculus
aaaccatgcccattggtacagggaa

SEQ ID NO: 7471 - DNA, 25 bp, Mus musculus
aaaccatgcctcattgaggtaacat

SEQ ID NO: 7472 - DNA, 25 bp, Mus musculus
aaaccatgcctctttgaggtaacat

SEQ ID NO: 7473 - DNA, 25 bp, Mus musculus
aaaccatgcctgaatctgcaatgca

SEQ ID NO: 7474 - DNA, 25 bp, Mus musculus
aaaccatgcctgtatctgcaatgca

SEQ ID NO: 7475 - DNA, 25 bp, Mus musculus
aaaccatggaggaatacggcttgct

SEQ ID NO: 7476 - DNA, 25 bp, Mus musculus
aaaccatggaggtatacggcttgct

SEQ ID NO: 7477 - DNA, 25 bp, Mus musculus
aaaccatggataattttcctcaggg

SEQ ID NO: 7478 - DNA, 25 bp, Mus musculus
aaaccatggatatttttcctcaggg

SEQ ID NO: 7479 - DNA, 25 bp, Mus musculus
aaaccatggatgcagctgaccaaat

SEQ ID NO: 7480 - DNA, 25 bp, Mus musculus
aaaccatggatggagctgaccaaat

SEQ ID NO: 7481 - DNA, 25 bp, Mus musculus
aaaccatggcagctgaacgttggct

SEQ ID NO: 7482 - DNA, 25 bp, Mus musculus
aaaccatggcaggtgaacgttggct

SEQ ID NO: 7483 - DNA, 25 bp, Mus musculus
aaaccatggctcatttaagttctta

SEQ ID NO: 7484 - DNA, 25 bp, Mus musculus
aaaccatggctcttttaagttctta

SEQ ID NO: 7485 - DNA, 25 bp, Mus musculus
aaaccatgggagatccgggcagaac

SEQ ID NO: 7486 - DNA, 25 bp, Mus musculus
aaaccatgggagttccgggcagaac

SEQ ID NO: 7487 - DNA, 25 bp, Mus musculus
aaaccatgggatcaatcagttgagc

SEQ ID NO: 7488 - DNA, 25 bp, Mus musculus
aaaccatgggatgaatcagttgagc

SEQ ID NO: 7489 - DNA, 25 bp, Mus musculus
aaaccatgggctacagtcagcaaga

SEQ ID NO: 7490 - DNA, 25 bp, Mus musculus
aaaccatgggcttcagtcagcaaga

SEQ ID NO: 7491 - DNA, 25 bp, Mus musculus
aaaccatgtaaaccccgaggagcgt

SEQ ID NO: 7492 - DNA, 25 bp, Mus musculus
aaaccatgtaaagcccgaggagcgt

SEQ ID NO: 7493 - DNA, 25 bp, Mus musculus
aaaccatgtgggacatccagccttg

SEQ ID NO: 7494 - DNA, 25 bp, Mus musculus
aaaccatgtgggtcatccagccttg

SEQ ID NO: 7495 - DNA, 25 bp, Mus musculus
aaaccatgttacagcttggcaggcc

SEQ ID NO: 7496 - DNA, 25 bp, Mus musculus
aaaccatgttactgcttggcaggcc

SEQ ID NO: 7497 - DNA, 25 bp, Mus musculus
aaaccatgttcgatgtctccagaag

SEQ ID NO: 7498 - DNA, 25 bp, Mus musculus
aaaccatgttcgttgtctccagaag

SEQ ID NO: 7499 - DNA, 25 bp, Mus musculus
aaaccatgttggagctatactagta

SEQ ID NO: 7500 - DNA, 25 bp, Mus musculus
aaaccatgttggtgctatactagta

SEQ ID NO: 7501 - DNA, 25 bp, Mus musculus
aaaccatgttttatatattcaatca

SEQ ID NO: 7502 - DNA, 25 bp, Mus musculus
aaaccatgttttttatattcaatca

SEQ ID NO: 7503 - DNA, 25 bp, Mus musculus
aaaccattaccaattcttgctccct

SEQ ID NO: 7504 - DNA, 25 bp, Mus musculus
aaaccattaccatttcttgctccct

SEQ ID NO: 7505 - DNA, 25 bp, Mus musculus
aaaccattaggaacagctgcttgta

SEQ ID NO: 7506 - DNA, 25 bp, Mus musculus
aaaccattaggatcagctgcttgta

SEQ ID NO: 7507 - DNA, 25 bp, Mus musculus
aaaccattatccaatgtgctccctt

SEQ ID NO: 7508 - DNA, 25 bp, Mus musculus
aaaccattatcctatgtgctccctt

SEQ ID NO: 7509 - DNA, 25 bp, Mus musculus
aaaccattcactctcttaattccga

SEQ ID NO: 7510 - DNA, 25 bp, Mus musculus
aaaccattcactgtcttaattccga

SEQ ID NO: 7511 - DNA, 25 bp, Mus musculus
aaaccattccctcggagaatcaact

SEQ ID NO: 7512 - DNA, 25 bp, Mus musculus
aaaccattccctgggagaatcaact

SEQ ID NO: 7513 - DNA, 25 bp, Mus musculus
aaaccattcgctagctttcagatag

SEQ ID NO: 7514 - DNA, 25 bp, Mus musculus
aaaccattcgcttgctttcagatag

SEQ ID NO: 7515 - DNA, 25 bp, Mus musculus
aaaccattcggtcactcagttgggt

SEQ ID NO: 7516 - DNA, 25 bp, Mus musculus
aaaccattcggtgactcagttgggt

SEQ ID NO: 7517 - DNA, 25 bp, Mus musculus
aaaccattctccctcagtgaatttg

SEQ ID NO: 7518 - DNA, 25 bp, Mus musculus
aaaccattctccgtcagtgaatttg

SEQ ID NO: 7519 - DNA, 25 bp, Mus musculus
aaaccattgtccattcccatatata

SEQ ID NO: 7520 - DNA, 25 bp, Mus musculus
aaaccattgtcctttcccatatata

SEQ ID NO: 7521 - DNA, 25 bp, Mus musculus
aaaccattgtgcatcttcataggaa

SEQ ID NO: 7522 - DNA, 25 bp, Mus musculus
aaaccattgtgcattctgagatccg

SEQ ID NO: 7523 - DNA, 25 bp, Mus musculus
aaaccattgtgcttcttcataggaa

SEQ ID NO: 7524 - DNA, 25 bp, Mus musculus
aaaccattgtgctttctgagatccg

SEQ ID NO: 7525 - DNA, 25 bp, Mus musculus
aaaccattgtggatttttgctgctc

SEQ ID NO: 7526 - DNA, 25 bp, Mus musculus
aaaccattgtggttttttgctgctc

SEQ ID NO: 7527 - DNA, 25 bp, Mus musculus
aaaccattgtgtctcttgtcgtgtc

SEQ ID NO: 7528 - DNA, 25 bp, Mus musculus
aaaccattgtgtgtcttgtcgtgtc

SEQ ID NO: 7529 - DNA, 25 bp, Mus musculus
aaaccatttctaagcactgttccgt

SEQ ID NO: 7530 - DNA, 25 bp, Mus musculus
aaaccatttctatgcactgttccgt

SEQ ID NO: 7531 - DNA, 25 bp, Mus musculus
aaaccatttctgattggctgcatcc

SEQ ID NO: 7532 - DNA, 25 bp, Mus musculus
aaaccatttctgtttggctgcatcc

SEQ ID NO: 7533 - DNA, 25 bp, Mus musculus
aaaccatttggcatgttccaactgg

SEQ ID NO: 7534 - DNA, 25 bp, Mus musculus
aaaccatttggcttgttccaactgg

SEQ ID NO: 7535 - DNA, 25 bp, Mus musculus
aaacccaaatctaatgtcttcacca

SEQ ID NO: 7536 - DNA, 25 bp, Mus musculus
aaacccaaatcttatgtcttcacca

SEQ ID NO: 7537 - DNA, 25 bp, Mus musculus
aaacccaaatgcatgtgcaatatgt

SEQ ID NO: 7538 - DNA, 25 bp, Mus musculus
aaacccaaatgcttgtgcaatatgt

SEQ ID NO: 7539 - DNA, 25 bp, Mus musculus
aaacccaaattcaaaagctcacaag

SEQ ID NO: 7540 - DNA, 25 bp, Mus musculus
aaacccaaattctaaagctcacaag

SEQ ID NO: 7541 - DNA, 25 bp, Mus musculus
aaacccaagagccttactgacctgt

SEQ ID NO: 7542 - DNA, 25 bp, Mus musculus
aaacccaagagcgttactgacctgt

SEQ ID NO: 7543 - DNA, 25 bp, Mus musculus
aaacccaagcagatctggtgtttgc

SEQ ID NO: 7544 - DNA, 25 bp, Mus musculus
aaacccaagcagttctggtgtttgc

SEQ ID NO: 7545 - DNA, 25 bp, Mus musculus
aaacccaaggccagaatgtcattgt

SEQ ID NO: 7546 - DNA, 25 bp, Mus musculus
aaacccaaggcctgaatgtcattgt

SEQ ID NO: 7547 - DNA, 25 bp, Mus musculus
aaacccaaggctacttgcacactat

SEQ ID NO: 7548 - DNA, 25 bp, Mus musculus
aaacccaaggcttcttgcacactat

SEQ ID NO: 7549 - DNA, 25 bp, Mus musculus
aaacccaagggcacatccctgatct

SEQ ID NO: 7550 - DNA, 25 bp, Mus musculus
aaacccaagggcagctgtattaaat

SEQ ID NO: 7551 - DNA, 25 bp, Mus musculus
aaacccaagggctcatccctgatct

SEQ ID NO: 7552 - DNA, 25 bp, Mus musculus
aaacccaagggctgctgtattaaat

SEQ ID NO: 7553 - DNA, 25 bp, Mus musculus
aaacccaaggttcataagcagtcat

SEQ ID NO: 7554 - DNA, 25 bp, Mus musculus
aaacccaaggttgataagcagtcat

SEQ ID NO: 7555 - DNA, 25 bp, Mus musculus
aaacccaagtggatttaagacatag

SEQ ID NO: 7556 - DNA, 25 bp, Mus musculus
aaacccaagtggttttaagacatag

SEQ ID NO: 7557 - DNA, 25 bp, Mus musculus
aaacccaagttgaagagcagaaaga

SEQ ID NO: 7558 - DNA, 25 bp, Mus musculus
aaacccaagttgtagagcagaaaga

SEQ ID NO: 7559 - DNA, 25 bp, Mus musculus
aaacccaatgttcgctggcgagagc

SEQ ID NO: 7560 - DNA, 25 bp, Mus musculus
aaacccaatgttggctggcgagagc

SEQ ID NO: 7561 - DNA, 25 bp, Mus musculus
aaacccacagccagtattttggtga

SEQ ID NO: 7562 - DNA, 25 bp, Mus musculus
aaacccacagcctgtattttggtga

SEQ ID NO: 7563 - DNA, 25 bp, Mus musculus
aaacccacatagaattcacatgaaa

SEQ ID NO: 7564 - DNA, 25 bp, Mus musculus
aaacccacatagtattcacatgaaa

SEQ ID NO: 7565 - DNA, 25 bp, Mus musculus
aaacccaccctaaccaggaatctgg

SEQ ID NO: 7566 - DNA, 25 bp, Mus musculus
aaacccaccctatccaggaatctgg

SEQ ID NO: 7567 - DNA, 25 bp, Mus musculus
aaacccaccctgctgagttgttcat

SEQ ID NO: 7568 - DNA, 25 bp, Mus musculus
aaacccaccctggtgagttgttcat

SEQ ID NO: 7569 - DNA, 25 bp, Mus musculus
aaacccacctgaagacacttggcga

SEQ ID NO: 7570 - DNA, 25 bp, Mus musculus
aaacccacctgatgacacttggcga

SEQ ID NO: 7571 - DNA, 25 bp, Mus musculus
aaacccacgacaatgacatcatgat

SEQ ID NO: 7572 - DNA, 25 bp, Mus musculus
aaacccacgacattgacatcatgat

SEQ ID NO: 7573 - DNA, 25 bp, Mus musculus
aaacccactaaaatcctatctccag

SEQ ID NO: 7574 - DNA, 25 bp, Mus musculus
aaacccactaaattcctatctccag

SEQ ID NO: 7575 - DNA, 25 bp, Mus musculus
aaacccactggcagggctacctgag

SEQ ID NO: 7576 - DNA, 25 bp, Mus musculus
aaacccactggctgggctacctgag

SEQ ID NO: 7577 - DNA, 25 bp, Mus musculus
aaacccacttacacagcatctatgt

SEQ ID NO: 7578 - DNA, 25 bp, Mus musculus
aaacccacttactcagcatctatgt

SEQ ID NO: 7579 - DNA, 25 bp, Mus musculus
aaacccacttctattcaagctagct

SEQ ID NO: 7580 - DNA, 25 bp, Mus musculus
aaacccacttcttttcaagctagct

SEQ ID NO: 7581 - DNA, 25 bp, Mus musculus
aaacccacttgtcagcaggagccgt

SEQ ID NO: 7582 - DNA, 25 bp, Mus musculus
aaacccacttgtgagcaggagccgt

SEQ ID NO: 7583 - DNA, 25 bp, Mus musculus
aaacccagacagcttttgtgatgtt

SEQ ID NO: 7584 - DNA, 25 bp, Mus musculus
aaacccagacaggttttgtgatgtt

SEQ ID NO: 7585 - DNA, 25 bp, Mus musculus
aaacccagactcaatggaagatgcc

SEQ ID NO: 7586 - DNA, 25 bp, Mus musculus
aaacccagactccagtagcaagcag

SEQ ID NO: 7587 - DNA, 25 bp, Mus musculus
aaacccagactcgagtagcaagcag

SEQ ID NO: 7588 - DNA, 25 bp, Mus musculus
aaacccagactctatggaagatgcc

SEQ ID NO: 7589 - DNA, 25 bp, Mus musculus
aaacccagagagattgcgttggctc

SEQ ID NO: 7590 - DNA, 25 bp, Mus musculus
aaacccagagagtttgcgttggctc

SEQ ID NO: 7591 - DNA, 25 bp, Mus musculus
aaacccagagatcttttgtcactga

SEQ ID NO: 7592 - DNA, 25 bp, Mus musculus
aaacccagagatgttttgtcactga

SEQ ID NO: 7593 - DNA, 25 bp, Mus musculus
aaacccagagcactttgccggcttc

SEQ ID NO: 7594 - DNA, 25 bp, Mus musculus
aaacccagagcagtttgccggcttc

SEQ ID NO: 7595 - DNA, 25 bp, Mus musculus
aaacccagaggaatggccctgctgt

SEQ ID NO: 7596 - DNA, 25 bp, Mus musculus
aaacccagaggattggccctgctgt

SEQ ID NO: 7597 - DNA, 25 bp, Mus musculus
aaacccagaggcaaatcaaggctgt

SEQ ID NO: 7598 - DNA, 25 bp, Mus musculus
aaacccagaggctaatcaaggctgt

SEQ ID NO: 7599 - DNA, 25 bp, Mus musculus
aaacccagatgacccgcatatgctt

SEQ ID NO: 7600 - DNA, 25 bp, Mus musculus
aaacccagatgagccgcatatgctt

SEQ ID NO: 7601 - DNA, 25 bp, Mus musculus
aaacccagatttatcaccccacaag

SEQ ID NO: 7602 - DNA, 25 bp, Mus musculus
aaacccagatttttcaccccacaag

SEQ ID NO: 7603 - DNA, 25 bp, Mus musculus
aaacccagcccaatgtgcagttaac

SEQ ID NO: 7604 - DNA, 25 bp, Mus musculus
aaacccagcccattgtgcagttaac

SEQ ID NO: 7605 - DNA, 25 bp, Mus musculus
aaacccagcctacttcatgctttag

SEQ ID NO: 7606 - DNA, 25 bp, Mus musculus
aaacccagcctagttcatgctttag

SEQ ID NO: 7607 - DNA, 25 bp, Mus musculus
aaacccagctagacgattttaattg

SEQ ID NO: 7608 - DNA, 25 bp, Mus musculus
aaacccagctagtcgattttaattg

SEQ ID NO: 7609 - DNA, 25 bp, Mus musculus
aaacccagcttactccagagaacct

SEQ ID NO: 7610 - DNA, 25 bp, Mus musculus
aaacccagcttagtccagagaacct

SEQ ID NO: 7611 - DNA, 25 bp, Mus musculus
aaacccagctttccatttatccatg

SEQ ID NO: 7612 - DNA, 25 bp, Mus musculus
aaacccagctttgcatttatccatg

SEQ ID NO: 7613 - DNA, 25 bp, Mus musculus
aaacccagggacagaaccaccagct

SEQ ID NO: 7614 - DNA, 25 bp, Mus musculus
aaacccagggactgaaccaccagct

SEQ ID NO: 7615 - DNA, 25 bp, Mus musculus
aaacccagtagcctggagtcgccaa

SEQ ID NO: 7616 - DNA, 25 bp, Mus musculus
aaacccagtagcgtggagtcgccaa

SEQ ID NO: 7617 - DNA, 25 bp, Mus musculus
aaacccagtagtccatttcttcaag

SEQ ID NO: 7618 - DNA, 25 bp, Mus musculus
aaacccagtagtgcatttcttcaag

SEQ ID NO: 7619 - DNA, 25 bp, Mus musculus
aaacccagtgtgatgattaatctag

SEQ ID NO: 7620 - DNA, 25 bp, Mus musculus
aaacccagtgtgttgattaatctag

SEQ ID NO: 7621 - DNA, 25 bp, Mus musculus
aaacccagttgcagccaatttcagt

SEQ ID NO: 7622 - DNA, 25 bp, Mus musculus
aaacccagttgctgccaatttcagt

SEQ ID NO: 7623 - DNA, 25 bp, Mus musculus
aaacccagtttgaggcttggctaat

SEQ ID NO: 7624 - DNA, 25 bp, Mus musculus
aaacccagtttgtggcttggctaat

SEQ ID NO: 7625 - DNA, 25 bp, Mus musculus
aaacccataaagacgatgtcaaatt

SEQ ID NO: 7626 - DNA, 25 bp, Mus musculus
aaacccataaagtcgatgtcaaatt

SEQ ID NO: 7627 - DNA, 25 bp, Mus musculus
aaacccataattattgtcctgcaga

SEQ ID NO: 7628 - DNA, 25 bp, Mus musculus
aaacccataattctggaggtggtgc

SEQ ID NO: 7629 - DNA, 25 bp, Mus musculus
aaacccataattgtggaggtggtgc

SEQ ID NO: 7630 - DNA, 25 bp, Mus musculus
aaacccataatttttgtcctgcaga

SEQ ID NO: 7631 - DNA, 25 bp, Mus musculus
aaacccatagctccgagccaagtgt

SEQ ID NO: 7632 - DNA, 25 bp, Mus musculus
aaacccatagctgcgagccaagtgt

SEQ ID NO: 7633 - DNA, 25 bp, Mus musculus
aaacccatagggagcatacttgaag

SEQ ID NO: 7634 - DNA, 25 bp, Mus musculus
aaacccatagggtgcatacttgaag

SEQ ID NO: 7635 - DNA, 25 bp, Mus musculus
aaacccatataacatgtatcatgct

SEQ ID NO: 7636 - DNA, 25 bp, Mus musculus
aaacccatataagatgtatcatgct

SEQ ID NO: 7637 - DNA, 25 bp, Mus musculus
aaacccatcaaactggctgcctagc

SEQ ID NO: 7638 - DNA, 25 bp, Mus musculus
aaacccatcaaagtggctgcctagc

SEQ ID NO: 7639 - DNA, 25 bp, Mus musculus
aaacccatccaaagcacagtgacat

SEQ ID NO: 7640 - DNA, 25 bp, Mus musculus
aaacccatccaactgggttctggct

SEQ ID NO: 7641 - DNA, 25 bp, Mus musculus
aaacccatccaagtgggttctggct

SEQ ID NO: 7642 - DNA, 25 bp, Mus musculus
aaacccatccaatgcacagtgacat

SEQ ID NO: 7643 - DNA, 25 bp, Mus musculus
aaacccatccacagctggtagtcag

SEQ ID NO: 7644 - DNA, 25 bp, Mus musculus
aaacccatccactgctggtagtcag

SEQ ID NO: 7645 - DNA, 25 bp, Mus musculus
aaacccatcgctaacatgccaggag

SEQ ID NO: 7646 - DNA, 25 bp, Mus musculus
aaacccatcgcttacatgccaggag

SEQ ID NO: 7647 - DNA, 25 bp, Mus musculus
aaacccatctggatttctggtgaaa

SEQ ID NO: 7648 - DNA, 25 bp, Mus musculus
aaacccatctggttttctggtgaaa

SEQ ID NO: 7649 - DNA, 25 bp, Mus musculus
aaacccatgaacattttgattagct

SEQ ID NO: 7650 - DNA, 25 bp, Mus musculus
aaacccatgaactttttgattagct

SEQ ID NO: 7651 - DNA, 25 bp, Mus musculus
aaacccatgaccatttactaagtga

SEQ ID NO: 7652 - DNA, 25 bp, Mus musculus
aaacccatgaccttttactaagtga

SEQ ID NO: 7653 - DNA, 25 bp, Mus musculus
aaacccatgatcaccaacttaatgg

SEQ ID NO: 7654 - DNA, 25 bp, Mus musculus
aaacccatgatctccaacttaatgg

SEQ ID NO: 7655 - DNA, 25 bp, Mus musculus
aaacccattgctattgaaggcctga

SEQ ID NO: 7656 - DNA, 25 bp, Mus musculus
aaacccattgcttttgaaggcctga

SEQ ID NO: 7657 - DNA, 25 bp, Mus musculus
aaacccattgtaatttcataaccat

SEQ ID NO: 7658 - DNA, 25 bp, Mus musculus
aaacccattgtattttcataaccat

SEQ ID NO: 7659 - DNA, 25 bp, Mus musculus
aaacccattttgctaatcagaattg

SEQ ID NO: 7660 - DNA, 25 bp, Mus musculus
aaacccattttggtaatcagaattg

SEQ ID NO: 7661 - DNA, 25 bp, Mus musculus
aaaccccaaaatccattgcctatct

SEQ ID NO: 7662 - DNA, 25 bp, Mus musculus
aaaccccaaaatgcattgcctatct

SEQ ID NO: 7663 - DNA, 25 bp, Mus musculus
aaaccccaagcaacctactggagtg

SEQ ID NO: 7664 - DNA, 25 bp, Mus musculus
aaaccccaagcatcctactggagtg

SEQ ID NO: 7665 - DNA, 25 bp, Mus musculus
aaaccccaagctcaagcaaagtcag

SEQ ID NO: 7666 - DNA, 25 bp, Mus musculus
aaaccccaagctgaagcaaagtcag

SEQ ID NO: 7667 - DNA, 25 bp, Mus musculus
aaaccccaaggaaaataacatcgtg

SEQ ID NO: 7668 - DNA, 25 bp, Mus musculus
aaaccccaaggactagctgaccaca

SEQ ID NO: 7669 - DNA, 25 bp, Mus musculus
aaaccccaaggagtagctgaccaca

SEQ ID NO: 7670 - DNA, 25 bp, Mus musculus
aaaccccaaggataataacatcgtg

SEQ ID NO: 7671 - DNA, 25 bp, Mus musculus
aaaccccaatgtcattgtcgatcca

SEQ ID NO: 7672 - DNA, 25 bp, Mus musculus
aaaccccaatgtgattgtcgatcca

SEQ ID NO: 7673 - DNA, 25 bp, Mus musculus
aaaccccacagcaggagtggacagc

SEQ ID NO: 7674 - DNA, 25 bp, Mus musculus
aaaccccacagccaatgtatgagga

SEQ ID NO: 7675 - DNA, 25 bp, Mus musculus
aaaccccacagcgaatgtatgagga

SEQ ID NO: 7676 - DNA, 25 bp, Mus musculus
aaaccccacagctggagtggacagc

SEQ ID NO: 7677 - DNA, 25 bp, Mus musculus
aaaccccagaggaacttcgtcatca

SEQ ID NO: 7678 - DNA, 25 bp, Mus musculus
aaaccccagaggtacttcgtcatca

SEQ ID NO: 7679 - DNA, 25 bp, Mus musculus
aaaccccagcgacaccaggctttca

SEQ ID NO: 7680 - DNA, 25 bp, Mus musculus
aaaccccagcgagaccaggctttca

SEQ ID NO: 7681 - DNA, 25 bp, Mus musculus
aaaccccagctcctcggaggatgga

SEQ ID NO: 7682 - DNA, 25 bp, Mus musculus
aaaccccagctcgtcggaggatgga

SEQ ID NO: 7683 - DNA, 25 bp, Mus musculus
aaaccccaggaaatgctctttccag

SEQ ID NO: 7684 - DNA, 25 bp, Mus musculus
aaaccccaggaaccgattcttgagt

SEQ ID NO: 7685 - DNA, 25 bp, Mus musculus
aaaccccaggaagcgattcttgagt

SEQ ID NO: 7686 - DNA, 25 bp, Mus musculus
aaaccccaggaattgctctttccag

SEQ ID NO: 7687 - DNA, 25 bp, Mus musculus
aaaccccagtcacctgtcagtctgg

SEQ ID NO: 7688 - DNA, 25 bp, Mus musculus
aaaccccagtcagctgtcagtctgg

SEQ ID NO: 7689 - DNA, 25 bp, Mus musculus
aaaccccatgctaggtattttcctg

SEQ ID NO: 7690 - DNA, 25 bp, Mus musculus
aaaccccatgcttggtattttcctg

SEQ ID NO: 7691 - DNA, 25 bp, Mus musculus
aaacccccagcacctgaggatgagg

SEQ ID NO: 7692 - DNA, 25 bp, Mus musculus
aaacccccagcagctgaggatgagg

SEQ ID NO: 7693 - DNA, 25 bp, Mus musculus
aaacccccaggaacatgaataaatg

SEQ ID NO: 7694 - DNA, 25 bp, Mus musculus
aaacccccaggatcatgaataaatg

SEQ ID NO: 7695 - DNA, 25 bp, Mus musculus
aaaccccgccatcttatgttaatgt

SEQ ID NO: 7696 - DNA, 25 bp, Mus musculus
aaaccccgccatgttatgttaatgt

SEQ ID NO: 7697 - DNA, 25 bp, Mus musculus
aaaccccgtctcacgatagatagat

SEQ ID NO: 7698 - DNA, 25 bp, Mus musculus
aaaccccgtctctcgatagatagat

SEQ ID NO: 7699 - DNA, 25 bp, Mus musculus
aaaccccgtgatcattttgctttgt

SEQ ID NO: 7700 - DNA, 25 bp, Mus musculus
aaaccccgtgatgattttgctttgt

SEQ ID NO: 7701 - DNA, 25 bp, Mus musculus
aaacccctaacactgccagaataag

SEQ ID NO: 7702 - DNA, 25 bp, Mus musculus
aaacccctaacagtgccagaataag

SEQ ID NO: 7703 - DNA, 25 bp, Mus musculus
aaacccctaatcatgatggactaag

SEQ ID NO: 7704 - DNA, 25 bp, Mus musculus
aaacccctaatcttgatggactaag

SEQ ID NO: 7705 - DNA, 25 bp, Mus musculus
aaacccctacagctcctgagaaagg

SEQ ID NO: 7706 - DNA, 25 bp, Mus musculus
aaacccctacaggtcctgagaaagg

SEQ ID NO: 7707 - DNA, 25 bp, Mus musculus
aaacccctagccactgtacaaggtg

SEQ ID NO: 7708 - DNA, 25 bp, Mus musculus
aaacccctagcctctgtacaaggtg

SEQ ID NO: 7709 - DNA, 25 bp, Mus musculus
aaacccctaggaacttgtgaagctc

SEQ ID NO: 7710 - DNA, 25 bp, Mus musculus
aaacccctaggatcttgtgaagctc

SEQ ID NO: 7711 - DNA, 25 bp, Mus musculus
aaacccctcagaaaggccaactgtg

SEQ ID NO: 7712 - DNA, 25 bp, Mus musculus
aaacccctcagataggccaactgtg

SEQ ID NO: 7713 - DNA, 25 bp, Mus musculus
aaacccctcatgaaatgccaggcta

SEQ ID NO: 7714 - DNA, 25 bp, Mus musculus
aaacccctcatgtaatgccaggcta

SEQ ID NO: 7715 - DNA, 25 bp, Mus musculus
aaacccctcttcacagggttcagag

SEQ ID NO: 7716 - DNA, 25 bp, Mus musculus
aaacccctcttctcagggttcagag

SEQ ID NO: 7717 - DNA, 25 bp, Mus musculus
aaacccctcttgacataaaatgaag

SEQ ID NO: 7718 - DNA, 25 bp, Mus musculus
aaacccctcttgtcataaaatgaag

SEQ ID NO: 7719 - DNA, 25 bp, Mus musculus
aaacccctgaaaactcatcctgaga

SEQ ID NO: 7720 - DNA, 25 bp, Mus musculus
aaacccctgaaatctcatcctgaga

SEQ ID NO: 7721 - DNA, 25 bp, Mus musculus
aaacccctgctaaacattctctgaa

SEQ ID NO: 7722 - DNA, 25 bp, Mus musculus
aaacccctgctatacattctctgaa

SEQ ID NO: 7723 - DNA, 25 bp, Mus musculus
aaacccctgctgcatcatctcaatg

SEQ ID NO: 7724 - DNA, 25 bp, Mus musculus
aaacccctgctggatcatctcaatg

SEQ ID NO: 7725 - DNA, 25 bp, Mus musculus
aaaccccttaccatgaatgcaccag

SEQ ID NO: 7726 - DNA, 25 bp, Mus musculus
aaaccccttaccttgaatgcaccag

SEQ ID NO: 7727 - DNA, 25 bp, Mus musculus
aaaccccttcaccttgggcaagctg

SEQ ID NO: 7728 - DNA, 25 bp, Mus musculus
aaaccccttcacgttgggcaagctg

SEQ ID NO: 7729 - DNA, 25 bp, Mus musculus
aaacccctttacaggctctgatctt

SEQ ID NO: 7730 - DNA, 25 bp, Mus musculus
aaacccctttactggctctgatctt

SEQ ID NO: 7731 - DNA, 25 bp, Mus musculus
aaacccgaatctctcgcatctgcgg

SEQ ID NO: 7732 - DNA, 25 bp, Mus musculus
aaacccgaatctgtcgcatctgcgg

SEQ ID NO: 7733 - DNA, 25 bp, Mus musculus
aaacccgagaggaggctgtctttct

SEQ ID NO: 7734 - DNA, 25 bp, Mus musculus
aaacccgagaggtggctgtctttct

SEQ ID NO: 7735 - DNA, 25 bp, Mus musculus
aaacccgagagtccttcacgagatt

SEQ ID NO: 7736 - DNA, 25 bp, Mus musculus
aaacccgagagtgcttcacgagatt

SEQ ID NO: 7737 - DNA, 25 bp, Mus musculus
aaacccgagctgcttgtcaaatggt

SEQ ID NO: 7738 - DNA, 25 bp, Mus musculus
aaacccgagctggttgtcaaatggt

SEQ ID NO: 7739 - DNA, 25 bp, Mus musculus
aaacccgagtccatgacaaagacag

SEQ ID NO: 7740 - DNA, 25 bp, Mus musculus
aaacccgagtccttgacaaagacag

SEQ ID NO: 7741 - DNA, 25 bp, Mus musculus
aaacccgctcaactgtgacctatag

SEQ ID NO: 7742 - DNA, 25 bp, Mus musculus
aaacccgctcaagtgtgacctatag

SEQ ID NO: 7743 - DNA, 25 bp, Mus musculus
aaacccgctggaatgggctagcacc

SEQ ID NO: 7744 - DNA, 25 bp, Mus musculus
aaacccgctggattgggctagcacc

SEQ ID NO: 7745 - DNA, 25 bp, Mus musculus
aaacccggattgagaccctgaatgc

SEQ ID NO: 7746 - DNA, 25 bp, Mus musculus
aaacccggattgtgaccctgaatgc

SEQ ID NO: 7747 - DNA, 25 bp, Mus musculus
aaacccgggcttagctgactgccgc

SEQ ID NO: 7748 - DNA, 25 bp, Mus musculus
aaacccgggctttgctgactgccgc

SEQ ID NO: 7749 - DNA, 25 bp, Mus musculus
aaacccggtgtgctataagtgcatc

SEQ ID NO: 7750 - DNA, 25 bp, Mus musculus
aaacccggtgtggtataagtgcatc

SEQ ID NO: 7751 - DNA, 25 bp, Mus musculus
aaacccgtaaatccattgtgtctga

SEQ ID NO: 7752 - DNA, 25 bp, Mus musculus
aaacccgtaaatgcattgtgtctga

SEQ ID NO: 7753 - DNA, 25 bp, Mus musculus
aaacccgtgaggaagagagctgtca

SEQ ID NO: 7754 - DNA, 25 bp, Mus musculus
aaacccgtgaggtagagagctgtca

SEQ ID NO: 7755 - DNA, 25 bp, Mus musculus
aaacccgtgcctcgtagcctgataa

SEQ ID NO: 7756 - DNA, 25 bp, Mus musculus
aaacccgtgcctggtagcctgataa

SEQ ID NO: 7757 - DNA, 25 bp, Mus musculus
aaacccgtggcgatgtgactgcttc

SEQ ID NO: 7758 - DNA, 25 bp, Mus musculus
aaacccgtggcgttgtgactgcttc

SEQ ID NO: 7759 - DNA, 25 bp, Mus musculus
aaacccgttgtgatctttgcaaaca

SEQ ID NO: 7760 - DNA, 25 bp, Mus musculus
aaacccgttgtgttctttgcaaaca

SEQ ID NO: 7761 - DNA, 25 bp, Mus musculus
aaaccctaacagacccatctgaggt

SEQ ID NO: 7762 - DNA, 25 bp, Mus musculus
aaaccctaacagtcccatctgaggt

SEQ ID NO: 7763 - DNA, 25 bp, Mus musculus
aaaccctaagacaaggtgttcgcag

SEQ ID NO: 7764 - DNA, 25 bp, Mus musculus
aaaccctaagactaggtgttcgcag

SEQ ID NO: 7765 - DNA, 25 bp, Mus musculus
aaaccctaagccctgtatgagtgga

SEQ ID NO: 7766 - DNA, 25 bp, Mus musculus
aaaccctaagccgtgtatgagtgga

SEQ ID NO: 7767 - DNA, 25 bp, Mus musculus
aaaccctaatcacttatctcgtgtg

SEQ ID NO: 7768 - DNA, 25 bp, Mus musculus
aaaccctaatcagttatctcgtgtg

SEQ ID NO: 7769 - DNA, 25 bp, Mus musculus
aaaccctaatgtccagttctccagt

SEQ ID NO: 7770 - DNA, 25 bp, Mus musculus
aaaccctaatgtgcagttctccagt

SEQ ID NO: 7771 - DNA, 25 bp, Mus musculus
aaaccctaatttagatctctagcac

SEQ ID NO: 7772 - DNA, 25 bp, Mus musculus
aaaccctaattttgatctctagcac

SEQ ID NO: 7773 - DNA, 25 bp, Mus musculus
aaaccctacaatattttcatggctg

SEQ ID NO: 7774 - DNA, 25 bp, Mus musculus
aaaccctacaattttttcatggctg

SEQ ID NO: 7775 - DNA, 25 bp, Mus musculus
aaaccctacatgatcccaaggatgc

SEQ ID NO: 7776 - DNA, 25 bp, Mus musculus
aaaccctacatgttcccaaggatgc

SEQ ID NO: 7777 - DNA, 25 bp, Mus musculus
aaaccctagcctagcttgttctttg

SEQ ID NO: 7778 - DNA, 25 bp, Mus musculus
aaaccctagccttgcttgttctttg

SEQ ID NO: 7779 - DNA, 25 bp, Mus musculus
aaaccctatctcactgattcttaac

SEQ ID NO: 7780 - DNA, 25 bp, Mus musculus
aaaccctatctctctgattcttaac

SEQ ID NO: 7781 - DNA, 25 bp, Mus musculus
aaaccctatgatcacgatgcggagt

SEQ ID NO: 7782 - DNA, 25 bp, Mus musculus
aaaccctatgatgacgatgcggagt

SEQ ID NO: 7783 - DNA, 25 bp, Mus musculus
aaaccctatgccatgcgttggaaac

SEQ ID NO: 7784 - DNA, 25 bp, Mus musculus
aaaccctatgccttgcgttggaaac

SEQ ID NO: 7785 - DNA, 25 bp, Mus musculus
aaaccctattcaagatcttctctac

SEQ ID NO: 7786 - DNA, 25 bp, Mus musculus
aaaccctattcatgatcttctctac

SEQ ID NO: 7787 - DNA, 25 bp, Mus musculus
aaaccctcaaataggcgctttcatt

SEQ ID NO: 7788 - DNA, 25 bp, Mus musculus
aaaccctcaaattggcgctttcatt

SEQ ID NO: 7789 - DNA, 25 bp, Mus musculus
aaaccctcaagacccacatgattgt

SEQ ID NO: 7790 - DNA, 25 bp, Mus musculus
aaaccctcaagagccacatgattgt

SEQ ID NO: 7791 - DNA, 25 bp, Mus musculus
aaaccctcagagatccttgatgggc

SEQ ID NO: 7792 - DNA, 25 bp, Mus musculus
aaaccctcagagttccttgatgggc

SEQ ID NO: 7793 - DNA, 25 bp, Mus musculus
aaaccctcagatcacttgtgtttct

SEQ ID NO: 7794 - DNA, 25 bp, Mus musculus
aaaccctcagatgacttgtgtttct

SEQ ID NO: 7795 - DNA, 25 bp, Mus musculus
aaaccctcagttatcaccaagatgt

SEQ ID NO: 7796 - DNA, 25 bp, Mus musculus
aaaccctcagttttcaccaagatgt

SEQ ID NO: 7797 - DNA, 25 bp, Mus musculus
aaaccctcatccaagtgccctgaga

SEQ ID NO: 7798 - DNA, 25 bp, Mus musculus
aaaccctcatcctagtgccctgaga

SEQ ID NO: 7799 - DNA, 25 bp, Mus musculus
aaaccctcatttagcagaaacacta

SEQ ID NO: 7800 - DNA, 25 bp, Mus musculus
aaaccctcattttgcagaaacacta

SEQ ID NO: 7801 - DNA, 25 bp, Mus musculus
aaaccctccagtctccaaaagatga

SEQ ID NO: 7802 - DNA, 25 bp, Mus musculus
aaaccctccagtgtccaaaagatga

SEQ ID NO: 7803 - DNA, 25 bp, Mus musculus
aaaccctccccacgtgatggacaat

SEQ ID NO: 7804 - DNA, 25 bp, Mus musculus
aaaccctccccaggtgatggacaat

SEQ ID NO: 7805 - DNA, 25 bp, Mus musculus
aaaccctcccttcgcaaaggagatg

SEQ ID NO: 7806 - DNA, 25 bp, Mus musculus
aaaccctcccttggcaaaggagatg

SEQ ID NO: 7807 - DNA, 25 bp, Mus musculus
aaaccctccgacatggaagctgaag

SEQ ID NO: 7808 - DNA, 25 bp, Mus musculus
aaaccctccgacttggaagctgaag

SEQ ID NO: 7809 - DNA, 25 bp, Mus musculus
aaaccctcctctatgatgttagtgg

SEQ ID NO: 7810 - DNA, 25 bp, Mus musculus
aaaccctcctctttgatgttagtgg

SEQ ID NO: 7811 - DNA, 25 bp, Mus musculus
aaaccctcgctgacagttggcagga

SEQ ID NO: 7812 - DNA, 25 bp, Mus musculus
aaaccctcgctgtcagttggcagga

SEQ ID NO: 7813 - DNA, 25 bp, Mus musculus
aaaccctcggcaaaacgcgtagtgg

SEQ ID NO: 7814 - DNA, 25 bp, Mus musculus
aaaccctcggcataacgcgtagtgg

SEQ ID NO: 7815 - DNA, 25 bp, Mus musculus
aaaccctcggctctgcagtcagcaa

SEQ ID NO: 7816 - DNA, 25 bp, Mus musculus
aaaccctcggctgtgcagtcagcaa

SEQ ID NO: 7817 - DNA, 25 bp, Mus musculus
aaaccctctcaaacaagcaagtgaa

SEQ ID NO: 7818 - DNA, 25 bp, Mus musculus
aaaccctctcaatcaagcaagtgaa

SEQ ID NO: 7819 - DNA, 25 bp, Mus musculus
aaaccctctcacagtgacctatagg

SEQ ID NO: 7820 - DNA, 25 bp, Mus musculus
aaaccctctcactgtgacctatagg

SEQ ID NO: 7821 - DNA, 25 bp, Mus musculus
aaaccctctgacaggtcaaccagtg

SEQ ID NO: 7822 - DNA, 25 bp, Mus musculus
aaaccctctgactggtcaaccagtg

SEQ ID NO: 7823 - DNA, 25 bp, Mus musculus
aaaccctctgccagctctagatggg

SEQ ID NO: 7824 - DNA, 25 bp, Mus musculus
aaaccctctgcctgctctagatggg

SEQ ID NO: 7825 - DNA, 25 bp, Mus musculus
aaaccctctgtaacaaagtctggac

SEQ ID NO: 7826 - DNA, 25 bp, Mus musculus
aaaccctctgtatcaaagtctggac

SEQ ID NO: 7827 - DNA, 25 bp, Mus musculus
aaaccctgaacacatcggcttgtct

SEQ ID NO: 7828 - DNA, 25 bp, Mus musculus
aaaccctgaacagatcggcttgtct

SEQ ID NO: 7829 - DNA, 25 bp, Mus musculus
aaaccctgacggaccacctgtgtgg

SEQ ID NO: 7830 - DNA, 25 bp, Mus musculus
aaaccctgacggtccacctgtgtgg

SEQ ID NO: 7831 - DNA, 25 bp, Mus musculus
aaaccctgacttactgacataacta

SEQ ID NO: 7832 - DNA, 25 bp, Mus musculus
aaaccctgactttctgacataacta

SEQ ID NO: 7833 - DNA, 25 bp, Mus musculus
aaaccctgagcccaacatagagtca

SEQ ID NO: 7834 - DNA, 25 bp, Mus musculus
aaaccctgagccgaacatagagtca

SEQ ID NO: 7835 - DNA, 25 bp, Mus musculus
aaaccctgaggccttgtccagacca

SEQ ID NO: 7836 - DNA, 25 bp, Mus musculus
aaaccctgaggcgttgtccagacca

SEQ ID NO: 7837 - DNA, 25 bp, Mus musculus
aaaccctgatcccatcacagtgtgt

SEQ ID NO: 7838 - DNA, 25 bp, Mus musculus
aaaccctgatccgatcacagtgtgt

SEQ ID NO: 7839 - DNA, 25 bp, Mus musculus
aaaccctgcaagatgtgtgaggccc

SEQ ID NO: 7840 - DNA, 25 bp, Mus musculus
aaaccctgcaagttgtgtgaggccc

SEQ ID NO: 7841 - DNA, 25 bp, Mus musculus
aaaccctgcaccatccaagctggtg

SEQ ID NO: 7842 - DNA, 25 bp, Mus musculus
aaaccctgcaccttccaagctggtg

SEQ ID NO: 7843 - DNA, 25 bp, Mus musculus
aaaccctgccatatactactacttg

SEQ ID NO: 7844 - DNA, 25 bp, Mus musculus
aaaccctgccatttactactacttg

SEQ ID NO: 7845 - DNA, 25 bp, Mus musculus
aaaccctgccccaatgatggtggtg

SEQ ID NO: 7846 - DNA, 25 bp, Mus musculus
aaaccctgcccctatgatggtggtg

SEQ ID NO: 7847 - DNA, 25 bp, Mus musculus
aaaccctgcctccttgtttatctgt

SEQ ID NO: 7848 - DNA, 25 bp, Mus musculus
aaaccctgcctcgttgtttatctgt

SEQ ID NO: 7849 - DNA, 25 bp, Mus musculus
aaaccctgcgctaaggtgatgacca

SEQ ID NO: 7850 - DNA, 25 bp, Mus musculus
aaaccctgcgcttaggtgatgacca

SEQ ID NO: 7851 - DNA, 25 bp, Mus musculus
aaaccctgcgtcaggtgttggagcg

SEQ ID NO: 7852 - DNA, 25 bp, Mus musculus
aaaccctgcgtctggtgttggagcg

SEQ ID NO: 7853 - DNA, 25 bp, Mus musculus
aaaccctgctcaattcagacttgtg

SEQ ID NO: 7854 - DNA, 25 bp, Mus musculus
aaaccctgctcatttcagacttgtg

SEQ ID NO: 7855 - DNA, 25 bp, Mus musculus
aaaccctgcttcatttggcatcttg

SEQ ID NO: 7856 - DNA, 25 bp, Mus musculus
aaaccctgcttcttttggcatcttg

SEQ ID NO: 7857 - DNA, 25 bp, Mus musculus
aaaccctgcttgacgtcaactgcat

SEQ ID NO: 7858 - DNA, 25 bp, Mus musculus
aaaccctgcttgtcgtcaactgcat

SEQ ID NO: 7859 - DNA, 25 bp, Mus musculus
aaaccctggccgaccactctggaat

SEQ ID NO: 7860 - DNA, 25 bp, Mus musculus
aaaccctggccgagactgagaacgg

SEQ ID NO: 7861 - DNA, 25 bp, Mus musculus
aaaccctggccgtccactctggaat

SEQ ID NO: 7862 - DNA, 25 bp, Mus musculus
aaaccctggccgtgactgagaacgg

SEQ ID NO: 7863 - DNA, 25 bp, Mus musculus
aaaccctggctaacctccagattga

SEQ ID NO: 7864 - DNA, 25 bp, Mus musculus
aaaccctggctatcctccagattga

SEQ ID NO: 7865 - DNA, 25 bp, Mus musculus
aaaccctgggagacatgtggcccat

SEQ ID NO: 7866 - DNA, 25 bp, Mus musculus
aaaccctgggagtcatgtggcccat

SEQ ID NO: 7867 - DNA, 25 bp, Mus musculus
aaaccctgggcgagtcacagagttt

SEQ ID NO: 7868 - DNA, 25 bp, Mus musculus
aaaccctgggcgtgtcacagagttt

SEQ ID NO: 7869 - DNA, 25 bp, Mus musculus
aaaccctgggctcattttgtccctg

SEQ ID NO: 7870 - DNA, 25 bp, Mus musculus
aaaccctgggctgattttgtccctg

SEQ ID NO: 7871 - DNA, 25 bp, Mus musculus
aaaccctggtctagatttgtgctcc

SEQ ID NO: 7872 - DNA, 25 bp, Mus musculus
aaaccctggtcttgatttgtgctcc

SEQ ID NO: 7873 - DNA, 25 bp, Mus musculus
aaaccctggtgcatattacattata

SEQ ID NO: 7874 - DNA, 25 bp, Mus musculus
aaaccctggtgcttattacattata

SEQ ID NO: 7875 - DNA, 25 bp, Mus musculus
aaaccctgtagtcgattgtaagagc

SEQ ID NO: 7876 - DNA, 25 bp, Mus musculus
aaaccctgtagtggattgtaagagc

SEQ ID NO: 7877 - DNA, 25 bp, Mus musculus
aaaccctgtctgacaaagcaagtgg

SEQ ID NO: 7878 - DNA, 25 bp, Mus musculus
aaaccctgtctgtcaaagcaagtgg

SEQ ID NO: 7879 - DNA, 25 bp, Mus musculus
aaaccctgtgagacgtcttggctgg

SEQ ID NO: 7880 - DNA, 25 bp, Mus musculus
aaaccctgtgagtcgtcttggctgg

SEQ ID NO: 7881 - DNA, 25 bp, Mus musculus
aaaccctgtgccaagaacatagcct

SEQ ID NO: 7882 - DNA, 25 bp, Mus musculus
aaaccctgtgcctagaacatagcct

SEQ ID NO: 7883 - DNA, 25 bp, Mus musculus
aaaccctgtggcattttctgaagat

SEQ ID NO: 7884 - DNA, 25 bp, Mus musculus
aaaccctgtggctttttctgaagat

SEQ ID NO: 7885 - DNA, 25 bp, Mus musculus
aaaccctgtggtaggaacagtctat

SEQ ID NO: 7886 - DNA, 25 bp, Mus musculus
aaaccctgtggttggaacagtctat

SEQ ID NO: 7887 - DNA, 25 bp, Mus musculus
aaaccctgtgtactttgaggctata

SEQ ID NO: 7888 - DNA, 25 bp, Mus musculus
aaaccctgtgtagtttgaggctata

SEQ ID NO: 7889 - DNA, 25 bp, Mus musculus
aaaccctgtttccagcgctcggtgg

SEQ ID NO: 7890 - DNA, 25 bp, Mus musculus
aaaccctgtttcgagcgctcggtgg

SEQ ID NO: 7891 - DNA, 25 bp, Mus musculus
aaacccttactcaatgaaatgataa

SEQ ID NO: 7892 - DNA, 25 bp, Mus musculus
aaacccttactctatgaaatgataa

SEQ ID NO: 7893 - DNA, 25 bp, Mus musculus
aaacccttagacctctgggatcacg

SEQ ID NO: 7894 - DNA, 25 bp, Mus musculus
aaacccttagacgtctgggatcacg

SEQ ID NO: 7895 - DNA, 25 bp, Mus musculus
aaacccttagggagtgctgtgacac

SEQ ID NO: 7896 - DNA, 25 bp, Mus musculus
aaacccttagggtgtgctgtgacac

SEQ ID NO: 7897 - DNA, 25 bp, Mus musculus
aaacccttattcacacagagctcag

SEQ ID NO: 7898 - DNA, 25 bp, Mus musculus
aaacccttattctcacagagctcag

SEQ ID NO: 7899 - DNA, 25 bp, Mus musculus
aaacccttattgagtcaaaccatgg

SEQ ID NO: 7900 - DNA, 25 bp, Mus musculus
aaacccttattgtgtcaaaccatgg

SEQ ID NO: 7901 - DNA, 25 bp, Mus musculus
aaacccttcaatagcatccttgagg

SEQ ID NO: 7902 - DNA, 25 bp, Mus musculus
aaacccttcaattgcatccttgagg

SEQ ID NO: 7903 - DNA, 25 bp, Mus musculus
aaacccttcagcaccttagatcctt

SEQ ID NO: 7904 - DNA, 25 bp, Mus musculus
aaacccttcagctccttagatcctt

SEQ ID NO: 7905 - DNA, 25 bp, Mus musculus
aaacccttcatccttcactggaata

SEQ ID NO: 7906 - DNA, 25 bp, Mus musculus
aaacccttcatcgttcactggaata

SEQ ID NO: 7907 - DNA, 25 bp, Mus musculus
aaacccttccgtaagagaggagcag

SEQ ID NO: 7908 - DNA, 25 bp, Mus musculus
aaacccttccgttagagaggagcag

SEQ ID NO: 7909 - DNA, 25 bp, Mus musculus
aaacccttctcaagggtctcactat

SEQ ID NO: 7910 - DNA, 25 bp, Mus musculus
aaacccttctcatgggtctcactat

SEQ ID NO: 7911 - DNA, 25 bp, Mus musculus
aaacccttgaggctttcttacattg

SEQ ID NO: 7912 - DNA, 25 bp, Mus musculus
aaacccttgagggtttcttacattg

SEQ ID NO: 7913 - DNA, 25 bp, Mus musculus
aaaccctttcacctggtgatgcaca

SEQ ID NO: 7914 - DNA, 25 bp, Mus musculus
aaaccctttcacgtggtgatgcaca

SEQ ID NO: 7915 - DNA, 25 bp, Mus musculus
aaaccctttcagatatcttcatcta

SEQ ID NO: 7916 - DNA, 25 bp, Mus musculus
aaaccctttcagcaggtcagatgag

SEQ ID NO: 7917 - DNA, 25 bp, Mus musculus
aaaccctttcaggaggtcagatgag

SEQ ID NO: 7918 - DNA, 25 bp, Mus musculus
aaaccctttcagttatcttcatcta

SEQ ID NO: 7919 - DNA, 25 bp, Mus musculus
aaaccctttctgagtgaagggcagt

SEQ ID NO: 7920 - DNA, 25 bp, Mus musculus
aaaccctttctgtgtgaagggcagt

SEQ ID NO: 7921 - DNA, 25 bp, Mus musculus
aaaccctttgatatgatccctgtgg

SEQ ID NO: 7922 - DNA, 25 bp, Mus musculus
aaaccctttgatttgatccctgtgg

SEQ ID NO: 7923 - DNA, 25 bp, Mus musculus
aaaccctttgcactgagcagcctgg

SEQ ID NO: 7924 - DNA, 25 bp, Mus musculus
aaaccctttgcagtgagcagcctgg

SEQ ID NO: 7925 - DNA, 25 bp, Mus musculus
aaaccctttggaagctaagctcgtg

SEQ ID NO: 7926 - DNA, 25 bp, Mus musculus
aaaccctttggatgctaagctcgtg

SEQ ID NO: 7927 - DNA, 25 bp, Mus musculus
aaaccctttggtctcacaggcggca

SEQ ID NO: 7928 - DNA, 25 bp, Mus musculus
aaaccctttggtgtcacaggcggca

SEQ ID NO: 7929 - DNA, 25 bp, Mus musculus
aaaccctttgtaactcatttcatgc

SEQ ID NO: 7930 - DNA, 25 bp, Mus musculus
aaaccctttgtatctcatttcatgc

SEQ ID NO: 7931 - DNA, 25 bp, Mus musculus
aaaccctttgtgcagcctttgagca

SEQ ID NO: 7932 - DNA, 25 bp, Mus musculus
aaaccctttgtggagcctttgagca

SEQ ID NO: 7933 - DNA, 25 bp, Mus musculus
aaaccctttttaaggctcacacagc

SEQ ID NO: 7934 - DNA, 25 bp, Mus musculus
aaaccctttttatggctcacacagc

SEQ ID NO: 7935 - DNA, 25 bp, Mus musculus
aaaccgaagcctcccaagaatgaat

SEQ ID NO: 7936 - DNA, 25 bp, Mus musculus
aaaccgaagcctgccaagaatgaat

SEQ ID NO: 7937 - DNA, 25 bp, Mus musculus
aaaccgaagtaactgttctgctctg

SEQ ID NO: 7938 - DNA, 25 bp, Mus musculus
aaaccgaagtaagtgttctgctctg

SEQ ID NO: 7939 - DNA, 25 bp, Mus musculus
aaaccgaatgctcttaccacttcct

SEQ ID NO: 7940 - DNA, 25 bp, Mus musculus
aaaccgaatgctgttaccacttcct

SEQ ID NO: 7941 - DNA, 25 bp, Mus musculus
aaaccgacgccacaactttgaaatg

SEQ ID NO: 7942 - DNA, 25 bp, Mus musculus
aaaccgacgccagaactttgaaatg

SEQ ID NO: 7943 - DNA, 25 bp, Mus musculus
aaaccgaggcctcatgtgaactatt

SEQ ID NO: 7944 - DNA, 25 bp, Mus musculus
aaaccgaggcctgatgtgaactatt

SEQ ID NO: 7945 - DNA, 25 bp, Mus musculus
aaaccgagtgatcacctaccgtgac

SEQ ID NO: 7946 - DNA, 25 bp, Mus musculus
aaaccgagtgatgacctaccgtgac

SEQ ID NO: 7947 - DNA, 25 bp, Mus musculus
aaaccgatacttctcacagctgaag

SEQ ID NO: 7948 - DNA, 25 bp, Mus musculus
aaaccgatacttgtcacagctgaag

SEQ ID NO: 7949 - DNA, 25 bp, Mus musculus
aaaccgatcagaaagctccagttat

SEQ ID NO: 7950 - DNA, 25 bp, Mus musculus
aaaccgatcagatagctccagttat

SEQ ID NO: 7951 - DNA, 25 bp, Mus musculus
aaaccgatgggcctagagctccttt

SEQ ID NO: 7952 - DNA, 25 bp, Mus musculus
aaaccgatgggcgtagagctccttt

SEQ ID NO: 7953 - DNA, 25 bp, Mus musculus
aaaccgatgggtcatctcctagatc

SEQ ID NO: 7954 - DNA, 25 bp, Mus musculus
aaaccgatgggtgatctcctagatc

SEQ ID NO: 7955 - DNA, 25 bp, Mus musculus
aaaccgcacaaaacccagtgtgtat

SEQ ID NO: 7956 - DNA, 25 bp, Mus musculus
aaaccgcacaaatcccagtgtgtat

SEQ ID NO: 7957 - DNA, 25 bp, Mus musculus
aaaccgcagacaccatcagtcgatt

SEQ ID NO: 7958 - DNA, 25 bp, Mus musculus
aaaccgcagacagcatcagtcgatt

SEQ ID NO: 7959 - DNA, 25 bp, Mus musculus
aaaccgcatgaaaaattcccaccca

SEQ ID NO: 7960 - DNA, 25 bp, Mus musculus
aaaccgcatgaataattcccaccca

SEQ ID NO: 7961 - DNA, 25 bp, Mus musculus
aaaccgcatgcacactcacttctgg

SEQ ID NO: 7962 - DNA, 25 bp, Mus musculus
aaaccgcatgcagactcacttctgg

SEQ ID NO: 7963 - DNA, 25 bp, Mus musculus
aaaccgccagcgaacttgacaatta

SEQ ID NO: 7964 - DNA, 25 bp, Mus musculus
aaaccgccagcgtacttgacaatta

SEQ ID NO: 7965 - DNA, 25 bp, Mus musculus
aaaccgcccaatcgtacttctcaag

SEQ ID NO: 7966 - DNA, 25 bp, Mus musculus
aaaccgcccaatggtacttctcaag

SEQ ID NO: 7967 - DNA, 25 bp, Mus musculus
aaaccgcccactatctgatgaagaa

SEQ ID NO: 7968 - DNA, 25 bp, Mus musculus
aaaccgcccactttctgatgaagaa

SEQ ID NO: 7969 - DNA, 25 bp, Mus musculus
aaaccgccgtgcctaaggactctgt

SEQ ID NO: 7970 - DNA, 25 bp, Mus musculus
aaaccgccgtgcgtaaggactctgt

SEQ ID NO: 7971 - DNA, 25 bp, Mus musculus
aaaccgcggcggacacttatgccag

SEQ ID NO: 7972 - DNA, 25 bp, Mus musculus
aaaccgcggcggtcacttatgccag

SEQ ID NO: 7973 - DNA, 25 bp, Mus musculus
aaaccgcgggatccatcccagctat

SEQ ID NO: 7974 - DNA, 25 bp, Mus musculus
aaaccgcgggatgcatcccagctat

SEQ ID NO: 7975 - DNA, 25 bp, Mus musculus
aaaccgctccccaacagaggctgga

SEQ ID NO: 7976 - DNA, 25 bp, Mus musculus
aaaccgctcccctacagaggctgga

SEQ ID NO: 7977 - DNA, 25 bp, Mus musculus
aaaccgctctagcaggtcatttcaa

SEQ ID NO: 7978 - DNA, 25 bp, Mus musculus
aaaccgctctaggaggtcatttcaa

SEQ ID NO: 7979 - DNA, 25 bp, Mus musculus
aaaccgctgatgcagaaatgtgtgc

SEQ ID NO: 7980 - DNA, 25 bp, Mus musculus
aaaccgctgatggagaaatgtgtgc

SEQ ID NO: 7981 - DNA, 25 bp, Mus musculus
aaaccgctggccactaatccctaag

SEQ ID NO: 7982 - DNA, 25 bp, Mus musculus
aaaccgctggcctctaatccctaag

SEQ ID NO: 7983 - DNA, 25 bp, Mus musculus
aaaccgctgggtctattatgctgat

SEQ ID NO: 7984 - DNA, 25 bp, Mus musculus
aaaccgctgggtgtattatgctgat

SEQ ID NO: 7985 - DNA, 25 bp, Mus musculus
aaaccgctgtttagcttagcatgga

SEQ ID NO: 7986 - DNA, 25 bp, Mus musculus
aaaccgctgttttgcttagcatgga

SEQ ID NO: 7987 - DNA, 25 bp, Mus musculus
aaaccgctttccagatcttatgatg

SEQ ID NO: 7988 - DNA, 25 bp, Mus musculus
aaaccgctttcctgatcttatgatg

SEQ ID NO: 7989 - DNA, 25 bp, Mus musculus
aaaccgcttttcaaagtgtccacat

SEQ ID NO: 7990 - DNA, 25 bp, Mus musculus
aaaccgcttttctaagtgtccacat

SEQ ID NO: 7991 - DNA, 25 bp, Mus musculus
aaaccggaagttaagtgtcgtgcat

SEQ ID NO: 7992 - DNA, 25 bp, Mus musculus
aaaccggaagtttagtgtcgtgcat

SEQ ID NO: 7993 - DNA, 25 bp, Mus musculus
aaaccggacatcaattgcttcatga

SEQ ID NO: 7994 - DNA, 25 bp, Mus musculus
aaaccggacatctattgcttcatga

SEQ ID NO: 7995 - DNA, 25 bp, Mus musculus
aaaccggcaggactattttgaatat

SEQ ID NO: 7996 - DNA, 25 bp, Mus musculus
aaaccggcaggagtattttgaatat

SEQ ID NO: 7997 - DNA, 25 bp, Mus musculus
aaaccggcagggaggtcagtcatat

SEQ ID NO: 7998 - DNA, 25 bp, Mus musculus
aaaccggcagggtggtcagtcatat

SEQ ID NO: 7999 - DNA, 25 bp, Mus musculus
aaaccggcattgagtctgtaataga

SEQ ID NO: 8000 - DNA, 25 bp, Mus musculus
aaaccggcattgtgtctgtaataga

SEQ ID NO: 8001 - DNA, 25 bp, Mus musculus
aaaccggccagcacagctacgcatc

SEQ ID NO: 8002 - DNA, 25 bp, Mus musculus
aaaccggccagctcagctacgcatc

SEQ ID NO: 8003 - DNA, 25 bp, Mus musculus
aaaccggccctgagtgccttaggag

SEQ ID NO: 8004 - DNA, 25 bp, Mus musculus
aaaccggccctgtgtgccttaggag

SEQ ID NO: 8005 - DNA, 25 bp, Mus musculus
aaaccggctccccacatgggactag

SEQ ID NO: 8006 - DNA, 25 bp, Mus musculus
aaaccggctcccgacatgggactag

SEQ ID NO: 8007 - DNA, 25 bp, Mus musculus
aaaccgggcgacagttgatcagcca

SEQ ID NO: 8008 - DNA, 25 bp, Mus musculus
aaaccgggcgactgttgatcagcca

SEQ ID NO: 8009 - DNA, 25 bp, Mus musculus
aaaccgggctccagagatagctaaa

SEQ ID NO: 8010 - DNA, 25 bp, Mus musculus
aaaccgggctcctgagatagctaaa

SEQ ID NO: 8011 - DNA, 25 bp, Mus musculus
aaaccgggtaacaaatgattatctg

SEQ ID NO: 8012 - DNA, 25 bp, Mus musculus
aaaccgggtaactaatgattatctg

SEQ ID NO: 8013 - DNA, 25 bp, Mus musculus
aaaccgggtggaagctcacgggaat

SEQ ID NO: 8014 - DNA, 25 bp, Mus musculus
aaaccgggtggatgctcacgggaat

SEQ ID NO: 8015 - DNA, 25 bp, Mus musculus
aaaccgggttgcagctcagaggagc

SEQ ID NO: 8016 - DNA, 25 bp, Mus musculus
aaaccgggttgctgctcagaggagc

SEQ ID NO: 8017 - DNA, 25 bp, Mus musculus
aaaccggtgtatctactgtgtattt

SEQ ID NO: 8018 - DNA, 25 bp, Mus musculus
aaaccggtgtatgtactgtgtattt

SEQ ID NO: 8019 - DNA, 25 bp, Mus musculus
aaaccgtatcagagtgatcagtgtg

SEQ ID NO: 8020 - DNA, 25 bp, Mus musculus
aaaccgtatcagtgtgatcagtgtg

SEQ ID NO: 8021 - DNA, 25 bp, Mus musculus
aaaccgtcatttcaaggctggacaa

SEQ ID NO: 8022 - DNA, 25 bp, Mus musculus
aaaccgtcatttccgattttcaggg

SEQ ID NO: 8023 - DNA, 25 bp, Mus musculus
aaaccgtcatttgaaggctggacaa

SEQ ID NO: 8024 - DNA, 25 bp, Mus musculus
aaaccgtcatttgcgattttcaggg

SEQ ID NO: 8025 - DNA, 25 bp, Mus musculus
aaaccgtctgacagtaagtgttgga

SEQ ID NO: 8026 - DNA, 25 bp, Mus musculus
aaaccgtctgactgtaagtgttgga

SEQ ID NO: 8027 - DNA, 25 bp, Mus musculus
aaaccgtctggaccagtgtcacctg

SEQ ID NO: 8028 - DNA, 25 bp, Mus musculus
aaaccgtctggagcagtgtcacctg

SEQ ID NO: 8029 - DNA, 25 bp, Mus musculus
aaaccgtcttgacctggtggtagat

SEQ ID NO: 8030 - DNA, 25 bp, Mus musculus
aaaccgtcttgagctggtggtagat

SEQ ID NO: 8031 - DNA, 25 bp, Mus musculus
aaaccgtgactgattacctctcaag

SEQ ID NO: 8032 - DNA, 25 bp, Mus musculus
aaaccgtgactgtttacctctcaag

SEQ ID NO: 8033 - DNA, 25 bp, Mus musculus
aaaccgtgatggcaacaggacctag

SEQ ID NO: 8034 - DNA, 25 bp, Mus musculus
aaaccgtgatgggaacaggacctag

SEQ ID NO: 8035 - DNA, 25 bp, Mus musculus
aaaccgtgcccacttgtgctcactg

SEQ ID NO: 8036 - DNA, 25 bp, Mus musculus
aaaccgtgcccagttgtgctcactg

SEQ ID NO: 8037 - DNA, 25 bp, Mus musculus
aaaccgtggaagcactcaccaccat

SEQ ID NO: 8038 - DNA, 25 bp, Mus musculus
aaaccgtggaaggactcaccaccat

SEQ ID NO: 8039 - DNA, 25 bp, Mus musculus
aaaccgtgggtaatgcgcgtgcgtt

SEQ ID NO: 8040 - DNA, 25 bp, Mus musculus
aaaccgtgggtattgcgcgtgcgtt

SEQ ID NO: 8041 - DNA, 25 bp, Mus musculus
aaaccgtggtctctgtttatccatt

SEQ ID NO: 8042 - DNA, 25 bp, Mus musculus
aaaccgtggtctgtgtttatccatt

SEQ ID NO: 8043 - DNA, 25 bp, Mus musculus
aaaccgtgtgttctcatttcctggg

SEQ ID NO: 8044 - DNA, 25 bp, Mus musculus
aaaccgtgtgttgtcatttcctggg

SEQ ID NO: 8045 - DNA, 25 bp, Mus musculus
aaaccgttaaagaggccatgcattt

SEQ ID NO: 8046 - DNA, 25 bp, Mus musculus
aaaccgttaaagtggccatgcattt

SEQ ID NO: 8047 - DNA, 25 bp, Mus musculus
aaaccgttctctaagatgcattttt

SEQ ID NO: 8048 - DNA, 25 bp, Mus musculus
aaaccgttctcttagatgcattttt

SEQ ID NO: 8049 - DNA, 25 bp, Mus musculus
aaaccgttctgtcggtgcgactaat

SEQ ID NO: 8050 - DNA, 25 bp, Mus musculus
aaaccgttctgtgggtgcgactaat

SEQ ID NO: 8051 - DNA, 25 bp, Mus musculus
aaacctaaaacaaacagtctgtgtg

SEQ ID NO: 8052 - DNA, 25 bp, Mus musculus
aaacctaaaacatacagtctgtgtg

SEQ ID NO: 8053 - DNA, 25 bp, Mus musculus
aaacctaaaccaagtgctctttgta

SEQ ID NO: 8054 - DNA, 25 bp, Mus musculus
aaacctaaaccatgtgctctttgta

SEQ ID NO: 8055 - DNA, 25 bp, Mus musculus
aaacctaaataacaagatgcctatc

SEQ ID NO: 8056 - DNA, 25 bp, Mus musculus
aaacctaaataagaagatgcctatc

SEQ ID NO: 8057 - DNA, 25 bp, Mus musculus
aaacctaaatcccaacctgcagaga

SEQ ID NO: 8058 - DNA, 25 bp, Mus musculus
aaacctaaatccgaacctgcagaga

SEQ ID NO: 8059 - DNA, 25 bp, Mus musculus
aaacctaacattaactctggagctt

SEQ ID NO: 8060 - DNA, 25 bp, Mus musculus
aaacctaacatttactctggagctt

SEQ ID NO: 8061 - DNA, 25 bp, Mus musculus
aaacctaacttaatctccatctcag

SEQ ID NO: 8062 - DNA, 25 bp, Mus musculus
aaacctaacttattctccatctcag

SEQ ID NO: 8063 - DNA, 25 bp, Mus musculus
aaacctaatggccagagcatctctg

SEQ ID NO: 8064 - DNA, 25 bp, Mus musculus
aaacctaatggcgagagcatctctg

SEQ ID NO: 8065 - DNA, 25 bp, Mus musculus
aaacctacaactcatggctaccctg

SEQ ID NO: 8066 - DNA, 25 bp, Mus musculus
aaacctacaactgatggctaccctg

SEQ ID NO: 8067 - DNA, 25 bp, Mus musculus
aaacctacaatcctagttctccaga

SEQ ID NO: 8068 - DNA, 25 bp, Mus musculus
aaacctacaatcgtagttctccaga

SEQ ID NO: 8069 - DNA, 25 bp, Mus musculus
aaacctacagctagtccagtacttt

SEQ ID NO: 8070 - DNA, 25 bp, Mus musculus
aaacctacagcttgtccagtacttt

SEQ ID NO: 8071 - DNA, 25 bp, Mus musculus
aaacctaccaaaaccgctgtgcatt

SEQ ID NO: 8072 - DNA, 25 bp, Mus musculus
aaacctaccaaatccgctgtgcatt

SEQ ID NO: 8073 - DNA, 25 bp, Mus musculus
aaacctaccagacacgttctctcta

SEQ ID NO: 8074 - DNA, 25 bp, Mus musculus
aaacctaccagagacgttctctcta

SEQ ID NO: 8075 - DNA, 25 bp, Mus musculus
aaacctacccaaatgacggattgtg

SEQ ID NO: 8076 - DNA, 25 bp, Mus musculus
aaacctacccaattgacggattgtg

SEQ ID NO: 8077 - DNA, 25 bp, Mus musculus
aaacctacctacagccgctgtggtg

SEQ ID NO: 8078 - DNA, 25 bp, Mus musculus
aaacctacctactgccgctgtggtg

SEQ ID NO: 8079 - DNA, 25 bp, Mus musculus
aaacctacctatctcagtcactgat

SEQ ID NO: 8080 - DNA, 25 bp, Mus musculus
aaacctacctatgtcagtcactgat

SEQ ID NO: 8081 - DNA, 25 bp, Mus musculus
aaacctactcaaaagcataacgatg

SEQ ID NO: 8082 - DNA, 25 bp, Mus musculus
aaacctactcaatagcataacgatg

SEQ ID NO: 8083 - DNA, 25 bp, Mus musculus
aaacctactcggcagaccatggact

SEQ ID NO: 8084 - DNA, 25 bp, Mus musculus
aaacctactcgggagaccatggact

SEQ ID NO: 8085 - DNA, 25 bp, Mus musculus
aaacctactggaacaggatcttcct

SEQ ID NO: 8086 - DNA, 25 bp, Mus musculus
aaacctactggatcaggatcttcct

SEQ ID NO: 8087 - DNA, 25 bp, Mus musculus
aaacctagaatgaccttagccaggg

SEQ ID NO: 8088 - DNA, 25 bp, Mus musculus
aaacctagaatgtccttagccaggg

SEQ ID NO: 8089 - DNA, 25 bp, Mus musculus
aaacctagacatattcagcattaca

SEQ ID NO: 8090 - DNA, 25 bp, Mus musculus
aaacctagacattttcagcattaca

SEQ ID NO: 8091 - DNA, 25 bp, Mus musculus
aaacctagacttaagagcactcaag

SEQ ID NO: 8092 - DNA, 25 bp, Mus musculus
aaacctagactttagagcactcaag

SEQ ID NO: 8093 - DNA, 25 bp, Mus musculus
aaacctagatgtcccaggtcagcta

SEQ ID NO: 8094 - DNA, 25 bp, Mus musculus
aaacctagatgtgccaggtcagcta

SEQ ID NO: 8095 - DNA, 25 bp, Mus musculus
aaacctagcactagtttgcttccct

SEQ ID NO: 8096 - DNA, 25 bp, Mus musculus
aaacctagcacttgtttgcttccct

SEQ ID NO: 8097 - DNA, 25 bp, Mus musculus
aaacctaggccgaccgagagcaact

SEQ ID NO: 8098 - DNA, 25 bp, Mus musculus
aaacctaggccgtccgagagcaact

SEQ ID NO: 8099 - DNA, 25 bp, Mus musculus
aaacctagggctctagtcaggcctt

SEQ ID NO: 8100 - DNA, 25 bp, Mus musculus
aaacctagggctgtagtcaggcctt

SEQ ID NO: 8101 - DNA, 25 bp, Mus musculus
aaacctaggtatctgttcattcagt

SEQ ID NO: 8102 - DNA, 25 bp, Mus musculus
aaacctaggtatgtgttcattcagt

SEQ ID NO: 8103 - DNA, 25 bp, Mus musculus
aaacctaggtgtcatgtgtcttaat

SEQ ID NO: 8104 - DNA, 25 bp, Mus musculus
aaacctaggtgtgatgtgtcttaat

SEQ ID NO: 8105 - DNA, 25 bp, Mus musculus
aaacctagtcacattctctgtaaga

SEQ ID NO: 8106 - DNA, 25 bp, Mus musculus
aaacctagtcactttctctgtaaga

SEQ ID NO: 8107 - DNA, 25 bp, Mus musculus
aaacctagtctgaagcgagggagtt

SEQ ID NO: 8108 - DNA, 25 bp, Mus musculus
aaacctagtctgctcaatcagtgga

SEQ ID NO: 8109 - DNA, 25 bp, Mus musculus
aaacctagtctggtcaatcagtgga

SEQ ID NO: 8110 - DNA, 25 bp, Mus musculus
aaacctagtctgtagcgagggagtt

SEQ ID NO: 8111 - DNA, 25 bp, Mus musculus
aaacctagtggcacagctacgtaaa

SEQ ID NO: 8112 - DNA, 25 bp, Mus musculus
aaacctagtggctcagctacgtaaa

SEQ ID NO: 8113 - DNA, 25 bp, Mus musculus
aaacctagtttcagacccagccgtg

SEQ ID NO: 8114 - DNA, 25 bp, Mus musculus
aaacctagtttctgacccagccgtg

SEQ ID NO: 8115 - DNA, 25 bp, Mus musculus
aaacctagtttgatctctgatcgcc

SEQ ID NO: 8116 - DNA, 25 bp, Mus musculus
aaacctagtttgttctctgatcgcc

SEQ ID NO: 8117 - DNA, 25 bp, Mus musculus
aaacctataacccattcgactctat

SEQ ID NO: 8118 - DNA, 25 bp, Mus musculus
aaacctataaccgattcgactctat

SEQ ID NO: 8119 - DNA, 25 bp, Mus musculus
aaacctatactgaggaatcctatgg

SEQ ID NO: 8120 - DNA, 25 bp, Mus musculus
aaacctatactgtggaatcctatgg

SEQ ID NO: 8121 - DNA, 25 bp, Mus musculus
aaacctatcagtagtagttagctgt

SEQ ID NO: 8122 - DNA, 25 bp, Mus musculus
aaacctatcagttgtagttagctgt

SEQ ID NO: 8123 - DNA, 25 bp, Mus musculus
aaacctatcctccacacatggcctg

SEQ ID NO: 8124 - DNA, 25 bp, Mus musculus
aaacctatcctcgacacatggcctg

SEQ ID NO: 8125 - DNA, 25 bp, Mus musculus
aaacctatctgaagcaccttctaag

SEQ ID NO: 8126 - DNA, 25 bp, Mus musculus
aaacctatctgatgcaccttctaag

SEQ ID NO: 8127 - DNA, 25 bp, Mus musculus
aaacctatgatcacccttaagacta

SEQ ID NO: 8128 - DNA, 25 bp, Mus musculus
aaacctatgatctcccttaagacta

SEQ ID NO: 8129 - DNA, 25 bp, Mus musculus
aaacctatgcacatcccttgcattt

SEQ ID NO: 8130 - DNA, 25 bp, Mus musculus
aaacctatgcacttcccttgcattt

SEQ ID NO: 8131 - DNA, 25 bp, Mus musculus
aaacctatgctcacttgattctttt

SEQ ID NO: 8132 - DNA, 25 bp, Mus musculus
aaacctatgctctcttgattctttt

SEQ ID NO: 8133 - DNA, 25 bp, Mus musculus
aaacctatgctgaaattcttgagcc

SEQ ID NO: 8134 - DNA, 25 bp, Mus musculus
aaacctatgctgagattcagagata

SEQ ID NO: 8135 - DNA, 25 bp, Mus musculus
aaacctatgctgtaattcttgagcc

SEQ ID NO: 8136 - DNA, 25 bp, Mus musculus
aaacctatgctgtgattcagagata

SEQ ID NO: 8137 - DNA, 25 bp, Mus musculus
aaacctatgtatacatgccgctgtg

SEQ ID NO: 8138 - DNA, 25 bp, Mus musculus
aaacctatgtattcatgccgctgtg

SEQ ID NO: 8139 - DNA, 25 bp, Mus musculus
aaacctatgtccctcatttttgctt

SEQ ID NO: 8140 - DNA, 25 bp, Mus musculus
aaacctatgtccgtcatttttgctt

SEQ ID NO: 8141 - DNA, 25 bp, Mus musculus
aaacctatgtgacgttcatttaaga

SEQ ID NO: 8142 - DNA, 25 bp, Mus musculus
aaacctatgtgaggttcatttaaga

SEQ ID NO: 8143 - DNA, 25 bp, Mus musculus
aaacctattattacaagccagagag

SEQ ID NO: 8144 - DNA, 25 bp, Mus musculus
aaacctattatttcaagccagagag

SEQ ID NO: 8145 - DNA, 25 bp, Mus musculus
aaacctattcttatattgcatatca

SEQ ID NO: 8146 - DNA, 25 bp, Mus musculus
aaacctattcttttattgcatatca

SEQ ID NO: 8147 - DNA, 25 bp, Mus musculus
aaacctattgctagtctcgtgtgag

SEQ ID NO: 8148 - DNA, 25 bp, Mus musculus
aaacctattgcttgtctcgtgtgag

SEQ ID NO: 8149 - DNA, 25 bp, Mus musculus
aaacctattgttcaactgctctgaa

SEQ ID NO: 8150 - DNA, 25 bp, Mus musculus
aaacctattgttgaactgctctgaa

SEQ ID NO: 8151 - DNA, 25 bp, Mus musculus
aaacctattttgactgaactcacag

SEQ ID NO: 8152 - DNA, 25 bp, Mus musculus
aaacctattttgtctgaactcacag

SEQ ID NO: 8153 - DNA, 25 bp, Mus musculus
aaacctcaacccagctcggagcaag

SEQ ID NO: 8154 - DNA, 25 bp, Mus musculus
aaacctcaaccctgctcggagcaag

SEQ ID NO: 8155 - DNA, 25 bp, Mus musculus
aaacctcaagacacgagatcccata

SEQ ID NO: 8156 - DNA, 25 bp, Mus musculus
aaacctcaagactcgagatcccata

SEQ ID NO: 8157 - DNA, 25 bp, Mus musculus
aaacctcaaggcaggcagtgcagag

SEQ ID NO: 8158 - DNA, 25 bp, Mus musculus
aaacctcaaggctggcagtgcagag

SEQ ID NO: 8159 - DNA, 25 bp, Mus musculus
aaacctcaagggatagcacatgctc

SEQ ID NO: 8160 - DNA, 25 bp, Mus musculus
aaacctcaagggttagcacatgctc

SEQ ID NO: 8161 - DNA, 25 bp, Mus musculus
aaacctcaagtgaaagcctaactag

SEQ ID NO: 8162 - DNA, 25 bp, Mus musculus
aaacctcaagtgtaagcctaactag

SEQ ID NO: 8163 - DNA, 25 bp, Mus musculus
aaacctcaatagcttttgtctgtat

SEQ ID NO: 8164 - DNA, 25 bp, Mus musculus
aaacctcaataggttttgtctgtat

SEQ ID NO: 8165 - DNA, 25 bp, Mus musculus
aaacctcaattacccattcacaaag

SEQ ID NO: 8166 - DNA, 25 bp, Mus musculus
aaacctcaattagccattcacaaag

SEQ ID NO: 8167 - DNA, 25 bp, Mus musculus
aaacctcacagacaaccaaatacag

SEQ ID NO: 8168 - DNA, 25 bp, Mus musculus
aaacctcacagagaaccaaatacag

SEQ ID NO: 8169 - DNA, 25 bp, Mus musculus
aaacctcacagcatgtataatgtaa

SEQ ID NO: 8170 - DNA, 25 bp, Mus musculus
aaacctcacagcttgtataatgtaa

SEQ ID NO: 8171 - DNA, 25 bp, Mus musculus
aaacctcacgagctcatatttctag

SEQ ID NO: 8172 - DNA, 25 bp, Mus musculus
aaacctcacgaggtcatatttctag

SEQ ID NO: 8173 - DNA, 25 bp, Mus musculus
aaacctcactatcatgcttgggcta

SEQ ID NO: 8174 - DNA, 25 bp, Mus musculus
aaacctcactatgatgcttgggcta

SEQ ID NO: 8175 - DNA, 25 bp, Mus musculus
aaacctcactcacggccacattgag

SEQ ID NO: 8176 - DNA, 25 bp, Mus musculus
aaacctcactcagggccacattgag

SEQ ID NO: 8177 - DNA, 25 bp, Mus musculus
aaacctcagatgctccgtctgagtt

SEQ ID NO: 8178 - DNA, 25 bp, Mus musculus
aaacctcagatggtccgtctgagtt

SEQ ID NO: 8179 - DNA, 25 bp, Mus musculus
aaacctcagattcctgccatttctc

SEQ ID NO: 8180 - DNA, 25 bp, Mus musculus
aaacctcagattgctgccatttctc

SEQ ID NO: 8181 - DNA, 25 bp, Mus musculus
aaacctcagccacatatggtggtgc

SEQ ID NO: 8182 - DNA, 25 bp, Mus musculus
aaacctcagccagatatggtggtgc

SEQ ID NO: 8183 - DNA, 25 bp, Mus musculus
aaacctcagccccagaataaggaag

SEQ ID NO: 8184 - DNA, 25 bp, Mus musculus
aaacctcagcccgagaataaggaag

SEQ ID NO: 8185 - DNA, 25 bp, Mus musculus
aaacctcagccgctggtggattgta

SEQ ID NO: 8186 - DNA, 25 bp, Mus musculus
aaacctcagccggtggtggattgta

SEQ ID NO: 8187 - DNA, 25 bp, Mus musculus
aaacctcagggcaccctgtgacagg

SEQ ID NO: 8188 - DNA, 25 bp, Mus musculus
aaacctcagggctccctgtgacagg

SEQ ID NO: 8189 - DNA, 25 bp, Mus musculus
aaacctcaggttagtggactgcgca

SEQ ID NO: 8190 - DNA, 25 bp, Mus musculus
aaacctcaggtttgtggactgcgca

SEQ ID NO: 8191 - DNA, 25 bp, Mus musculus
aaacctcagtacctcttattccaag

SEQ ID NO: 8192 - DNA, 25 bp, Mus musculus
aaacctcagtacgtcttattccaag

SEQ ID NO: 8193 - DNA, 25 bp, Mus musculus
aaacctcatgctagggctggtgaga

SEQ ID NO: 8194 - DNA, 25 bp, Mus musculus
aaacctcatgcttgggctggtgaga

SEQ ID NO: 8195 - DNA, 25 bp, Mus musculus
aaacctcattctacattagacaacg

SEQ ID NO: 8196 - DNA, 25 bp, Mus musculus
aaacctcattcttcattagacaacg

SEQ ID NO: 8197 - DNA, 25 bp, Mus musculus
aaacctcattttaatgctgtatttt

SEQ ID NO: 8198 - DNA, 25 bp, Mus musculus
aaacctcatttttatgctgtatttt

SEQ ID NO: 8199 - DNA, 25 bp, Mus musculus
aaacctccaaagaagatgtggactc

SEQ ID NO: 8200 - DNA, 25 bp, Mus musculus
aaacctccaaagtagatgtggactc

SEQ ID NO: 8201 - DNA, 25 bp, Mus musculus
aaacctccaagaccagagtgcctta

SEQ ID NO: 8202 - DNA, 25 bp, Mus musculus
aaacctccaagagcagagtgcctta

SEQ ID NO: 8203 - DNA, 25 bp, Mus musculus
aaacctccacctacattgcttatat

SEQ ID NO: 8204 - DNA, 25 bp, Mus musculus
aaacctccaccttcattgcttatat

SEQ ID NO: 8205 - DNA, 25 bp, Mus musculus
aaacctccactgactactctaggta

SEQ ID NO: 8206 - DNA, 25 bp, Mus musculus
aaacctccactgcaactgctggagt

SEQ ID NO: 8207 - DNA, 25 bp, Mus musculus
aaacctccactggaactgctggagt

SEQ ID NO: 8208 - DNA, 25 bp, Mus musculus
aaacctccactgtctactctaggta

SEQ ID NO: 8209 - DNA, 25 bp, Mus musculus
aaacctccagaacactttttggcag

SEQ ID NO: 8210 - DNA, 25 bp, Mus musculus
aaacctccagaagactttttggcag

SEQ ID NO: 8211 - DNA, 25 bp, Mus musculus
aaacctccagagatgcacatgtact

SEQ ID NO: 8212 - DNA, 25 bp, Mus musculus
aaacctccagagttgcacatgtact

SEQ ID NO: 8213 - DNA, 25 bp, Mus musculus
aaacctccatatacctatttgatgt

SEQ ID NO: 8214 - DNA, 25 bp, Mus musculus
aaacctccatattcctatttgatgt

SEQ ID NO: 8215 - DNA, 25 bp, Mus musculus
aaacctccatggctcccgtgtagag

SEQ ID NO: 8216 - DNA, 25 bp, Mus musculus
aaacctccatgggtcccgtgtagag

SEQ ID NO: 8217 - DNA, 25 bp, Mus musculus
aaacctcccagtagaccaggaacag

SEQ ID NO: 8218 - DNA, 25 bp, Mus musculus
aaacctcccagttgaccaggaacag

SEQ ID NO: 8219 - DNA, 25 bp, Mus musculus
aaacctcccgagaaagaaagatgtg

SEQ ID NO: 8220 - DNA, 25 bp, Mus musculus
aaacctcccgagtaagaaagatgtg

SEQ ID NO: 8221 - DNA, 25 bp, Mus musculus
aaacctccctgaccagtgttcaatg

SEQ ID NO: 8222 - DNA, 25 bp, Mus musculus
aaacctccctgagcagtgttcaatg

SEQ ID NO: 8223 - DNA, 25 bp, Mus musculus
aaacctcctactctgacatgcaggg

SEQ ID NO: 8224 - DNA, 25 bp, Mus musculus
aaacctcctactgtgacatgcaggg

SEQ ID NO: 8225 - DNA, 25 bp, Mus musculus
aaacctcctcgcagtgcacggaaac

SEQ ID NO: 8226 - DNA, 25 bp, Mus musculus
aaacctcctcgctgtgcacggaaac

SEQ ID NO: 8227 - DNA, 25 bp, Mus musculus
aaacctcctgtcatttaaccatgtg

SEQ ID NO: 8228 - DNA, 25 bp, Mus musculus
aaacctcctgtcttttaaccatgtg

SEQ ID NO: 8229 - DNA, 25 bp, Mus musculus
aaacctcctgtgagctaagcggctt

SEQ ID NO: 8230 - DNA, 25 bp, Mus musculus
aaacctcctgtgtgctaagcggctt

SEQ ID NO: 8231 - DNA, 25 bp, Mus musculus
aaacctcctgttcatttgtaggact

SEQ ID NO: 8232 - DNA, 25 bp, Mus musculus
aaacctcctgttcttatctttgctg

SEQ ID NO: 8233 - DNA, 25 bp, Mus musculus
aaacctcctgttgatttgtaggact

SEQ ID NO: 8234 - DNA, 25 bp, Mus musculus
aaacctcctgttgttatctttgctg

SEQ ID NO: 8235 - DNA, 25 bp, Mus musculus
aaacctccttcgactgtattttcat

SEQ ID NO: 8236 - DNA, 25 bp, Mus musculus
aaacctccttcgtctgtattttcat

SEQ ID NO: 8237 - DNA, 25 bp, Mus musculus
aaacctcgctcgatggcgtgtgcac

SEQ ID NO: 8238 - DNA, 25 bp, Mus musculus
aaacctcgctcgttggcgtgtgcac

SEQ ID NO: 8239 - DNA, 25 bp, Mus musculus
aaacctcgggagcagcgcagaagct

SEQ ID NO: 8240 - DNA, 25 bp, Mus musculus
aaacctcgggaggagcgcagaagct

SEQ ID NO: 8241 - DNA, 25 bp, Mus musculus
aaacctcgtaggacagaagtgctcg

SEQ ID NO: 8242 - DNA, 25 bp, Mus musculus
aaacctcgtaggtcagaagtgctcg

SEQ ID NO: 8243 - DNA, 25 bp, Mus musculus
aaacctcgtgtgacttactcatcag

SEQ ID NO: 8244 - DNA, 25 bp, Mus musculus
aaacctcgtgtgtcttactcatcag

SEQ ID NO: 8245 - DNA, 25 bp, Mus musculus
aaacctctaagaattgggatgtcaa

SEQ ID NO: 8246 - DNA, 25 bp, Mus musculus
aaacctctaagatttgggatgtcaa

SEQ ID NO: 8247 - DNA, 25 bp, Mus musculus
aaacctctaataatctaagcagcat

SEQ ID NO: 8248 - DNA, 25 bp, Mus musculus
aaacctctaatattctaagcagcat

SEQ ID NO: 8249 - DNA, 25 bp, Mus musculus
aaacctctacagcagggcgtcacac

SEQ ID NO: 8250 - DNA, 25 bp, Mus musculus
aaacctctacaggagggcgtcacac

SEQ ID NO: 8251 - DNA, 25 bp, Mus musculus
aaacctctcaacatcatgactgtga

SEQ ID NO: 8252 - DNA, 25 bp, Mus musculus
aaacctctcaacttcatgactgtga

SEQ ID NO: 8253 - DNA, 25 bp, Mus musculus
aaacctctcctgattgtttagcctg

SEQ ID NO: 8254 - DNA, 25 bp, Mus musculus
aaacctctcctgtttgtttagcctg

SEQ ID NO: 8255 - DNA, 25 bp, Mus musculus
aaacctctccttctaatctacattt

SEQ ID NO: 8256 - DNA, 25 bp, Mus musculus
aaacctctccttgtaatctacattt

SEQ ID NO: 8257 - DNA, 25 bp, Mus musculus
aaacctctcttgacgcacgtatttg

SEQ ID NO: 8258 - DNA, 25 bp, Mus musculus
aaacctctcttgactattgttacaa

SEQ ID NO: 8259 - DNA, 25 bp, Mus musculus
aaacctctcttgtcgcacgtatttg

SEQ ID NO: 8260 - DNA, 25 bp, Mus musculus
aaacctctcttgtctattgttacaa

SEQ ID NO: 8261 - DNA, 25 bp, Mus musculus
aaacctctgactatgtacacattta

SEQ ID NO: 8262 - DNA, 25 bp, Mus musculus
aaacctctgactcgctcttcgagga

SEQ ID NO: 8263 - DNA, 25 bp, Mus musculus
aaacctctgactggctcttcgagga

SEQ ID NO: 8264 - DNA, 25 bp, Mus musculus
aaacctctgactttgtacacattta

SEQ ID NO: 8265 - DNA, 25 bp, Mus musculus
aaacctctgatcacttacattcgaa

SEQ ID NO: 8266 - DNA, 25 bp, Mus musculus
aaacctctgatctcttacattcgaa

SEQ ID NO: 8267 - DNA, 25 bp, Mus musculus
aaacctctgcagacaatacttgtgg

SEQ ID NO: 8268 - DNA, 25 bp, Mus musculus
aaacctctgcagatcaggtgatgac

SEQ ID NO: 8269 - DNA, 25 bp, Mus musculus
aaacctctgcagtcaatacttgtgg

SEQ ID NO: 8270 - DNA, 25 bp, Mus musculus
aaacctctgcagttcaggtgatgac

SEQ ID NO: 8271 - DNA, 25 bp, Mus musculus
aaacctctgctactcatagaattat

SEQ ID NO: 8272 - DNA, 25 bp, Mus musculus
aaacctctgctagtcatagaattat

SEQ ID NO: 8273 - DNA, 25 bp, Mus musculus
aaacctctgctcaagtcaccattaa

SEQ ID NO: 8274 - DNA, 25 bp, Mus musculus
aaacctctgctcactataagttcta

SEQ ID NO: 8275 - DNA, 25 bp, Mus musculus
aaacctctgctctagtcaccattaa

SEQ ID NO: 8276 - DNA, 25 bp, Mus musculus
aaacctctgctctctataagttcta

SEQ ID NO: 8277 - DNA, 25 bp, Mus musculus
aaacctctggaacccgcgattgaat

SEQ ID NO: 8278 - DNA, 25 bp, Mus musculus
aaacctctggaagccgcgattgaat

SEQ ID NO: 8279 - DNA, 25 bp, Mus musculus
aaacctctggagactgctgttcctg

SEQ ID NO: 8280 - DNA, 25 bp, Mus musculus
aaacctctggagtctgctgttcctg

SEQ ID NO: 8281 - DNA, 25 bp, Mus musculus
aaacctctggatcctgtcaccatta

SEQ ID NO: 8282 - DNA, 25 bp, Mus musculus
aaacctctggatgctgtcaccatta

SEQ ID NO: 8283 - DNA, 25 bp, Mus musculus
aaacctctgggtcctggtgccattg

SEQ ID NO: 8284 - DNA, 25 bp, Mus musculus
aaacctctgggtcctttacagaatg

SEQ ID NO: 8285 - DNA, 25 bp, Mus musculus
aaacctctgggtgctggtgccattg

SEQ ID NO: 8286 - DNA, 25 bp, Mus musculus
aaacctctgggtgctttacagaatg

SEQ ID NO: 8287 - DNA, 25 bp, Mus musculus
aaacctctgtccagcggctgggaga

SEQ ID NO: 8288 - DNA, 25 bp, Mus musculus
aaacctctgtccctaagggcaggtg

SEQ ID NO: 8289 - DNA, 25 bp, Mus musculus
aaacctctgtccgtaagggcaggtg

SEQ ID NO: 8290 - DNA, 25 bp, Mus musculus
aaacctctgtcctgcggctgggaga

SEQ ID NO: 8291 - DNA, 25 bp, Mus musculus
aaacctctgtttctgcgccatagaa

SEQ ID NO: 8292 - DNA, 25 bp, Mus musculus
aaacctctgtttgtgcgccatagaa

SEQ ID NO: 8293 - DNA, 25 bp, Mus musculus
aaacctcttagacatttccacatgg

SEQ ID NO: 8294 - DNA, 25 bp, Mus musculus
aaacctcttagagatttccacatgg

SEQ ID NO: 8295 - DNA, 25 bp, Mus musculus
aaacctcttctaccctggacctagt

SEQ ID NO: 8296 - DNA, 25 bp, Mus musculus
aaacctcttctagcctggacctagt

SEQ ID NO: 8297 - DNA, 25 bp, Mus musculus
aaacctcttgacattggcctgtcac

SEQ ID NO: 8298 - DNA, 25 bp, Mus musculus
aaacctcttgactttggcctgtcac

SEQ ID NO: 8299 - DNA, 25 bp, Mus musculus
aaacctgaaaacacactgcatcgat

SEQ ID NO: 8300 - DNA, 25 bp, Mus musculus
aaacctgaaaactcactgcatcgat

SEQ ID NO: 8301 - DNA, 25 bp, Mus musculus
aaacctgaaaggactgcatctccag

SEQ ID NO: 8302 - DNA, 25 bp, Mus musculus
aaacctgaaaggtctgcatctccag

SEQ ID NO: 8303 - DNA, 25 bp, Mus musculus
aaacctgaaatcacggcagtgcaca

SEQ ID NO: 8304 - DNA, 25 bp, Mus musculus
aaacctgaaatctcggcagtgcaca

SEQ ID NO: 8305 - DNA, 25 bp, Mus musculus
aaacctgaacacagctttttgccct

SEQ ID NO: 8306 - DNA, 25 bp, Mus musculus
aaacctgaacactgctttttgccct

SEQ ID NO: 8307 - DNA, 25 bp, Mus musculus
aaacctgaacggagcaacagcatca

SEQ ID NO: 8308 - DNA, 25 bp, Mus musculus
aaacctgaacggtgcaacagcatca

SEQ ID NO: 8309 - DNA, 25 bp, Mus musculus
aaacctgaacttccaggatccggtg

SEQ ID NO: 8310 - DNA, 25 bp, Mus musculus
aaacctgaacttgcaggatccggtg

SEQ ID NO: 8311 - DNA, 25 bp, Mus musculus
aaacctgaagagctctttcttggaa

SEQ ID NO: 8312 - DNA, 25 bp, Mus musculus
aaacctgaagaggtctttcttggaa

SEQ ID NO: 8313 - DNA, 25 bp, Mus musculus
aaacctgaagatatatggccaacaa

SEQ ID NO: 8314 - DNA, 25 bp, Mus musculus
aaacctgaagatatccgcagtccgt

SEQ ID NO: 8315 - DNA, 25 bp, Mus musculus
aaacctgaagatttatggccaacaa

SEQ ID NO: 8316 - DNA, 25 bp, Mus musculus
aaacctgaagatttccgcagtccgt

SEQ ID NO: 8317 - DNA, 25 bp, Mus musculus
aaacctgaagccaagaacataaatt

SEQ ID NO: 8318 - DNA, 25 bp, Mus musculus
aaacctgaagcctagaacataaatt

SEQ ID NO: 8319 - DNA, 25 bp, Mus musculus
aaacctgaaggcatcagtttgatag

SEQ ID NO: 8320 - DNA, 25 bp, Mus musculus
aaacctgaaggcttcagtttgatag

SEQ ID NO: 8321 - DNA, 25 bp, Mus musculus
aaacctgacaggctggcaggcacct

SEQ ID NO: 8322 - DNA, 25 bp, Mus musculus
aaacctgacagggtggcaggcacct

SEQ ID NO: 8323 - DNA, 25 bp, Mus musculus
aaacctgacattctgaatttcccca

SEQ ID NO: 8324 - DNA, 25 bp, Mus musculus
aaacctgacattgtgaatttcccca

SEQ ID NO: 8325 - DNA, 25 bp, Mus musculus
aaacctgaccacaagcctcctggag

SEQ ID NO: 8326 - DNA, 25 bp, Mus musculus
aaacctgaccactagcctcctggag

SEQ ID NO: 8327 - DNA, 25 bp, Mus musculus
aaacctgacgagaaagagccagtgt

SEQ ID NO: 8328 - DNA, 25 bp, Mus musculus
aaacctgacgagtaagagccagtgt

SEQ ID NO: 8329 - DNA, 25 bp, Mus musculus
aaacctgacggccagttctgagaaa

SEQ ID NO: 8330 - DNA, 25 bp, Mus musculus
aaacctgacggcgagttctgagaaa

SEQ ID NO: 8331 - DNA, 25 bp, Mus musculus
aaacctgactatccactgagctctg

SEQ ID NO: 8332 - DNA, 25 bp, Mus musculus
aaacctgactatccctgtgaaccta

SEQ ID NO: 8333 - DNA, 25 bp, Mus musculus
aaacctgactatgcactgagctctg

SEQ ID NO: 8334 - DNA, 25 bp, Mus musculus
aaacctgactatgcctgtgaaccta

SEQ ID NO: 8335 - DNA, 25 bp, Mus musculus
aaacctgactgaacgtgtgcgccca

SEQ ID NO: 8336 - DNA, 25 bp, Mus musculus
aaacctgactgacagttccctctga

SEQ ID NO: 8337 - DNA, 25 bp, Mus musculus
aaacctgactgagagttccctctga

SEQ ID NO: 8338 - DNA, 25 bp, Mus musculus
aaacctgactgatcgtgtgcgccca

SEQ ID NO: 8339 - DNA, 25 bp, Mus musculus
aaacctgacttccatcgtctagaat

SEQ ID NO: 8340 - DNA, 25 bp, Mus musculus
aaacctgacttcgatcgtctagaat

SEQ ID NO: 8341 - DNA, 25 bp, Mus musculus
aaacctgacttgcttggagatgatg

SEQ ID NO: 8342 - DNA, 25 bp, Mus musculus
aaacctgacttggttggagatgatg

SEQ ID NO: 8343 - DNA, 25 bp, Mus musculus
aaacctgactttcgctactggtgac

SEQ ID NO: 8344 - DNA, 25 bp, Mus musculus
aaacctgactttggctactggtgac

SEQ ID NO: 8345 - DNA, 25 bp, Mus musculus
aaacctgagaagacagcaactcaca

SEQ ID NO: 8346 - DNA, 25 bp, Mus musculus
aaacctgagaagtcagcaactcaca

SEQ ID NO: 8347 - DNA, 25 bp, Mus musculus
aaacctgagcctcaatccttatgag

SEQ ID NO: 8348 - DNA, 25 bp, Mus musculus
aaacctgagcctgaatccttatgag

SEQ ID NO: 8349 - DNA, 25 bp, Mus musculus
aaacctgagctaatttactgggact

SEQ ID NO: 8350 - DNA, 25 bp, Mus musculus
aaacctgagctattttactgggact

SEQ ID NO: 8351 - DNA, 25 bp, Mus musculus
aaacctgagctccaggcatgcctga

SEQ ID NO: 8352 - DNA, 25 bp, Mus musculus
aaacctgagctcgaggcatgcctga

SEQ ID NO: 8353 - DNA, 25 bp, Mus musculus
aaacctgaggtcatagggtcattat

SEQ ID NO: 8354 - DNA, 25 bp, Mus musculus
aaacctgaggtcttagggtcattat

SEQ ID NO: 8355 - DNA, 25 bp, Mus musculus
aaacctgagtctaaggagccgccct

SEQ ID NO: 8356 - DNA, 25 bp, Mus musculus
aaacctgagtctatcaagagcaaca

SEQ ID NO: 8357 - DNA, 25 bp, Mus musculus
aaacctgagtcttaggagccgccct

SEQ ID NO: 8358 - DNA, 25 bp, Mus musculus
aaacctgagtctttcaagagcaaca

SEQ ID NO: 8359 - DNA, 25 bp, Mus musculus
aaacctgatccaccaatctctctaa

SEQ ID NO: 8360 - DNA, 25 bp, Mus musculus
aaacctgatccagcaatctctctaa

SEQ ID NO: 8361 - DNA, 25 bp, Mus musculus
aaacctgatgaccttctaccaaatg

SEQ ID NO: 8362 - DNA, 25 bp, Mus musculus
aaacctgatgacgttctaccaaatg

SEQ ID NO: 8363 - DNA, 25 bp, Mus musculus
aaacctgatggcaatgattactacg

SEQ ID NO: 8364 - DNA, 25 bp, Mus musculus
aaacctgatggctatgattactacg

SEQ ID NO: 8365 - DNA, 25 bp, Mus musculus
aaacctgatgtgaacattacccgat

SEQ ID NO: 8366 - DNA, 25 bp, Mus musculus
aaacctgatgtgtacattacccgat

SEQ ID NO: 8367 - DNA, 25 bp, Mus musculus
aaacctgcaaatcactggagtccca

SEQ ID NO: 8368 - DNA, 25 bp, Mus musculus
aaacctgcaaatgactggagtccca

SEQ ID NO: 8369 - DNA, 25 bp, Mus musculus
aaacctgcaagacattattttgaat

SEQ ID NO: 8370 - DNA, 25 bp, Mus musculus
aaacctgcaagagattattttgaat

SEQ ID NO: 8371 - DNA, 25 bp, Mus musculus
aaacctgcactacagagtgtcagat

SEQ ID NO: 8372 - DNA, 25 bp, Mus musculus
aaacctgcactagagagtgtcagat

SEQ ID NO: 8373 - DNA, 25 bp, Mus musculus
aaacctgcaggtctcagctgtaagc

SEQ ID NO: 8374 - DNA, 25 bp, Mus musculus
aaacctgcaggtgtcagctgtaagc

SEQ ID NO: 8375 - DNA, 25 bp, Mus musculus
aaacctgcagtcaaaatgtcactag

SEQ ID NO: 8376 - DNA, 25 bp, Mus musculus
aaacctgcagtcactcttacctaga

SEQ ID NO: 8377 - DNA, 25 bp, Mus musculus
aaacctgcagtctaaatgtcactag

SEQ ID NO: 8378 - DNA, 25 bp, Mus musculus
aaacctgcagtctctcttacctaga

SEQ ID NO: 8379 - DNA, 25 bp, Mus musculus
aaacctgcatctagcctggcgtggt

SEQ ID NO: 8380 - DNA, 25 bp, Mus musculus
aaacctgcatcttgcctggcgtggt

SEQ ID NO: 8381 - DNA, 25 bp, Mus musculus
aaacctgcatttatgtcgtgttcta

SEQ ID NO: 8382 - DNA, 25 bp, Mus musculus
aaacctgcatttttgtcgtgttcta

SEQ ID NO: 8383 - DNA, 25 bp, Mus musculus
aaacctgccagtcctaagaagaaca

SEQ ID NO: 8384 - DNA, 25 bp, Mus musculus
aaacctgccagtcttgtagtgtata

SEQ ID NO: 8385 - DNA, 25 bp, Mus musculus
aaacctgccagtgctaagaagaaca

SEQ ID NO: 8386 - DNA, 25 bp, Mus musculus
aaacctgccagtgttgtagtgtata

SEQ ID NO: 8387 - DNA, 25 bp, Mus musculus
aaacctgcctggacgagatgaacgt

SEQ ID NO: 8388 - DNA, 25 bp, Mus musculus
aaacctgcctggtcgagatgaacgt

SEQ ID NO: 8389 - DNA, 25 bp, Mus musculus
aaacctgccttaatggagaagtcac

SEQ ID NO: 8390 - DNA, 25 bp, Mus musculus
aaacctgccttattggagaagtcac

SEQ ID NO: 8391 - DNA, 25 bp, Mus musculus
aaacctgctacactaatacttgatt

SEQ ID NO: 8392 - DNA, 25 bp, Mus musculus
aaacctgctacagtaatacttgatt

SEQ ID NO: 8393 - DNA, 25 bp, Mus musculus
aaacctgctatacttctgtgaatca

SEQ ID NO: 8394 - DNA, 25 bp, Mus musculus
aaacctgctatagttctgtgaatca

SEQ ID NO: 8395 - DNA, 25 bp, Mus musculus
aaacctgctctgaggtatagccttt

SEQ ID NO: 8396 - DNA, 25 bp, Mus musculus
aaacctgctctgtggtatagccttt

SEQ ID NO: 8397 - DNA, 25 bp, Mus musculus
aaacctgctgataccagtcatggta

SEQ ID NO: 8398 - DNA, 25 bp, Mus musculus
aaacctgctgattccagtcatggta

SEQ ID NO: 8399 - DNA, 25 bp, Mus musculus
aaacctgctgtcacgtggacaaagt

SEQ ID NO: 8400 - DNA, 25 bp, Mus musculus
aaacctgctgtctcgtggacaaagt

SEQ ID NO: 8401 - DNA, 25 bp, Mus musculus
aaacctgctttgagtgtgatgatac

SEQ ID NO: 8402 - DNA, 25 bp, Mus musculus
aaacctgctttgtgtgtgatgatac

SEQ ID NO: 8403 - DNA, 25 bp, Mus musculus
aaacctggacggacgctgtcctggg

SEQ ID NO: 8404 - DNA, 25 bp, Mus musculus
aaacctggacggtcgctgtcctggg

SEQ ID NO: 8405 - DNA, 25 bp, Mus musculus
aaacctggactcctatggatggctg

SEQ ID NO: 8406 - DNA, 25 bp, Mus musculus
aaacctggactcgtatggatggctg

SEQ ID NO: 8407 - DNA, 25 bp, Mus musculus
aaacctggagctcttggcccagcat

SEQ ID NO: 8408 - DNA, 25 bp, Mus musculus
aaacctggagctgttggcccagcat

SEQ ID NO: 8409 - DNA, 25 bp, Mus musculus
aaacctggagtgctatatgcaacac

SEQ ID NO: 8410 - DNA, 25 bp, Mus musculus
aaacctggagtggtatatgcaacac

SEQ ID NO: 8411 - DNA, 25 bp, Mus musculus
aaacctggagttcttcctcttgatt

SEQ ID NO: 8412 - DNA, 25 bp, Mus musculus
aaacctggagttgttcctcttgatt

SEQ ID NO: 8413 - DNA, 25 bp, Mus musculus
aaacctggcattccgctgagtgtaa

SEQ ID NO: 8414 - DNA, 25 bp, Mus musculus
aaacctggcattgcgctgagtgtaa

SEQ ID NO: 8415 - DNA, 25 bp, Mus musculus
aaacctggctgacgacggattcaca

SEQ ID NO: 8416 - DNA, 25 bp, Mus musculus
aaacctggctgaggacggattcaca

SEQ ID NO: 8417 - DNA, 25 bp, Mus musculus
aaacctggcttgatatagaagtcct

SEQ ID NO: 8418 - DNA, 25 bp, Mus musculus
aaacctggcttgttatagaagtcct

SEQ ID NO: 8419 - DNA, 25 bp, Mus musculus
aaacctgggatgatgcatgagtact

SEQ ID NO: 8420 - DNA, 25 bp, Mus musculus
aaacctgggatgttgcatgagtact

SEQ ID NO: 8421 - DNA, 25 bp, Mus musculus
aaacctgggccaaggtgtccaagca

SEQ ID NO: 8422 - DNA, 25 bp, Mus musculus
aaacctgggccatggtgtccaagca

SEQ ID NO: 8423 - DNA, 25 bp, Mus musculus
aaacctgggtacctagcagctgata

SEQ ID NO: 8424 - DNA, 25 bp, Mus musculus
aaacctgggtacgtagcagctgata

SEQ ID NO: 8425 - DNA, 25 bp, Mus musculus
aaacctgggtctaaacatgtgcaca

SEQ ID NO: 8426 - DNA, 25 bp, Mus musculus
aaacctgggtctcaggaggaaccat

SEQ ID NO: 8427 - DNA, 25 bp, Mus musculus
aaacctgggtctcgtgtgatggctc

SEQ ID NO: 8428 - DNA, 25 bp, Mus musculus
aaacctgggtctgaggaggaaccat

SEQ ID NO: 8429 - DNA, 25 bp, Mus musculus
aaacctgggtctggtgtgatggctc

SEQ ID NO: 8430 - DNA, 25 bp, Mus musculus
aaacctgggtcttaacatgtgcaca

SEQ ID NO: 8431 - DNA, 25 bp, Mus musculus
aaacctgggtgcacaggagccccag

SEQ ID NO: 8432 - DNA, 25 bp, Mus musculus
aaacctgggtgctcaggagccccag

SEQ ID NO: 8433 - DNA, 25 bp, Mus musculus
aaacctgggtttacaacatcatgaa

SEQ ID NO: 8434 - DNA, 25 bp, Mus musculus
aaacctgggttttcaacatcatgaa

SEQ ID NO: 8435 - DNA, 25 bp, Mus musculus
aaacctggtaggaacttggcactgg

SEQ ID NO: 8436 - DNA, 25 bp, Mus musculus
aaacctggtaggtacttggcactgg

SEQ ID NO: 8437 - DNA, 25 bp, Mus musculus
aaacctggtgagctggtgcatgcct

SEQ ID NO: 8438 - DNA, 25 bp, Mus musculus
aaacctggtgaggtggtgcatgcct

SEQ ID NO: 8439 - DNA, 25 bp, Mus musculus
aaacctggtgtactgagcgctttca

SEQ ID NO: 8440 - DNA, 25 bp, Mus musculus
aaacctggtgtagtgagcgctttca

SEQ ID NO: 8441 - DNA, 25 bp, Mus musculus
aaacctggtgttatatataggtctg

SEQ ID NO: 8442 - DNA, 25 bp, Mus musculus
aaacctggtgttttatataggtctg

SEQ ID NO: 8443 - DNA, 25 bp, Mus musculus
aaacctggttctctggtaggctact

SEQ ID NO: 8444 - DNA, 25 bp, Mus musculus
aaacctggttctgtggtaggctact

SEQ ID NO: 8445 - DNA, 25 bp, Mus musculus
aaacctgtacatattctgccaataa

SEQ ID NO: 8446 - DNA, 25 bp, Mus musculus
aaacctgtacattttctgccaataa

SEQ ID NO: 8447 - DNA, 25 bp, Mus musculus
aaacctgtacccatcagtgactata

SEQ ID NO: 8448 - DNA, 25 bp, Mus musculus
aaacctgtacccttcagtgactata

SEQ ID NO: 8449 - DNA, 25 bp, Mus musculus
aaacctgtagtacaatgtatcattg

SEQ ID NO: 8450 - DNA, 25 bp, Mus musculus
aaacctgtagtagaatgtatcattg

SEQ ID NO: 8451 - DNA, 25 bp, Mus musculus
aaacctgtatgtcagccaggcagat

SEQ ID NO: 8452 - DNA, 25 bp, Mus musculus
aaacctgtatgtgagccaggcagat

SEQ ID NO: 8453 - DNA, 25 bp, Mus musculus
aaacctgtatttactggatatcact

SEQ ID NO: 8454 - DNA, 25 bp, Mus musculus
aaacctgtattttctggatatcact

SEQ ID NO: 8455 - DNA, 25 bp, Mus musculus
aaacctgtcaaaacatagtatgcca

SEQ ID NO: 8456 - DNA, 25 bp, Mus musculus
aaacctgtcaaatcatagtatgcca

SEQ ID NO: 8457 - DNA, 25 bp, Mus musculus
aaacctgtcaatatacgatgggcct

SEQ ID NO: 8458 - DNA, 25 bp, Mus musculus
aaacctgtcaatttacgatgggcct

SEQ ID NO: 8459 - DNA, 25 bp, Mus musculus
aaacctgtcacaaactcccgtgata

SEQ ID NO: 8460 - DNA, 25 bp, Mus musculus
aaacctgtcacacagaacatcagtg

SEQ ID NO: 8461 - DNA, 25 bp, Mus musculus
aaacctgtcacagagaacatcagtg

SEQ ID NO: 8462 - DNA, 25 bp, Mus musculus
aaacctgtcacatactcccgtgata

SEQ ID NO: 8463 - DNA, 25 bp, Mus musculus
aaacctgtcagtaatgggactccga

SEQ ID NO: 8464 - DNA, 25 bp, Mus musculus
aaacctgtcagtacttggtgagtga

SEQ ID NO: 8465 - DNA, 25 bp, Mus musculus
aaacctgtcagttatgggactccga

SEQ ID NO: 8466 - DNA, 25 bp, Mus musculus
aaacctgtcagttcttggtgagtga

SEQ ID NO: 8467 - DNA, 25 bp, Mus musculus
aaacctgtcatacttaggcccttga

SEQ ID NO: 8468 - DNA, 25 bp, Mus musculus
aaacctgtcatagttaggcccttga

SEQ ID NO: 8469 - DNA, 25 bp, Mus musculus
aaacctgtcatcacagcttttggga

SEQ ID NO: 8470 - DNA, 25 bp, Mus musculus
aaacctgtcatctcagcttttggga

SEQ ID NO: 8471 - DNA, 25 bp, Mus musculus
aaacctgtcgctcagaagctcggct

SEQ ID NO: 8472 - DNA, 25 bp, Mus musculus
aaacctgtcgctgagaagctcggct

SEQ ID NO: 8473 - DNA, 25 bp, Mus musculus
aaacctgtcgtaaaagctgctgtcc

SEQ ID NO: 8474 - DNA, 25 bp, Mus musculus
aaacctgtcgtataagctgctgtcc

SEQ ID NO: 8475 - DNA, 25 bp, Mus musculus
aaacctgtctgcatatacctaccag

SEQ ID NO: 8476 - DNA, 25 bp, Mus musculus
aaacctgtctgcttatacctaccag

SEQ ID NO: 8477 - DNA, 25 bp, Mus musculus
aaacctgtcttgactacttttagct

SEQ ID NO: 8478 - DNA, 25 bp, Mus musculus
aaacctgtcttgtctacttttagct

SEQ ID NO: 8479 - DNA, 25 bp, Mus musculus
aaacctgtctttctctatatcatta

SEQ ID NO: 8480 - DNA, 25 bp, Mus musculus
aaacctgtctttgtctatatcatta

SEQ ID NO: 8481 - DNA, 25 bp, Mus musculus
aaacctgtgaatcagccccaagagg

SEQ ID NO: 8482 - DNA, 25 bp, Mus musculus
aaacctgtgaatgagccccaagagg

SEQ ID NO: 8483 - DNA, 25 bp, Mus musculus
aaacctgtgagaaggaattttccct

SEQ ID NO: 8484 - DNA, 25 bp, Mus musculus
aaacctgtgagatggaattttccct

SEQ ID NO: 8485 - DNA, 25 bp, Mus musculus
aaacctgtgagcctgaaactttgag

SEQ ID NO: 8486 - DNA, 25 bp, Mus musculus
aaacctgtgagcgtgaaactttgag

SEQ ID NO: 8487 - DNA, 25 bp, Mus musculus
aaacctgtgataagctgatctgttg

SEQ ID NO: 8488 - DNA, 25 bp, Mus musculus
aaacctgtgatatgctgatctgttg

SEQ ID NO: 8489 - DNA, 25 bp, Mus musculus
aaacctgtgcaccaaagctttattt

SEQ ID NO: 8490 - DNA, 25 bp, Mus musculus
aaacctgtgcacctgtaagcaagcc

SEQ ID NO: 8491 - DNA, 25 bp, Mus musculus
aaacctgtgcacgaaagctttattt

SEQ ID NO: 8492 - DNA, 25 bp, Mus musculus
aaacctgtgcacgtgtaagcaagcc

SEQ ID NO: 8493 - DNA, 25 bp, Mus musculus
aaacctgtgcccaggttaagtgcgg

SEQ ID NO: 8494 - DNA, 25 bp, Mus musculus
aaacctgtgccctggttaagtgcgg

SEQ ID NO: 8495 - DNA, 25 bp, Mus musculus
aaacctgtgcgactgaccctgcact

SEQ ID NO: 8496 - DNA, 25 bp, Mus musculus
aaacctgtgcgagtgaccctgcact

SEQ ID NO: 8497 - DNA, 25 bp, Mus musculus
aaacctgtgctgatttacaattttt

SEQ ID NO: 8498 - DNA, 25 bp, Mus musculus
aaacctgtgctgttttacaattttt

SEQ ID NO: 8499 - DNA, 25 bp, Mus musculus
aaacctgtggatcagccgacactat

SEQ ID NO: 8500 - DNA, 25 bp, Mus musculus
aaacctgtggatgagccgacactat

SEQ ID NO: 8501 - DNA, 25 bp, Mus musculus
aaacctgtgggaaagagacaagatg

SEQ ID NO: 8502 - DNA, 25 bp, Mus musculus
aaacctgtgggatagagacaagatg

SEQ ID NO: 8503 - DNA, 25 bp, Mus musculus
aaacctgtgggcattggagccaacc

SEQ ID NO: 8504 - DNA, 25 bp, Mus musculus
aaacctgtgggctttggagccaacc

SEQ ID NO: 8505 - DNA, 25 bp, Mus musculus
aaacctgtgtacaccagtatttggc

SEQ ID NO: 8506 - DNA, 25 bp, Mus musculus
aaacctgtgtacaccctatcagggt

SEQ ID NO: 8507 - DNA, 25 bp, Mus musculus
aaacctgtgtactccagtatttggc

SEQ ID NO: 8508 - DNA, 25 bp, Mus musculus
aaacctgtgtactccctatcagggt

SEQ ID NO: 8509 - DNA, 25 bp, Mus musculus
aaacctgtgtcgacgtaaatgccaa

SEQ ID NO: 8510 - DNA, 25 bp, Mus musculus
aaacctgtgtcgtcgtaaatgccaa

SEQ ID NO: 8511 - DNA, 25 bp, Mus musculus
aaacctgtgttaacacttgtcacac

SEQ ID NO: 8512 - DNA, 25 bp, Mus musculus
aaacctgtgttatcacttgtcacac

SEQ ID NO: 8513 - DNA, 25 bp, Mus musculus
aaacctgtgttgctctgtagtgaca

SEQ ID NO: 8514 - DNA, 25 bp, Mus musculus
aaacctgtgttggtctgtagtgaca

SEQ ID NO: 8515 - DNA, 25 bp, Mus musculus
aaacctgttaagctcagttgggctg

SEQ ID NO: 8516 - DNA, 25 bp, Mus musculus
aaacctgttaaggtcagttgggctg

SEQ ID NO: 8517 - DNA, 25 bp, Mus musculus
aaacctgttataaattgcatcacca

SEQ ID NO: 8518 - DNA, 25 bp, Mus musculus
aaacctgttatatattgcatcacca

SEQ ID NO: 8519 - DNA, 25 bp, Mus musculus
aaacctgttattcagctcacttggg

SEQ ID NO: 8520 - DNA, 25 bp, Mus musculus
aaacctgttattgagctcacttggg

SEQ ID NO: 8521 - DNA, 25 bp, Mus musculus
aaacctgttcagaatgatttcatct

SEQ ID NO: 8522 - DNA, 25 bp, Mus musculus
aaacctgttcagtatgatttcatct

SEQ ID NO: 8523 - DNA, 25 bp, Mus musculus
aaacctgttcatctttagcacctta

SEQ ID NO: 8524 - DNA, 25 bp, Mus musculus
aaacctgttcatgtttagcacctta

SEQ ID NO: 8525 - DNA, 25 bp, Mus musculus
aaacctgttcttcggctttcgagtg

SEQ ID NO: 8526 - DNA, 25 bp, Mus musculus
aaacctgttcttctggttcagctgt

SEQ ID NO: 8527 - DNA, 25 bp, Mus musculus
aaacctgttcttgggctttcgagtg

SEQ ID NO: 8528 - DNA, 25 bp, Mus musculus
aaacctgttcttgtggttcagctgt

SEQ ID NO: 8529 - DNA, 25 bp, Mus musculus
aaacctgttgaaatttacacattgg

SEQ ID NO: 8530 - DNA, 25 bp, Mus musculus
aaacctgttgaactcttacgtacat

SEQ ID NO: 8531 - DNA, 25 bp, Mus musculus
aaacctgttgaagtcttacgtacat

SEQ ID NO: 8532 - DNA, 25 bp, Mus musculus
aaacctgttgaattttacacattgg

SEQ ID NO: 8533 - DNA, 25 bp, Mus musculus
aaacctgttgagaccatatctcgag

SEQ ID NO: 8534 - DNA, 25 bp, Mus musculus
aaacctgttgagtccatatctcgag

SEQ ID NO: 8535 - DNA, 25 bp, Mus musculus
aaacctgttgtccagcatttgggaa

SEQ ID NO: 8536 - DNA, 25 bp, Mus musculus
aaacctgttgtcgagcatttgggaa

SEQ ID NO: 8537 - DNA, 25 bp, Mus musculus
aaacctgtttatcattttcaagttg

SEQ ID NO: 8538 - DNA, 25 bp, Mus musculus
aaacctgtttatgattttcaagttg

SEQ ID NO: 8539 - DNA, 25 bp, Mus musculus
aaacctgtttgcagccacaaatgtg

SEQ ID NO: 8540 - DNA, 25 bp, Mus musculus
aaacctgtttgctgccacaaatgtg

SEQ ID NO: 8541 - DNA, 25 bp, Mus musculus
aaacctgttttccatagtgattatg

SEQ ID NO: 8542 - DNA, 25 bp, Mus musculus
aaacctgttttcgatagtgattatg

SEQ ID NO: 8543 - DNA, 25 bp, Mus musculus
aaacctgttttgaacttagagactg

SEQ ID NO: 8544 - DNA, 25 bp, Mus musculus
aaacctgttttgacgtcgtgagtgt

SEQ ID NO: 8545 - DNA, 25 bp, Mus musculus
aaacctgttttgtacttagagactg

SEQ ID NO: 8546 - DNA, 25 bp, Mus musculus
aaacctgttttgtcgtcgtgagtgt

SEQ ID NO: 8547 - DNA, 25 bp, Mus musculus
aaaccttaagatcccttggagtagc

SEQ ID NO: 8548 - DNA, 25 bp, Mus musculus
aaaccttaagatgccttggagtagc

SEQ ID NO: 8549 - DNA, 25 bp, Mus musculus
aaaccttaagtcaaccacaagccat

SEQ ID NO: 8550 - DNA, 25 bp, Mus musculus
aaaccttaagtctaccacaagccat

SEQ ID NO: 8551 - DNA, 25 bp, Mus musculus
aaaccttacaacactgagtgcccac

SEQ ID NO: 8552 - DNA, 25 bp, Mus musculus
aaaccttacaactctgagtgcccac

SEQ ID NO: 8553 - DNA, 25 bp, Mus musculus
aaaccttacaagacatcagaggact

SEQ ID NO: 8554 - DNA, 25 bp, Mus musculus
aaaccttacaagtcatcagaggact

SEQ ID NO: 8555 - DNA, 25 bp, Mus musculus
aaaccttacaggacgttgccagaga

SEQ ID NO: 8556 - DNA, 25 bp, Mus musculus
aaaccttacaggtcgttgccagaga

SEQ ID NO: 8557 - DNA, 25 bp, Mus musculus
aaaccttaccacagaatactggcac

SEQ ID NO: 8558 - DNA, 25 bp, Mus musculus
aaaccttaccactgaatactggcac

SEQ ID NO: 8559 - DNA, 25 bp, Mus musculus
aaaccttagatcatatcaattacaa

SEQ ID NO: 8560 - DNA, 25 bp, Mus musculus
aaaccttagatcttatcaattacaa

SEQ ID NO: 8561 - DNA, 25 bp, Mus musculus
aaaccttagctcacaaagccgtggg

SEQ ID NO: 8562 - DNA, 25 bp, Mus musculus
aaaccttagctctcaaagccgtggg

SEQ ID NO: 8563 - DNA, 25 bp, Mus musculus
aaaccttagtgacgcctacctggtg

SEQ ID NO: 8564 - DNA, 25 bp, Mus musculus
aaaccttagtgaggcctacctggtg

SEQ ID NO: 8565 - DNA, 25 bp, Mus musculus
aaaccttagtgcacgaattagaaat

SEQ ID NO: 8566 - DNA, 25 bp, Mus musculus
aaaccttagtgctcgaattagaaat

SEQ ID NO: 8567 - DNA, 25 bp, Mus musculus
aaaccttatccactggcacacagct

SEQ ID NO: 8568 - DNA, 25 bp, Mus musculus
aaaccttatccagtggcacacagct

SEQ ID NO: 8569 - DNA, 25 bp, Mus musculus
aaaccttatgagaaccctattgcaa

SEQ ID NO: 8570 - DNA, 25 bp, Mus musculus
aaaccttatgagtaccctattgcaa

SEQ ID NO: 8571 - DNA, 25 bp, Mus musculus
aaaccttatgccactgtttgttggt

SEQ ID NO: 8572 - DNA, 25 bp, Mus musculus
aaaccttatgccatttgtagctgtc

SEQ ID NO: 8573 - DNA, 25 bp, Mus musculus
aaaccttatgcctctgtttgttggt

SEQ ID NO: 8574 - DNA, 25 bp, Mus musculus
aaaccttatgccttttgtagctgtc

SEQ ID NO: 8575 - DNA, 25 bp, Mus musculus
aaaccttatttcagtgcatctggca

SEQ ID NO: 8576 - DNA, 25 bp, Mus musculus
aaaccttatttctgtgcatctggca

SEQ ID NO: 8577 - DNA, 25 bp, Mus musculus
aaaccttcaaagctctggcctgtta

SEQ ID NO: 8578 - DNA, 25 bp, Mus musculus
aaaccttcaaaggtctggcctgtta

SEQ ID NO: 8579 - DNA, 25 bp, Mus musculus
aaaccttcacaaaattctcatcctg

SEQ ID NO: 8580 - DNA, 25 bp, Mus musculus
aaaccttcacaatattctcatcctg

SEQ ID NO: 8581 - DNA, 25 bp, Mus musculus
aaaccttcagatattgttgcaagca

SEQ ID NO: 8582 - DNA, 25 bp, Mus musculus
aaaccttcagattttgttgcaagca

SEQ ID NO: 8583 - DNA, 25 bp, Mus musculus
aaaccttcagtaacctcgatcgtgg

SEQ ID NO: 8584 - DNA, 25 bp, Mus musculus
aaaccttcagtatcctcgatcgtgg

SEQ ID NO: 8585 - DNA, 25 bp, Mus musculus
aaaccttcatccagattggacacct

SEQ ID NO: 8586 - DNA, 25 bp, Mus musculus
aaaccttcatcctgattggacacct

SEQ ID NO: 8587 - DNA, 25 bp, Mus musculus
aaaccttcatgaaaatctctgtcca

SEQ ID NO: 8588 - DNA, 25 bp, Mus musculus
aaaccttcatgataatctctgtcca

SEQ ID NO: 8589 - DNA, 25 bp, Mus musculus
aaaccttccaggcaaacagcacaga

SEQ ID NO: 8590 - DNA, 25 bp, Mus musculus
aaaccttccagggaaacagcacaga

SEQ ID NO: 8591 - DNA, 25 bp, Mus musculus
aaaccttccataacatctgctgcta

SEQ ID NO: 8592 - DNA, 25 bp, Mus musculus
aaaccttccatatcatctgctgcta

SEQ ID NO: 8593 - DNA, 25 bp, Mus musculus
aaaccttccattagtgaattgtctg

SEQ ID NO: 8594 - DNA, 25 bp, Mus musculus
aaaccttccattcataggcagccat

SEQ ID NO: 8595 - DNA, 25 bp, Mus musculus
aaaccttccattgataggcagccat

SEQ ID NO: 8596 - DNA, 25 bp, Mus musculus
aaaccttccatttgtgaattgtctg

SEQ ID NO: 8597 - DNA, 25 bp, Mus musculus
aaaccttcccgcacacgtagtgaat

SEQ ID NO: 8598 - DNA, 25 bp, Mus musculus
aaaccttcccgctcacgtagtgaat

SEQ ID NO: 8599 - DNA, 25 bp, Mus musculus
aaaccttccctgattgaggacattg

SEQ ID NO: 8600 - DNA, 25 bp, Mus musculus
aaaccttccctgtttgaggacattg

SEQ ID NO: 8601 - DNA, 25 bp, Mus musculus
aaaccttcctccattcaaagttctg

SEQ ID NO: 8602 - DNA, 25 bp, Mus musculus
aaaccttcctcctttcaaagttctg

SEQ ID NO: 8603 - DNA, 25 bp, Mus musculus
aaaccttcggatcctggatcactga

SEQ ID NO: 8604 - DNA, 25 bp, Mus musculus
aaaccttcggatgctggatcactga

SEQ ID NO: 8605 - DNA, 25 bp, Mus musculus
aaaccttctcctaagattctttgtg

SEQ ID NO: 8606 - DNA, 25 bp, Mus musculus
aaaccttctccttagattctttgtg

SEQ ID NO: 8607 - DNA, 25 bp, Mus musculus
aaaccttctctcagtagaagcagaa

SEQ ID NO: 8608 - DNA, 25 bp, Mus musculus
aaaccttctctctgtagaagcagaa

SEQ ID NO: 8609 - DNA, 25 bp, Mus musculus
aaaccttctgagattgcatcggaga

SEQ ID NO: 8610 - DNA, 25 bp, Mus musculus
aaaccttctgagtttgcatcggaga

SEQ ID NO: 8611 - DNA, 25 bp, Mus musculus
aaaccttgaaccagaagagcgaaga

SEQ ID NO: 8612 - DNA, 25 bp, Mus musculus
aaaccttgaacctgaagagcgaaga

SEQ ID NO: 8613 - DNA, 25 bp, Mus musculus
aaaccttgaactaggtcagtgtgga

SEQ ID NO: 8614 - DNA, 25 bp, Mus musculus
aaaccttgaacttggtcagtgtgga

SEQ ID NO: 8615 - DNA, 25 bp, Mus musculus
aaaccttgagacaggtgaactccca

SEQ ID NO: 8616 - DNA, 25 bp, Mus musculus
aaaccttgagactggtgaactccca

SEQ ID NO: 8617 - DNA, 25 bp, Mus musculus
aaaccttgagtgatcttcagggaga

SEQ ID NO: 8618 - DNA, 25 bp, Mus musculus
aaaccttgagtgttcttcagggaga

SEQ ID NO: 8619 - DNA, 25 bp, Mus musculus
aaaccttgagttctgggttgcctgt

SEQ ID NO: 8620 - DNA, 25 bp, Mus musculus
aaaccttgagttctgtttccactgt

SEQ ID NO: 8621 - DNA, 25 bp, Mus musculus
aaaccttgagttgtgggttgcctgt

SEQ ID NO: 8622 - DNA, 25 bp, Mus musculus
aaaccttgagttgtgtttccactgt

SEQ ID NO: 8623 - DNA, 25 bp, Mus musculus
aaaccttgcaacataatctgactac

SEQ ID NO: 8624 - DNA, 25 bp, Mus musculus
aaaccttgcaacatacatggaaagc

SEQ ID NO: 8625 - DNA, 25 bp, Mus musculus
aaaccttgcaacttaatctgactac

SEQ ID NO: 8626 - DNA, 25 bp, Mus musculus
aaaccttgcaacttacatggaaagc

SEQ ID NO: 8627 - DNA, 25 bp, Mus musculus
aaaccttgcaccacgggccgcagtt

SEQ ID NO: 8628 - DNA, 25 bp, Mus musculus
aaaccttgcacctcgggccgcagtt

SEQ ID NO: 8629 - DNA, 25 bp, Mus musculus
aaaccttgcattctctgcatttcct

SEQ ID NO: 8630 - DNA, 25 bp, Mus musculus
aaaccttgcattgtctgcatttcct

SEQ ID NO: 8631 - DNA, 25 bp, Mus musculus
aaaccttgctatatctgcaactcca

SEQ ID NO: 8632 - DNA, 25 bp, Mus musculus
aaaccttgctatattcgtttgagca

SEQ ID NO: 8633 - DNA, 25 bp, Mus musculus
aaaccttgctatcagtgcagtctgg

SEQ ID NO: 8634 - DNA, 25 bp, Mus musculus
aaaccttgctatgagtgcagtctgg

SEQ ID NO: 8635 - DNA, 25 bp, Mus musculus
aaaccttgctatttctgcaactcca

SEQ ID NO: 8636 - DNA, 25 bp, Mus musculus
aaaccttgctattttcgtttgagca

SEQ ID NO: 8637 - DNA, 25 bp, Mus musculus
aaaccttgcttcctatgaattgtac

SEQ ID NO: 8638 - DNA, 25 bp, Mus musculus
aaaccttgcttcgtatgaattgtac

SEQ ID NO: 8639 - DNA, 25 bp, Mus musculus
aaaccttgctttctctgctgtgttg

SEQ ID NO: 8640 - DNA, 25 bp, Mus musculus
aaaccttgctttgtctgctgtgttg

SEQ ID NO: 8641 - DNA, 25 bp, Mus musculus
aaaccttggcacagaacgtgagcat

SEQ ID NO: 8642 - DNA, 25 bp, Mus musculus
aaaccttggcactgaacgtgagcat

SEQ ID NO: 8643 - DNA, 25 bp, Mus musculus
aaaccttggctcaggtgtactgagg

SEQ ID NO: 8644 - DNA, 25 bp, Mus musculus
aaaccttggctctggtgtactgagg

SEQ ID NO: 8645 - DNA, 25 bp, Mus musculus
aaaccttgggttagagcactcagaa

SEQ ID NO: 8646 - DNA, 25 bp, Mus musculus
aaaccttgggtttgagcactcagaa

SEQ ID NO: 8647 - DNA, 25 bp, Mus musculus
aaaccttggtcgagatgacagagtt

SEQ ID NO: 8648 - DNA, 25 bp, Mus musculus
aaaccttggtcgtgatgacagagtt

SEQ ID NO: 8649 - DNA, 25 bp, Mus musculus
aaaccttggttcagatagacttcgt

SEQ ID NO: 8650 - DNA, 25 bp, Mus musculus
aaaccttggttctgatagacttcgt

SEQ ID NO: 8651 - DNA, 25 bp, Mus musculus
aaaccttgtgacagtctcttggtac

SEQ ID NO: 8652 - DNA, 25 bp, Mus musculus
aaaccttgtgactgtctcttggtac

SEQ ID NO: 8653 - DNA, 25 bp, Mus musculus
aaaccttgttagagctgattttatt

SEQ ID NO: 8654 - DNA, 25 bp, Mus musculus
aaaccttgttagtgctgattttatt

SEQ ID NO: 8655 - DNA, 25 bp, Mus musculus
aaacctttagccagcataagacaac

SEQ ID NO: 8656 - DNA, 25 bp, Mus musculus
aaacctttagccatgaactgtcaga

SEQ ID NO: 8657 - DNA, 25 bp, Mus musculus
aaacctttagcctgcataagacaac

SEQ ID NO: 8658 - DNA, 25 bp, Mus musculus
aaacctttagccttgaactgtcaga

SEQ ID NO: 8659 - DNA, 25 bp, Mus musculus
aaacctttcatccatacctgtgcat

SEQ ID NO: 8660 - DNA, 25 bp, Mus musculus
aaacctttcatcgatacctgtgcat

SEQ ID NO: 8661 - DNA, 25 bp, Mus musculus
aaacctttccaacaaagaccatgtg

SEQ ID NO: 8662 - DNA, 25 bp, Mus musculus
aaacctttccaagaaagaccatgtg

SEQ ID NO: 8663 - DNA, 25 bp, Mus musculus
aaacctttcgagcagggtcctgtgt

SEQ ID NO: 8664 - DNA, 25 bp, Mus musculus
aaacctttcgaggagggtcctgtgt

SEQ ID NO: 8665 - DNA, 25 bp, Mus musculus
aaacctttctcgcacctgtactgag

SEQ ID NO: 8666 - DNA, 25 bp, Mus musculus
aaacctttctcggacctgtactgag

SEQ ID NO: 8667 - DNA, 25 bp, Mus musculus
aaacctttgaggattccccagtgat

SEQ ID NO: 8668 - DNA, 25 bp, Mus musculus
aaacctttgaggtttccccagtgat

SEQ ID NO: 8669 - DNA, 25 bp, Mus musculus
aaacctttgctgaaccatgagccaa

SEQ ID NO: 8670 - DNA, 25 bp, Mus musculus
aaacctttgctgtaccatgagccaa

SEQ ID NO: 8671 - DNA, 25 bp, Mus musculus
aaacctttggctaagtggctgcttc

SEQ ID NO: 8672 - DNA, 25 bp, Mus musculus
aaacctttggcttagtggctgcttc

SEQ ID NO: 8673 - DNA, 25 bp, Mus musculus
aaacctttggtcagactctccataa

SEQ ID NO: 8674 - DNA, 25 bp, Mus musculus
aaacctttggtctgactctccataa

SEQ ID NO: 8675 - DNA, 25 bp, Mus musculus
aaacctttgtccacagattggctag

SEQ ID NO: 8676 - DNA, 25 bp, Mus musculus
aaacctttgtcctcagattggctag

SEQ ID NO: 8677 - DNA, 25 bp, Mus musculus
aaaccttttccacttgacatgctag

SEQ ID NO: 8678 - DNA, 25 bp, Mus musculus
aaaccttttccagttgacatgctag

SEQ ID NO: 8679 - DNA, 25 bp, Mus musculus
aaacgaaggagcacaagtcaggtct

SEQ ID NO: 8680 - DNA, 25 bp, Mus musculus
aaacgaaggagctcaagtcaggtct

SEQ ID NO: 8681 - DNA, 25 bp, Mus musculus
aaacgaagggagctcctgctcactc

SEQ ID NO: 8682 - DNA, 25 bp, Mus musculus
aaacgaagggaggtcctgctcactc

SEQ ID NO: 8683 - DNA, 25 bp, Mus musculus
aaacgaagtactaggcaggaccaga

SEQ ID NO: 8684 - DNA, 25 bp, Mus musculus
aaacgaagtacttggcaggaccaga

SEQ ID NO: 8685 - DNA, 25 bp, Mus musculus
aaacgaataggcacggagacacgaa

SEQ ID NO: 8686 - DNA, 25 bp, Mus musculus
aaacgaataggctcggagacacgaa

SEQ ID NO: 8687 - DNA, 25 bp, Mus musculus
aaacgaatcagtctggtgccggacc

SEQ ID NO: 8688 - DNA, 25 bp, Mus musculus
aaacgaatcagtgtggtgccggacc

SEQ ID NO: 8689 - DNA, 25 bp, Mus musculus
aaacgaatccacactttctaacgtg

SEQ ID NO: 8690 - DNA, 25 bp, Mus musculus
aaacgaatccactctttctaacgtg

SEQ ID NO: 8691 - DNA, 25 bp, Mus musculus
aaacgaatgatacactcttcaccaa

SEQ ID NO: 8692 - DNA, 25 bp, Mus musculus
aaacgaatgatagactcttcaccaa

SEQ ID NO: 8693 - DNA, 25 bp, Mus musculus
aaacgacaacccaggcgtgaggaga

SEQ ID NO: 8694 - DNA, 25 bp, Mus musculus
aaacgacaaccctggcgtgaggaga

SEQ ID NO: 8695 - DNA, 25 bp, Mus musculus
aaacgacacaccacatagccaaaga

SEQ ID NO: 8696 - DNA, 25 bp, Mus musculus
aaacgacacacctcatagccaaaga

SEQ ID NO: 8697 - DNA, 25 bp, Mus musculus
aaacgacacgggagctggccaagac

SEQ ID NO: 8698 - DNA, 25 bp, Mus musculus
aaacgacacgggtgctggccaagac

SEQ ID NO: 8699 - DNA, 25 bp, Mus musculus
aaacgacagctgagggaccgtacgc

SEQ ID NO: 8700 - DNA, 25 bp, Mus musculus
aaacgacagctgtgggaccgtacgc

SEQ ID NO: 8701 - DNA, 25 bp, Mus musculus
aaacgacaggttatctatgttcatt

SEQ ID NO: 8702 - DNA, 25 bp, Mus musculus
aaacgacaggttttctatgttcatt

SEQ ID NO: 8703 - DNA, 25 bp, Mus musculus
aaacgaccaaatctgtataagaaga

SEQ ID NO: 8704 - DNA, 25 bp, Mus musculus
aaacgaccaaatgtgtataagaaga

SEQ ID NO: 8705 - DNA, 25 bp, Mus musculus
aaacgaccatttctctaagccaagt

SEQ ID NO: 8706 - DNA, 25 bp, Mus musculus
aaacgaccatttgtctaagccaagt

SEQ ID NO: 8707 - DNA, 25 bp, Mus musculus
aaacgacccttaatactcccagatg

SEQ ID NO: 8708 - DNA, 25 bp, Mus musculus
aaacgacccttattactcccagatg

SEQ ID NO: 8709 - DNA, 25 bp, Mus musculus
aaacgaccgactcgagaactcacca

SEQ ID NO: 8710 - DNA, 25 bp, Mus musculus
aaacgaccgactggagaactcacca

SEQ ID NO: 8711 - DNA, 25 bp, Mus musculus
aaacgacggcagaagtcagtctgat

SEQ ID NO: 8712 - DNA, 25 bp, Mus musculus
aaacgacggcagtagtcagtctgat

SEQ ID NO: 8713 - DNA, 25 bp, Mus musculus
aaacgacgtcgtagccagtaggaag

SEQ ID NO: 8714 - DNA, 25 bp, Mus musculus
aaacgacgtcgttgccagtaggaag

SEQ ID NO: 8715 - DNA, 25 bp, Mus musculus
aaacgactcccactatgtctgttgg

SEQ ID NO: 8716 - DNA, 25 bp, Mus musculus
aaacgactcccagtatgtctgttgg

SEQ ID NO: 8717 - DNA, 25 bp, Mus musculus
aaacgactcctgacttcttgtctat

SEQ ID NO: 8718 - DNA, 25 bp, Mus musculus
aaacgactcctgtcttcttgtctat

SEQ ID NO: 8719 - DNA, 25 bp, Mus musculus
aaacgactcttcataagcacgcctt

SEQ ID NO: 8720 - DNA, 25 bp, Mus musculus
aaacgactcttcttaagcacgcctt

SEQ ID NO: 8721 - DNA, 25 bp, Mus musculus
aaacgactgacacttgtggccgcag

SEQ ID NO: 8722 - DNA, 25 bp, Mus musculus
aaacgactgacagttgtggccgcag

SEQ ID NO: 8723 - DNA, 25 bp, Mus musculus
aaacgactggcgaccatcagagtgc

SEQ ID NO: 8724 - DNA, 25 bp, Mus musculus
aaacgactggcgtccatcagagtgc

SEQ ID NO: 8725 - DNA, 25 bp, Mus musculus
aaacgactgtaaatggctgctgtgt

SEQ ID NO: 8726 - DNA, 25 bp, Mus musculus
aaacgactgtaattggctgctgtgt

SEQ ID NO: 8727 - DNA, 25 bp, Mus musculus
aaacgactgtatcaggtcaccctga

SEQ ID NO: 8728 - DNA, 25 bp, Mus musculus
aaacgactgtatgaggtcaccctga

SEQ ID NO: 8729 - DNA, 25 bp, Mus musculus
aaacgacttcacacataggcagtag

SEQ ID NO: 8730 - DNA, 25 bp, Mus musculus
aaacgacttcactcataggcagtag

SEQ ID NO: 8731 - DNA, 25 bp, Mus musculus
aaacgacttctgcatcagactctgt

SEQ ID NO: 8732 - DNA, 25 bp, Mus musculus
aaacgacttctggatcagactctgt

SEQ ID NO: 8733 - DNA, 25 bp, Mus musculus
aaacgactttcacgttgtgctgacc

SEQ ID NO: 8734 - DNA, 25 bp, Mus musculus
aaacgactttcaggttgtgctgacc

SEQ ID NO: 8735 - DNA, 25 bp, Mus musculus
aaacgagaaaaactattgcctattg

SEQ ID NO: 8736 - DNA, 25 bp, Mus musculus
aaacgagaaaaagtattgcctattg

SEQ ID NO: 8737 - DNA, 25 bp, Mus musculus
aaacgagacggaactcagatccaga

SEQ ID NO: 8738 - DNA, 25 bp, Mus musculus
aaacgagacggatctcagatccaga

SEQ ID NO: 8739 - DNA, 25 bp, Mus musculus
aaacgagaggataaaaccaccacag

SEQ ID NO: 8740 - DNA, 25 bp, Mus musculus
aaacgagaggattaaaccaccacag

SEQ ID NO: 8741 - DNA, 25 bp, Mus musculus
aaacgagagtcacctgctgaagtta

SEQ ID NO: 8742 - DNA, 25 bp, Mus musculus
aaacgagagtcagctgctgaagtta

SEQ ID NO: 8743 - DNA, 25 bp, Mus musculus
aaacgagatcctcaccacatgaaca

SEQ ID NO: 8744 - DNA, 25 bp, Mus musculus
aaacgagatcctgaccacatgaaca

SEQ ID NO: 8745 - DNA, 25 bp, Mus musculus
aaacgagcagaacaacaagaagaga

SEQ ID NO: 8746 - DNA, 25 bp, Mus musculus
aaacgagcagaagaacaagaagaga

SEQ ID NO: 8747 - DNA, 25 bp, Mus musculus
aaacgagccctgctcagaaagtcaa

SEQ ID NO: 8748 - DNA, 25 bp, Mus musculus
aaacgagccctggtcagaaagtcaa

SEQ ID NO: 8749 - DNA, 25 bp, Mus musculus
aaacgagcggcacagatggagcttc

SEQ ID NO: 8750 - DNA, 25 bp, Mus musculus
aaacgagcggcagagatggagcttc

SEQ ID NO: 8751 - DNA, 25 bp, Mus musculus
aaacgagctcaaatggaccacttgg

SEQ ID NO: 8752 - DNA, 25 bp, Mus musculus
aaacgagctcaattggaccacttgg

SEQ ID NO: 8753 - DNA, 25 bp, Mus musculus
aaacgagctcatctacaagcgaggc

SEQ ID NO: 8754 - DNA, 25 bp, Mus musculus
aaacgagctcatgtacaagcgaggc

SEQ ID NO: 8755 - DNA, 25 bp, Mus musculus
aaacgagctccactcaagtcaggcg

SEQ ID NO: 8756 - DNA, 25 bp, Mus musculus
aaacgagctccagtcaagtcaggcg

SEQ ID NO: 8757 - DNA, 25 bp, Mus musculus
aaacgagctcctcaactccagggaa

SEQ ID NO: 8758 - DNA, 25 bp, Mus musculus
aaacgagctcctgaactccagggaa

SEQ ID NO: 8759 - DNA, 25 bp, Mus musculus
aaacgagcttgcaatcgggaaggag

SEQ ID NO: 8760 - DNA, 25 bp, Mus musculus
aaacgagcttgcactgagcggtggt

SEQ ID NO: 8761 - DNA, 25 bp, Mus musculus
aaacgagcttgctatcgggaaggag

SEQ ID NO: 8762 - DNA, 25 bp, Mus musculus
aaacgagcttgctctgagcggtggt

SEQ ID NO: 8763 - DNA, 25 bp, Mus musculus
aaacgaggactaataagatgggcaa

SEQ ID NO: 8764 - DNA, 25 bp, Mus musculus
aaacgaggactattaagatgggcaa

SEQ ID NO: 8765 - DNA, 25 bp, Mus musculus
aaacgaggccatacagcgagcagca

SEQ ID NO: 8766 - DNA, 25 bp, Mus musculus
aaacgaggccattcagcgagcagca

SEQ ID NO: 8767 - DNA, 25 bp, Mus musculus
aaacgaggccctcacacactaatta

SEQ ID NO: 8768 - DNA, 25 bp, Mus musculus
aaacgaggccctgacacactaatta

SEQ ID NO: 8769 - DNA, 25 bp, Mus musculus
aaacgagtgctcagtcattattaaa

SEQ ID NO: 8770 - DNA, 25 bp, Mus musculus
aaacgagtgctctgtcattattaaa

SEQ ID NO: 8771 - DNA, 25 bp, Mus musculus
aaacgataccgtaaaatgtcaccag

SEQ ID NO: 8772 - DNA, 25 bp, Mus musculus
aaacgataccgttaaatgtcaccag

SEQ ID NO: 8773 - DNA, 25 bp, Mus musculus
aaacgatccgagctgagagaaccaa

SEQ ID NO: 8774 - DNA, 25 bp, Mus musculus
aaacgatccgaggtgagagaaccaa

SEQ ID NO: 8775 - DNA, 25 bp, Mus musculus
aaacgatcttttactgtacaagtat

SEQ ID NO: 8776 - DNA, 25 bp, Mus musculus
aaacgatctttttctgtacaagtat

SEQ ID NO: 8777 - DNA, 25 bp, Mus musculus
aaacgatgagagaccactcccaaca

SEQ ID NO: 8778 - DNA, 25 bp, Mus musculus
aaacgatgagagtccactcccaaca

SEQ ID NO: 8779 - DNA, 25 bp, Mus musculus
aaacgatgccggatccctttgatga

SEQ ID NO: 8780 - DNA, 25 bp, Mus musculus
aaacgatgccggttccctttgatga

SEQ ID NO: 8781 - DNA, 25 bp, Mus musculus
aaacgatggcgcaggctgtctttaa

SEQ ID NO: 8782 - DNA, 25 bp, Mus musculus
aaacgatggcgctggctgtctttaa

SEQ ID NO: 8783 - DNA, 25 bp, Mus musculus
aaacgatgggtgcacggtccacagc

SEQ ID NO: 8784 - DNA, 25 bp, Mus musculus
aaacgatgggtggacggtccacagc

SEQ ID NO: 8785 - DNA, 25 bp, Mus musculus
aaacgatggttaccttggtggcaac

SEQ ID NO: 8786 - DNA, 25 bp, Mus musculus
aaacgatggttagcttggtggcaac

SEQ ID NO: 8787 - DNA, 25 bp, Mus musculus
aaacgatgtcacctggcaagctttg

SEQ ID NO: 8788 - DNA, 25 bp, Mus musculus
aaacgatgtcacgtggcaagctttg

SEQ ID NO: 8789 - DNA, 25 bp, Mus musculus
aaacgatgtctcacttactctgtat

SEQ ID NO: 8790 - DNA, 25 bp, Mus musculus
aaacgatgtctctcttactctgtat

SEQ ID NO: 8791 - DNA, 25 bp, Mus musculus
aaacgattattcacacccacagtag

SEQ ID NO: 8792 - DNA, 25 bp, Mus musculus
aaacgattattctcacccacagtag

SEQ ID NO: 8793 - DNA, 25 bp, Mus musculus
aaacgattctctcctgagtgtcctt

SEQ ID NO: 8794 - DNA, 25 bp, Mus musculus
aaacgattctctgctgagtgtcctt

SEQ ID NO: 8795 - DNA, 25 bp, Mus musculus
aaacgattttccagtgattccctag

SEQ ID NO: 8796 - DNA, 25 bp, Mus musculus
aaacgattttcctgtgattccctag

SEQ ID NO: 8797 - DNA, 25 bp, Mus musculus
aaacgcaaagccaaacaccagtctg

SEQ ID NO: 8798 - DNA, 25 bp, Mus musculus
aaacgcaaagcctaacaccagtctg

SEQ ID NO: 8799 - DNA, 25 bp, Mus musculus
aaacgcaagttcaggtattcatttt

SEQ ID NO: 8800 - DNA, 25 bp, Mus musculus
aaacgcaagttctggtattcatttt

SEQ ID NO: 8801 - DNA, 25 bp, Mus musculus
aaacgcacaggacaccagagctgct

SEQ ID NO: 8802 - DNA, 25 bp, Mus musculus
aaacgcacaggagaccagagctgct

SEQ ID NO: 8803 - DNA, 25 bp, Mus musculus
aaacgcacagtcagttctgcagcaa

SEQ ID NO: 8804 - DNA, 25 bp, Mus musculus
aaacgcacagtctgttctgcagcaa

SEQ ID NO: 8805 - DNA, 25 bp, Mus musculus
aaacgcaccgttaattatatactgt

SEQ ID NO: 8806 - DNA, 25 bp, Mus musculus
aaacgcaccgtttattatatactgt

SEQ ID NO: 8807 - DNA, 25 bp, Mus musculus
aaacgcactgtgctcacgtggcgct

SEQ ID NO: 8808 - DNA, 25 bp, Mus musculus
aaacgcactgtggtcacgtggcgct

SEQ ID NO: 8809 - DNA, 25 bp, Mus musculus
aaacgcagacctccccagggtcaga

SEQ ID NO: 8810 - DNA, 25 bp, Mus musculus
aaacgcagacctgcccagggtcaga

SEQ ID NO: 8811 - DNA, 25 bp, Mus musculus
aaacgcaggaagactcaagactctt

SEQ ID NO: 8812 - DNA, 25 bp, Mus musculus
aaacgcaggaagtctcaagactctt

SEQ ID NO: 8813 - DNA, 25 bp, Mus musculus
aaacgcaggcacctatgacgccaag

SEQ ID NO: 8814 - DNA, 25 bp, Mus musculus
aaacgcaggcacgtatgacgccaag

SEQ ID NO: 8815 - DNA, 25 bp, Mus musculus
aaacgcaggttcacattcttgcatg

SEQ ID NO: 8816 - DNA, 25 bp, Mus musculus
aaacgcaggttctcattcttgcatg

SEQ ID NO: 8817 - DNA, 25 bp, Mus musculus
aaacgcagtcagatgtccataccta

SEQ ID NO: 8818 - DNA, 25 bp, Mus musculus
aaacgcagtcagttgtccataccta

SEQ ID NO: 8819 - DNA, 25 bp, Mus musculus
aaacgcagtctgattttggcaaagt

SEQ ID NO: 8820 - DNA, 25 bp, Mus musculus
aaacgcagtctgtttttggcaaagt

SEQ ID NO: 8821 - DNA, 25 bp, Mus musculus
aaacgcagttgccagtctcatcact

SEQ ID NO: 8822 - DNA, 25 bp, Mus musculus
aaacgcagttgcgagtctcatcact

SEQ ID NO: 8823 - DNA, 25 bp, Mus musculus
aaacgcatcgtgagagcgcatgggc

SEQ ID NO: 8824 - DNA, 25 bp, Mus musculus
aaacgcatcgtgtgagcgcatgggc

SEQ ID NO: 8825 - DNA, 25 bp, Mus musculus
aaacgcatctcacgagctcagcatg

SEQ ID NO: 8826 - DNA, 25 bp, Mus musculus
aaacgcatctcaggagctcagcatg

SEQ ID NO: 8827 - DNA, 25 bp, Mus musculus
aaacgccaagctcaatcagtacagt

SEQ ID NO: 8828 - DNA, 25 bp, Mus musculus
aaacgccaagctgaatcagtacagt

SEQ ID NO: 8829 - DNA, 25 bp, Mus musculus
aaacgccagagcagggactatgacg

SEQ ID NO: 8830 - DNA, 25 bp, Mus musculus
aaacgccagagctgggactatgacg

SEQ ID NO: 8831 - DNA, 25 bp, Mus musculus
aaacgccaggtgatcaagtcccatg

SEQ ID NO: 8832 - DNA, 25 bp, Mus musculus
aaacgccaggtgttcaagtcccatg

SEQ ID NO: 8833 - DNA, 25 bp, Mus musculus
aaacgccatcatagcttcagaagct

SEQ ID NO: 8834 - DNA, 25 bp, Mus musculus
aaacgccatcattgcttcagaagct

SEQ ID NO: 8835 - DNA, 25 bp, Mus musculus
aaacgccatccgcattgtggatctg

SEQ ID NO: 8836 - DNA, 25 bp, Mus musculus
aaacgccatccggattgtggatctg

SEQ ID NO: 8837 - DNA, 25 bp, Mus musculus
aaacgcccaatgctgtccttatctg

SEQ ID NO: 8838 - DNA, 25 bp, Mus musculus
aaacgcccaatggtgtccttatctg

SEQ ID NO: 8839 - DNA, 25 bp, Mus musculus
aaacgcccgacaagttgaactgcct

SEQ ID NO: 8840 - DNA, 25 bp, Mus musculus
aaacgcccgacatgttgaactgcct

SEQ ID NO: 8841 - DNA, 25 bp, Mus musculus
aaacgcccgacgaatttgctctgaa

SEQ ID NO: 8842 - DNA, 25 bp, Mus musculus
aaacgcccgacgtatttgctctgaa

SEQ ID NO: 8843 - DNA, 25 bp, Mus musculus
aaacgccgatatccaggatctgccc

SEQ ID NO: 8844 - DNA, 25 bp, Mus musculus
aaacgccgatatgcaggatctgccc

SEQ ID NO: 8845 - DNA, 25 bp, Mus musculus
aaacgccgatgtagcttcatttacc

SEQ ID NO: 8846 - DNA, 25 bp, Mus musculus
aaacgccgatgttgcttcatttacc

SEQ ID NO: 8847 - DNA, 25 bp, Mus musculus
aaacgccgtgaaatgtacctacaag

SEQ ID NO: 8848 - DNA, 25 bp, Mus musculus
aaacgccgtgaattgtacctacaag

SEQ ID NO: 8849 - DNA, 25 bp, Mus musculus
aaacgcctcagtcttcagacagtga

SEQ ID NO: 8850 - DNA, 25 bp, Mus musculus
aaacgcctcagtgttcagacagtga

SEQ ID NO: 8851 - DNA, 25 bp, Mus musculus
aaacgcctctctcgctgggtggtgc

SEQ ID NO: 8852 - DNA, 25 bp, Mus musculus
aaacgcctctctggctgggtggtgc

SEQ ID NO: 8853 - DNA, 25 bp, Mus musculus
aaacgcctgaagcaatcctaagatg

SEQ ID NO: 8854 - DNA, 25 bp, Mus musculus
aaacgcctgaaggaatcctaagatg

SEQ ID NO: 8855 - DNA, 25 bp, Mus musculus
aaacgccttcagcaagccttagagc

SEQ ID NO: 8856 - DNA, 25 bp, Mus musculus
aaacgccttcaggaagccttagagc

SEQ ID NO: 8857 - DNA, 25 bp, Mus musculus
aaacgcgatgaacaggttcaacagt

SEQ ID NO: 8858 - DNA, 25 bp, Mus musculus
aaacgcgatgaagaggttcaacagt

SEQ ID NO: 8859 - DNA, 25 bp, Mus musculus
aaacgcgggtttctcactaaggatg

SEQ ID NO: 8860 - DNA, 25 bp, Mus musculus
aaacgcgggtttgtcactaaggatg

SEQ ID NO: 8861 - DNA, 25 bp, Mus musculus
aaacgcgtatttcagagattctgtc

SEQ ID NO: 8862 - DNA, 25 bp, Mus musculus
aaacgcgtatttgagagattctgtc

SEQ ID NO: 8863 - DNA, 25 bp, Mus musculus
aaacgctactcgcaaagagcttcag

SEQ ID NO: 8864 - DNA, 25 bp, Mus musculus
aaacgctactcggaaagagcttcag

SEQ ID NO: 8865 - DNA, 25 bp, Mus musculus
aaacgctacttacatggtgtggtgt

SEQ ID NO: 8866 - DNA, 25 bp, Mus musculus
aaacgctacttagatggtgtggtgt

SEQ ID NO: 8867 - DNA, 25 bp, Mus musculus
aaacgctactttcaatgccaggcca

SEQ ID NO: 8868 - DNA, 25 bp, Mus musculus
aaacgctactttgaatgccaggcca

SEQ ID NO: 8869 - DNA, 25 bp, Mus musculus
aaacgctagtcaatctgtattggtg

SEQ ID NO: 8870 - DNA, 25 bp, Mus musculus
aaacgctagtcattctgtattggtg

SEQ ID NO: 8871 - DNA, 25 bp, Mus musculus
aaacgctagtccatagtctcagtta

SEQ ID NO: 8872 - DNA, 25 bp, Mus musculus
aaacgctagtccttagtctcagtta

SEQ ID NO: 8873 - DNA, 25 bp, Mus musculus
aaacgctatggccatcagtgagatg

SEQ ID NO: 8874 - DNA, 25 bp, Mus musculus
aaacgctatggcgatcagtgagatg

SEQ ID NO: 8875 - DNA, 25 bp, Mus musculus
aaacgctcctaacaccgatgctaga

SEQ ID NO: 8876 - DNA, 25 bp, Mus musculus
aaacgctcctaagaccgatgctaga

SEQ ID NO: 8877 - DNA, 25 bp, Mus musculus
aaacgctcctatatacatgcattcc

SEQ ID NO: 8878 - DNA, 25 bp, Mus musculus
aaacgctcctatttacatgcattcc

SEQ ID NO: 8879 - DNA, 25 bp, Mus musculus
aaacgctctgaacgagtacaactcc

SEQ ID NO: 8880 - DNA, 25 bp, Mus musculus
aaacgctctgaaggagtacaactcc

SEQ ID NO: 8881 - DNA, 25 bp, Mus musculus
aaacgctctgagctcttccttcagg

SEQ ID NO: 8882 - DNA, 25 bp, Mus musculus
aaacgctctgaggtcttccttcagg

SEQ ID NO: 8883 - DNA, 25 bp, Mus musculus
aaacgctgacggatgaggtgaccaa

SEQ ID NO: 8884 - DNA, 25 bp, Mus musculus
aaacgctgacggttgaggtgaccaa

SEQ ID NO: 8885 - DNA, 25 bp, Mus musculus
aaacgctgacgtctgtagctagcta

SEQ ID NO: 8886 - DNA, 25 bp, Mus musculus
aaacgctgacgtgtgtagctagcta

SEQ ID NO: 8887 - DNA, 25 bp, Mus musculus
aaacgctgatgcaacccaactgatg

SEQ ID NO: 8888 - DNA, 25 bp, Mus musculus
aaacgctgatgctacccaactgatg

SEQ ID NO: 8889 - DNA, 25 bp, Mus musculus
aaacgctgcaaacccctagaccagg

SEQ ID NO: 8890 - DNA, 25 bp, Mus musculus
aaacgctgcaaagccctagaccagg

SEQ ID NO: 8891 - DNA, 25 bp, Mus musculus
aaacgctgcattcgcacagcagcgg

SEQ ID NO: 8892 - DNA, 25 bp, Mus musculus
aaacgctgcattggcacagcagcgg

SEQ ID NO: 8893 - DNA, 25 bp, Mus musculus
aaacgctgcggcatgtgtgcgccct

SEQ ID NO: 8894 - DNA, 25 bp, Mus musculus
aaacgctgcggcttgtgtgcgccct

SEQ ID NO: 8895 - DNA, 25 bp, Mus musculus
aaacgctggctaaagcggtgttggc

SEQ ID NO: 8896 - DNA, 25 bp, Mus musculus
aaacgctggctatagcggtgttggc

SEQ ID NO: 8897 - DNA, 25 bp, Mus musculus
aaacgctgggacagacctcctgtgg

SEQ ID NO: 8898 - DNA, 25 bp, Mus musculus
aaacgctgggactgacctcctgtgg

SEQ ID NO: 8899 - DNA, 25 bp, Mus musculus
aaacgctgggatctcagccatacac

SEQ ID NO: 8900 - DNA, 25 bp, Mus musculus
aaacgctgggatgtcagccatacac

SEQ ID NO: 8901 - DNA, 25 bp, Mus musculus
aaacgctgtgtacttcggagaatac

SEQ ID NO: 8902 - DNA, 25 bp, Mus musculus
aaacgctgtgtagttcggagaatac

SEQ ID NO: 8903 - DNA, 25 bp, Mus musculus
aaacgcttcacgatcgtgctggcgg

SEQ ID NO: 8904 - DNA, 25 bp, Mus musculus
aaacgcttcacgttcgtgctggcgg

SEQ ID NO: 8905 - DNA, 25 bp, Mus musculus
aaacgcttcaggaagtgacgcccac

SEQ ID NO: 8906 - DNA, 25 bp, Mus musculus
aaacgcttcaggtagtgacgcccac

SEQ ID NO: 8907 - DNA, 25 bp, Mus musculus
aaacgcttctgtcggacgtgaaatc

SEQ ID NO: 8908 - DNA, 25 bp, Mus musculus
aaacgcttctgtgggacgtgaaatc

SEQ ID NO: 8909 - DNA, 25 bp, Mus musculus
aaacgcttgactcttcactggaggt

SEQ ID NO: 8910 - DNA, 25 bp, Mus musculus
aaacgcttgactgttcactggaggt

SEQ ID NO: 8911 - DNA, 25 bp, Mus musculus
aaacgctttttgaagtctttcagtg

SEQ ID NO: 8912 - DNA, 25 bp, Mus musculus
aaacgctttttgtagtctttcagtg

SEQ ID NO: 8913 - DNA, 25 bp, Mus musculus
aaacggaaacgtaccagagatgctt

SEQ ID NO: 8914 - DNA, 25 bp, Mus musculus
aaacggaaacgttccagagatgctt

SEQ ID NO: 8915 - DNA, 25 bp, Mus musculus
aaacggaaattgcacagagactctc

SEQ ID NO: 8916 - DNA, 25 bp, Mus musculus
aaacggaaattggacagagactctc

SEQ ID NO: 8917 - DNA, 25 bp, Mus musculus
aaacggaacgaacccgtggccacat

SEQ ID NO: 8918 - DNA, 25 bp, Mus musculus
aaacggaacgaagccgtggccacat

SEQ ID NO: 8919 - DNA, 25 bp, Mus musculus
aaacggaagctgacgtccgctgtgt

SEQ ID NO: 8920 - DNA, 25 bp, Mus musculus
aaacggaagctgtcgtccgctgtgt

SEQ ID NO: 8921 - DNA, 25 bp, Mus musculus
aaacggacatctatctagctagcaa

SEQ ID NO: 8922 - DNA, 25 bp, Mus musculus
aaacggacatctttctagctagcaa

SEQ ID NO: 8923 - DNA, 25 bp, Mus musculus
aaacggactcaccagtctctcgatg

SEQ ID NO: 8924 - DNA, 25 bp, Mus musculus
aaacggactcacgagtctctcgatg

SEQ ID NO: 8925 - DNA, 25 bp, Mus musculus
aaacggagaaatccggcactggccg

SEQ ID NO: 8926 - DNA, 25 bp, Mus musculus
aaacggagaaatgcggcactggccg

SEQ ID NO: 8927 - DNA, 25 bp, Mus musculus
aaacggaggcaccagtgacttccat

SEQ ID NO: 8928 - DNA, 25 bp, Mus musculus
aaacggaggcacgagtgacttccat

SEQ ID NO: 8929 - DNA, 25 bp, Mus musculus
aaacggatatacactgaacactggg

SEQ ID NO: 8930 - DNA, 25 bp, Mus musculus
aaacggatatactctgaacactggg

SEQ ID NO: 8931 - DNA, 25 bp, Mus musculus
aaacggatcaagattccccaggaga

SEQ ID NO: 8932 - DNA, 25 bp, Mus musculus
aaacggatcaagtttccccaggaga

SEQ ID NO: 8933 - DNA, 25 bp, Mus musculus
aaacggatcgccatggcactgcaga

SEQ ID NO: 8934 - DNA, 25 bp, Mus musculus
aaacggatcgccttggcactgcaga

SEQ ID NO: 8935 - DNA, 25 bp, Mus musculus
aaacggattaggaccaggctcagtg

SEQ ID NO: 8936 - DNA, 25 bp, Mus musculus
aaacggattaggtccaggctcagtg

SEQ ID NO: 8937 - DNA, 25 bp, Mus musculus
aaacggatttctacttactcgctct

SEQ ID NO: 8938 - DNA, 25 bp, Mus musculus
aaacggatttcttcttactcgctct

SEQ ID NO: 8939 - DNA, 25 bp, Mus musculus
aaacggcaaagcacccgcagcttca

SEQ ID NO: 8940 - DNA, 25 bp, Mus musculus
aaacggcaaagctcccgcagcttca

SEQ ID NO: 8941 - DNA, 25 bp, Mus musculus
aaacggcaacttcgacctgaggaga

SEQ ID NO: 8942 - DNA, 25 bp, Mus musculus
aaacggcaacttggacctgaggaga

SEQ ID NO: 8943 - DNA, 25 bp, Mus musculus
aaacggcacctgcgcgacaggctgg

SEQ ID NO: 8944 - DNA, 25 bp, Mus musculus
aaacggcacctgggcgacaggctgg

SEQ ID NO: 8945 - DNA, 25 bp, Mus musculus
aaacggcagagcagccgcatggcgc

SEQ ID NO: 8946 - DNA, 25 bp, Mus musculus
aaacggcagagctgccgcatggcgc

SEQ ID NO: 8947 - DNA, 25 bp, Mus musculus
aaacggcatcggagggatcttctgt

SEQ ID NO: 8948 - DNA, 25 bp, Mus musculus
aaacggcatcggtgggatcttctgt

SEQ ID NO: 8949 - DNA, 25 bp, Mus musculus
aaacggccatggctggtctggaact

SEQ ID NO: 8950 - DNA, 25 bp, Mus musculus
aaacggccatgggtggtctggaact

SEQ ID NO: 8951 - DNA, 25 bp, Mus musculus
aaacggccctacatcactgtggatg

SEQ ID NO: 8952 - DNA, 25 bp, Mus musculus
aaacggccctacttcactgtggatg

SEQ ID NO: 8953 - DNA, 25 bp, Mus musculus
aaacggcctcctctgtagagacgat

SEQ ID NO: 8954 - DNA, 25 bp, Mus musculus
aaacggcctcctgtgtagagacgat

SEQ ID NO: 8955 - DNA, 25 bp, Mus musculus
aaacggcgacctctacatctgggat

SEQ ID NO: 8956 - DNA, 25 bp, Mus musculus
aaacggcgacctgtacatctgggat

SEQ ID NO: 8957 - DNA, 25 bp, Mus musculus
aaacggcggcgtccggatgaagtgc

SEQ ID NO: 8958 - DNA, 25 bp, Mus musculus
aaacggcggcgtgcggatgaagtgc

SEQ ID NO: 8959 - DNA, 25 bp, Mus musculus
aaacggcgttggaatctagtggatc

SEQ ID NO: 8960 - DNA, 25 bp, Mus musculus
aaacggcgttggtatctagtggatc

SEQ ID NO: 8961 - DNA, 25 bp, Mus musculus
aaacggctatttacatctcttgcac

SEQ ID NO: 8962 - DNA, 25 bp, Mus musculus
aaacggctattttcatctcttgcac

SEQ ID NO: 8963 - DNA, 25 bp, Mus musculus
aaacggctcttgctgagctggtgaa

SEQ ID NO: 8964 - DNA, 25 bp, Mus musculus
aaacggctcttggtgagctggtgaa

SEQ ID NO: 8965 - DNA, 25 bp, Mus musculus
aaacggctgattcaggacactgagg

SEQ ID NO: 8966 - DNA, 25 bp, Mus musculus
aaacggctgattgaggacactgagg

SEQ ID NO: 8967 - DNA, 25 bp, Mus musculus
aaacggctggaccagtacacccaag

SEQ ID NO: 8968 - DNA, 25 bp, Mus musculus
aaacggctggacgagtacacccaag

SEQ ID NO: 8969 - DNA, 25 bp, Mus musculus
aaacggcttatgaagcaaccagagt

SEQ ID NO: 8970 - DNA, 25 bp, Mus musculus
aaacggcttatgtagcaaccagagt

SEQ ID NO: 8971 - DNA, 25 bp, Mus musculus
aaacggcttttgatgaggccatcgc

SEQ ID NO: 8972 - DNA, 25 bp, Mus musculus
aaacggcttttgttgaggccatcgc

SEQ ID NO: 8973 - DNA, 25 bp, Mus musculus
aaacgggaaccccatggcaataatg

SEQ ID NO: 8974 - DNA, 25 bp, Mus musculus
aaacgggaacccgatggcaataatg

SEQ ID NO: 8975 - DNA, 25 bp, Mus musculus
aaacgggaactaaactgcctggtct

SEQ ID NO: 8976 - DNA, 25 bp, Mus musculus
aaacgggaactatactgcctggtct

SEQ ID NO: 8977 - DNA, 25 bp, Mus musculus
aaacgggaaggcagctcagagtcct

SEQ ID NO: 8978 - DNA, 25 bp, Mus musculus
aaacgggaaggctgctcagagtcct

SEQ ID NO: 8979 - DNA, 25 bp, Mus musculus
aaacgggacattagacacctattca

SEQ ID NO: 8980 - DNA, 25 bp, Mus musculus
aaacgggacatttgacacctattca

SEQ ID NO: 8981 - DNA, 25 bp, Mus musculus
aaacgggacctgctgcttctgatat

SEQ ID NO: 8982 - DNA, 25 bp, Mus musculus
aaacgggacctggtgcttctgatat

SEQ ID NO: 8983 - DNA, 25 bp, Mus musculus
aaacgggacgcgcacacctgagctg

SEQ ID NO: 8984 - DNA, 25 bp, Mus musculus
aaacgggacgcggacacctgagctg

SEQ ID NO: 8985 - DNA, 25 bp, Mus musculus
aaacgggcattaaaagttctgcaaa

SEQ ID NO: 8986 - DNA, 25 bp, Mus musculus
aaacgggcattataagttctgcaaa

SEQ ID NO: 8987 - DNA, 25 bp, Mus musculus
aaacgggccttgagttcgttcactg

SEQ ID NO: 8988 - DNA, 25 bp, Mus musculus
aaacgggccttgtgttcgttcactg

SEQ ID NO: 8989 - DNA, 25 bp, Mus musculus
aaacgggcgtgcaggaggtcagaac

SEQ ID NO: 8990 - DNA, 25 bp, Mus musculus
aaacgggcgtgctggaggtcagaac

SEQ ID NO: 8991 - DNA, 25 bp, Mus musculus
aaacgggtggaaactcaggctgtcg

SEQ ID NO: 8992 - DNA, 25 bp, Mus musculus
aaacgggtggaatctcaggctgtcg

SEQ ID NO: 8993 - DNA, 25 bp, Mus musculus
aaacggtaccgtccagtgtatgact

SEQ ID NO: 8994 - DNA, 25 bp, Mus musculus
aaacggtaccgtgcagtgtatgact

SEQ ID NO: 8995 - DNA, 25 bp, Mus musculus
aaacggtcatttactggctggcaga

SEQ ID NO: 8996 - DNA, 25 bp, Mus musculus
aaacggtcattttctggctggcaga

SEQ ID NO: 8997 - DNA, 25 bp, Mus musculus
aaacggtccctacggtgcttgctgt

SEQ ID NO: 8998 - DNA, 25 bp, Mus musculus
aaacggtccctagggtgcttgctgt

SEQ ID NO: 8999 - DNA, 25 bp, Mus musculus
aaacggtctcaaaacttacagtgca

SEQ ID NO: 9000 - DNA, 25 bp, Mus musculus
aaacggtctcaatacttacagtgca

SEQ ID NO: 9001 - DNA, 25 bp, Mus musculus
aaacggtgagacctcctggagtaga

SEQ ID NO: 9002 - DNA, 25 bp, Mus musculus
aaacggtgagacgtcctggagtaga

SEQ ID NO: 9003 - DNA, 25 bp, Mus musculus
aaacggtgcttccacaagaaggctt

SEQ ID NO: 9004 - DNA, 25 bp, Mus musculus
aaacggtgcttcgacaagaaggctt

SEQ ID NO: 9005 - DNA, 25 bp, Mus musculus
aaacggtggtggcagaatttctaga

SEQ ID NO: 9006 - DNA, 25 bp, Mus musculus
aaacggtggtgggagaatttctaga

SEQ ID NO: 9007 - DNA, 25 bp, Mus musculus
aaacggttccctattcagtgtgtgt

SEQ ID NO: 9008 - DNA, 25 bp, Mus musculus
aaacggttcccttttcagtgtgtgt

SEQ ID NO: 9009 - DNA, 25 bp, Mus musculus
aaacggttctatacaatctgcatcg

SEQ ID NO: 9010 - DNA, 25 bp, Mus musculus
aaacggttctattcaatctgcatcg

SEQ ID NO: 9011 - DNA, 25 bp, Mus musculus
aaacggttgtgcaatcccatgctgc

SEQ ID NO: 9012 - DNA, 25 bp, Mus musculus
aaacggttgtgctatcccatgctgc

SEQ ID NO: 9013 - DNA, 25 bp, Mus musculus
aaacggtttgccacaggaatatcaa

SEQ ID NO: 9014 - DNA, 25 bp, Mus musculus
aaacggtttgcctcaggaatatcaa

SEQ ID NO: 9015 - DNA, 25 bp, Mus musculus
aaacgtaaagaaatgcagttgaggc

SEQ ID NO: 9016 - DNA, 25 bp, Mus musculus
aaacgtaaagaattgcagttgaggc

SEQ ID NO: 9017 - DNA, 25 bp, Mus musculus
aaacgtaagtggatcctcagtagag

SEQ ID NO: 9018 - DNA, 25 bp, Mus musculus
aaacgtaagtggttcctcagtagag

SEQ ID NO: 9019 - DNA, 25 bp, Mus musculus
aaacgtaatgccaatgtgcgattgc

SEQ ID NO: 9020 - DNA, 25 bp, Mus musculus
aaacgtaatgcctatgtgcgattgc

SEQ ID NO: 9021 - DNA, 25 bp, Mus musculus
aaacgtagctccaagggtgtcttgc

SEQ ID NO: 9022 - DNA, 25 bp, Mus musculus
aaacgtagctcctagggtgtcttgc

SEQ ID NO: 9023 - DNA, 25 bp, Mus musculus
aaacgtaggttcctcttacatgcct

SEQ ID NO: 9024 - DNA, 25 bp, Mus musculus
aaacgtaggttcgtcttacatgcct

SEQ ID NO: 9025 - DNA, 25 bp, Mus musculus
aaacgtagttctagtggctttgctc

SEQ ID NO: 9026 - DNA, 25 bp, Mus musculus
aaacgtagttcttgtggctttgctc

SEQ ID NO: 9027 - DNA, 25 bp, Mus musculus
aaacgtatagaaaacgtggtctaat

SEQ ID NO: 9028 - DNA, 25 bp, Mus musculus
aaacgtatagaatacgtggtctaat

SEQ ID NO: 9029 - DNA, 25 bp, Mus musculus
aaacgtatcgtcattctggcactaa

SEQ ID NO: 9030 - DNA, 25 bp, Mus musculus
aaacgtatcgtctttctggcactaa

SEQ ID NO: 9031 - DNA, 25 bp, Mus musculus
aaacgtatgcatcagggcctggtcc

SEQ ID NO: 9032 - DNA, 25 bp, Mus musculus
aaacgtatgcatgagggcctggtcc

SEQ ID NO: 9033 - DNA, 25 bp, Mus musculus
aaacgtatgtttctgcttgctgtgc

SEQ ID NO: 9034 - DNA, 25 bp, Mus musculus
aaacgtatgtttgtgcttgctgtgc

SEQ ID NO: 9035 - DNA, 25 bp, Mus musculus
aaacgtcaattcacaccattcaact

SEQ ID NO: 9036 - DNA, 25 bp, Mus musculus
aaacgtcaattctcaccattcaact

SEQ ID NO: 9037 - DNA, 25 bp, Mus musculus
aaacgtcacgctcaatatatgacca

SEQ ID NO: 9038 - DNA, 25 bp, Mus musculus
aaacgtcacgctgaatatatgacca

SEQ ID NO: 9039 - DNA, 25 bp, Mus musculus
aaacgtcagtgtctttgttgccaag

SEQ ID NO: 9040 - DNA, 25 bp, Mus musculus
aaacgtcagtgtgtttgttgccaag

SEQ ID NO: 9041 - DNA, 25 bp, Mus musculus
aaacgtcatctgaaggcctatgata

SEQ ID NO: 9042 - DNA, 25 bp, Mus musculus
aaacgtcatctgtaggcctatgata

SEQ ID NO: 9043 - DNA, 25 bp, Mus musculus
aaacgtccctaaatttcacatctag

SEQ ID NO: 9044 - DNA, 25 bp, Mus musculus
aaacgtccctaattttcacatctag

SEQ ID NO: 9045 - DNA, 25 bp, Mus musculus
aaacgtcgcctgcagacagacagtg

SEQ ID NO: 9046 - DNA, 25 bp, Mus musculus
aaacgtcgcctggagacagacagtg

SEQ ID NO: 9047 - DNA, 25 bp, Mus musculus
aaacgtcggcaaaggctatgacatt

SEQ ID NO: 9048 - DNA, 25 bp, Mus musculus
aaacgtcggcaatggctatgacatt

SEQ ID NO: 9049 - DNA, 25 bp, Mus musculus
aaacgtcggcgtatggctgaataca

SEQ ID NO: 9050 - DNA, 25 bp, Mus musculus
aaacgtcggcgtttggctgaataca

SEQ ID NO: 9051 - DNA, 25 bp, Mus musculus
aaacgtcgtcccaggcagaggctga

SEQ ID NO: 9052 - DNA, 25 bp, Mus musculus
aaacgtcgtccctggcagaggctga

SEQ ID NO: 9053 - DNA, 25 bp, Mus musculus
aaacgtctcgttcattctgtaacgc

SEQ ID NO: 9054 - DNA, 25 bp, Mus musculus
aaacgtctcgttgattctgtaacgc

SEQ ID NO: 9055 - DNA, 25 bp, Mus musculus
aaacgtctgaatacaaaggaggtca

SEQ ID NO: 9056 - DNA, 25 bp, Mus musculus
aaacgtctgaattcaaaggaggtca

SEQ ID NO: 9057 - DNA, 25 bp, Mus musculus
aaacgtctgcgacttcagtggtcca

SEQ ID NO: 9058 - DNA, 25 bp, Mus musculus
aaacgtctgcgagttcagtggtcca

SEQ ID NO: 9059 - DNA, 25 bp, Mus musculus
aaacgtcttcacaaaatgcagcccc

SEQ ID NO: 9060 - DNA, 25 bp, Mus musculus
aaacgtcttcactaaatgcagcccc

SEQ ID NO: 9061 - DNA, 25 bp, Mus musculus
aaacgtcttctcatatgatgatcca

SEQ ID NO: 9062 - DNA, 25 bp, Mus musculus
aaacgtcttctcttatgatgatcca

SEQ ID NO: 9063 - DNA, 25 bp, Mus musculus
aaacgtcttgatagccagagtgcta

SEQ ID NO: 9064 - DNA, 25 bp, Mus musculus
aaacgtcttgattgccagagtgcta

SEQ ID NO: 9065 - DNA, 25 bp, Mus musculus
aaacgtgaatccaaacatgagaagc

SEQ ID NO: 9066 - DNA, 25 bp, Mus musculus
aaacgtgaatcctaacatgagaagc

SEQ ID NO: 9067 - DNA, 25 bp, Mus musculus
aaacgtgaatgacccagcctccgac

SEQ ID NO: 9068 - DNA, 25 bp, Mus musculus
aaacgtgaatgagccagcctccgac

SEQ ID NO: 9069 - DNA, 25 bp, Mus musculus
aaacgtgacaccagggaactgctgg

SEQ ID NO: 9070 - DNA, 25 bp, Mus musculus
aaacgtgacacctgggaactgctgg

SEQ ID NO: 9071 - DNA, 25 bp, Mus musculus
aaacgtgcattcatatcacagcctg

SEQ ID NO: 9072 - DNA, 25 bp, Mus musculus
aaacgtgcattcttatcacagcctg

SEQ ID NO: 9073 - DNA, 25 bp, Mus musculus
aaacgtgcccctatctaaccagtga

SEQ ID NO: 9074 - DNA, 25 bp, Mus musculus
aaacgtgcccctttctaaccagtga

SEQ ID NO: 9075 - DNA, 25 bp, Mus musculus
aaacgtgcctaaacctgaagagact

SEQ ID NO: 9076 - DNA, 25 bp, Mus musculus
aaacgtgcctaatcctgaagagact

SEQ ID NO: 9077 - DNA, 25 bp, Mus musculus
aaacgtgcgggcactgtacatcaag

SEQ ID NO: 9078 - DNA, 25 bp, Mus musculus
aaacgtgcgggctctgtacatcaag

SEQ ID NO: 9079 - DNA, 25 bp, Mus musculus
aaacgtgcgtgtacagcgatgccta

SEQ ID NO: 9080 - DNA, 25 bp, Mus musculus
aaacgtgcgtgttcagcgatgccta

SEQ ID NO: 9081 - DNA, 25 bp, Mus musculus
aaacgtgctggaatgctgcccaccc

SEQ ID NO: 9082 - DNA, 25 bp, Mus musculus
aaacgtgctggattgctgcccaccc

SEQ ID NO: 9083 - DNA, 25 bp, Mus musculus
aaacgtgcttgtcagttgagtgaat

SEQ ID NO: 9084 - DNA, 25 bp, Mus musculus
aaacgtgcttgtgagttgagtgaat

SEQ ID NO: 9085 - DNA, 25 bp, Mus musculus
aaacgtggacatactgtgggactcc

SEQ ID NO: 9086 - DNA, 25 bp, Mus musculus
aaacgtggacattctgtgggactcc

SEQ ID NO: 9087 - DNA, 25 bp, Mus musculus
aaacgtggacgaccctgaaaagcat

SEQ ID NO: 9088 - DNA, 25 bp, Mus musculus
aaacgtggacgagcctgaaaagcat

SEQ ID NO: 9089 - DNA, 25 bp, Mus musculus
aaacgtggcacaaatataaatggta

SEQ ID NO: 9090 - DNA, 25 bp, Mus musculus
aaacgtggcacatatataaatggta

SEQ ID NO: 9091 - DNA, 25 bp, Mus musculus
aaacgtggcttaatccactgggacg

SEQ ID NO: 9092 - DNA, 25 bp, Mus musculus
aaacgtggcttattccactgggacg

SEQ ID NO: 9093 - DNA, 25 bp, Mus musculus
aaacgtggtcttcacagcaagcagc

SEQ ID NO: 9094 - DNA, 25 bp, Mus musculus
aaacgtggtcttgacagcaagcagc

SEQ ID NO: 9095 - DNA, 25 bp, Mus musculus
aaacgtggtggcatgtgagagcatt

SEQ ID NO: 9096 - DNA, 25 bp, Mus musculus
aaacgtggtggcttgtgagagcatt

SEQ ID NO: 9097 - DNA, 25 bp, Mus musculus
aaacgtggtgtgcttgactatccca

SEQ ID NO: 9098 - DNA, 25 bp, Mus musculus
aaacgtggtgtggttgactatccca

SEQ ID NO: 9099 - DNA, 25 bp, Mus musculus
aaacgtggttgactgatgttcatga

SEQ ID NO: 9100 - DNA, 25 bp, Mus musculus
aaacgtggttgagtgatgttcatga

SEQ ID NO: 9101 - DNA, 25 bp, Mus musculus
aaacgtgtcaacattgctatgctag

SEQ ID NO: 9102 - DNA, 25 bp, Mus musculus
aaacgtgtcaactttgctatgctag

SEQ ID NO: 9103 - DNA, 25 bp, Mus musculus
aaacgtgtccttcaaaaccactgct

SEQ ID NO: 9104 - DNA, 25 bp, Mus musculus
aaacgtgtccttgaaaaccactgct

SEQ ID NO: 9105 - DNA, 25 bp, Mus musculus
aaacgtgtctccccgtgtatatgta

SEQ ID NO: 9106 - DNA, 25 bp, Mus musculus
aaacgtgtctccgcgtgtatatgta

SEQ ID NO: 9107 - DNA, 25 bp, Mus musculus
aaacgtgtgagcaccgagggtcctt

SEQ ID NO: 9108 - DNA, 25 bp, Mus musculus
aaacgtgtgagctccgagggtcctt

SEQ ID NO: 9109 - DNA, 25 bp, Mus musculus
aaacgtgtgcctaacagcgtgcttt

SEQ ID NO: 9110 - DNA, 25 bp, Mus musculus
aaacgtgtgcctacacagcactgtt

SEQ ID NO: 9111 - DNA, 25 bp, Mus musculus
aaacgtgtgccttacagcgtgcttt

SEQ ID NO: 9112 - DNA, 25 bp, Mus musculus
aaacgtgtgccttcacagcactgtt

SEQ ID NO: 9113 - DNA, 25 bp, Mus musculus
aaacgtgtgttcatactggcttaga

SEQ ID NO: 9114 - DNA, 25 bp, Mus musculus
aaacgtgtgttcttactggcttaga

SEQ ID NO: 9115 - DNA, 25 bp, Mus musculus
aaacgtgttagtctctgtacctcct

SEQ ID NO: 9116 - DNA, 25 bp, Mus musculus
aaacgtgttagtgtctgtacctcct

SEQ ID NO: 9117 - DNA, 25 bp, Mus musculus
aaacgtgttcttatctatgttcaga

SEQ ID NO: 9118 - DNA, 25 bp, Mus musculus
aaacgtgttcttttctatgttcaga

SEQ ID NO: 9119 - DNA, 25 bp, Mus musculus
aaacgtgttgcccacatctgatgcg

SEQ ID NO: 9120 - DNA, 25 bp, Mus musculus
aaacgtgttgccgacatctgatgcg

SEQ ID NO: 9121 - DNA, 25 bp, Mus musculus
aaacgtgttgttattctagggactg

SEQ ID NO: 9122 - DNA, 25 bp, Mus musculus
aaacgtgttgtttttctagggactg

SEQ ID NO: 9123 - DNA, 25 bp, Mus musculus
aaacgtgtttcaaccagatccagaa

SEQ ID NO: 9124 - DNA, 25 bp, Mus musculus
aaacgtgtttcatccagatccagaa

SEQ ID NO: 9125 - DNA, 25 bp, Mus musculus
aaacgttactttcgtcactctgctc

SEQ ID NO: 9126 - DNA, 25 bp, Mus musculus
aaacgttactttggtcactctgctc

SEQ ID NO: 9127 - DNA, 25 bp, Mus musculus
aaacgttcacacacagcaacactga

SEQ ID NO: 9128 - DNA, 25 bp, Mus musculus
aaacgttcacactcagcaacactga

SEQ ID NO: 9129 - DNA, 25 bp, Mus musculus
aaacgttcacataggctttgaggaa

SEQ ID NO: 9130 - DNA, 25 bp, Mus musculus
aaacgttcacattggctttgaggaa

SEQ ID NO: 9131 - DNA, 25 bp, Mus musculus
aaacgttcacccagtggtttgcaag

SEQ ID NO: 9132 - DNA, 25 bp, Mus musculus
aaacgttcaccctgtggtttgcaag

SEQ ID NO: 9133 - DNA, 25 bp, Mus musculus
aaacgttccccaatcaggtcttcag

SEQ ID NO: 9134 - DNA, 25 bp, Mus musculus
aaacgttccccattcaggtcttcag

SEQ ID NO: 9135 - DNA, 25 bp, Mus musculus
aaacgttctgagacaggcgacccaa

SEQ ID NO: 9136 - DNA, 25 bp, Mus musculus
aaacgttctgagtcaggcgacccaa

SEQ ID NO: 9137 - DNA, 25 bp, Mus musculus
aaacgttctgtgaaatcttcattaa

SEQ ID NO: 9138 - DNA, 25 bp, Mus musculus
aaacgttctgtgtaatcttcattaa

SEQ ID NO: 9139 - DNA, 25 bp, Mus musculus
aaacgttctgttcggtgtggtgcta

SEQ ID NO: 9140 - DNA, 25 bp, Mus musculus
aaacgttctgttgggtgtggtgcta

SEQ ID NO: 9141 - DNA, 25 bp, Mus musculus
aaacgttctttgatgtcaactccat

SEQ ID NO: 9142 - DNA, 25 bp, Mus musculus
aaacgttctttgttgtcaactccat

SEQ ID NO: 9143 - DNA, 25 bp, Mus musculus
aaacgttgagtcatgggaaatgtgt

SEQ ID NO: 9144 - DNA, 25 bp, Mus musculus
aaacgttgagtcttgggaaatgtgt

SEQ ID NO: 9145 - DNA, 25 bp, Mus musculus
aaacgttgcaggctgttaacatgac

SEQ ID NO: 9146 - DNA, 25 bp, Mus musculus
aaacgttgcagggtgttaacatgac

SEQ ID NO: 9147 - DNA, 25 bp, Mus musculus
aaacgttgccttaaagcacatgcct

SEQ ID NO: 9148 - DNA, 25 bp, Mus musculus
aaacgttgcctttaagcacatgcct

SEQ ID NO: 9149 - DNA, 25 bp, Mus musculus
aaacgttgctgtaacaatgggtcat

SEQ ID NO: 9150 - DNA, 25 bp, Mus musculus
aaacgttgctgttacaatgggtcat

SEQ ID NO: 9151 - DNA, 25 bp, Mus musculus
aaacgttggtggatggagccagcta

SEQ ID NO: 9152 - DNA, 25 bp, Mus musculus
aaacgttggtggttggagccagcta

SEQ ID NO: 9153 - DNA, 25 bp, Mus musculus
aaacgtttgcatcactttcccattg

SEQ ID NO: 9154 - DNA, 25 bp, Mus musculus
aaacgtttgcatgactttcccattg

SEQ ID NO: 9155 - DNA, 25 bp, Mus musculus
aaacgtttgcttatcatcgtggctg

SEQ ID NO: 9156 - DNA, 25 bp, Mus musculus
aaacgtttgcttatgtaatttcaca

SEQ ID NO: 9157 - DNA, 25 bp, Mus musculus
aaacgtttgcttttcatcgtggctg

SEQ ID NO: 9158 - DNA, 25 bp, Mus musculus
aaacgtttgcttttgtaatttcaca

SEQ ID NO: 9159 - DNA, 25 bp, Mus musculus
aaacgtttggcaactggaagcacag

SEQ ID NO: 9160 - DNA, 25 bp, Mus musculus
aaacgtttggcatctggaagcacag

SEQ ID NO: 9161 - DNA, 25 bp, Mus musculus
aaacgtttgtttatgttcgtgcgtg

SEQ ID NO: 9162 - DNA, 25 bp, Mus musculus
aaacgtttgtttttgttcgtgcgtg

SEQ ID NO: 9163 - DNA, 25 bp, Mus musculus
aaacgttttcagaggcgatccatcc

SEQ ID NO: 9164 - DNA, 25 bp, Mus musculus
aaacgttttcagtggcgatccatcc

SEQ ID NO: 9165 - DNA, 25 bp, Mus musculus
aaacgttttgcacttggtcacctca

SEQ ID NO: 9166 - DNA, 25 bp, Mus musculus
aaacgttttgcagttggtcacctca

SEQ ID NO: 9167 - DNA, 25 bp, Mus musculus
aaacgttttggaaagcacttcagat

SEQ ID NO: 9168 - DNA, 25 bp, Mus musculus
aaacgttttggatagcacttcagat

SEQ ID NO: 9169 - DNA, 25 bp, Mus musculus
aaacgtttttgccactgtgactctc

SEQ ID NO: 9170 - DNA, 25 bp, Mus musculus
aaacgtttttgcgactgtgactctc

SEQ ID NO: 9171 - DNA, 25 bp, Mus musculus
aaactaaaccctaggctgctttgat

SEQ ID NO: 9172 - DNA, 25 bp, Mus musculus
aaactaaacccttggctgctttgat

SEQ ID NO: 9173 - DNA, 25 bp, Mus musculus
aaactaaacttactcctctgtgcag

SEQ ID NO: 9174 - DNA, 25 bp, Mus musculus
aaactaaacttagtcctctgtgcag

SEQ ID NO: 9175 - DNA, 25 bp, Mus musculus
aaactaaagatgactctcctctacc

SEQ ID NO: 9176 - DNA, 25 bp, Mus musculus
aaactaaagatgtctctcctctacc

SEQ ID NO: 9177 - DNA, 25 bp, Mus musculus
aaactaaagcccagcacatgtatgc

SEQ ID NO: 9178 - DNA, 25 bp, Mus musculus
aaactaaagccctgcacatgtatgc

SEQ ID NO: 9179 - DNA, 25 bp, Mus musculus
aaactaaagctacactgccggccag

SEQ ID NO: 9180 - DNA, 25 bp, Mus musculus
aaactaaagctagactgccggccag

SEQ ID NO: 9181 - DNA, 25 bp, Mus musculus
aaactaaatgccatctcggtcctgt

SEQ ID NO: 9182 - DNA, 25 bp, Mus musculus
aaactaaatgccttctcggtcctgt

SEQ ID NO: 9183 - DNA, 25 bp, Mus musculus
aaactaaccctgattctgcatgtca

SEQ ID NO: 9184 - DNA, 25 bp, Mus musculus
aaactaaccctgtttctgcatgtca

SEQ ID NO: 9185 - DNA, 25 bp, Mus musculus
aaactaaccttgaacctctcaggca

SEQ ID NO: 9186 - DNA, 25 bp, Mus musculus
aaactaaccttgtacctctcaggca

SEQ ID NO: 9187 - DNA, 25 bp, Mus musculus
aaactaactaacactcaccatctgg

SEQ ID NO: 9188 - DNA, 25 bp, Mus musculus
aaactaactaactctcaccatctgg

SEQ ID NO: 9189 - DNA, 25 bp, Mus musculus
aaactaactagtccacagccagaat

SEQ ID NO: 9190 - DNA, 25 bp, Mus musculus
aaactaactagtgcacagccagaat

SEQ ID NO: 9191 - DNA, 25 bp, Mus musculus
aaactaactccaactttacattctg

SEQ ID NO: 9192 - DNA, 25 bp, Mus musculus
aaactaactccatctttacattctg

SEQ ID NO: 9193 - DNA, 25 bp, Mus musculus
aaactaactgaaatctgccctgctc

SEQ ID NO: 9194 - DNA, 25 bp, Mus musculus
aaactaactgaattctgccctgctc

SEQ ID NO: 9195 - DNA, 25 bp, Mus musculus
aaactaactgcccttggtgtgtgtt

SEQ ID NO: 9196 - DNA, 25 bp, Mus musculus
aaactaactgccgttggtgtgtgtt

SEQ ID NO: 9197 - DNA, 25 bp, Mus musculus
aaactaagagtccttctgcttccac

SEQ ID NO: 9198 - DNA, 25 bp, Mus musculus
aaactaagagtcgttctgcttccac

SEQ ID NO: 9199 - DNA, 25 bp, Mus musculus
aaactaagcttacccatcgcatgta

SEQ ID NO: 9200 - DNA, 25 bp, Mus musculus
aaactaagcttagccatcgcatgta

SEQ ID NO: 9201 - DNA, 25 bp, Mus musculus
aaactaatagcgatgggcttcttca

SEQ ID NO: 9202 - DNA, 25 bp, Mus musculus
aaactaatagcgttgggcttcttca

SEQ ID NO: 9203 - DNA, 25 bp, Mus musculus
aaactaatgactcgcctttcacacc

SEQ ID NO: 9204 - DNA, 25 bp, Mus musculus
aaactaatgactggcctttcacacc

SEQ ID NO: 9205 - DNA, 25 bp, Mus musculus
aaactaatgatcaagcctctgtagg

SEQ ID NO: 9206 - DNA, 25 bp, Mus musculus
aaactaatgatctagcctctgtagg

SEQ ID NO: 9207 - DNA, 25 bp, Mus musculus
aaactaatggatacactgccttgcc

SEQ ID NO: 9208 - DNA, 25 bp, Mus musculus
aaactaatggattcactgccttgcc

SEQ ID NO: 9209 - DNA, 25 bp, Mus musculus
aaactaatttgtatcgtctgctcta

SEQ ID NO: 9210 - DNA, 25 bp, Mus musculus
aaactaatttgtttcgtctgctcta

SEQ ID NO: 9211 - DNA, 25 bp, Mus musculus
aaactacaacaccacgctggagcag

SEQ ID NO: 9212 - DNA, 25 bp, Mus musculus
aaactacaacacgacgctggagcag

SEQ ID NO: 9213 - DNA, 25 bp, Mus musculus
aaactacaatataatccagagctga

SEQ ID NO: 9214 - DNA, 25 bp, Mus musculus
aaactacaatattatccagagctga

SEQ ID NO: 9215 - DNA, 25 bp, Mus musculus
aaactacaccccagctagagcatga

SEQ ID NO: 9216 - DNA, 25 bp, Mus musculus
aaactacacccctgctagagcatga

SEQ ID NO: 9217 - DNA, 25 bp, Mus musculus
aaactacactccagaacttttctgc

SEQ ID NO: 9218 - DNA, 25 bp, Mus musculus
aaactacactcctgaacttttctgc

SEQ ID NO: 9219 - DNA, 25 bp, Mus musculus
aaactacactctatcttcagcacag

SEQ ID NO: 9220 - DNA, 25 bp, Mus musculus
aaactacactctttcttcagcacag

SEQ ID NO: 9221 - DNA, 25 bp, Mus musculus
aaactacacttaacctacagcacag

SEQ ID NO: 9222 - DNA, 25 bp, Mus musculus
aaactacacttatcctacagcacag

SEQ ID NO: 9223 - DNA, 25 bp, Mus musculus
aaactacaggatactcagtcggctt

SEQ ID NO: 9224 - DNA, 25 bp, Mus musculus
aaactacaggattctcagtcggctt

SEQ ID NO: 9225 - DNA, 25 bp, Mus musculus
aaactacagtgtctgcctgcagtat

SEQ ID NO: 9226 - DNA, 25 bp, Mus musculus
aaactacagtgtgtgcctgcagtat

SEQ ID NO: 9227 - DNA, 25 bp, Mus musculus
aaactacatagcaaggtcctatctt

SEQ ID NO: 9228 - DNA, 25 bp, Mus musculus
aaactacatagctaggtcctatctt

SEQ ID NO: 9229 - DNA, 25 bp, Mus musculus
aaactacatccacagaatcggtcga

SEQ ID NO: 9230 - DNA, 25 bp, Mus musculus
aaactacatccagagaatcggtcga

SEQ ID NO: 9231 - DNA, 25 bp, Mus musculus
aaactacattctcctggcgttcttt

SEQ ID NO: 9232 - DNA, 25 bp, Mus musculus
aaactacattctgctggcgttcttt

SEQ ID NO: 9233 - DNA, 25 bp, Mus musculus
aaactaccaagacgatgccatccca

SEQ ID NO: 9234 - DNA, 25 bp, Mus musculus
aaactaccaagaggatgccatccca

SEQ ID NO: 9235 - DNA, 25 bp, Mus musculus
aaactaccaatgctgatcaataaag

SEQ ID NO: 9236 - DNA, 25 bp, Mus musculus
aaactaccaatggtgatcaataaag

SEQ ID NO: 9237 - DNA, 25 bp, Mus musculus
aaactaccacgtcttgatttttgca

SEQ ID NO: 9238 - DNA, 25 bp, Mus musculus
aaactaccacgtgttgatttttgca

SEQ ID NO: 9239 - DNA, 25 bp, Mus musculus
aaactaccagcccagtctttgttag

SEQ ID NO: 9240 - DNA, 25 bp, Mus musculus
aaactaccagccgagtctttgttag

SEQ ID NO: 9241 - DNA, 25 bp, Mus musculus
aaactacccagcattctgctcagta

SEQ ID NO: 9242 - DNA, 25 bp, Mus musculus
aaactacccagctttctgctcagta

SEQ ID NO: 9243 - DNA, 25 bp, Mus musculus
aaactaccctcacgaatgcgctggg

SEQ ID NO: 9244 - DNA, 25 bp, Mus musculus
aaactaccctcaggaatgcgctggg

SEQ ID NO: 9245 - DNA, 25 bp, Mus musculus
aaactaccgtctccagggatcttgg

SEQ ID NO: 9246 - DNA, 25 bp, Mus musculus
aaactaccgtctgcagggatcttgg

SEQ ID NO: 9247 - DNA, 25 bp, Mus musculus
aaactacctcttcccacaatgactt

SEQ ID NO: 9248 - DNA, 25 bp, Mus musculus
aaactacctcttgccacaatgactt

SEQ ID NO: 9249 - DNA, 25 bp, Mus musculus
aaactacctgagaaatggtggttgc

SEQ ID NO: 9250 - DNA, 25 bp, Mus musculus
aaactacctgagtaatggtggttgc

SEQ ID NO: 9251 - DNA, 25 bp, Mus musculus
aaactacctgcaaaacttcatgtga

SEQ ID NO: 9252 - DNA, 25 bp, Mus musculus
aaactacctgcataacttcatgtga

SEQ ID NO: 9253 - DNA, 25 bp, Mus musculus
aaactacctggcctgaagctatgga

SEQ ID NO: 9254 - DNA, 25 bp, Mus musculus
aaactacctggcgtgaagctatgga

SEQ ID NO: 9255 - DNA, 25 bp, Mus musculus
aaactacctgtaccataaaatgtca

SEQ ID NO: 9256 - DNA, 25 bp, Mus musculus
aaactacctgtagcataaaatgtca

SEQ ID NO: 9257 - DNA, 25 bp, Mus musculus
aaactacgctgacctttggaccagt

SEQ ID NO: 9258 - DNA, 25 bp, Mus musculus
aaactacgctgagctttggaccagt

SEQ ID NO: 9259 - DNA, 25 bp, Mus musculus
aaactacggtgaacagtcagcagac

SEQ ID NO: 9260 - DNA, 25 bp, Mus musculus
aaactacggtgatcagtcagcagac

SEQ ID NO: 9261 - DNA, 25 bp, Mus musculus
aaactacgttgtctacctgggtcag

SEQ ID NO: 9262 - DNA, 25 bp, Mus musculus
aaactacgttgtgtacctgggtcag

SEQ ID NO: 9263 - DNA, 25 bp, Mus musculus
aaactactaattacctggcctgtgt

SEQ ID NO: 9264 - DNA, 25 bp, Mus musculus
aaactactaatttcctggcctgtgt

SEQ ID NO: 9265 - DNA, 25 bp, Mus musculus
aaactactacccaattccagaggca

SEQ ID NO: 9266 - DNA, 25 bp, Mus musculus
aaactactaccctattccagaggca

SEQ ID NO: 9267 - DNA, 25 bp, Mus musculus
aaactactatcgcttggctgttaat

SEQ ID NO: 9268 - DNA, 25 bp, Mus musculus
aaactactatcggttggctgttaat

SEQ ID NO: 9269 - DNA, 25 bp, Mus musculus
aaactactatctaggagccttcaga

SEQ ID NO: 9270 - DNA, 25 bp, Mus musculus
aaactactatcttggagccttcaga

SEQ ID NO: 9271 - DNA, 25 bp, Mus musculus
aaactactcaggacagaaatatgtt

SEQ ID NO: 9272 - DNA, 25 bp, Mus musculus
aaactactcaggtcagaaatatgtt

SEQ ID NO: 9273 - DNA, 25 bp, Mus musculus
aaactactcgtaagcagccctttgt

SEQ ID NO: 9274 - DNA, 25 bp, Mus musculus
aaactactcgtatgcagccctttgt

SEQ ID NO: 9275 - DNA, 25 bp, Mus musculus
aaactactcgtcctgtacagttaga

SEQ ID NO: 9276 - DNA, 25 bp, Mus musculus
aaactactcgtcgtgtacagttaga

SEQ ID NO: 9277 - DNA, 25 bp, Mus musculus
aaactactcttacttcctctcataa

SEQ ID NO: 9278 - DNA, 25 bp, Mus musculus
aaactactcttagttcctctcataa

SEQ ID NO: 9279 - DNA, 25 bp, Mus musculus
aaactactgattacctgggcatcca

SEQ ID NO: 9280 - DNA, 25 bp, Mus musculus
aaactactgatttcctgggcatcca

SEQ ID NO: 9281 - DNA, 25 bp, Mus musculus
aaactactgcatattaagcttccta

SEQ ID NO: 9282 - DNA, 25 bp, Mus musculus
aaactactgcattttaagcttccta

SEQ ID NO: 9283 - DNA, 25 bp, Mus musculus
aaactactggacataccaccctcag

SEQ ID NO: 9284 - DNA, 25 bp, Mus musculus
aaactactggacttaccaccctcag

SEQ ID NO: 9285 - DNA, 25 bp, Mus musculus
aaactactggtcaaggattgcctcg

SEQ ID NO: 9286 - DNA, 25 bp, Mus musculus
aaactactggtctaggattgcctcg

SEQ ID NO: 9287 - DNA, 25 bp, Mus musculus
aaactactgtaaaccacaaccctga

SEQ ID NO: 9288 - DNA, 25 bp, Mus musculus
aaactactgtaatccacaaccctga

SEQ ID NO: 9289 - DNA, 25 bp, Mus musculus
aaactactgtatagtggagccggca

SEQ ID NO: 9290 - DNA, 25 bp, Mus musculus
aaactactgtattgtggagccggca

SEQ ID NO: 9291 - DNA, 25 bp, Mus musculus
aaactactgtgtcttgttgctcctg

SEQ ID NO: 9292 - DNA, 25 bp, Mus musculus
aaactactgtgtgttgttgctcctg

SEQ ID NO: 9293 - DNA, 25 bp, Mus musculus
aaactacttctcatgttagatagat

SEQ ID NO: 9294 - DNA, 25 bp, Mus musculus
aaactacttctcttgttagatagat

SEQ ID NO: 9295 - DNA, 25 bp, Mus musculus
aaactacttgatcttgcctcacctc

SEQ ID NO: 9296 - DNA, 25 bp, Mus musculus
aaactacttgatgttgcctcacctc

SEQ ID NO: 9297 - DNA, 25 bp, Mus musculus
aaactactttggctgcattctgctg

SEQ ID NO: 9298 - DNA, 25 bp, Mus musculus
aaactactttgggtgcattctgctg

SEQ ID NO: 9299 - DNA, 25 bp, Mus musculus
aaactagaagtcaccacttcactgg

SEQ ID NO: 9300 - DNA, 25 bp, Mus musculus
aaactagaagtctccacttcactgg

SEQ ID NO: 9301 - DNA, 25 bp, Mus musculus
aaactagaataactccagccgcggc

SEQ ID NO: 9302 - DNA, 25 bp, Mus musculus
aaactagaataagtccagccgcggc

SEQ ID NO: 9303 - DNA, 25 bp, Mus musculus
aaactagaatctatacggctctgaa

SEQ ID NO: 9304 - DNA, 25 bp, Mus musculus
aaactagaatctttacggctctgaa

SEQ ID NO: 9305 - DNA, 25 bp, Mus musculus
aaactagacacgcagctggcattag

SEQ ID NO: 9306 - DNA, 25 bp, Mus musculus
aaactagacacggagctggcattag

SEQ ID NO: 9307 - DNA, 25 bp, Mus musculus
aaactagacattctctgtgccttcc

SEQ ID NO: 9308 - DNA, 25 bp, Mus musculus
aaactagacattgtctgtgccttcc

SEQ ID NO: 9309 - DNA, 25 bp, Mus musculus
aaactagaccatatctgcggtggga

SEQ ID NO: 9310 - DNA, 25 bp, Mus musculus
aaactagaccatttctgcggtggga

SEQ ID NO: 9311 - DNA, 25 bp, Mus musculus
aaactagactgcagctagacttcag

SEQ ID NO: 9312 - DNA, 25 bp, Mus musculus
aaactagactgctgctagacttcag

SEQ ID NO: 9313 - DNA, 25 bp, Mus musculus
aaactagagagaacaccctcgacct

SEQ ID NO: 9314 - DNA, 25 bp, Mus musculus
aaactagagagatcaccctcgacct

SEQ ID NO: 9315 - DNA, 25 bp, Mus musculus
aaactagagttcattccctgggcat

SEQ ID NO: 9316 - DNA, 25 bp, Mus musculus
aaactagagttctttccctgggcat

SEQ ID NO: 9317 - DNA, 25 bp, Mus musculus
aaactagcaaccatcctgctttagc

SEQ ID NO: 9318 - DNA, 25 bp, Mus musculus
aaactagcaaccttcctgctttagc

SEQ ID NO: 9319 - DNA, 25 bp, Mus musculus
aaactagcagttcgcattttcgtgc

SEQ ID NO: 9320 - DNA, 25 bp, Mus musculus
aaactagcagttggcattttcgtgc

SEQ ID NO: 9321 - DNA, 25 bp, Mus musculus
aaactagcatatccatcggccggcc

SEQ ID NO: 9322 - DNA, 25 bp, Mus musculus
aaactagcatatgcatcggccggcc

SEQ ID NO: 9323 - DNA, 25 bp, Mus musculus
aaactagccacaagcttgccttaaa

SEQ ID NO: 9324 - DNA, 25 bp, Mus musculus
aaactagccacatgcttgccttaaa

SEQ ID NO: 9325 - DNA, 25 bp, Mus musculus
aaactagctaatcagctgtgcctca

SEQ ID NO: 9326 - DNA, 25 bp, Mus musculus
aaactagctaatgagctgtgcctca

SEQ ID NO: 9327 - DNA, 25 bp, Mus musculus
aaactagctggtaccgcatgacttc

SEQ ID NO: 9328 - DNA, 25 bp, Mus musculus
aaactagctggttccgcatgacttc

SEQ ID NO: 9329 - DNA, 25 bp, Mus musculus
aaactagctgtgagatacttctgtc

SEQ ID NO: 9330 - DNA, 25 bp, Mus musculus
aaactagctgtgtgatacttctgtc

SEQ ID NO: 9331 - DNA, 25 bp, Mus musculus
aaactagcttgcaagcaccaggtcc

SEQ ID NO: 9332 - DNA, 25 bp, Mus musculus
aaactagcttgctagcaccaggtcc

SEQ ID NO: 9333 - DNA, 25 bp, Mus musculus
aaactaggcacgagctccagggatg

SEQ ID NO: 9334 - DNA, 25 bp, Mus musculus
aaactaggcacgtgctccagggatg

SEQ ID NO: 9335 - DNA, 25 bp, Mus musculus
aaactaggctgtctcgaacccctgg

SEQ ID NO: 9336 - DNA, 25 bp, Mus musculus
aaactaggctgtgtcgaacccctgg

SEQ ID NO: 9337 - DNA, 25 bp, Mus musculus
aaactaggtactaaactgcagcgct

SEQ ID NO: 9338 - DNA, 25 bp, Mus musculus
aaactaggtacttaactgcagcgct

SEQ ID NO: 9339 - DNA, 25 bp, Mus musculus
aaactaggtggcagcgccgtcattt

SEQ ID NO: 9340 - DNA, 25 bp, Mus musculus
aaactaggtggctgcgccgtcattt

SEQ ID NO: 9341 - DNA, 25 bp, Mus musculus
aaactagtaagacgccaactgccca

SEQ ID NO: 9342 - DNA, 25 bp, Mus musculus
aaactagtaagaggccaactgccca

SEQ ID NO: 9343 - DNA, 25 bp, Mus musculus
aaactagtagacaccccgtgtgcgg

SEQ ID NO: 9344 - DNA, 25 bp, Mus musculus
aaactagtagactccccgtgtgcgg

SEQ ID NO: 9345 - DNA, 25 bp, Mus musculus
aaactagtagctaccatttgtgcac

SEQ ID NO: 9346 - DNA, 25 bp, Mus musculus
aaactagtagcttccatttgtgcac

SEQ ID NO: 9347 - DNA, 25 bp, Mus musculus
aaactagtcatcacttagcctccag

SEQ ID NO: 9348 - DNA, 25 bp, Mus musculus
aaactagtcatctcttagcctccag

SEQ ID NO: 9349 - DNA, 25 bp, Mus musculus
aaactagtgctgacatctgaactca

SEQ ID NO: 9350 - DNA, 25 bp, Mus musculus
aaactagtgctgtcatctgaactca

SEQ ID NO: 9351 - DNA, 25 bp, Mus musculus
aaactagtggtgaaaatgaactcat

SEQ ID NO: 9352 - DNA, 25 bp, Mus musculus
aaactagtggtgtaaatgaactcat

SEQ ID NO: 9353 - DNA, 25 bp, Mus musculus
aaactagttcccaactgagaggcac

SEQ ID NO: 9354 - DNA, 25 bp, Mus musculus
aaactagttccctactgagaggcac

SEQ ID NO: 9355 - DNA, 25 bp, Mus musculus
aaactagttgaacacagctgtattt

SEQ ID NO: 9356 - DNA, 25 bp, Mus musculus
aaactagttgaagacagctgtattt

SEQ ID NO: 9357 - DNA, 25 bp, Mus musculus
aaactagtttggatgctttggctta

SEQ ID NO: 9358 - DNA, 25 bp, Mus musculus
aaactagtttggttgctttggctta

SEQ ID NO: 9359 - DNA, 25 bp, Mus musculus
aaactataattcatctgtcctgtct

SEQ ID NO: 9360 - DNA, 25 bp, Mus musculus
aaactataattcttctgtcctgtct

SEQ ID NO: 9361 - DNA, 25 bp, Mus musculus
aaactataatttctgcatccttctt

SEQ ID NO: 9362 - DNA, 25 bp, Mus musculus
aaactataatttgtgcatccttctt

SEQ ID NO: 9363 - DNA, 25 bp, Mus musculus
aaactatagaatatgccaagcctca

SEQ ID NO: 9364 - DNA, 25 bp, Mus musculus
aaactatagaatttgccaagcctca

SEQ ID NO: 9365 - DNA, 25 bp, Mus musculus
aaactatatatgagctccctggaaa

SEQ ID NO: 9366 - DNA, 25 bp, Mus musculus
aaactatatatgtgctccctggaaa

SEQ ID NO: 9367 - DNA, 25 bp, Mus musculus
aaactatatttgacgctacttcata

SEQ ID NO: 9368 - DNA, 25 bp, Mus musculus
aaactatatttgtcgctacttcata

SEQ ID NO: 9369 - DNA, 25 bp, Mus musculus
aaactatccagcacttattttgatt

SEQ ID NO: 9370 - DNA, 25 bp, Mus musculus
aaactatccagctcttattttgatt

SEQ ID NO: 9371 - DNA, 25 bp, Mus musculus
aaactatccatgctttgctgatcct

SEQ ID NO: 9372 - DNA, 25 bp, Mus musculus
aaactatccatggtttgctgatcct

SEQ ID NO: 9373 - DNA, 25 bp, Mus musculus
aaactatcccctcattggcagttga

SEQ ID NO: 9374 - DNA, 25 bp, Mus musculus
aaactatcccctgattggcagttga

SEQ ID NO: 9375 - DNA, 25 bp, Mus musculus
aaactatcggtaccttgactgttga

SEQ ID NO: 9376 - DNA, 25 bp, Mus musculus
aaactatcggtagcttgactgttga

SEQ ID NO: 9377 - DNA, 25 bp, Mus musculus
aaactatctaatactttcatatcaa

SEQ ID NO: 9378 - DNA, 25 bp, Mus musculus
aaactatctaattctttcatatcaa

SEQ ID NO: 9379 - DNA, 25 bp, Mus musculus
aaactatcttccaaagagcctgccg

SEQ ID NO: 9380 - DNA, 25 bp, Mus musculus
aaactatcttcctaagagcctgccg

SEQ ID NO: 9381 - DNA, 25 bp, Mus musculus
aaactatctttactcacagatgaca

SEQ ID NO: 9382 - DNA, 25 bp, Mus musculus
aaactatctttagtcacagatgaca

SEQ ID NO: 9383 - DNA, 25 bp, Mus musculus
aaactatgcaccagtcaagactgta

SEQ ID NO: 9384 - DNA, 25 bp, Mus musculus
aaactatgcacctgtcaagactgta

SEQ ID NO: 9385 - DNA, 25 bp, Mus musculus
aaactatgcatgcacggacacgtga

SEQ ID NO: 9386 - DNA, 25 bp, Mus musculus
aaactatgcatggacggacacgtga

SEQ ID NO: 9387 - DNA, 25 bp, Mus musculus
aaactatggaaaaaataccctacag

SEQ ID NO: 9388 - DNA, 25 bp, Mus musculus
aaactatggaaataataccctacag

SEQ ID NO: 9389 - DNA, 25 bp, Mus musculus
aaactatggcccctagctaagtggc

SEQ ID NO: 9390 - DNA, 25 bp, Mus musculus
aaactatggcccgtagctaagtggc

SEQ ID NO: 9391 - DNA, 25 bp, Mus musculus
aaactatgtgcacagaattggccgc

SEQ ID NO: 9392 - DNA, 25 bp, Mus musculus
aaactatgtgcactgctctttctgt

SEQ ID NO: 9393 - DNA, 25 bp, Mus musculus
aaactatgtgcagagaattggccgc

SEQ ID NO: 9394 - DNA, 25 bp, Mus musculus
aaactatgtgcagtgctctttctgt

SEQ ID NO: 9395 - DNA, 25 bp, Mus musculus
aaactatgtgtgatactgccctgta

SEQ ID NO: 9396 - DNA, 25 bp, Mus musculus
aaactatgtgtgttactgccctgta

SEQ ID NO: 9397 - DNA, 25 bp, Mus musculus
aaactatgtttaagcctactacaag

SEQ ID NO: 9398 - DNA, 25 bp, Mus musculus
aaactatgtttatgcctactacaag

SEQ ID NO: 9399 - DNA, 25 bp, Mus musculus
aaactatgttttagccatgtgtggc

SEQ ID NO: 9400 - DNA, 25 bp, Mus musculus
aaactatgtttttgccatgtgtggc

SEQ ID NO: 9401 - DNA, 25 bp, Mus musculus
aaactattcctacctccagttctag

SEQ ID NO: 9402 - DNA, 25 bp, Mus musculus
aaactattcctagctccagttctag

SEQ ID NO: 9403 - DNA, 25 bp, Mus musculus
aaactattctagacgcctgagctct

SEQ ID NO: 9404 - DNA, 25 bp, Mus musculus
aaactattctagtcgcctgagctct

SEQ ID NO: 9405 - DNA, 25 bp, Mus musculus
aaactattgaacatgtgtgtctgtg

SEQ ID NO: 9406 - DNA, 25 bp, Mus musculus
aaactattgaacttgtgtgtctgtg

SEQ ID NO: 9407 - DNA, 25 bp, Mus musculus
aaactatttacactgatctgggaga

SEQ ID NO: 9408 - DNA, 25 bp, Mus musculus
aaactatttacagtgatctgggaga

SEQ ID NO: 9409 - DNA, 25 bp, Mus musculus
aaactatttctcaataaccaggtga

SEQ ID NO: 9410 - DNA, 25 bp, Mus musculus
aaactatttctctataaccaggtga

SEQ ID NO: 9411 - DNA, 25 bp, Mus musculus
aaactattttgaacagccacactat

SEQ ID NO: 9412 - DNA, 25 bp, Mus musculus
aaactattttgatcagccacactat

SEQ ID NO: 9413 - DNA, 25 bp, Mus musculus
aaactcaaaagtccgctgggagcca

SEQ ID NO: 9414 - DNA, 25 bp, Mus musculus
aaactcaaaagtgcgctgggagcca

SEQ ID NO: 9415 - DNA, 25 bp, Mus musculus
aaactcaaatccacgtctcaaggac

SEQ ID NO: 9416 - DNA, 25 bp, Mus musculus
aaactcaaatcctcgtctcaaggac

SEQ ID NO: 9417 - DNA, 25 bp, Mus musculus
aaactcaacactaagtcaacaccag

SEQ ID NO: 9418 - DNA, 25 bp, Mus musculus
aaactcaacacttagtcaacaccag

SEQ ID NO: 9419 - DNA, 25 bp, Mus musculus
aaactcaaccaacctgtgatacgtg

SEQ ID NO: 9420 - DNA, 25 bp, Mus musculus
aaactcaaccaagctgtgatacgtg

SEQ ID NO: 9421 - DNA, 25 bp, Mus musculus
aaactcaagcggctggctttcatcg

SEQ ID NO: 9422 - DNA, 25 bp, Mus musculus
aaactcaagcgggtggctttcatcg

SEQ ID NO: 9423 - DNA, 25 bp, Mus musculus
aaactcaaggacaactattctcttc

SEQ ID NO: 9424 - DNA, 25 bp, Mus musculus
aaactcaaggactactattctcttc

SEQ ID NO: 9425 - DNA, 25 bp, Mus musculus
aaactcaagggcacggacccagaag

SEQ ID NO: 9426 - DNA, 25 bp, Mus musculus
aaactcaagggctcggacccagaag

SEQ ID NO: 9427 - DNA, 25 bp, Mus musculus
aaactcaagttgagcccagcagtgg

SEQ ID NO: 9428 - DNA, 25 bp, Mus musculus
aaactcaagttgtgcccagcagtgg

SEQ ID NO: 9429 - DNA, 25 bp, Mus musculus
aaactcaatcaacgccacactggtc

SEQ ID NO: 9430 - DNA, 25 bp, Mus musculus
aaactcaatcaaggccacactggtc

SEQ ID NO: 9431 - DNA, 25 bp, Mus musculus
aaactcaatcatccctcgttggatg

SEQ ID NO: 9432 - DNA, 25 bp, Mus musculus
aaactcaatcatgcctcgttggatg

SEQ ID NO: 9433 - DNA, 25 bp, Mus musculus
aaactcacaacgcatgtctctggag

SEQ ID NO: 9434 - DNA, 25 bp, Mus musculus
aaactcacaacggatgtctctggag

SEQ ID NO: 9435 - DNA, 25 bp, Mus musculus
aaactcacaaggagctcgggaagga

SEQ ID NO: 9436 - DNA, 25 bp, Mus musculus
aaactcacaaggtgctcgggaagga

SEQ ID NO: 9437 - DNA, 25 bp, Mus musculus
aaactcacaatcatgctttctcagc

SEQ ID NO: 9438 - DNA, 25 bp, Mus musculus
aaactcacaatcttgctttctcagc

SEQ ID NO: 9439 - DNA, 25 bp, Mus musculus
aaactcacacttctgcactagtatg

SEQ ID NO: 9440 - DNA, 25 bp, Mus musculus
aaactcacacttgtgcactagtatg

SEQ ID NO: 9441 - DNA, 25 bp, Mus musculus
aaactcacagttaacgccagcttaa

SEQ ID NO: 9442 - DNA, 25 bp, Mus musculus
aaactcacagttcaggtccaaatca

SEQ ID NO: 9443 - DNA, 25 bp, Mus musculus
aaactcacagttgaggtccaaatca

SEQ ID NO: 9444 - DNA, 25 bp, Mus musculus
aaactcacagtttacgccagcttaa

SEQ ID NO: 9445 - DNA, 25 bp, Mus musculus
aaactcacccacaaggaggtgctag

SEQ ID NO: 9446 - DNA, 25 bp, Mus musculus
aaactcacccactaggaggtgctag

SEQ ID NO: 9447 - DNA, 25 bp, Mus musculus
aaactcacccttatcaaacattgtg

SEQ ID NO: 9448 - DNA, 25 bp, Mus musculus
aaactcacccttttcaaacattgtg

SEQ ID NO: 9449 - DNA, 25 bp, Mus musculus
aaactcactgtcagaacccgtgcag

SEQ ID NO: 9450 - DNA, 25 bp, Mus musculus
aaactcactgtctgaacccgtgcag

SEQ ID NO: 9451 - DNA, 25 bp, Mus musculus
aaactcagacgtaccgagctccaaa

SEQ ID NO: 9452 - DNA, 25 bp, Mus musculus
aaactcagacgttccgagctccaaa

SEQ ID NO: 9453 - DNA, 25 bp, Mus musculus
aaactcagactgctttcgcgcaggc

SEQ ID NO: 9454 - DNA, 25 bp, Mus musculus
aaactcagactggtttcgcgcaggc

SEQ ID NO: 9455 - DNA, 25 bp, Mus musculus
aaactcagagagctcttcttctgcc

SEQ ID NO: 9456 - DNA, 25 bp, Mus musculus
aaactcagagaggtcttcttctgcc

SEQ ID NO: 9457 - DNA, 25 bp, Mus musculus
aaactcagcgttatgccaggcaggc

SEQ ID NO: 9458 - DNA, 25 bp, Mus musculus
aaactcagcgttttgccaggcaggc

SEQ ID NO: 9459 - DNA, 25 bp, Mus musculus
aaactcagctcactcacacttggca

SEQ ID NO: 9460 - DNA, 25 bp, Mus musculus
aaactcagctcagtcacacttggca

SEQ ID NO: 9461 - DNA, 25 bp, Mus musculus
aaactcagctggagtctctgtataa

SEQ ID NO: 9462 - DNA, 25 bp, Mus musculus
aaactcagctggtgtctctgtataa

SEQ ID NO: 9463 - DNA, 25 bp, Mus musculus
aaactcagcttcactaaacttgatg

SEQ ID NO: 9464 - DNA, 25 bp, Mus musculus
aaactcagcttctctaaacttgatg

SEQ ID NO: 9465 - DNA, 25 bp, Mus musculus
aaactcaggatacggttcacaagac

SEQ ID NO: 9466 - DNA, 25 bp, Mus musculus
aaactcaggatagggttcacaagac

SEQ ID NO: 9467 - DNA, 25 bp, Mus musculus
aaactcaggatcaggtacctgcctg

SEQ ID NO: 9468 - DNA, 25 bp, Mus musculus
aaactcaggatctggtacctgcctg

SEQ ID NO: 9469 - DNA, 25 bp, Mus musculus
aaactcaggatgaatggtccactgt

SEQ ID NO: 9470 - DNA, 25 bp, Mus musculus
aaactcaggatgtatggtccactgt

SEQ ID NO: 9471 - DNA, 25 bp, Mus musculus
aaactcagggtcacatgcatactaa

SEQ ID NO: 9472 - DNA, 25 bp, Mus musculus
aaactcagggtcattacagaattgc

SEQ ID NO: 9473 - DNA, 25 bp, Mus musculus
aaactcagggtctcatgcatactaa

SEQ ID NO: 9474 - DNA, 25 bp, Mus musculus
aaactcagggtctttacagaattgc

SEQ ID NO: 9475 - DNA, 25 bp, Mus musculus
aaactcagtcaaaaaatgggcaaat

SEQ ID NO: 9476 - DNA, 25 bp, Mus musculus
aaactcagtcaataaatgggcaaat

SEQ ID NO: 9477 - DNA, 25 bp, Mus musculus
aaactcagtccaacggtccatggaa

SEQ ID NO: 9478 - DNA, 25 bp, Mus musculus
aaactcagtccatcggtccatggaa

SEQ ID NO: 9479 - DNA, 25 bp, Mus musculus
aaactcagtctacgtctgtagtgtc

SEQ ID NO: 9480 - DNA, 25 bp, Mus musculus
aaactcagtctaggtctgtagtgtc

SEQ ID NO: 9481 - DNA, 25 bp, Mus musculus
aaactcagtctgaatctgtaaaggt

SEQ ID NO: 9482 - DNA, 25 bp, Mus musculus
aaactcagtctgtatctgtaaaggt

SEQ ID NO: 9483 - DNA, 25 bp, Mus musculus
aaactcagtgatctctgctttccta

SEQ ID NO: 9484 - DNA, 25 bp, Mus musculus
aaactcagtgatgtctgctttccta

SEQ ID NO: 9485 - DNA, 25 bp, Mus musculus
aaactcagtgccacagaagctttgg

SEQ ID NO: 9486 - DNA, 25 bp, Mus musculus
aaactcagtgcctcagaagctttgg

SEQ ID NO: 9487 - DNA, 25 bp, Mus musculus
aaactcagttaccaactgcatcctc

SEQ ID NO: 9488 - DNA, 25 bp, Mus musculus
aaactcagttacgaactgcatcctc

SEQ ID NO: 9489 - DNA, 25 bp, Mus musculus
aaactcataatgacaggctagtgtt

SEQ ID NO: 9490 - DNA, 25 bp, Mus musculus
aaactcataatgtcaggctagtgtt

SEQ ID NO: 9491 - DNA, 25 bp, Mus musculus
aaactcatagccctgtggacctagc

SEQ ID NO: 9492 - DNA, 25 bp, Mus musculus
aaactcatagccgtgtggacctagc

SEQ ID NO: 9493 - DNA, 25 bp, Mus musculus
aaactcatagctcgcagtgttttgt

SEQ ID NO: 9494 - DNA, 25 bp, Mus musculus
aaactcatagctggcagtgttttgt

SEQ ID NO: 9495 - DNA, 25 bp, Mus musculus
aaactcatcagccagttggaaattg

SEQ ID NO: 9496 - DNA, 25 bp, Mus musculus
aaactcatcagcgagttggaaattg

SEQ ID NO: 9497 - DNA, 25 bp, Mus musculus
aaactcatcatacccttggcctagc

SEQ ID NO: 9498 - DNA, 25 bp, Mus musculus
aaactcatcatagccttggcctagc

SEQ ID NO: 9499 - DNA, 25 bp, Mus musculus
aaactcatccggaatccaggcagtc

SEQ ID NO: 9500 - DNA, 25 bp, Mus musculus
aaactcatccggtatccaggcagtc

SEQ ID NO: 9501 - DNA, 25 bp, Mus musculus
aaactcatccttattcctagcatag

SEQ ID NO: 9502 - DNA, 25 bp, Mus musculus
aaactcatcctttttcctagcatag

SEQ ID NO: 9503 - DNA, 25 bp, Mus musculus
aaactcatcgccatgagtcagcaga

SEQ ID NO: 9504 - DNA, 25 bp, Mus musculus
aaactcatcgccttgagtcagcaga

SEQ ID NO: 9505 - DNA, 25 bp, Mus musculus
aaactcatcgtccagcaaactcctg

SEQ ID NO: 9506 - DNA, 25 bp, Mus musculus
aaactcatcgtcgagcaaactcctg

SEQ ID NO: 9507 - DNA, 25 bp, Mus musculus
aaactcatcttaacaggagggctaa

SEQ ID NO: 9508 - DNA, 25 bp, Mus musculus
aaactcatcttacaagtctttaaag

SEQ ID NO: 9509 - DNA, 25 bp, Mus musculus
aaactcatcttagaagtctttaaag

SEQ ID NO: 9510 - DNA, 25 bp, Mus musculus
aaactcatcttatcaggagggctaa

SEQ ID NO: 9511 - DNA, 25 bp, Mus musculus
aaactcatctttcagaagcgtccgc

SEQ ID NO: 9512 - DNA, 25 bp, Mus musculus
aaactcatctttgagaagcgtccgc

SEQ ID NO: 9513 - DNA, 25 bp, Mus musculus
aaactcatgactaatctttgtgcaa

SEQ ID NO: 9514 - DNA, 25 bp, Mus musculus
aaactcatgacttatctttgtgcaa

SEQ ID NO: 9515 - DNA, 25 bp, Mus musculus
aaactcatggcgaccccaggcctgg

SEQ ID NO: 9516 - DNA, 25 bp, Mus musculus
aaactcatggcgtccccaggcctgg

SEQ ID NO: 9517 - DNA, 25 bp, Mus musculus
aaactcatggctatgtgcatcggaa

SEQ ID NO: 9518 - DNA, 25 bp, Mus musculus
aaactcatggctttgtgcatcggaa

SEQ ID NO: 9519 - DNA, 25 bp, Mus musculus
aaactcatggttcgtccctctgctt

SEQ ID NO: 9520 - DNA, 25 bp, Mus musculus
aaactcatggttggtccctctgctt

SEQ ID NO: 9521 - DNA, 25 bp, Mus musculus
aaactcatgttccttggcatacacc

SEQ ID NO: 9522 - DNA, 25 bp, Mus musculus
aaactcatgttcgttggcatacacc

SEQ ID NO: 9523 - DNA, 25 bp, Mus musculus
aaactcattgagatcccaagggtgg

SEQ ID NO: 9524 - DNA, 25 bp, Mus musculus
aaactcattgagttcccaagggtgg

SEQ ID NO: 9525 - DNA, 25 bp, Mus musculus
aaactcattgttatgtactctaatt

SEQ ID NO: 9526 - DNA, 25 bp, Mus musculus
aaactcattgttttgtactctaatt

SEQ ID NO: 9527 - DNA, 25 bp, Mus musculus
aaactcattttgctctcagaaacct

SEQ ID NO: 9528 - DNA, 25 bp, Mus musculus
aaactcattttggtctcagaaacct

SEQ ID NO: 9529 - DNA, 25 bp, Mus musculus
aaactccaagtgaaagtcaagtcct

SEQ ID NO: 9530 - DNA, 25 bp, Mus musculus
aaactccaagtgtaagtcaagtcct

SEQ ID NO: 9531 - DNA, 25 bp, Mus musculus
aaactccaattccatgcctaacttg

SEQ ID NO: 9532 - DNA, 25 bp, Mus musculus
aaactccaattcgatgcctaacttg

SEQ ID NO: 9533 - DNA, 25 bp, Mus musculus
aaactccaccaactatgcggttgaa

SEQ ID NO: 9534 - DNA, 25 bp, Mus musculus
aaactccaccaagtatgcggttgaa

SEQ ID NO: 9535 - DNA, 25 bp, Mus musculus
aaactccaccatagtcttccctctg

SEQ ID NO: 9536 - DNA, 25 bp, Mus musculus
aaactccaccattgtcttccctctg

SEQ ID NO: 9537 - DNA, 25 bp, Mus musculus
aaactccaccggctctgatggctgt

SEQ ID NO: 9538 - DNA, 25 bp, Mus musculus
aaactccaccgggtctgatggctgt

SEQ ID NO: 9539 - DNA, 25 bp, Mus musculus
aaactccactcacgtttcggcagag

SEQ ID NO: 9540 - DNA, 25 bp, Mus musculus
aaactccactcaggtttcggcagag

SEQ ID NO: 9541 - DNA, 25 bp, Mus musculus
aaactccactgaaaactgcggcatc

SEQ ID NO: 9542 - DNA, 25 bp, Mus musculus
aaactccactgataactgcggcatc

SEQ ID NO: 9543 - DNA, 25 bp, Mus musculus
aaactccagcgaacacaaggtccct

SEQ ID NO: 9544 - DNA, 25 bp, Mus musculus
aaactccagcgatcacaaggtccct

SEQ ID NO: 9545 - DNA, 25 bp, Mus musculus
aaactccagctcacaggtagtacaa

SEQ ID NO: 9546 - DNA, 25 bp, Mus musculus
aaactccagctctcaggtagtacaa

SEQ ID NO: 9547 - DNA, 25 bp, Mus musculus
aaactccagctgagaaagcaacata

SEQ ID NO: 9548 - DNA, 25 bp, Mus musculus
aaactccagctgtgaaagcaacata

SEQ ID NO: 9549 - DNA, 25 bp, Mus musculus
aaactccaggacaagacatcggctc

SEQ ID NO: 9550 - DNA, 25 bp, Mus musculus
aaactccaggactagacatcggctc

SEQ ID NO: 9551 - DNA, 25 bp, Mus musculus
aaactccaggctcactgccttcagg

SEQ ID NO: 9552 - DNA, 25 bp, Mus musculus
aaactccaggctgactgccttcagg

SEQ ID NO: 9553 - DNA, 25 bp, Mus musculus
aaactccaggttacatgaagctatt

SEQ ID NO: 9554 - DNA, 25 bp, Mus musculus
aaactccaggtttcatgaagctatt

SEQ ID NO: 9555 - DNA, 25 bp, Mus musculus
aaactccagtttattggtgccctgc

SEQ ID NO: 9556 - DNA, 25 bp, Mus musculus
aaactccagttttttggtgccctgc

SEQ ID NO: 9557 - DNA, 25 bp, Mus musculus
aaactccatacaattgcaggccata

SEQ ID NO: 9558 - DNA, 25 bp, Mus musculus
aaactccatacatttgcaggccata

SEQ ID NO: 9559 - DNA, 25 bp, Mus musculus
aaactccatgctatctgacagacta

SEQ ID NO: 9560 - DNA, 25 bp, Mus musculus
aaactccatgctttctgacagacta

SEQ ID NO: 9561 - DNA, 25 bp, Mus musculus
aaactccatggaagaccactttggt

SEQ ID NO: 9562 - DNA, 25 bp, Mus musculus
aaactccatggatgaccactttggt

SEQ ID NO: 9563 - DNA, 25 bp, Mus musculus
aaactccatgttaagatgaagcatt

SEQ ID NO: 9564 - DNA, 25 bp, Mus musculus
aaactccatgtttagatgaagcatt

SEQ ID NO: 9565 - DNA, 25 bp, Mus musculus
aaactccattcgacacacttggtgg

SEQ ID NO: 9566 - DNA, 25 bp, Mus musculus
aaactccattcgtcacacttggtgg

SEQ ID NO: 9567 - DNA, 25 bp, Mus musculus
aaactccattgcatgttagcatcag

SEQ ID NO: 9568 - DNA, 25 bp, Mus musculus
aaactccattgcttgttagcatcag

SEQ ID NO: 9569 - DNA, 25 bp, Mus musculus
aaactcccaaatcaacctcggctgt

SEQ ID NO: 9570 - DNA, 25 bp, Mus musculus
aaactcccaaatgaacctcggctgt

SEQ ID NO: 9571 - DNA, 25 bp, Mus musculus
aaactcccacgtccagtgcactgat

SEQ ID NO: 9572 - DNA, 25 bp, Mus musculus
aaactcccacgtgcagtgcactgat

SEQ ID NO: 9573 - DNA, 25 bp, Mus musculus
aaactcccatgccatatttcatagg

SEQ ID NO: 9574 - DNA, 25 bp, Mus musculus
aaactcccatgcgatatttcatagg

SEQ ID NO: 9575 - DNA, 25 bp, Mus musculus
aaactccccagtactagtctgcagg

SEQ ID NO: 9576 - DNA, 25 bp, Mus musculus
aaactccccagttctagtctgcagg

SEQ ID NO: 9577 - DNA, 25 bp, Mus musculus
aaactcccctttctctaatagcaag

SEQ ID NO: 9578 - DNA, 25 bp, Mus musculus
aaactcccctttgtctaatagcaag

SEQ ID NO: 9579 - DNA, 25 bp, Mus musculus
aaactcccgagaaggctttgcatga

SEQ ID NO: 9580 - DNA, 25 bp, Mus musculus
aaactcccgagatggctttgcatga

SEQ ID NO: 9581 - DNA, 25 bp, Mus musculus
aaactccctattaattgcccttctg

SEQ ID NO: 9582 - DNA, 25 bp, Mus musculus
aaactccctatttattgcccttctg

SEQ ID NO: 9583 - DNA, 25 bp, Mus musculus
aaactccctctgatacacgggccag

SEQ ID NO: 9584 - DNA, 25 bp, Mus musculus
aaactccctctgttacacgggccag

SEQ ID NO: 9585 - DNA, 25 bp, Mus musculus
aaactccgagagactttctgctaat

SEQ ID NO: 9586 - DNA, 25 bp, Mus musculus
aaactccgagagtctttctgctaat

SEQ ID NO: 9587 - DNA, 25 bp, Mus musculus
aaactccgcttacagatcttaaaag

SEQ ID NO: 9588 - DNA, 25 bp, Mus musculus
aaactccgcttagagatcttaaaag

SEQ ID NO: 9589 - DNA, 25 bp, Mus musculus
aaactccggctcagcttcaaggatt

SEQ ID NO: 9590 - DNA, 25 bp, Mus musculus
aaactccggctctgcttcaaggatt

SEQ ID NO: 9591 - DNA, 25 bp, Mus musculus
aaactccgggagctctgcaattgcc

SEQ ID NO: 9592 - DNA, 25 bp, Mus musculus
aaactccgggaggtctgcaattgcc

SEQ ID NO: 9593 - DNA, 25 bp, Mus musculus
aaactccggtccacagtgaaagtct

SEQ ID NO: 9594 - DNA, 25 bp, Mus musculus
aaactccggtcctcagtgaaagtct

SEQ ID NO: 9595 - DNA, 25 bp, Mus musculus
aaactccgtcgtcagatctacaagg

SEQ ID NO: 9596 - DNA, 25 bp, Mus musculus
aaactccgtcgtgagatctacaagg

SEQ ID NO: 9597 - DNA, 25 bp, Mus musculus
aaactccgtcttcatgtttaccatg

SEQ ID NO: 9598 - DNA, 25 bp, Mus musculus
aaactccgtcttgatgtttaccatg

SEQ ID NO: 9599 - DNA, 25 bp, Mus musculus
aaactcctagggagccacagacttc

SEQ ID NO: 9600 - DNA, 25 bp, Mus musculus
aaactcctagggtgccacagacttc

SEQ ID NO: 9601 - DNA, 25 bp, Mus musculus
aaactcctcaaacaatccggtgcaa

SEQ ID NO: 9602 - DNA, 25 bp, Mus musculus
aaactcctcaaagaatccggtgcaa

SEQ ID NO: 9603 - DNA, 25 bp, Mus musculus
aaactcctcacactcctgtgtgaag

SEQ ID NO: 9604 - DNA, 25 bp, Mus musculus
aaactcctcacagtcctgtgtgaag

SEQ ID NO: 9605 - DNA, 25 bp, Mus musculus
aaactcctcagtagcccaaaggcat

SEQ ID NO: 9606 - DNA, 25 bp, Mus musculus
aaactcctcagttgcccaaaggcat

SEQ ID NO: 9607 - DNA, 25 bp, Mus musculus
aaactcctccctagccaaagattag

SEQ ID NO: 9608 - DNA, 25 bp, Mus musculus
aaactcctcccttgccaaagattag

SEQ ID NO: 9609 - DNA, 25 bp, Mus musculus
aaactcctccttaagtgtagcctgt

SEQ ID NO: 9610 - DNA, 25 bp, Mus musculus
aaactcctcctttagtgtagcctgt

SEQ ID NO: 9611 - DNA, 25 bp, Mus musculus
aaactcctctgccattcagaaaggc

SEQ ID NO: 9612 - DNA, 25 bp, Mus musculus
aaactcctctgcgattcagaaaggc

SEQ ID NO: 9613 - DNA, 25 bp, Mus musculus
aaactcctgagtacctctttggcgg

SEQ ID NO: 9614 - DNA, 25 bp, Mus musculus
aaactcctgagttcctctttggcgg

SEQ ID NO: 9615 - DNA, 25 bp, Mus musculus
aaactcctgatcagagaagcacaat

SEQ ID NO: 9616 - DNA, 25 bp, Mus musculus
aaactcctgatctgagaagcacaat

SEQ ID NO: 9617 - DNA, 25 bp, Mus musculus
aaactcctgattccgtgtcttgaaa

SEQ ID NO: 9618 - DNA, 25 bp, Mus musculus
aaactcctgattgcgtgtcttgaaa

SEQ ID NO: 9619 - DNA, 25 bp, Mus musculus
aaactcctgctaacagatgtgttaa

SEQ ID NO: 9620 - DNA, 25 bp, Mus musculus
aaactcctgctatcagatgtgttaa

SEQ ID NO: 9621 - DNA, 25 bp, Mus musculus
aaactcctggccaaactcatgctgg

SEQ ID NO: 9622 - DNA, 25 bp, Mus musculus
aaactcctggcctaactcatgctgg

SEQ ID NO: 9623 - DNA, 25 bp, Mus musculus
aaactcctgggcaaagtatctgaca

SEQ ID NO: 9624 - DNA, 25 bp, Mus musculus
aaactcctgggctaagtatctgaca

SEQ ID NO: 9625 - DNA, 25 bp, Mus musculus
aaactcctgtcacttgctggatgtc

SEQ ID NO: 9626 - DNA, 25 bp, Mus musculus
aaactcctgtcagttgctggatgtc

SEQ ID NO: 9627 - DNA, 25 bp, Mus musculus
aaactccttaatccaatccgtgcat

SEQ ID NO: 9628 - DNA, 25 bp, Mus musculus
aaactccttaatgcaatccgtgcat

SEQ ID NO: 9629 - DNA, 25 bp, Mus musculus
aaactccttcggcattgagaccatc

SEQ ID NO: 9630 - DNA, 25 bp, Mus musculus
aaactccttcgggattgagaccatc

SEQ ID NO: 9631 - DNA, 25 bp, Mus musculus
aaactccttcttatgtcaaagagca

SEQ ID NO: 9632 - DNA, 25 bp, Mus musculus
aaactccttcttttgtcaaagagca

SEQ ID NO: 9633 - DNA, 25 bp, Mus musculus
aaactccttgctaagtgaggttcag

SEQ ID NO: 9634 - DNA, 25 bp, Mus musculus
aaactccttgcttagtgaggttcag

SEQ ID NO: 9635 - DNA, 25 bp, Mus musculus
aaactccttggaactttcaattgtg

SEQ ID NO: 9636 - DNA, 25 bp, Mus musculus
aaactccttggatctttcaattgtg

SEQ ID NO: 9637 - DNA, 25 bp, Mus musculus
aaactcctttgaagaccatatagct

SEQ ID NO: 9638 - DNA, 25 bp, Mus musculus
aaactcctttgatgaccatatagct

SEQ ID NO: 9639 - DNA, 25 bp, Mus musculus
aaactcctttggcttggttctctag

SEQ ID NO: 9640 - DNA, 25 bp, Mus musculus
aaactcctttgggttggttctctag

SEQ ID NO: 9641 - DNA, 25 bp, Mus musculus
aaactcgaaatgatctgcccatctc

SEQ ID NO: 9642 - DNA, 25 bp, Mus musculus
aaactcgaaatgttctgcccatctc

SEQ ID NO: 9643 - DNA, 25 bp, Mus musculus
aaactcgacagaaactggagaagcc

SEQ ID NO: 9644 - DNA, 25 bp, Mus musculus
aaactcgacagatactggagaagcc

SEQ ID NO: 9645 - DNA, 25 bp, Mus musculus
aaactcgacagcctacggaacagaa

SEQ ID NO: 9646 - DNA, 25 bp, Mus musculus
aaactcgacagcgtacggaacagaa

SEQ ID NO: 9647 - DNA, 25 bp, Mus musculus
aaactcgacctgcacaatttcacct

SEQ ID NO: 9648 - DNA, 25 bp, Mus musculus
aaactcgacctggacaatttcacct

SEQ ID NO: 9649 - DNA, 25 bp, Mus musculus
aaactcgacgcacagctgtgggctg

SEQ ID NO: 9650 - DNA, 25 bp, Mus musculus
aaactcgacgcagagctgtgggctg

SEQ ID NO: 9651 - DNA, 25 bp, Mus musculus
aaactcgagcttccgccgctcggat

SEQ ID NO: 9652 - DNA, 25 bp, Mus musculus
aaactcgagcttgcgccgctcggat

SEQ ID NO: 9653 - DNA, 25 bp, Mus musculus
aaactcgagtacaggcaggcaattc

SEQ ID NO: 9654 - DNA, 25 bp, Mus musculus
aaactcgagtactggcaggcaattc

SEQ ID NO: 9655 - DNA, 25 bp, Mus musculus
aaactcgagtgtcaggtccagctgc

SEQ ID NO: 9656 - DNA, 25 bp, Mus musculus
aaactcgagtgtgaggtccagctgc

SEQ ID NO: 9657 - DNA, 25 bp, Mus musculus
aaactcgccgtgatatctgccgata

SEQ ID NO: 9658 - DNA, 25 bp, Mus musculus
aaactcgccgtgttatctgccgata

SEQ ID NO: 9659 - DNA, 25 bp, Mus musculus
aaactcggaattccatatgtaatag

SEQ ID NO: 9660 - DNA, 25 bp, Mus musculus
aaactcggaattgcatatgtaatag

SEQ ID NO: 9661 - DNA, 25 bp, Mus musculus
aaactcgggacacctcagggctagc

SEQ ID NO: 9662 - DNA, 25 bp, Mus musculus
aaactcgggacagctcagggctagc

SEQ ID NO: 9663 - DNA, 25 bp, Mus musculus
aaactcgggagtatctgggcagaca

SEQ ID NO: 9664 - DNA, 25 bp, Mus musculus
aaactcgggagtttctgggcagaca

SEQ ID NO: 9665 - DNA, 25 bp, Mus musculus
aaactcgggatcaccggccagcaag

SEQ ID NO: 9666 - DNA, 25 bp, Mus musculus
aaactcgggatctccggccagcaag

SEQ ID NO: 9667 - DNA, 25 bp, Mus musculus
aaactcgggccgactttgactgcag

SEQ ID NO: 9668 - DNA, 25 bp, Mus musculus
aaactcgggccgtctttgactgcag

SEQ ID NO: 9669 - DNA, 25 bp, Mus musculus
aaactcggtgtgagctgttccctca

SEQ ID NO: 9670 - DNA, 25 bp, Mus musculus
aaactcggtgtgtgctgttccctca

SEQ ID NO: 9671 - DNA, 25 bp, Mus musculus
aaactcggtttgaaggcctgtgtct

SEQ ID NO: 9672 - DNA, 25 bp, Mus musculus
aaactcggtttgtaggcctgtgtct

SEQ ID NO: 9673 - DNA, 25 bp, Mus musculus
aaactcgtacgacgctgaactgtaa

SEQ ID NO: 9674 - DNA, 25 bp, Mus musculus
aaactcgtacgaggctgaactgtaa

SEQ ID NO: 9675 - DNA, 25 bp, Mus musculus
aaactcgtagatctgtatttctagt

SEQ ID NO: 9676 - DNA, 25 bp, Mus musculus
aaactcgtagatgtgtatttctagt

SEQ ID NO: 9677 - DNA, 25 bp, Mus musculus
aaactcgtagtgctgatgaaccaat

SEQ ID NO: 9678 - DNA, 25 bp, Mus musculus
aaactcgtagtggtgatgaaccaat

SEQ ID NO: 9679 - DNA, 25 bp, Mus musculus
aaactcgtgcttagacttttccaca

SEQ ID NO: 9680 - DNA, 25 bp, Mus musculus
aaactcgtgctttgacttttccaca

SEQ ID NO: 9681 - DNA, 25 bp, Mus musculus
aaactctaaatcactgccagaactg

SEQ ID NO: 9682 - DNA, 25 bp, Mus musculus
aaactctaaatctctgccagaactg

SEQ ID NO: 9683 - DNA, 25 bp, Mus musculus
aaactctaactgaatttccctagtg

SEQ ID NO: 9684 - DNA, 25 bp, Mus musculus
aaactctaactgtatttccctagtg

SEQ ID NO: 9685 - DNA, 25 bp, Mus musculus
aaactctactatcagctgcttcaaa

SEQ ID NO: 9686 - DNA, 25 bp, Mus musculus
aaactctactatgagctgcttcaaa

SEQ ID NO: 9687 - DNA, 25 bp, Mus musculus
aaactctagctacttggctgaccag

SEQ ID NO: 9688 - DNA, 25 bp, Mus musculus
aaactctagctagttggctgaccag

SEQ ID NO: 9689 - DNA, 25 bp, Mus musculus
aaactctaggttctctcaaaataca

SEQ ID NO: 9690 - DNA, 25 bp, Mus musculus
aaactctaggttgtctcaaaataca

SEQ ID NO: 9691 - DNA, 25 bp, Mus musculus
aaactctatagtctgttactcgtgt

SEQ ID NO: 9692 - DNA, 25 bp, Mus musculus
aaactctatagtgtgttactcgtgt

SEQ ID NO: 9693 - DNA, 25 bp, Mus musculus
aaactctattgaatgagctccctcc

SEQ ID NO: 9694 - DNA, 25 bp, Mus musculus
aaactctattgattgagctccctcc

SEQ ID NO: 9695 - DNA, 25 bp, Mus musculus
aaactctcaagcctcaaatacctag

SEQ ID NO: 9696 - DNA, 25 bp, Mus musculus
aaactctcaagcctccttatattgc

SEQ ID NO: 9697 - DNA, 25 bp, Mus musculus
aaactctcaagcgtcaaatacctag

SEQ ID NO: 9698 - DNA, 25 bp, Mus musculus
aaactctcaagcgtccttatattgc

SEQ ID NO: 9699 - DNA, 25 bp, Mus musculus
aaactctcagagactgggactacta

SEQ ID NO: 9700 - DNA, 25 bp, Mus musculus
aaactctcagagtctgggactacta

SEQ ID NO: 9701 - DNA, 25 bp, Mus musculus
aaactctcagttcacttctcacata

SEQ ID NO: 9702 - DNA, 25 bp, Mus musculus
aaactctcagttgacttctcacata

SEQ ID NO: 9703 - DNA, 25 bp, Mus musculus
aaactctcatcaagatcacaggccc

SEQ ID NO: 9704 - DNA, 25 bp, Mus musculus
aaactctcatcatgatcacaggccc

SEQ ID NO: 9705 - DNA, 25 bp, Mus musculus
aaactctcccatatacctcttcttt

SEQ ID NO: 9706 - DNA, 25 bp, Mus musculus
aaactctcccatttacctcttcttt

SEQ ID NO: 9707 - DNA, 25 bp, Mus musculus
aaactctcccttagtaaatagctct

SEQ ID NO: 9708 - DNA, 25 bp, Mus musculus
aaactctccctttgtaaatagctct

SEQ ID NO: 9709 - DNA, 25 bp, Mus musculus
aaactctcctagctgaaccatttaa

SEQ ID NO: 9710 - DNA, 25 bp, Mus musculus
aaactctcctaggtgaaccatttaa

SEQ ID NO: 9711 - DNA, 25 bp, Mus musculus
aaactctcctatcatggcgatcagc

SEQ ID NO: 9712 - DNA, 25 bp, Mus musculus
aaactctcctatctgtaggctgcct

SEQ ID NO: 9713 - DNA, 25 bp, Mus musculus
aaactctcctatgatggcgatcagc

SEQ ID NO: 9714 - DNA, 25 bp, Mus musculus
aaactctcctatgtgtaggctgcct

SEQ ID NO: 9715 - DNA, 25 bp, Mus musculus
aaactctcctgacgtgtccgtgttc

SEQ ID NO: 9716 - DNA, 25 bp, Mus musculus
aaactctcctgaggtgtccgtgttc

SEQ ID NO: 9717 - DNA, 25 bp, Mus musculus
aaactctcgcaaccagtttgccatt

SEQ ID NO: 9718 - DNA, 25 bp, Mus musculus
aaactctcgcaagcagtttgccatt

SEQ ID NO: 9719 - DNA, 25 bp, Mus musculus
aaactctcgcacagtgtaggactca

SEQ ID NO: 9720 - DNA, 25 bp, Mus musculus
aaactctcgcactgtgtaggactca

SEQ ID NO: 9721 - DNA, 25 bp, Mus musculus
aaactctcgctccaagcatttgaga

SEQ ID NO: 9722 - DNA, 25 bp, Mus musculus
aaactctcgctcgaagcatttgaga

SEQ ID NO: 9723 - DNA, 25 bp, Mus musculus
aaactctctaccaatttcatacagc

SEQ ID NO: 9724 - DNA, 25 bp, Mus musculus
aaactctctacctatttcatacagc

SEQ ID NO: 9725 - DNA, 25 bp, Mus musculus
aaactctctccaaagtcttaagaag

SEQ ID NO: 9726 - DNA, 25 bp, Mus musculus
aaactctctccatagtcttaagaag

SEQ ID NO: 9727 - DNA, 25 bp, Mus musculus
aaactctctctacactggagtctcc

SEQ ID NO: 9728 - DNA, 25 bp, Mus musculus
aaactctctctagactggagtctcc

SEQ ID NO: 9729 - DNA, 25 bp, Mus musculus
aaactctctggaatcatacgcccaa

SEQ ID NO: 9730 - DNA, 25 bp, Mus musculus
aaactctctggattcatacgcccaa

SEQ ID NO: 9731 - DNA, 25 bp, Mus musculus
aaactctctgttatactactgctga

SEQ ID NO: 9732 - DNA, 25 bp, Mus musculus
aaactctctgttttactactgctga

SEQ ID NO: 9733 - DNA, 25 bp, Mus musculus
aaactctcttctaaacatccaacat

SEQ ID NO: 9734 - DNA, 25 bp, Mus musculus
aaactctcttcttaacatccaacat

SEQ ID NO: 9735 - DNA, 25 bp, Mus musculus
aaactctgaacactgcgctgtccta

SEQ ID NO: 9736 - DNA, 25 bp, Mus musculus
aaactctgaacagtgcgctgtccta

SEQ ID NO: 9737 - DNA, 25 bp, Mus musculus
aaactctgacctctcttaagaatgg

SEQ ID NO: 9738 - DNA, 25 bp, Mus musculus
aaactctgacctgtcttaagaatgg

SEQ ID NO: 9739 - DNA, 25 bp, Mus musculus
aaactctgactccagggctcattcc

SEQ ID NO: 9740 - DNA, 25 bp, Mus musculus
aaactctgactcgagggctcattcc

SEQ ID NO: 9741 - DNA, 25 bp, Mus musculus
aaactctgagccacggagacttgga

SEQ ID NO: 9742 - DNA, 25 bp, Mus musculus
aaactctgagcctcggagacttgga

SEQ ID NO: 9743 - DNA, 25 bp, Mus musculus
aaactctgattcctcagggagaagg

SEQ ID NO: 9744 - DNA, 25 bp, Mus musculus
aaactctgattcgtcagggagaagg

SEQ ID NO: 9745 - DNA, 25 bp, Mus musculus
aaactctgccttagtgattctatca

SEQ ID NO: 9746 - DNA, 25 bp, Mus musculus
aaactctgccttctgatgttaacgc

SEQ ID NO: 9747 - DNA, 25 bp, Mus musculus
aaactctgccttgtgatgttaacgc

SEQ ID NO: 9748 - DNA, 25 bp, Mus musculus
aaactctgcctttgtgattctatca

SEQ ID NO: 9749 - DNA, 25 bp, Mus musculus
aaactctgctccatacacttgtatt

SEQ ID NO: 9750 - DNA, 25 bp, Mus musculus
aaactctgctccttacacttgtatt

SEQ ID NO: 9751 - DNA, 25 bp, Mus musculus
aaactctgctgtctattggaggaga

SEQ ID NO: 9752 - DNA, 25 bp, Mus musculus
aaactctgctgtgtattggaggaga

SEQ ID NO: 9753 - DNA, 25 bp, Mus musculus
aaactctggatccaaaatgtggcat

SEQ ID NO: 9754 - DNA, 25 bp, Mus musculus
aaactctggatcgaaaatgtggcat

SEQ ID NO: 9755 - DNA, 25 bp, Mus musculus
aaactctggattaataggacatcca

SEQ ID NO: 9756 - DNA, 25 bp, Mus musculus
aaactctggatttataggacatcca

SEQ ID NO: 9757 - DNA, 25 bp, Mus musculus
aaactctgggaccagtttcctctgg

SEQ ID NO: 9758 - DNA, 25 bp, Mus musculus
aaactctgggacgagtttcctctgg

SEQ ID NO: 9759 - DNA, 25 bp, Mus musculus
aaactctgggccagctggtagcaca

SEQ ID NO: 9760 - DNA, 25 bp, Mus musculus
aaactctgggcctgctggtagcaca

SEQ ID NO: 9761 - DNA, 25 bp, Mus musculus
aaactctgggtacaaactgcaatag

SEQ ID NO: 9762 - DNA, 25 bp, Mus musculus
aaactctgggtagaaactgcaatag

SEQ ID NO: 9763 - DNA, 25 bp, Mus musculus
aaactctggtatccctgcagcaagc

SEQ ID NO: 9764 - DNA, 25 bp, Mus musculus
aaactctggtatgcctgcagcaagc

SEQ ID NO: 9765 - DNA, 25 bp, Mus musculus
aaactctgtattagctatgcaggga

SEQ ID NO: 9766 - DNA, 25 bp, Mus musculus
aaactctgtatttgctatgcaggga

SEQ ID NO: 9767 - DNA, 25 bp, Mus musculus
aaactctgtgagaaacttgctttag

SEQ ID NO: 9768 - DNA, 25 bp, Mus musculus
aaactctgtgagtaacttgctttag

SEQ ID NO: 9769 - DNA, 25 bp, Mus musculus
aaactctgtgtgcttcttaaggcaa

SEQ ID NO: 9770 - DNA, 25 bp, Mus musculus
aaactctgtgtggttcttaaggcaa

SEQ ID NO: 9771 - DNA, 25 bp, Mus musculus
aaactctgttagagtgatactgtca

SEQ ID NO: 9772 - DNA, 25 bp, Mus musculus
aaactctgttagtgtgatactgtca

SEQ ID NO: 9773 - DNA, 25 bp, Mus musculus
aaactctgttggacagcactgggca

SEQ ID NO: 9774 - DNA, 25 bp, Mus musculus
aaactctgttggtcagcactgggca

SEQ ID NO: 9775 - DNA, 25 bp, Mus musculus
aaactctgtttgcttgtccaacttg

SEQ ID NO: 9776 - DNA, 25 bp, Mus musculus
aaactctgtttggttgtccaacttg

SEQ ID NO: 9777 - DNA, 25 bp, Mus musculus
aaactctgttttcgaccacagcctg

SEQ ID NO: 9778 - DNA, 25 bp, Mus musculus
aaactctgttttggaccacagcctg

SEQ ID NO: 9779 - DNA, 25 bp, Mus musculus
aaactcttaagcacatcactaaagt

SEQ ID NO: 9780 - DNA, 25 bp, Mus musculus
aaactcttaagctcatcactaaagt

SEQ ID NO: 9781 - DNA, 25 bp, Mus musculus
aaactcttaatgacccggtcgatga

SEQ ID NO: 9782 - DNA, 25 bp, Mus musculus
aaactcttaatgtcccggtcgatga

SEQ ID NO: 9783 - DNA, 25 bp, Mus musculus
aaactcttcaaacggcttgtggact

SEQ ID NO: 9784 - DNA, 25 bp, Mus musculus
aaactcttcaaagggcttgtggact

SEQ ID NO: 9785 - DNA, 25 bp, Mus musculus
aaactcttcacgagtgttgtcacca

SEQ ID NO: 9786 - DNA, 25 bp, Mus musculus
aaactcttcacgtgtgttgtcacca

SEQ ID NO: 9787 - DNA, 25 bp, Mus musculus
aaactcttcactacttttatatatg

SEQ ID NO: 9788 - DNA, 25 bp, Mus musculus
aaactcttcacttcttttatatatg

SEQ ID NO: 9789 - DNA, 25 bp, Mus musculus
aaactcttcctcaggcctgagagaa

SEQ ID NO: 9790 - DNA, 25 bp, Mus musculus
aaactcttcctctggcctgagagaa

SEQ ID NO: 9791 - DNA, 25 bp, Mus musculus
aaactcttgctgctggaatttggaa

SEQ ID NO: 9792 - DNA, 25 bp, Mus musculus
aaactcttgctggtggaatttggaa

SEQ ID NO: 9793 - DNA, 25 bp, Mus musculus
aaactctttagtcgctgtagaccta

SEQ ID NO: 9794 - DNA, 25 bp, Mus musculus
aaactctttagtggctgtagaccta

SEQ ID NO: 9795 - DNA, 25 bp, Mus musculus
aaactctttctcacagactttccct

SEQ ID NO: 9796 - DNA, 25 bp, Mus musculus
aaactctttctctcagactttccct

SEQ ID NO: 9797 - DNA, 25 bp, Mus musculus
aaactctttcttcactggtcattcc

SEQ ID NO: 9798 - DNA, 25 bp, Mus musculus
aaactctttcttgactggtcattcc

SEQ ID NO: 9799 - DNA, 25 bp, Mus musculus
aaactctttggcagagtgctcacca

SEQ ID NO: 9800 - DNA, 25 bp, Mus musculus
aaactctttggctgagtgctcacca

SEQ ID NO: 9801 - DNA, 25 bp, Mus musculus
aaactgaaacagactcttgttcaag

SEQ ID NO: 9802 - DNA, 25 bp, Mus musculus
aaactgaaacagtctcttgttcaag

SEQ ID NO: 9803 - DNA, 25 bp, Mus musculus
aaactgaagatcatccttccctcga

SEQ ID NO: 9804 - DNA, 25 bp, Mus musculus
aaactgaagatcttccttccctcga

SEQ ID NO: 9805 - DNA, 25 bp, Mus musculus
aaactgaagcatactacttcctccc

SEQ ID NO: 9806 - DNA, 25 bp, Mus musculus
aaactgaagcattctacttcctccc

SEQ ID NO: 9807 - DNA, 25 bp, Mus musculus
aaactgaaggacagtggcaatattt

SEQ ID NO: 9808 - DNA, 25 bp, Mus musculus
aaactgaaggactgtggcaatattt

SEQ ID NO: 9809 - DNA, 25 bp, Mus musculus
aaactgaagtttctctttgctccta

SEQ ID NO: 9810 - DNA, 25 bp, Mus musculus
aaactgaagtttgtctttgctccta

SEQ ID NO: 9811 - DNA, 25 bp, Mus musculus
aaactgaatcctcctggttaggtag

SEQ ID NO: 9812 - DNA, 25 bp, Mus musculus
aaactgaatcctgctggttaggtag

SEQ ID NO: 9813 - DNA, 25 bp, Mus musculus
aaactgaatttcaagcggctgggag

SEQ ID NO: 9814 - DNA, 25 bp, Mus musculus
aaactgaatttctagcggctgggag

SEQ ID NO: 9815 - DNA, 25 bp, Mus musculus
aaactgaattttatcttacacctat

SEQ ID NO: 9816 - DNA, 25 bp, Mus musculus
aaactgaattttttcttacacctat

SEQ ID NO: 9817 - DNA, 25 bp, Mus musculus
aaactgacaatgatgctggatgcta

SEQ ID NO: 9818 - DNA, 25 bp, Mus musculus
aaactgacaatgttgctggatgcta

SEQ ID NO: 9819 - DNA, 25 bp, Mus musculus
aaactgacacctatgttagccacct

SEQ ID NO: 9820 - DNA, 25 bp, Mus musculus
aaactgacacctttgttagccacct

SEQ ID NO: 9821 - DNA, 25 bp, Mus musculus
aaactgacagacatggtgtcccaaa

SEQ ID NO: 9822 - DNA, 25 bp, Mus musculus
aaactgacagacttggtgtcccaaa

SEQ ID NO: 9823 - DNA, 25 bp, Mus musculus
aaactgacagccattcctgtttctg

SEQ ID NO: 9824 - DNA, 25 bp, Mus musculus
aaactgacagcctttcctgtttctg

SEQ ID NO: 9825 - DNA, 25 bp, Mus musculus
aaactgacagctacactatgatacg

SEQ ID NO: 9826 - DNA, 25 bp, Mus musculus
aaactgacagcttcactatgatacg

SEQ ID NO: 9827 - DNA, 25 bp, Mus musculus
aaactgacatagcaagcctctgctt

SEQ ID NO: 9828 - DNA, 25 bp, Mus musculus
aaactgacataggaagcctctgctt

SEQ ID NO: 9829 - DNA, 25 bp, Mus musculus
aaactgacatgtacgcagcagtgct

SEQ ID NO: 9830 - DNA, 25 bp, Mus musculus
aaactgacatgttcgcagcagtgct

SEQ ID NO: 9831 - DNA, 25 bp, Mus musculus
aaactgaccaagagactccttcatg

SEQ ID NO: 9832 - DNA, 25 bp, Mus musculus
aaactgaccaagtgactccttcatg

SEQ ID NO: 9833 - DNA, 25 bp, Mus musculus
aaactgaccatcatctgaagtctgc

SEQ ID NO: 9834 - DNA, 25 bp, Mus musculus
aaactgaccatcttctgaagtctgc

SEQ ID NO: 9835 - DNA, 25 bp, Mus musculus
aaactgaccctgacaagggctgcag

SEQ ID NO: 9836 - DNA, 25 bp, Mus musculus
aaactgaccctgtcaagggctgcag

SEQ ID NO: 9837 - DNA, 25 bp, Mus musculus
aaactgacccttcatgcacatcatg

SEQ ID NO: 9838 - DNA, 25 bp, Mus musculus
aaactgacccttgatgcacatcatg

SEQ ID NO: 9839 - DNA, 25 bp, Mus musculus
aaactgaccggtatggctgcctttt

SEQ ID NO: 9840 - DNA, 25 bp, Mus musculus
aaactgaccggtttggctgcctttt

SEQ ID NO: 9841 - DNA, 25 bp, Mus musculus
aaactgacctctctaccgaattcat

SEQ ID NO: 9842 - DNA, 25 bp, Mus musculus
aaactgacctctgtaccgaattcat

SEQ ID NO: 9843 - DNA, 25 bp, Mus musculus
aaactgacgaaacagcctcgtggtt

SEQ ID NO: 9844 - DNA, 25 bp, Mus musculus
aaactgacgaaagagcctcgtggtt

SEQ ID NO: 9845 - DNA, 25 bp, Mus musculus
aaactgacgctacccatggtgacat

SEQ ID NO: 9846 - DNA, 25 bp, Mus musculus
aaactgacgctagccatggtgacat

SEQ ID NO: 9847 - DNA, 25 bp, Mus musculus
aaactgactacaactggatcgcctc

SEQ ID NO: 9848 - DNA, 25 bp, Mus musculus
aaactgactacatctggatcgcctc

SEQ ID NO: 9849 - DNA, 25 bp, Mus musculus
aaactgactcgtctctggaggagtt

SEQ ID NO: 9850 - DNA, 25 bp, Mus musculus
aaactgactcgtgtctggaggagtt

SEQ ID NO: 9851 - DNA, 25 bp, Mus musculus
aaactgactcttccgataagcaagt

SEQ ID NO: 9852 - DNA, 25 bp, Mus musculus
aaactgactcttgcgataagcaagt

SEQ ID NO: 9853 - DNA, 25 bp, Mus musculus
aaactgactgccatttaatgatggt

SEQ ID NO: 9854 - DNA, 25 bp, Mus musculus
aaactgactgccttttaatgatggt

SEQ ID NO: 9855 - DNA, 25 bp, Mus musculus
aaactgactgttcaccttgtcaccg

SEQ ID NO: 9856 - DNA, 25 bp, Mus musculus
aaactgactgttgaccttgtcaccg

SEQ ID NO: 9857 - DNA, 25 bp, Mus musculus
aaactgacttgcacgtgctttttaa

SEQ ID NO: 9858 - DNA, 25 bp, Mus musculus
aaactgacttgctcgtgctttttaa

SEQ ID NO: 9859 - DNA, 25 bp, Mus musculus
aaactgactttccatgagttgccat

SEQ ID NO: 9860 - DNA, 25 bp, Mus musculus
aaactgactttcgatgagttgccat

SEQ ID NO: 9861 - DNA, 25 bp, Mus musculus
aaactgagacaaccgaactcttaca

SEQ ID NO: 9862 - DNA, 25 bp, Mus musculus
aaactgagacaagcgaactcttaca

SEQ ID NO: 9863 - DNA, 25 bp, Mus musculus
aaactgagacagaggctgcgcccca

SEQ ID NO: 9864 - DNA, 25 bp, Mus musculus
aaactgagacagctgcccgaactat

SEQ ID NO: 9865 - DNA, 25 bp, Mus musculus
aaactgagacaggtgcccgaactat

SEQ ID NO: 9866 - DNA, 25 bp, Mus musculus
aaactgagacagtggctgcgcccca

SEQ ID NO: 9867 - DNA, 25 bp, Mus musculus
aaactgagagcaccaacagccctct

SEQ ID NO: 9868 - DNA, 25 bp, Mus musculus
aaactgagagcagcaacagccctct

SEQ ID NO: 9869 - DNA, 25 bp, Mus musculus
aaactgagattcataattttttatg

SEQ ID NO: 9870 - DNA, 25 bp, Mus musculus
aaactgagattcatcaggtcaggac

SEQ ID NO: 9871 - DNA, 25 bp, Mus musculus
aaactgagattcttaattttttatg

SEQ ID NO: 9872 - DNA, 25 bp, Mus musculus
aaactgagattcttcaggtcaggac

SEQ ID NO: 9873 - DNA, 25 bp, Mus musculus
aaactgagatttcgtctcacccaaa

SEQ ID NO: 9874 - DNA, 25 bp, Mus musculus
aaactgagatttggtctcacccaaa

SEQ ID NO: 9875 - DNA, 25 bp, Mus musculus
aaactgagcaaactggaccatcgtc

SEQ ID NO: 9876 - DNA, 25 bp, Mus musculus
aaactgagcaaagtggaccatcgtc

SEQ ID NO: 9877 - DNA, 25 bp, Mus musculus
aaactgagcatcatggccctcctgt

SEQ ID NO: 9878 - DNA, 25 bp, Mus musculus
aaactgagcatcttggccctcctgt

SEQ ID NO: 9879 - DNA, 25 bp, Mus musculus
aaactgagcattctgacctgtcaca

SEQ ID NO: 9880 - DNA, 25 bp, Mus musculus
aaactgagcattgtgacctgtcaca

SEQ ID NO: 9881 - DNA, 25 bp, Mus musculus
aaactgagccatcaacaaccccaag

SEQ ID NO: 9882 - DNA, 25 bp, Mus musculus
aaactgagccatgaacaaccccaag

SEQ ID NO: 9883 - DNA, 25 bp, Mus musculus
aaactgagcgtgcagccaggctacc

SEQ ID NO: 9884 - DNA, 25 bp, Mus musculus
aaactgagcgtggagccaggctacc

SEQ ID NO: 9885 - DNA, 25 bp, Mus musculus
aaactgagctacacaaacctctgct

SEQ ID NO: 9886 - DNA, 25 bp, Mus musculus
aaactgagctactcaaacctctgct

SEQ ID NO: 9887 - DNA, 25 bp, Mus musculus
aaactgagctctcggcacgtgatgc

SEQ ID NO: 9888 - DNA, 25 bp, Mus musculus
aaactgagctctgggcacgtgatgc

SEQ ID NO: 9889 - DNA, 25 bp, Mus musculus
aaactgaggaatatcacctgtgtac

SEQ ID NO: 9890 - DNA, 25 bp, Mus musculus
aaactgaggaatttcacctgtgtac

SEQ ID NO: 9891 - DNA, 25 bp, Mus musculus
aaactgaggacaagccctgggtggt

SEQ ID NO: 9892 - DNA, 25 bp, Mus musculus
aaactgaggacatgccctgggtggt

SEQ ID NO: 9893 - DNA, 25 bp, Mus musculus
aaactgaggcacatggtaactgcaa

SEQ ID NO: 9894 - DNA, 25 bp, Mus musculus
aaactgaggcacttggtaactgcaa

SEQ ID NO: 9895 - DNA, 25 bp, Mus musculus
aaactgaggcccagcaggtctgcaa

SEQ ID NO: 9896 - DNA, 25 bp, Mus musculus
aaactgaggccctgcaggtctgcaa

SEQ ID NO: 9897 - DNA, 25 bp, Mus musculus
aaactgagtactacactgggtgtgg

SEQ ID NO: 9898 - DNA, 25 bp, Mus musculus
aaactgagtacttcactgggtgtgg

SEQ ID NO: 9899 - DNA, 25 bp, Mus musculus
aaactgagttatatccaccatgacc

SEQ ID NO: 9900 - DNA, 25 bp, Mus musculus
aaactgagttatttccaccatgacc

SEQ ID NO: 9901 - DNA, 25 bp, Mus musculus
aaactgagtttgacccttctgagat

SEQ ID NO: 9902 - DNA, 25 bp, Mus musculus
aaactgagtttgtcccttctgagat

SEQ ID NO: 9903 - DNA, 25 bp, Mus musculus
aaactgataacgcttgagtccacta

SEQ ID NO: 9904 - DNA, 25 bp, Mus musculus
aaactgataacggttgagtccacta

SEQ ID NO: 9905 - DNA, 25 bp, Mus musculus
aaactgatatataccctgtctgcca

SEQ ID NO: 9906 - DNA, 25 bp, Mus musculus
aaactgatatattccctgtctgcca

SEQ ID NO: 9907 - DNA, 25 bp, Mus musculus
aaactgatcactcggttactctctt

SEQ ID NO: 9908 - DNA, 25 bp, Mus musculus
aaactgatcactgggttactctctt

SEQ ID NO: 9909 - DNA, 25 bp, Mus musculus
aaactgatcagtcgagctggtctcc

SEQ ID NO: 9910 - DNA, 25 bp, Mus musculus
aaactgatcagtggagctggtctcc

SEQ ID NO: 9911 - DNA, 25 bp, Mus musculus
aaactgatccggcacagcccagatg

SEQ ID NO: 9912 - DNA, 25 bp, Mus musculus
aaactgatccgggacagcccagatg

SEQ ID NO: 9913 - DNA, 25 bp, Mus musculus
aaactgatctccacacatacagcat

SEQ ID NO: 9914 - DNA, 25 bp, Mus musculus
aaactgatctcctcacatacagcat

SEQ ID NO: 9915 - DNA, 25 bp, Mus musculus
aaactgatgaataagccccgctttg

SEQ ID NO: 9916 - DNA, 25 bp, Mus musculus
aaactgatgaatatgtatacggtca

SEQ ID NO: 9917 - DNA, 25 bp, Mus musculus
aaactgatgaattagccccgctttg

SEQ ID NO: 9918 - DNA, 25 bp, Mus musculus
aaactgatgaatttgtatacggtca

SEQ ID NO: 9919 - DNA, 25 bp, Mus musculus
aaactgatgctaccgattccactca

SEQ ID NO: 9920 - DNA, 25 bp, Mus musculus
aaactgatgctagcgattccactca

SEQ ID NO: 9921 - DNA, 25 bp, Mus musculus
aaactgatggatcagctccacaagt

SEQ ID NO: 9922 - DNA, 25 bp, Mus musculus
aaactgatggatgagctccacaagt

SEQ ID NO: 9923 - DNA, 25 bp, Mus musculus
aaactgattagaccaagagcacgtg

SEQ ID NO: 9924 - DNA, 25 bp, Mus musculus
aaactgattagagcaagagcacgtg

SEQ ID NO: 9925 - DNA, 25 bp, Mus musculus
aaactgattagtctgtaatgccaac

SEQ ID NO: 9926 - DNA, 25 bp, Mus musculus
aaactgattagtgtgtaatgccaac

SEQ ID NO: 9927 - DNA, 25 bp, Mus musculus
aaactgattcttaccggcaagtcac

SEQ ID NO: 9928 - DNA, 25 bp, Mus musculus
aaactgattctttccggcaagtcac

SEQ ID NO: 9929 - DNA, 25 bp, Mus musculus
aaactgattgccctattttgcccct

SEQ ID NO: 9930 - DNA, 25 bp, Mus musculus
aaactgattgccgtattttgcccct

SEQ ID NO: 9931 - DNA, 25 bp, Mus musculus
aaactgatttcaagggtcacagatg

SEQ ID NO: 9932 - DNA, 25 bp, Mus musculus
aaactgatttcatgggtcacagatg

SEQ ID NO: 9933 - DNA, 25 bp, Mus musculus
aaactgcaacaacaactgtcatata

SEQ ID NO: 9934 - DNA, 25 bp, Mus musculus
aaactgcaacaagaactgtcatata

SEQ ID NO: 9935 - DNA, 25 bp, Mus musculus
aaactgcaagcacagctccctgtgg

SEQ ID NO: 9936 - DNA, 25 bp, Mus musculus
aaactgcaagcagagctccctgtgg

SEQ ID NO: 9937 - DNA, 25 bp, Mus musculus
aaactgcaagccaacgtcagggtca

SEQ ID NO: 9938 - DNA, 25 bp, Mus musculus
aaactgcaagcctacgtcagggtca

SEQ ID NO: 9939 - DNA, 25 bp, Mus musculus
aaactgcaagggacgtagctacatt

SEQ ID NO: 9940 - DNA, 25 bp, Mus musculus
aaactgcaagggtcgtagctacatt

SEQ ID NO: 9941 - DNA, 25 bp, Mus musculus
aaactgcaccgcaagattaccaatc

SEQ ID NO: 9942 - DNA, 25 bp, Mus musculus
aaactgcaccgctagattaccaatc

SEQ ID NO: 9943 - DNA, 25 bp, Mus musculus
aaactgcacctgcagtgtagcctgc

SEQ ID NO: 9944 - DNA, 25 bp, Mus musculus
aaactgcacctggagtgtagcctgc

SEQ ID NO: 9945 - DNA, 25 bp, Mus musculus
aaactgcaccttagtaacatattga

SEQ ID NO: 9946 - DNA, 25 bp, Mus musculus
aaactgcacctttgtaacatattga

SEQ ID NO: 9947 - DNA, 25 bp, Mus musculus
aaactgcactctctccgaagggatt

SEQ ID NO: 9948 - DNA, 25 bp, Mus musculus
aaactgcactctgtccgaagggatt

SEQ ID NO: 9949 - DNA, 25 bp, Mus musculus
aaactgcactgcatccaaacactga

SEQ ID NO: 9950 - DNA, 25 bp, Mus musculus
aaactgcactgcttccaaacactga

SEQ ID NO: 9951 - DNA, 25 bp, Mus musculus
aaactgcagaagacttagtgaactt

SEQ ID NO: 9952 - DNA, 25 bp, Mus musculus
aaactgcagaagctgcccttgctac

SEQ ID NO: 9953 - DNA, 25 bp, Mus musculus
aaactgcagaaggtgcccttgctac

SEQ ID NO: 9954 - DNA, 25 bp, Mus musculus
aaactgcagaagtcttagtgaactt

SEQ ID NO: 9955 - DNA, 25 bp, Mus musculus
aaactgcagactactgcccgcttgg

SEQ ID NO: 9956 - DNA, 25 bp, Mus musculus
aaactgcagacttctgcccgcttgg

SEQ ID NO: 9957 - DNA, 25 bp, Mus musculus
aaactgcagcatcgactgggctaca

SEQ ID NO: 9958 - DNA, 25 bp, Mus musculus
aaactgcagcatggactgggctaca

SEQ ID NO: 9959 - DNA, 25 bp, Mus musculus
aaactgcagtctaaagatgacagaa

SEQ ID NO: 9960 - DNA, 25 bp, Mus musculus
aaactgcagtcttaagatgacagaa

SEQ ID NO: 9961 - DNA, 25 bp, Mus musculus
aaactgcagtggaggctctgcccct

SEQ ID NO: 9962 - DNA, 25 bp, Mus musculus
aaactgcagtggtggctctgcccct

SEQ ID NO: 9963 - DNA, 25 bp, Mus musculus
aaactgcagtgtcggatgagacatc

SEQ ID NO: 9964 - DNA, 25 bp, Mus musculus
aaactgcagtgtgggatgagacatc

SEQ ID NO: 9965 - DNA, 25 bp, Mus musculus
aaactgcagttgctgctggccccac

SEQ ID NO: 9966 - DNA, 25 bp, Mus musculus
aaactgcagttggtgctggccccac

SEQ ID NO: 9967 - DNA, 25 bp, Mus musculus
aaactgcatatcaggctggagaagg

SEQ ID NO: 9968 - DNA, 25 bp, Mus musculus
aaactgcatatctggctggagaagg

SEQ ID NO: 9969 - DNA, 25 bp, Mus musculus
aaactgcatgcgaagtctgattaca

SEQ ID NO: 9970 - DNA, 25 bp, Mus musculus
aaactgcatgcgtagtctgattaca

SEQ ID NO: 9971 - DNA, 25 bp, Mus musculus
aaactgcattatacatcgctgtctt

SEQ ID NO: 9972 - DNA, 25 bp, Mus musculus
aaactgcattatatccacgctaccg

SEQ ID NO: 9973 - DNA, 25 bp, Mus musculus
aaactgcattattcatcgctgtctt

SEQ ID NO: 9974 - DNA, 25 bp, Mus musculus
aaactgcattatttccacgctaccg

SEQ ID NO: 9975 - DNA, 25 bp, Mus musculus
aaactgccaagtatagcccagcgga

SEQ ID NO: 9976 - DNA, 25 bp, Mus musculus
aaactgccaagtttagcccagcgga

SEQ ID NO: 9977 - DNA, 25 bp, Mus musculus
aaactgccaccaactgaaggtctta

SEQ ID NO: 9978 - DNA, 25 bp, Mus musculus
aaactgccaccatctgaaggtctta

SEQ ID NO: 9979 - DNA, 25 bp, Mus musculus
aaactgccagcaatgatctaaactt

SEQ ID NO: 9980 - DNA, 25 bp, Mus musculus
aaactgccagcattgatctaaactt

SEQ ID NO: 9981 - DNA, 25 bp, Mus musculus
aaactgccaggtcaattgcaactgt

SEQ ID NO: 9982 - DNA, 25 bp, Mus musculus
aaactgccaggtcgaatctttcctt

SEQ ID NO: 9983 - DNA, 25 bp, Mus musculus
aaactgccaggtgaattgcaactgt

SEQ ID NO: 9984 - DNA, 25 bp, Mus musculus
aaactgccaggtggaatctttcctt

SEQ ID NO: 9985 - DNA, 25 bp, Mus musculus
aaactgccagtgatcaaatgaaaaa

SEQ ID NO: 9986 - DNA, 25 bp, Mus musculus
aaactgccagtgttcaaatgaaaaa

SEQ ID NO: 9987 - DNA, 25 bp, Mus musculus
aaactgcccatgatttacttggtca

SEQ ID NO: 9988 - DNA, 25 bp, Mus musculus
aaactgcccatgttttacttggtca

SEQ ID NO: 9989 - DNA, 25 bp, Mus musculus
aaactgccccggatcaagatagaag

SEQ ID NO: 9990 - DNA, 25 bp, Mus musculus
aaactgccccggttcaagatagaag

SEQ ID NO: 9991 - DNA, 25 bp, Mus musculus
aaactgccccgtagagtcctggtca

SEQ ID NO: 9992 - DNA, 25 bp, Mus musculus
aaactgccccgttgagtcctggtca

SEQ ID NO: 9993 - DNA, 25 bp, Mus musculus
aaactgccctgcaaatcaaggctgc

SEQ ID NO: 9994 - DNA, 25 bp, Mus musculus
aaactgccctgctaatcaaggctgc

SEQ ID NO: 9995 - DNA, 25 bp, Mus musculus
aaactgccctggctgatcgaggaac

SEQ ID NO: 9996 - DNA, 25 bp, Mus musculus
aaactgccctgggtgatcgaggaac

SEQ ID NO: 9997 - DNA, 25 bp, Mus musculus
aaactgcccttcagagaccaacggg

SEQ ID NO: 9998 - DNA, 25 bp, Mus musculus
aaactgcccttctgagaccaacggg

SEQ ID NO: 9999 - DNA, 25 bp, Mus musculus
aaactgccgattacaggactgggat

SEQ ID NO: 10000 - DNA, 25 bp, Mus musculus
aaactgccgatttcaggactgggat

SEQ ID NO: 10001 - DNA, 25 bp, Mus musculus
aaactgcctaggaccagagctaacc

SEQ ID NO: 10002 - DNA, 25 bp, Mus musculus
aaactgcctaggtccagagctaacc

SEQ ID NO: 10003 - DNA, 25 bp, Mus musculus
aaactgcctatcaactgttactgtt

SEQ ID NO: 10004 - DNA, 25 bp, Mus musculus
aaactgcctatctactgttactgtt

SEQ ID NO: 10005 - DNA, 25 bp, Mus musculus
aaactgcctccaaagaaggtgctgg

SEQ ID NO: 10006 - DNA, 25 bp, Mus musculus
aaactgcctccatagaaggtgctgg

SEQ ID NO: 10007 - DNA, 25 bp, Mus musculus
aaactgcgatagcttcagcttgcac

SEQ ID NO: 10008 - DNA, 25 bp, Mus musculus
aaactgcgataggttcagcttgcac

SEQ ID NO: 10009 - DNA, 25 bp, Mus musculus
aaactgcgcatgctggaccttcgag

SEQ ID NO: 10010 - DNA, 25 bp, Mus musculus
aaactgcgcatggtggaccttcgag

SEQ ID NO: 10011 - DNA, 25 bp, Mus musculus
aaactgcgctttaagcggcgctgga

SEQ ID NO: 10012 - DNA, 25 bp, Mus musculus
aaactgcgcttttagcggcgctgga

SEQ ID NO: 10013 - DNA, 25 bp, Mus musculus
aaactgcgtgtgaatgtatttgatg

SEQ ID NO: 10014 - DNA, 25 bp, Mus musculus
aaactgcgtgtgtatgtatttgatg

SEQ ID NO: 10015 - DNA, 25 bp, Mus musculus
aaactgcgttttagctcttctgtgg

SEQ ID NO: 10016 - DNA, 25 bp, Mus musculus
aaactgcgtttttgctcttctgtgg

SEQ ID NO: 10017 - DNA, 25 bp, Mus musculus
aaactgctacaaataccgtgtggag

SEQ ID NO: 10018 - DNA, 25 bp, Mus musculus
aaactgctacaattaccgtgtggag

SEQ ID NO: 10019 - DNA, 25 bp, Mus musculus
aaactgctatccataccagatgcat

SEQ ID NO: 10020 - DNA, 25 bp, Mus musculus
aaactgctatccctttgctttaaag

SEQ ID NO: 10021 - DNA, 25 bp, Mus musculus
aaactgctatccgtttgctttaaag

SEQ ID NO: 10022 - DNA, 25 bp, Mus musculus
aaactgctatccttaccagatgcat

SEQ ID NO: 10023 - DNA, 25 bp, Mus musculus
aaactgctatctagtcctcagattg

SEQ ID NO: 10024 - DNA, 25 bp, Mus musculus
aaactgctatcttgtcctcagattg

SEQ ID NO: 10025 - DNA, 25 bp, Mus musculus
aaactgctattgatccattgactgc

SEQ ID NO: 10026 - DNA, 25 bp, Mus musculus
aaactgctattgttccattgactgc

SEQ ID NO: 10027 - DNA, 25 bp, Mus musculus
aaactgctcaggctgtgtcttaaga

SEQ ID NO: 10028 - DNA, 25 bp, Mus musculus
aaactgctcagggtgtgtcttaaga

SEQ ID NO: 10029 - DNA, 25 bp, Mus musculus
aaactgctccggaagctactgaagc

SEQ ID NO: 10030 - DNA, 25 bp, Mus musculus
aaactgctccggtagctactgaagc

SEQ ID NO: 10031 - DNA, 25 bp, Mus musculus
aaactgctcctcagtggagttactt

SEQ ID NO: 10032 - DNA, 25 bp, Mus musculus
aaactgctcctctgtggagttactt

SEQ ID NO: 10033 - DNA, 25 bp, Mus musculus
aaactgctcctgactagggttctga

SEQ ID NO: 10034 - DNA, 25 bp, Mus musculus
aaactgctcctgtctagggttctga

SEQ ID NO: 10035 - DNA, 25 bp, Mus musculus
aaactgctctatcccacaggctctg

SEQ ID NO: 10036 - DNA, 25 bp, Mus musculus
aaactgctctatccccgggagatcc

SEQ ID NO: 10037 - DNA, 25 bp, Mus musculus
aaactgctctatgccacaggctctg

SEQ ID NO: 10038 - DNA, 25 bp, Mus musculus
aaactgctctatgcccgggagatcc

SEQ ID NO: 10039 - DNA, 25 bp, Mus musculus
aaactgctctcaatttgctttcagc

SEQ ID NO: 10040 - DNA, 25 bp, Mus musculus
aaactgctctcattttgctttcagc

SEQ ID NO: 10041 - DNA, 25 bp, Mus musculus
aaactgctgattcgcactgtgttcc

SEQ ID NO: 10042 - DNA, 25 bp, Mus musculus
aaactgctgattggcactgtgttcc

SEQ ID NO: 10043 - DNA, 25 bp, Mus musculus
aaactgctgcctacgaagtgtgcga

SEQ ID NO: 10044 - DNA, 25 bp, Mus musculus
aaactgctgccttcgaagtgtgcga

SEQ ID NO: 10045 - DNA, 25 bp, Mus musculus
aaactgctgcgaacagaacctgcca

SEQ ID NO: 10046 - DNA, 25 bp, Mus musculus
aaactgctgcgatcagaacctgcca

SEQ ID NO: 10047 - DNA, 25 bp, Mus musculus
aaactgctgctgcagttgtgccctg

SEQ ID NO: 10048 - DNA, 25 bp, Mus musculus
aaactgctgctggagttgtgccctg

SEQ ID NO: 10049 - DNA, 25 bp, Mus musculus
aaactgctgcttaccctgtctcact

SEQ ID NO: 10050 - DNA, 25 bp, Mus musculus
aaactgctgctttccctgtctcact

SEQ ID NO: 10051 - DNA, 25 bp, Mus musculus
aaactgctggcaacagtcagggcaa

SEQ ID NO: 10052 - DNA, 25 bp, Mus musculus
aaactgctggcatcagtcagggcaa

SEQ ID NO: 10053 - DNA, 25 bp, Mus musculus
aaactgctggccagagggacaaaaa

SEQ ID NO: 10054 - DNA, 25 bp, Mus musculus
aaactgctggcctgagggacaaaaa

SEQ ID NO: 10055 - DNA, 25 bp, Mus musculus
aaactgctggtgagccctactcagt

SEQ ID NO: 10056 - DNA, 25 bp, Mus musculus
aaactgctggtgtgccctactcagt

SEQ ID NO: 10057 - DNA, 25 bp, Mus musculus
aaactgctgtaactcacttgctgga

SEQ ID NO: 10058 - DNA, 25 bp, Mus musculus
aaactgctgtaagtcacttgctgga

SEQ ID NO: 10059 - DNA, 25 bp, Mus musculus
aaactgctgtagactgaggaactca

SEQ ID NO: 10060 - DNA, 25 bp, Mus musculus
aaactgctgtagtctgaggaactca

SEQ ID NO: 10061 - DNA, 25 bp, Mus musculus
aaactgctgtctctgcgggcctagg

SEQ ID NO: 10062 - DNA, 25 bp, Mus musculus
aaactgctgtctgtgcgggcctagg

SEQ ID NO: 10063 - DNA, 25 bp, Mus musculus
aaactgctgttgagacttccaggtt

SEQ ID NO: 10064 - DNA, 25 bp, Mus musculus
aaactgctgttgtgacttccaggtt

SEQ ID NO: 10065 - DNA, 25 bp, Mus musculus
aaactgctgtttaggagatctgtgc

SEQ ID NO: 10066 - DNA, 25 bp, Mus musculus
aaactgctgttttggagatctgtgc

SEQ ID NO: 10067 - DNA, 25 bp, Mus musculus
aaactgcttaatactcatcgcttct

SEQ ID NO: 10068 - DNA, 25 bp, Mus musculus
aaactgcttaattctcatcgcttct

SEQ ID NO: 10069 - DNA, 25 bp, Mus musculus
aaactgcttataactctgcctccag

SEQ ID NO: 10070 - DNA, 25 bp, Mus musculus
aaactgcttatatctctgcctccag

SEQ ID NO: 10071 - DNA, 25 bp, Mus musculus
aaactgcttcaacacgtccgccaga

SEQ ID NO: 10072 - DNA, 25 bp, Mus musculus
aaactgcttcaagacgtccgccaga

SEQ ID NO: 10073 - DNA, 25 bp, Mus musculus
aaactgcttcccaatagctggactt

SEQ ID NO: 10074 - DNA, 25 bp, Mus musculus
aaactgcttccctatagctggactt

SEQ ID NO: 10075 - DNA, 25 bp, Mus musculus
aaactgcttcgacccctaagtgagc

SEQ ID NO: 10076 - DNA, 25 bp, Mus musculus
aaactgcttcgagccctaagtgagc

SEQ ID NO: 10077 - DNA, 25 bp, Mus musculus
aaactgcttggtagccgggtgaaca

SEQ ID NO: 10078 - DNA, 25 bp, Mus musculus
aaactgcttggttgccgggtgaaca

SEQ ID NO: 10079 - DNA, 25 bp, Mus musculus
aaactgcttgtcacagacaatttat

SEQ ID NO: 10080 - DNA, 25 bp, Mus musculus
aaactgcttgtctcagacaatttat

SEQ ID NO: 10081 - DNA, 25 bp, Mus musculus
aaactgctttctattttgtactgtg

SEQ ID NO: 10082 - DNA, 25 bp, Mus musculus
aaactgctttcttttttgtactgtg

SEQ ID NO: 10083 - DNA, 25 bp, Mus musculus
aaactgctttttcaatgaaggtata

SEQ ID NO: 10084 - DNA, 25 bp, Mus musculus
aaactgctttttgaatgaaggtata

SEQ ID NO: 10085 - DNA, 25 bp, Mus musculus
aaactggaacaactctgccctatct

SEQ ID NO: 10086 - DNA, 25 bp, Mus musculus
aaactggaacaagtctgccctatct

SEQ ID NO: 10087 - DNA, 25 bp, Mus musculus
aaactggaacacaccatttgccact

SEQ ID NO: 10088 - DNA, 25 bp, Mus musculus
aaactggaacactccatttgccact

SEQ ID NO: 10089 - DNA, 25 bp, Mus musculus
aaactggaacatctgggagaccgtg

SEQ ID NO: 10090 - DNA, 25 bp, Mus musculus
aaactggaacatgtgggagaccgtg

SEQ ID NO: 10091 - DNA, 25 bp, Mus musculus
aaactggaaccacgttggcctgtga

SEQ ID NO: 10092 - DNA, 25 bp, Mus musculus
aaactggaaccaggttggcctgtga

SEQ ID NO: 10093 - DNA, 25 bp, Mus musculus
aaactggaactgacatacagggata

SEQ ID NO: 10094 - DNA, 25 bp, Mus musculus
aaactggaactgtcatacagggata

SEQ ID NO: 10095 - DNA, 25 bp, Mus musculus
aaactggaagatcgcttgagactca

SEQ ID NO: 10096 - DNA, 25 bp, Mus musculus
aaactggaagatggcttgagactca

SEQ ID NO: 10097 - DNA, 25 bp, Mus musculus
aaactggaagcacttcctctcctga

SEQ ID NO: 10098 - DNA, 25 bp, Mus musculus
aaactggaagcagttcctctcctga

SEQ ID NO: 10099 - DNA, 25 bp, Mus musculus
aaactggaagcgactcgtgctggct

SEQ ID NO: 10100 - DNA, 25 bp, Mus musculus
aaactggaagcgagagagaggctca

SEQ ID NO: 10101 - DNA, 25 bp, Mus musculus
aaactggaagcgtctcgtgctggct

SEQ ID NO: 10102 - DNA, 25 bp, Mus musculus
aaactggaagcgtgagagaggctca

SEQ ID NO: 10103 - DNA, 25 bp, Mus musculus
aaactggaaggaacctgtccccagc

SEQ ID NO: 10104 - DNA, 25 bp, Mus musculus
aaactggaaggatcctgtccccagc

SEQ ID NO: 10105 - DNA, 25 bp, Mus musculus
aaactggaatatccagggacctttc

SEQ ID NO: 10106 - DNA, 25 bp, Mus musculus
aaactggaatatgcagggacctttc

SEQ ID NO: 10107 - DNA, 25 bp, Mus musculus
aaactggaatcaatagctctatggg

SEQ ID NO: 10108 - DNA, 25 bp, Mus musculus
aaactggaatcattagctctatggg

SEQ ID NO: 10109 - DNA, 25 bp, Mus musculus
aaactggaatccacaaaatgctgtg

SEQ ID NO: 10110 - DNA, 25 bp, Mus musculus
aaactggaatcctcaaaatgctgtg

SEQ ID NO: 10111 - DNA, 25 bp, Mus musculus
aaactggacaagatcatattgagtg

SEQ ID NO: 10112 - DNA, 25 bp, Mus musculus
aaactggacaagttcatattgagtg

SEQ ID NO: 10113 - DNA, 25 bp, Mus musculus
aaactggacagcaaattacagcgtc

SEQ ID NO: 10114 - DNA, 25 bp, Mus musculus
aaactggacagctaattacagcgtc

SEQ ID NO: 10115 - DNA, 25 bp, Mus musculus
aaactggacatacttcgtgggaact

SEQ ID NO: 10116 - DNA, 25 bp, Mus musculus
aaactggacatagttcgtgggaact

SEQ ID NO: 10117 - DNA, 25 bp, Mus musculus
aaactggacattatgcaacgccaaa

SEQ ID NO: 10118 - DNA, 25 bp, Mus musculus
aaactggacattttgcaacgccaaa

SEQ ID NO: 10119 - DNA, 25 bp, Mus musculus
aaactggaccagactcatttagaga

SEQ ID NO: 10120 - DNA, 25 bp, Mus musculus
aaactggaccagagcattatgcctt

SEQ ID NO: 10121 - DNA, 25 bp, Mus musculus
aaactggaccagtctcatttagaga

SEQ ID NO: 10122 - DNA, 25 bp, Mus musculus
aaactggaccagtgcattatgcctt

SEQ ID NO: 10123 - DNA, 25 bp, Mus musculus
aaactggactacctgtgtttgatct

SEQ ID NO: 10124 - DNA, 25 bp, Mus musculus
aaactggactacgtgtgtttgatct

SEQ ID NO: 10125 - DNA, 25 bp, Mus musculus
aaactggactcacgaaggctgcctc

SEQ ID NO: 10126 - DNA, 25 bp, Mus musculus
aaactggactcaggaaggctgcctc

SEQ ID NO: 10127 - DNA, 25 bp, Mus musculus
aaactggactccatatttctgaaat

SEQ ID NO: 10128 - DNA, 25 bp, Mus musculus
aaactggactccttatttctgaaat

SEQ ID NO: 10129 - DNA, 25 bp, Mus musculus
aaactggactggctcccggtctgaa

SEQ ID NO: 10130 - DNA, 25 bp, Mus musculus
aaactggactgggtcccggtctgaa

SEQ ID NO: 10131 - DNA, 25 bp, Mus musculus
aaactggagaatcctcaccccaaag

SEQ ID NO: 10132 - DNA, 25 bp, Mus musculus
aaactggagaatgctcaccccaaag

SEQ ID NO: 10133 - DNA, 25 bp, Mus musculus
aaactggagacaataccgcctggac

SEQ ID NO: 10134 - DNA, 25 bp, Mus musculus
aaactggagacattaccgcctggac

SEQ ID NO: 10135 - DNA, 25 bp, Mus musculus
aaactggagagaccatacactagca

SEQ ID NO: 10136 - DNA, 25 bp, Mus musculus
aaactggagagagcatacactagca

SEQ ID NO: 10137 - DNA, 25 bp, Mus musculus
aaactggagcctagtgtctggcctt

SEQ ID NO: 10138 - DNA, 25 bp, Mus musculus
aaactggagccttgtgtctggcctt

SEQ ID NO: 10139 - DNA, 25 bp, Mus musculus
aaactggagctgaatgttctggaat

SEQ ID NO: 10140 - DNA, 25 bp, Mus musculus
aaactggagctgattctgacagaag

SEQ ID NO: 10141 - DNA, 25 bp, Mus musculus
aaactggagctgtatgttctggaat

SEQ ID NO: 10142 - DNA, 25 bp, Mus musculus
aaactggagctgtttctgacagaag

SEQ ID NO: 10143 - DNA, 25 bp, Mus musculus
aaactggaggctacgcattttgatg

SEQ ID NO: 10144 - DNA, 25 bp, Mus musculus
aaactggaggcttcgcattttgatg

SEQ ID NO: 10145 - DNA, 25 bp, Mus musculus
aaactggagggcagttatccacaga

SEQ ID NO: 10146 - DNA, 25 bp, Mus musculus
aaactggagggctgttatccacaga

SEQ ID NO: 10147 - DNA, 25 bp, Mus musculus
aaactggagtggactttcatcaacg

SEQ ID NO: 10148 - DNA, 25 bp, Mus musculus
aaactggagtggtctttcatcaacg

SEQ ID NO: 10149 - DNA, 25 bp, Mus musculus
aaactggataaaaaccacagtctga

SEQ ID NO: 10150 - DNA, 25 bp, Mus musculus
aaactggataaataccacagtctga

SEQ ID NO: 10151 - DNA, 25 bp, Mus musculus
aaactggatactctactgacactat

SEQ ID NO: 10152 - DNA, 25 bp, Mus musculus
aaactggatactgtactgacactat

SEQ ID NO: 10153 - DNA, 25 bp, Mus musculus
aaactggatgccaaggtttggccca

SEQ ID NO: 10154 - DNA, 25 bp, Mus musculus
aaactggatgcctaggtttggccca

SEQ ID NO: 10155 - DNA, 25 bp, Mus musculus
aaactggatgtcatactgggtgcta

SEQ ID NO: 10156 - DNA, 25 bp, Mus musculus
aaactggatgtcttactgggtgcta

SEQ ID NO: 10157 - DNA, 25 bp, Mus musculus
aaactggatttgagccctttaccat

SEQ ID NO: 10158 - DNA, 25 bp, Mus musculus
aaactggatttgtgccctttaccat

SEQ ID NO: 10159 - DNA, 25 bp, Mus musculus
aaactggattttagccctatcacga

SEQ ID NO: 10160 - DNA, 25 bp, Mus musculus
aaactggatttttgccctatcacga

SEQ ID NO: 10161 - DNA, 25 bp, Mus musculus
aaactggcacatccaagcacagagt

SEQ ID NO: 10162 - DNA, 25 bp, Mus musculus
aaactggcacatgcaagcacagagt

SEQ ID NO: 10163 - DNA, 25 bp, Mus musculus
aaactggcaccaactgggtcactag

SEQ ID NO: 10164 - DNA, 25 bp, Mus musculus
aaactggcaccatctgggtcactag

SEQ ID NO: 10165 - DNA, 25 bp, Mus musculus
aaactggcactccagttttgcctgt

SEQ ID NO: 10166 - DNA, 25 bp, Mus musculus
aaactggcactcgagttttgcctgt

SEQ ID NO: 10167 - DNA, 25 bp, Mus musculus
aaactggcagacatgggaattgcaa

SEQ ID NO: 10168 - DNA, 25 bp, Mus musculus
aaactggcagacttgggaattgcaa

SEQ ID NO: 10169 - DNA, 25 bp, Mus musculus
aaactggcagtgaccttggtggtgt

SEQ ID NO: 10170 - DNA, 25 bp, Mus musculus
aaactggcagtgtccttggtggtgt

SEQ ID NO: 10171 - DNA, 25 bp, Mus musculus
aaactggcattgcttagacccgctg

SEQ ID NO: 10172 - DNA, 25 bp, Mus musculus
aaactggcattggttagacccgctg

SEQ ID NO: 10173 - DNA, 25 bp, Mus musculus
aaactggccattattttgcactgta

SEQ ID NO: 10174 - DNA, 25 bp, Mus musculus
aaactggccatttttttgcactgta

SEQ ID NO: 10175 - DNA, 25 bp, Mus musculus
aaactggccccacaggagaccggag

SEQ ID NO: 10176 - DNA, 25 bp, Mus musculus
aaactggccccagaggagaccggag

SEQ ID NO: 10177 - DNA, 25 bp, Mus musculus
aaactggcctcaagttctggatcct

SEQ ID NO: 10178 - DNA, 25 bp, Mus musculus
aaactggcctcatgttctggatcct

SEQ ID NO: 10179 - DNA, 25 bp, Mus musculus
aaactggcctgcaaaatcatagtca

SEQ ID NO: 10180 - DNA, 25 bp, Mus musculus
aaactggcctgctaaatcatagtca

SEQ ID NO: 10181 - DNA, 25 bp, Mus musculus
aaactggcctgtattatttatgcac

SEQ ID NO: 10182 - DNA, 25 bp, Mus musculus
aaactggcctgttttatttatgcac

SEQ ID NO: 10183 - DNA, 25 bp, Mus musculus
aaactggccttcaggtaacatttgt

SEQ ID NO: 10184 - DNA, 25 bp, Mus musculus
aaactggccttctggtaacatttgt

SEQ ID NO: 10185 - DNA, 25 bp, Mus musculus
aaactggcgcggactgacactcgtg

SEQ ID NO: 10186 - DNA, 25 bp, Mus musculus
aaactggcgcggtctgacactcgtg

SEQ ID NO: 10187 - DNA, 25 bp, Mus musculus
aaactggcgctcaagtgggtcctgc

SEQ ID NO: 10188 - DNA, 25 bp, Mus musculus
aaactggcgctctagtgggtcctgc

SEQ ID NO: 10189 - DNA, 25 bp, Mus musculus
aaactggcggcccatcgtctgtgcc

SEQ ID NO: 10190 - DNA, 25 bp, Mus musculus
aaactggcggccgatcgtctgtgcc

SEQ ID NO: 10191 - DNA, 25 bp, Mus musculus
aaactggctagtaaataggctgtag

SEQ ID NO: 10192 - DNA, 25 bp, Mus musculus
aaactggctagttaataggctgtag

SEQ ID NO: 10193 - DNA, 25 bp, Mus musculus
aaactggctcctctcaaagattaag

SEQ ID NO: 10194 - DNA, 25 bp, Mus musculus
aaactggctcctgtcaaagattaag

SEQ ID NO: 10195 - DNA, 25 bp, Mus musculus
aaactggctggtcagctcctgagat

SEQ ID NO: 10196 - DNA, 25 bp, Mus musculus
aaactggctggtgagctcctgagat

SEQ ID NO: 10197 - DNA, 25 bp, Mus musculus
aaactggctgttcctactgatgcta

SEQ ID NO: 10198 - DNA, 25 bp, Mus musculus
aaactggctgttgctactgatgcta

SEQ ID NO: 10199 - DNA, 25 bp, Mus musculus
aaactggcttctcatgcatgaacat

SEQ ID NO: 10200 - DNA, 25 bp, Mus musculus
aaactggcttctgatgcatgaacat

SEQ ID NO: 10201 - DNA, 25 bp, Mus musculus
aaactggcttggcagttaagggcaa

SEQ ID NO: 10202 - DNA, 25 bp, Mus musculus
aaactggcttgggagttaagggcaa

SEQ ID NO: 10203 - DNA, 25 bp, Mus musculus
aaactggcttttctcctggtggaat

SEQ ID NO: 10204 - DNA, 25 bp, Mus musculus
aaactggcttttgtcctggtggaat

SEQ ID NO: 10205 - DNA, 25 bp, Mus musculus
aaactgggaaacactgtctgcctct

SEQ ID NO: 10206 - DNA, 25 bp, Mus musculus
aaactgggaaactctgtctgcctct

SEQ ID NO: 10207 - DNA, 25 bp, Mus musculus
aaactgggagaactgtgcacagcta

SEQ ID NO: 10208 - DNA, 25 bp, Mus musculus
aaactgggagaagtgtgcacagcta

SEQ ID NO: 10209 - DNA, 25 bp, Mus musculus
aaactgggagagacaactgttgttc

SEQ ID NO: 10210 - DNA, 25 bp, Mus musculus
aaactgggagagtcaactgttgttc

SEQ ID NO: 10211 - DNA, 25 bp, Mus musculus
aaactgggagccaaattctgcagaa

SEQ ID NO: 10212 - DNA, 25 bp, Mus musculus
aaactgggagcctaattctgcagaa

SEQ ID NO: 10213 - DNA, 25 bp, Mus musculus
aaactgggaggaactatcactggaa

SEQ ID NO: 10214 - DNA, 25 bp, Mus musculus
aaactgggaggatctatcactggaa

SEQ ID NO: 10215 - DNA, 25 bp, Mus musculus
aaactgggcaaaacctttcaactag

SEQ ID NO: 10216 - DNA, 25 bp, Mus musculus
aaactgggcaaatcctttcaactag

SEQ ID NO: 10217 - DNA, 25 bp, Mus musculus
aaactgggcaagctctcgcaaacgc

SEQ ID NO: 10218 - DNA, 25 bp, Mus musculus
aaactgggcaaggtctcgcaaacgc

SEQ ID NO: 10219 - DNA, 25 bp, Mus musculus
aaactgggcagcatggatatactcc

SEQ ID NO: 10220 - DNA, 25 bp, Mus musculus
aaactgggcagcttggatatactcc

SEQ ID NO: 10221 - DNA, 25 bp, Mus musculus
aaactgggcataatgatacacacat

SEQ ID NO: 10222 - DNA, 25 bp, Mus musculus
aaactgggcatattgatacacacat

SEQ ID NO: 10223 - DNA, 25 bp, Mus musculus
aaactgggcgtacgactcaggaact

SEQ ID NO: 10224 - DNA, 25 bp, Mus musculus
aaactgggcgtaggactcaggaact

SEQ ID NO: 10225 - DNA, 25 bp, Mus musculus
aaactgggcgtcaacaacaccagca

SEQ ID NO: 10226 - DNA, 25 bp, Mus musculus
aaactgggcgtctacaacaccagca

SEQ ID NO: 10227 - DNA, 25 bp, Mus musculus
aaactgggctgcatgctgtctgagc

SEQ ID NO: 10228 - DNA, 25 bp, Mus musculus
aaactgggctgcttgctgtctgagc

SEQ ID NO: 10229 - DNA, 25 bp, Mus musculus
aaactgggttctagcttgtaaatag

SEQ ID NO: 10230 - DNA, 25 bp, Mus musculus
aaactgggttcttgcttgtaaatag

SEQ ID NO: 10231 - DNA, 25 bp, Mus musculus
aaactggtaactatttgcttctcag

SEQ ID NO: 10232 - DNA, 25 bp, Mus musculus
aaactggtaactttttgcttctcag

SEQ ID NO: 10233 - DNA, 25 bp, Mus musculus
aaactggtacaccagcatgccttca

SEQ ID NO: 10234 - DNA, 25 bp, Mus musculus
aaactggtacacgagcatgccttca

SEQ ID NO: 10235 - DNA, 25 bp, Mus musculus
aaactggtagcaccgagtccttact

SEQ ID NO: 10236 - DNA, 25 bp, Mus musculus
aaactggtagcagcgagtccttact

SEQ ID NO: 10237 - DNA, 25 bp, Mus musculus
aaactggtattccatttacagctaa

SEQ ID NO: 10238 - DNA, 25 bp, Mus musculus
aaactggtattcctgccgagtgtca

SEQ ID NO: 10239 - DNA, 25 bp, Mus musculus
aaactggtattcgatttacagctaa

SEQ ID NO: 10240 - DNA, 25 bp, Mus musculus
aaactggtattcgtgccgagtgtca

SEQ ID NO: 10241 - DNA, 25 bp, Mus musculus
aaactggtcactaggatggtgtatt

SEQ ID NO: 10242 - DNA, 25 bp, Mus musculus
aaactggtcacttggatggtgtatt

SEQ ID NO: 10243 - DNA, 25 bp, Mus musculus
aaactggtcagcaaaaggcccacca

SEQ ID NO: 10244 - DNA, 25 bp, Mus musculus
aaactggtcagctaaaggcccacca

SEQ ID NO: 10245 - DNA, 25 bp, Mus musculus
aaactggtccagagtgtcacagcag

SEQ ID NO: 10246 - DNA, 25 bp, Mus musculus
aaactggtccagtgtgtcacagcag

SEQ ID NO: 10247 - DNA, 25 bp, Mus musculus
aaactggtcgttctctctatacaca

SEQ ID NO: 10248 - DNA, 25 bp, Mus musculus
aaactggtcgttgtctctatacaca

SEQ ID NO: 10249 - DNA, 25 bp, Mus musculus
aaactggtctccaaattccattcct

SEQ ID NO: 10250 - DNA, 25 bp, Mus musculus
aaactggtctcctaattccattcct

SEQ ID NO: 10251 - DNA, 25 bp, Mus musculus
aaactggtctctcgtgacttccaca

SEQ ID NO: 10252 - DNA, 25 bp, Mus musculus
aaactggtctctggtgacttccaca

SEQ ID NO: 10253 - DNA, 25 bp, Mus musculus
aaactggtgagcaggattcaatccc

SEQ ID NO: 10254 - DNA, 25 bp, Mus musculus
aaactggtgagctggattcaatccc

SEQ ID NO: 10255 - DNA, 25 bp, Mus musculus
aaactggtgatcactccaaatgaaa

SEQ ID NO: 10256 - DNA, 25 bp, Mus musculus
aaactggtgatctctccaaatgaaa

SEQ ID NO: 10257 - DNA, 25 bp, Mus musculus
aaactggtgcatagtgccctggcaa

SEQ ID NO: 10258 - DNA, 25 bp, Mus musculus
aaactggtgcattgtgccctggcaa

SEQ ID NO: 10259 - DNA, 25 bp, Mus musculus
aaactggtgccacgctgacatgtct

SEQ ID NO: 10260 - DNA, 25 bp, Mus musculus
aaactggtgccaggctgacatgtct

SEQ ID NO: 10261 - DNA, 25 bp, Mus musculus
aaactggtgcttcttagtccataga

SEQ ID NO: 10262 - DNA, 25 bp, Mus musculus
aaactggtgcttgttagtccataga

SEQ ID NO: 10263 - DNA, 25 bp, Mus musculus
aaactggtggccagggtttcatcca

SEQ ID NO: 10264 - DNA, 25 bp, Mus musculus
aaactggtggcctgggtttcatcca

SEQ ID NO: 10265 - DNA, 25 bp, Mus musculus
aaactggtgtaaatcaagcttgact

SEQ ID NO: 10266 - DNA, 25 bp, Mus musculus
aaactggtgtaattcaagcttgact

SEQ ID NO: 10267 - DNA, 25 bp, Mus musculus
aaactggttgctcattctgtctctt

SEQ ID NO: 10268 - DNA, 25 bp, Mus musculus
aaactggttgctgattctgtctctt

SEQ ID NO: 10269 - DNA, 25 bp, Mus musculus
aaactggttggcagtataccttgtt

SEQ ID NO: 10270 - DNA, 25 bp, Mus musculus
aaactggttggctgtataccttgtt

SEQ ID NO: 10271 - DNA, 25 bp, Mus musculus
aaactggttgtgcagcaattcaata

SEQ ID NO: 10272 - DNA, 25 bp, Mus musculus
aaactggttgtggagcaattcaata

SEQ ID NO: 10273 - DNA, 25 bp, Mus musculus
aaactggttttcacagcatgagctg

SEQ ID NO: 10274 - DNA, 25 bp, Mus musculus
aaactggttttctcagcatgagctg

SEQ ID NO: 10275 - DNA, 25 bp, Mus musculus
aaactggttttgaatcacttgaata

SEQ ID NO: 10276 - DNA, 25 bp, Mus musculus
aaactggttttgtatcacttgaata

SEQ ID NO: 10277 - DNA, 25 bp, Mus musculus
aaactgtaaagccagtgtgtcccca

SEQ ID NO: 10278 - DNA, 25 bp, Mus musculus
aaactgtaaagcgagtgtgtcccca

SEQ ID NO: 10279 - DNA, 25 bp, Mus musculus
aaactgtaactaacctccttaaatg

SEQ ID NO: 10280 - DNA, 25 bp, Mus musculus
aaactgtaactatcctccttaaatg

SEQ ID NO: 10281 - DNA, 25 bp, Mus musculus
aaactgtaagtcacactgcaccatg

SEQ ID NO: 10282 - DNA, 25 bp, Mus musculus
aaactgtaagtctcactgcaccatg

SEQ ID NO: 10283 - DNA, 25 bp, Mus musculus
aaactgtaatataccaatggtcaag

SEQ ID NO: 10284 - DNA, 25 bp, Mus musculus
aaactgtaatatcgcgtaactgtcg

SEQ ID NO: 10285 - DNA, 25 bp, Mus musculus
aaactgtaatatggcgtaactgtcg

SEQ ID NO: 10286 - DNA, 25 bp, Mus musculus
aaactgtaatattccaatggtcaag

SEQ ID NO: 10287 - DNA, 25 bp, Mus musculus
aaactgtaattcatgtaatgtatgt

SEQ ID NO: 10288 - DNA, 25 bp, Mus musculus
aaactgtaattcttgtaatgtatgt

SEQ ID NO: 10289 - DNA, 25 bp, Mus musculus
aaactgtacactcgcttggaatgtt

SEQ ID NO: 10290 - DNA, 25 bp, Mus musculus
aaactgtacactggcttggaatgtt

SEQ ID NO: 10291 - DNA, 25 bp, Mus musculus
aaactgtaccagctgatcggcaagc

SEQ ID NO: 10292 - DNA, 25 bp, Mus musculus
aaactgtaccaggtgatcggcaagc

SEQ ID NO: 10293 - DNA, 25 bp, Mus musculus
aaactgtacctccattttggcaata

SEQ ID NO: 10294 - DNA, 25 bp, Mus musculus
aaactgtacctcgattttggcaata

SEQ ID NO: 10295 - DNA, 25 bp, Mus musculus
aaactgtacctgaaaattgtgcaat

SEQ ID NO: 10296 - DNA, 25 bp, Mus musculus
aaactgtacctgtaaattgtgcaat

SEQ ID NO: 10297 - DNA, 25 bp, Mus musculus
aaactgtactttaagcacacatgca

SEQ ID NO: 10298 - DNA, 25 bp, Mus musculus
aaactgtacttttagcacacatgca

SEQ ID NO: 10299 - DNA, 25 bp, Mus musculus
aaactgtagctgcatttgaatatca

SEQ ID NO: 10300 - DNA, 25 bp, Mus musculus
aaactgtagctggatttgaatatca

SEQ ID NO: 10301 - DNA, 25 bp, Mus musculus
aaactgtaggacacccggcgtggtg

SEQ ID NO: 10302 - DNA, 25 bp, Mus musculus
aaactgtaggactcccggcgtggtg

SEQ ID NO: 10303 - DNA, 25 bp, Mus musculus
aaactgtagggtctgtcccagctct

SEQ ID NO: 10304 - DNA, 25 bp, Mus musculus
aaactgtagggtgtgtcccagctct

SEQ ID NO: 10305 - DNA, 25 bp, Mus musculus
aaactgtaggtaactgcgtgctttc

SEQ ID NO: 10306 - DNA, 25 bp, Mus musculus
aaactgtaggtatctgcgtgctttc

SEQ ID NO: 10307 - DNA, 25 bp, Mus musculus
aaactgtatcttcctgagagtgaac

SEQ ID NO: 10308 - DNA, 25 bp, Mus musculus
aaactgtatcttgctgagagtgaac

SEQ ID NO: 10309 - DNA, 25 bp, Mus musculus
aaactgtcaatgacaacgaaccaat

SEQ ID NO: 10310 - DNA, 25 bp, Mus musculus
aaactgtcaatgtcaacgaaccaat

SEQ ID NO: 10311 - DNA, 25 bp, Mus musculus
aaactgtcagcgctgggtgtcctct

SEQ ID NO: 10312 - DNA, 25 bp, Mus musculus
aaactgtcagcggtgggtgtcctct

SEQ ID NO: 10313 - DNA, 25 bp, Mus musculus
aaactgtcagctatgtctgtactaa

SEQ ID NO: 10314 - DNA, 25 bp, Mus musculus
aaactgtcagctttgtctgtactaa

SEQ ID NO: 10315 - DNA, 25 bp, Mus musculus
aaactgtcataaaagttcatctcgg

SEQ ID NO: 10316 - DNA, 25 bp, Mus musculus
aaactgtcataatagttcatctcgg

SEQ ID NO: 10317 - DNA, 25 bp, Mus musculus
aaactgtcataccactgaactgagc

SEQ ID NO: 10318 - DNA, 25 bp, Mus musculus
aaactgtcatacctatgggacctac

SEQ ID NO: 10319 - DNA, 25 bp, Mus musculus
aaactgtcatacgactgaactgagc

SEQ ID NO: 10320 - DNA, 25 bp, Mus musculus
aaactgtcatacgtatgggacctac

SEQ ID NO: 10321 - DNA, 25 bp, Mus musculus
aaactgtcatcaagttccagccctg

SEQ ID NO: 10322 - DNA, 25 bp, Mus musculus
aaactgtcatcatgttccagccctg

SEQ ID NO: 10323 - DNA, 25 bp, Mus musculus
aaactgtccactccaacttgattaa

SEQ ID NO: 10324 - DNA, 25 bp, Mus musculus
aaactgtccactgcaacttgattaa

SEQ ID NO: 10325 - DNA, 25 bp, Mus musculus
aaactgtccagcatgtagccaactt

SEQ ID NO: 10326 - DNA, 25 bp, Mus musculus
aaactgtccagcttgtagccaactt

SEQ ID NO: 10327 - DNA, 25 bp, Mus musculus
aaactgtccattcctcattagagca

SEQ ID NO: 10328 - DNA, 25 bp, Mus musculus
aaactgtccattgctcattagagca

SEQ ID NO: 10329 - DNA, 25 bp, Mus musculus
aaactgtcccaaagacctaatccct

SEQ ID NO: 10330 - DNA, 25 bp, Mus musculus
aaactgtcccaatgacctaatccct

SEQ ID NO: 10331 - DNA, 25 bp, Mus musculus
aaactgtcccgcaaccttgagatat

SEQ ID NO: 10332 - DNA, 25 bp, Mus musculus
aaactgtcccgctaccttgagatat

SEQ ID NO: 10333 - DNA, 25 bp, Mus musculus
aaactgtccctgagcctagatgaaa

SEQ ID NO: 10334 - DNA, 25 bp, Mus musculus
aaactgtccctgtgcctagatgaaa

SEQ ID NO: 10335 - DNA, 25 bp, Mus musculus
aaactgtccttgagtgaggttttca

SEQ ID NO: 10336 - DNA, 25 bp, Mus musculus
aaactgtccttgtgtgaggttttca

SEQ ID NO: 10337 - DNA, 25 bp, Mus musculus
aaactgtcgggaccaggatgcacga

SEQ ID NO: 10338 - DNA, 25 bp, Mus musculus
aaactgtcgggagcaggatgcacga

SEQ ID NO: 10339 - DNA, 25 bp, Mus musculus
aaactgtctatccaatttccgtaat

SEQ ID NO: 10340 - DNA, 25 bp, Mus musculus
aaactgtctatcgaatttccgtaat

SEQ ID NO: 10341 - DNA, 25 bp, Mus musculus
aaactgtctcacacggtttatggag

SEQ ID NO: 10342 - DNA, 25 bp, Mus musculus
aaactgtctcactcggtttatggag

SEQ ID NO: 10343 - DNA, 25 bp, Mus musculus
aaactgtctccacagagttgttggg

SEQ ID NO: 10344 - DNA, 25 bp, Mus musculus
aaactgtctccagagagttgttggg

SEQ ID NO: 10345 - DNA, 25 bp, Mus musculus
aaactgtctggccagtaatccccag

SEQ ID NO: 10346 - DNA, 25 bp, Mus musculus
aaactgtctggcgagtaatccccag

SEQ ID NO: 10347 - DNA, 25 bp, Mus musculus
aaactgtcttccagaactacttgct

SEQ ID NO: 10348 - DNA, 25 bp, Mus musculus
aaactgtcttcccaacaattccatg

SEQ ID NO: 10349 - DNA, 25 bp, Mus musculus
aaactgtcttccgaacaattccatg

SEQ ID NO: 10350 - DNA, 25 bp, Mus musculus
aaactgtcttcctgaactacttgct

SEQ ID NO: 10351 - DNA, 25 bp, Mus musculus
aaactgtcttttatgcttggatcgc

SEQ ID NO: 10352 - DNA, 25 bp, Mus musculus
aaactgtcttttttgcttggatcgc

SEQ ID NO: 10353 - DNA, 25 bp, Mus musculus
aaactgtgaagcattcccagtgcac

SEQ ID NO: 10354 - DNA, 25 bp, Mus musculus
aaactgtgaagctttcccagtgcac

SEQ ID NO: 10355 - DNA, 25 bp, Mus musculus
aaactgtgaccccagcatttgagag

SEQ ID NO: 10356 - DNA, 25 bp, Mus musculus
aaactgtgacccgagcatttgagag

SEQ ID NO: 10357 - DNA, 25 bp, Mus musculus
aaactgtgaccgcaacggcaacttc

SEQ ID NO: 10358 - DNA, 25 bp, Mus musculus
aaactgtgaccggaacggcaacttc

SEQ ID NO: 10359 - DNA, 25 bp, Mus musculus
aaactgtgacggagccagagcaaca

SEQ ID NO: 10360 - DNA, 25 bp, Mus musculus
aaactgtgacggtgccagagcaaca

SEQ ID NO: 10361 - DNA, 25 bp, Mus musculus
aaactgtgacgtatcctttatgtgg

SEQ ID NO: 10362 - DNA, 25 bp, Mus musculus
aaactgtgacgtttcctttatgtgg

SEQ ID NO: 10363 - DNA, 25 bp, Mus musculus
aaactgtgagacatccggcgtgggt

SEQ ID NO: 10364 - DNA, 25 bp, Mus musculus
aaactgtgagacttccggcgtgggt

SEQ ID NO: 10365 - DNA, 25 bp, Mus musculus
aaactgtgagcccagaagctccatc

SEQ ID NO: 10366 - DNA, 25 bp, Mus musculus
aaactgtgagccgagaagctccatc

SEQ ID NO: 10367 - DNA, 25 bp, Mus musculus
aaactgtgagtaccgactcctcggg

SEQ ID NO: 10368 - DNA, 25 bp, Mus musculus
aaactgtgagtagcgactcctcggg

SEQ ID NO: 10369 - DNA, 25 bp, Mus musculus
aaactgtgattgagttttagaacaa

SEQ ID NO: 10370 - DNA, 25 bp, Mus musculus
aaactgtgattgtgttttagaacaa

SEQ ID NO: 10371 - DNA, 25 bp, Mus musculus
aaactgtgatttatcaacttatgaa

SEQ ID NO: 10372 - DNA, 25 bp, Mus musculus
aaactgtgatttttcaacttatgaa

SEQ ID NO: 10373 - DNA, 25 bp, Mus musculus
aaactgtgccccagtcattaacagg

SEQ ID NO: 10374 - DNA, 25 bp, Mus musculus
aaactgtgcccctgtcattaacagg

SEQ ID NO: 10375 - DNA, 25 bp, Mus musculus
aaactgtgcgggaaatacttgttat

SEQ ID NO: 10376 - DNA, 25 bp, Mus musculus
aaactgtgcgggtaatacttgttat

SEQ ID NO: 10377 - DNA, 25 bp, Mus musculus
aaactgtgctaaacgaactctgtca

SEQ ID NO: 10378 - DNA, 25 bp, Mus musculus
aaactgtgctaatcgaactctgtca

SEQ ID NO: 10379 - DNA, 25 bp, Mus musculus
aaactgtgctcaacttggcttatgc

SEQ ID NO: 10380 - DNA, 25 bp, Mus musculus
aaactgtgctcatcttggcttatgc

SEQ ID NO: 10381 - DNA, 25 bp, Mus musculus
aaactgtgctccacaggccactggg

SEQ ID NO: 10382 - DNA, 25 bp, Mus musculus
aaactgtgctcctcaggccactggg

SEQ ID NO: 10383 - DNA, 25 bp, Mus musculus
aaactgtgctgtcattcccagctca

SEQ ID NO: 10384 - DNA, 25 bp, Mus musculus
aaactgtgctgtgattcccagctca

SEQ ID NO: 10385 - DNA, 25 bp, Mus musculus
aaactgtggcacaacctacccatat

SEQ ID NO: 10386 - DNA, 25 bp, Mus musculus
aaactgtggcactacctacccatat

SEQ ID NO: 10387 - DNA, 25 bp, Mus musculus
aaactgtggccaagctttggttgaa

SEQ ID NO: 10388 - DNA, 25 bp, Mus musculus
aaactgtggccatgctttggttgaa

SEQ ID NO: 10389 - DNA, 25 bp, Mus musculus
aaactgtggcttactgctcgctctg

SEQ ID NO: 10390 - DNA, 25 bp, Mus musculus
aaactgtggctttctgctcgctctg

SEQ ID NO: 10391 - DNA, 25 bp, Mus musculus
aaactgtgggttagtcttgggcatc

SEQ ID NO: 10392 - DNA, 25 bp, Mus musculus
aaactgtgggtttgtcttgggcatc

SEQ ID NO: 10393 - DNA, 25 bp, Mus musculus
aaactgtggtcaccttagccataca

SEQ ID NO: 10394 - DNA, 25 bp, Mus musculus
aaactgtggtcagcttagccataca

SEQ ID NO: 10395 - DNA, 25 bp, Mus musculus
aaactgtggttcatctgttcactgt

SEQ ID NO: 10396 - DNA, 25 bp, Mus musculus
aaactgtggttcttctgttcactgt

SEQ ID NO: 10397 - DNA, 25 bp, Mus musculus
aaactgtgtcagctgtcttttgagt

SEQ ID NO: 10398 - DNA, 25 bp, Mus musculus
aaactgtgtcaggtgtcttttgagt

SEQ ID NO: 10399 - DNA, 25 bp, Mus musculus
aaactgtgtgccacagggattaagg

SEQ ID NO: 10400 - DNA, 25 bp, Mus musculus
aaactgtgtgcctcagggattaagg

SEQ ID NO: 10401 - DNA, 25 bp, Mus musculus
aaactgtgtggaaaagtgtccctgt

SEQ ID NO: 10402 - DNA, 25 bp, Mus musculus
aaactgtgtggataagtgtccctgt

SEQ ID NO: 10403 - DNA, 25 bp, Mus musculus
aaactgtgtgtcagcgttctggtca

SEQ ID NO: 10404 - DNA, 25 bp, Mus musculus
aaactgtgtgtctgcgttctggtca

SEQ ID NO: 10405 - DNA, 25 bp, Mus musculus
aaactgtgtttgcaactctgctgaa

SEQ ID NO: 10406 - DNA, 25 bp, Mus musculus
aaactgtgtttggaactctgctgaa

SEQ ID NO: 10407 - DNA, 25 bp, Mus musculus
aaactgttaaccactgtcactctga

SEQ ID NO: 10408 - DNA, 25 bp, Mus musculus
aaactgttaacctctgtcactctga

SEQ ID NO: 10409 - DNA, 25 bp, Mus musculus
aaactgttacctcaaattactcaag

SEQ ID NO: 10410 - DNA, 25 bp, Mus musculus
aaactgttacctgaaattactcaag

SEQ ID NO: 10411 - DNA, 25 bp, Mus musculus
aaactgttactcacagggcctgtta

SEQ ID NO: 10412 - DNA, 25 bp, Mus musculus
aaactgttactctcagggcctgtta

SEQ ID NO: 10413 - DNA, 25 bp, Mus musculus
aaactgttactgatctgtaccccag

SEQ ID NO: 10414 - DNA, 25 bp, Mus musculus
aaactgttactgttctgtaccccag

SEQ ID NO: 10415 - DNA, 25 bp, Mus musculus
aaactgttagacctgctgcagcttg

SEQ ID NO: 10416 - DNA, 25 bp, Mus musculus
aaactgttagacgtgctgcagcttg

SEQ ID NO: 10417 - DNA, 25 bp, Mus musculus
aaactgttagtgacacaacggtgac

SEQ ID NO: 10418 - DNA, 25 bp, Mus musculus
aaactgttagtgtcacaacggtgac

SEQ ID NO: 10419 - DNA, 25 bp, Mus musculus
aaactgttcaagaatttgctacaac

SEQ ID NO: 10420 - DNA, 25 bp, Mus musculus
aaactgttcaagtatttgctacaac

SEQ ID NO: 10421 - DNA, 25 bp, Mus musculus
aaactgttcatcactgttatcctga

SEQ ID NO: 10422 - DNA, 25 bp, Mus musculus
aaactgttcatctctgttatcctga

SEQ ID NO: 10423 - DNA, 25 bp, Mus musculus
aaactgttccagacgcctgtgggca

SEQ ID NO: 10424 - DNA, 25 bp, Mus musculus
aaactgttccagtcgcctgtgggca

SEQ ID NO: 10425 - DNA, 25 bp, Mus musculus
aaactgttcctcatcttaaggcgac

SEQ ID NO: 10426 - DNA, 25 bp, Mus musculus
aaactgttcctcttcttaaggcgac

SEQ ID NO: 10427 - DNA, 25 bp, Mus musculus
aaactgttcgggagcggttagagca

SEQ ID NO: 10428 - DNA, 25 bp, Mus musculus
aaactgttcgggtgcggttagagca

SEQ ID NO: 10429 - DNA, 25 bp, Mus musculus
aaactgttctctcactgagtggctg

SEQ ID NO: 10430 - DNA, 25 bp, Mus musculus
aaactgttctctgactgagtggctg

SEQ ID NO: 10431 - DNA, 25 bp, Mus musculus
aaactgttgcaccttctgaaatgac

SEQ ID NO: 10432 - DNA, 25 bp, Mus musculus
aaactgttgcacgttctgaaatgac

SEQ ID NO: 10433 - DNA, 25 bp, Mus musculus
aaactgttgcatccctttttgtaga

SEQ ID NO: 10434 - DNA, 25 bp, Mus musculus
aaactgttgcatgcctttttgtaga

SEQ ID NO: 10435 - DNA, 25 bp, Mus musculus
aaactgttgctactaaatcttattt

SEQ ID NO: 10436 - DNA, 25 bp, Mus musculus
aaactgttgctagtaaatcttattt

SEQ ID NO: 10437 - DNA, 25 bp, Mus musculus
aaactgttgggacacggtcactcgt

SEQ ID NO: 10438 - DNA, 25 bp, Mus musculus
aaactgttgggagacggtcactcgt

SEQ ID NO: 10439 - DNA, 25 bp, Mus musculus
aaactgttgtagacaagaatcccaa

SEQ ID NO: 10440 - DNA, 25 bp, Mus musculus
aaactgttgtagtcaagaatcccaa

SEQ ID NO: 10441 - DNA, 25 bp, Mus musculus
aaactgtttctaagctgggatgtac

SEQ ID NO: 10442 - DNA, 25 bp, Mus musculus
aaactgtttctatgctgggatgtac

SEQ ID NO: 10443 - DNA, 25 bp, Mus musculus
aaactgttttgtactgatgttgccc

SEQ ID NO: 10444 - DNA, 25 bp, Mus musculus
aaactgttttgttctgatgttgccc

SEQ ID NO: 10445 - DNA, 25 bp, Mus musculus
aaacttaaaagcatcacaaatggtg

SEQ ID NO: 10446 - DNA, 25 bp, Mus musculus
aaacttaaaagcttcacaaatggtg

SEQ ID NO: 10447 - DNA, 25 bp, Mus musculus
aaacttaaccatctcgtcactgtgc

SEQ ID NO: 10448 - DNA, 25 bp, Mus musculus
aaacttaaccatgtcgtcactgtgc

SEQ ID NO: 10449 - DNA, 25 bp, Mus musculus
aaacttaactccacagagcttctgc

SEQ ID NO: 10450 - DNA, 25 bp, Mus musculus
aaacttaactcctcagagcttctgc

SEQ ID NO: 10451 - DNA, 25 bp, Mus musculus
aaacttaatcaccaatgctcaggga

SEQ ID NO: 10452 - DNA, 25 bp, Mus musculus
aaacttaatcacgaatgctcaggga

SEQ ID NO: 10453 - DNA, 25 bp, Mus musculus
aaacttaatggcatctgctcagatt

SEQ ID NO: 10454 - DNA, 25 bp, Mus musculus
aaacttaatggcttctgctcagatt

SEQ ID NO: 10455 - DNA, 25 bp, Mus musculus
aaacttaattgtctctcggtcactg

SEQ ID NO: 10456 - DNA, 25 bp, Mus musculus
aaacttaattgtgtctcggtcactg

SEQ ID NO: 10457 - DNA, 25 bp, Mus musculus
aaacttaatttcaggcctgtgacta

SEQ ID NO: 10458 - DNA, 25 bp, Mus musculus
aaacttaatttctggcctgtgacta

SEQ ID NO: 10459 - DNA, 25 bp, Mus musculus
aaacttacatggaccggtgggatca

SEQ ID NO: 10460 - DNA, 25 bp, Mus musculus
aaacttacatggtccggtgggatca

SEQ ID NO: 10461 - DNA, 25 bp, Mus musculus
aaacttacccatcacgttgaattga

SEQ ID NO: 10462 - DNA, 25 bp, Mus musculus
aaacttacccatgacgttgaattga

SEQ ID NO: 10463 - DNA, 25 bp, Mus musculus
aaacttacgcagctggttgcagata

SEQ ID NO: 10464 - DNA, 25 bp, Mus musculus
aaacttacgcaggtggttgcagata

SEQ ID NO: 10465 - DNA, 25 bp, Mus musculus
aaacttacgcatcataggtcctttg

SEQ ID NO: 10466 - DNA, 25 bp, Mus musculus
aaacttacgcatgataggtcctttg

SEQ ID NO: 10467 - DNA, 25 bp, Mus musculus
aaacttacgtcacagtccatggcat

SEQ ID NO: 10468 - DNA, 25 bp, Mus musculus
aaacttacgtcagagtccatggcat

SEQ ID NO: 10469 - DNA, 25 bp, Mus musculus
aaacttactcgccttgacatgcagt

SEQ ID NO: 10470 - DNA, 25 bp, Mus musculus
aaacttactcgcgttgacatgcagt

SEQ ID NO: 10471 - DNA, 25 bp, Mus musculus
aaacttactctgctcaacggtgtca

SEQ ID NO: 10472 - DNA, 25 bp, Mus musculus
aaacttactctggtcaacggtgtca

SEQ ID NO: 10473 - DNA, 25 bp, Mus musculus
aaacttagcaaaccatcctgctgaa

SEQ ID NO: 10474 - DNA, 25 bp, Mus musculus
aaacttagcaaagcatcctgctgaa

SEQ ID NO: 10475 - DNA, 25 bp, Mus musculus
aaacttagcaacagagctctcccct

SEQ ID NO: 10476 - DNA, 25 bp, Mus musculus
aaacttagcaactgagctctcccct

SEQ ID NO: 10477 - DNA, 25 bp, Mus musculus
aaacttagcaatccttatttgttag

SEQ ID NO: 10478 - DNA, 25 bp, Mus musculus
aaacttagcaatgcttatttgttag

SEQ ID NO: 10479 - DNA, 25 bp, Mus musculus
aaacttaggctaatgagaggctcct

SEQ ID NO: 10480 - DNA, 25 bp, Mus musculus
aaacttaggctattgagaggctcct

SEQ ID NO: 10481 - DNA, 25 bp, Mus musculus
aaacttagggcaatggtgtggccat

SEQ ID NO: 10482 - DNA, 25 bp, Mus musculus
aaacttagggcattggtgtggccat

SEQ ID NO: 10483 - DNA, 25 bp, Mus musculus
aaacttagggtgaatcacatactat

SEQ ID NO: 10484 - DNA, 25 bp, Mus musculus
aaacttagggtgtatcacatactat

SEQ ID NO: 10485 - DNA, 25 bp, Mus musculus
aaacttagtaacattccctcagcct

SEQ ID NO: 10486 - DNA, 25 bp, Mus musculus
aaacttagtaactttccctcagcct

SEQ ID NO: 10487 - DNA, 25 bp, Mus musculus
aaacttagtggcacagtgtcaggta

SEQ ID NO: 10488 - DNA, 25 bp, Mus musculus
aaacttagtggctcagtgtcaggta

SEQ ID NO: 10489 - DNA, 25 bp, Mus musculus
aaacttatagaccttcatgtcatga

SEQ ID NO: 10490 - DNA, 25 bp, Mus musculus
aaacttatagacgttcatgtcatga

SEQ ID NO: 10491 - DNA, 25 bp, Mus musculus
aaacttatgattagattcacagtca

SEQ ID NO: 10492 - DNA, 25 bp, Mus musculus
aaacttatgatttgattcacagtca

SEQ ID NO: 10493 - DNA, 25 bp, Mus musculus
aaacttatgctcattgtccaaagga

SEQ ID NO: 10494 - DNA, 25 bp, Mus musculus
aaacttatgctctttgtccaaagga

SEQ ID NO: 10495 - DNA, 25 bp, Mus musculus
aaacttatgtttcccgtgtatgaga

SEQ ID NO: 10496 - DNA, 25 bp, Mus musculus
aaacttatgtttgccgtgtatgaga

SEQ ID NO: 10497 - DNA, 25 bp, Mus musculus
aaacttatttcgcagctgtgccatg

SEQ ID NO: 10498 - DNA, 25 bp, Mus musculus
aaacttatttcggagctgtgccatg

SEQ ID NO: 10499 - DNA, 25 bp, Mus musculus
aaacttatttggcagaattttgcat

SEQ ID NO: 10500 - DNA, 25 bp, Mus musculus
aaacttatttgggagaattttgcat

SEQ ID NO: 10501 - DNA, 25 bp, Mus musculus
aaacttcaagatcctgttctctatt

SEQ ID NO: 10502 - DNA, 25 bp, Mus musculus
aaacttcaagatgctgttctctatt

SEQ ID NO: 10503 - DNA, 25 bp, Mus musculus
aaacttcaagtcaacctgtcagcgg

SEQ ID NO: 10504 - DNA, 25 bp, Mus musculus
aaacttcaagtctacctgtcagcgg

SEQ ID NO: 10505 - DNA, 25 bp, Mus musculus
aaacttcaatctacagagacacgtg

SEQ ID NO: 10506 - DNA, 25 bp, Mus musculus
aaacttcaatcttcagagacacgtg

SEQ ID NO: 10507 - DNA, 25 bp, Mus musculus
aaacttcaatttatctcttgtctga

SEQ ID NO: 10508 - DNA, 25 bp, Mus musculus
aaacttcaatttttctcttgtctga

SEQ ID NO: 10509 - DNA, 25 bp, Mus musculus
aaacttcacagtacagagaattgtt

SEQ ID NO: 10510 - DNA, 25 bp, Mus musculus
aaacttcacagttcagagaattgtt

SEQ ID NO: 10511 - DNA, 25 bp, Mus musculus
aaacttcacccacgcgtcaaatatc

SEQ ID NO: 10512 - DNA, 25 bp, Mus musculus
aaacttcacccaggcgtcaaatatc

SEQ ID NO: 10513 - DNA, 25 bp, Mus musculus
aaacttcaccctaccagaggttgca

SEQ ID NO: 10514 - DNA, 25 bp, Mus musculus
aaacttcacccttccagaggttgca

SEQ ID NO: 10515 - DNA, 25 bp, Mus musculus
aaacttcacctacaattgccatcag

SEQ ID NO: 10516 - DNA, 25 bp, Mus musculus
aaacttcacctagaattgccatcag

SEQ ID NO: 10517 - DNA, 25 bp, Mus musculus
aaacttcacgtcattgttgcttgat

SEQ ID NO: 10518 - DNA, 25 bp, Mus musculus
aaacttcacgtctttgttgcttgat

SEQ ID NO: 10519 - DNA, 25 bp, Mus musculus
aaacttcactcacacacaggcacat

SEQ ID NO: 10520 - DNA, 25 bp, Mus musculus
aaacttcactcagacacaggcacat

SEQ ID NO: 10521 - DNA, 25 bp, Mus musculus
aaacttcagcttattccaatggatg

SEQ ID NO: 10522 - DNA, 25 bp, Mus musculus
aaacttcagctttttccaatggatg

SEQ ID NO: 10523 - DNA, 25 bp, Mus musculus
aaacttcagggcacaattgcgcttt

SEQ ID NO: 10524 - DNA, 25 bp, Mus musculus
aaacttcagggctcaattgcgcttt

SEQ ID NO: 10525 - DNA, 25 bp, Mus musculus
aaacttcagtggcttctagatcaaa

SEQ ID NO: 10526 - DNA, 25 bp, Mus musculus
aaacttcagtgggttctagatcaaa

SEQ ID NO: 10527 - DNA, 25 bp, Mus musculus
aaacttcagttcagaggcgagcatc

SEQ ID NO: 10528 - DNA, 25 bp, Mus musculus
aaacttcagttctgaggcgagcatc

SEQ ID NO: 10529 - DNA, 25 bp, Mus musculus
aaacttcagtttatgcttcagctag

SEQ ID NO: 10530 - DNA, 25 bp, Mus musculus
aaacttcagtttttgcttcagctag

SEQ ID NO: 10531 - DNA, 25 bp, Mus musculus
aaacttcatctactaatttacattt

SEQ ID NO: 10532 - DNA, 25 bp, Mus musculus
aaacttcatctagtaatttacattt

SEQ ID NO: 10533 - DNA, 25 bp, Mus musculus
aaacttcatgacagcgtgggtccca

SEQ ID NO: 10534 - DNA, 25 bp, Mus musculus
aaacttcatgactgcgtgggtccca

SEQ ID NO: 10535 - DNA, 25 bp, Mus musculus
aaacttcatgctagcaaatttaata

SEQ ID NO: 10536 - DNA, 25 bp, Mus musculus
aaacttcatgcttgcaaatttaata

SEQ ID NO: 10537 - DNA, 25 bp, Mus musculus
aaacttcatggtctacttatgctag

SEQ ID NO: 10538 - DNA, 25 bp, Mus musculus
aaacttcatggtgtacttatgctag

SEQ ID NO: 10539 - DNA, 25 bp, Mus musculus
aaacttcatgttacaaggcaagctt

SEQ ID NO: 10540 - DNA, 25 bp, Mus musculus
aaacttcatgtttcaaggcaagctt

SEQ ID NO: 10541 - DNA, 25 bp, Mus musculus
aaacttcatttgatggaagctaacg

SEQ ID NO: 10542 - DNA, 25 bp, Mus musculus
aaacttcatttgttggaagctaacg

SEQ ID NO: 10543 - DNA, 25 bp, Mus musculus
aaacttcattttcattggcagctaa

SEQ ID NO: 10544 - DNA, 25 bp, Mus musculus
aaacttcattttgattggcagctaa

SEQ ID NO: 10545 - DNA, 25 bp, Mus musculus
aaacttccaaatagctctacctctg

SEQ ID NO: 10546 - DNA, 25 bp, Mus musculus
aaacttccaaattgctctacctctg

SEQ ID NO: 10547 - DNA, 25 bp, Mus musculus
aaacttccaggactatgtcgccttc

SEQ ID NO: 10548 - DNA, 25 bp, Mus musculus
aaacttccaggagtatgtcgccttc

SEQ ID NO: 10549 - DNA, 25 bp, Mus musculus
aaacttccatgaatgcaggaaagtt

SEQ ID NO: 10550 - DNA, 25 bp, Mus musculus
aaacttccatgattgcaggaaagtt

SEQ ID NO: 10551 - DNA, 25 bp, Mus musculus
aaacttccatgtattcagggatatt

SEQ ID NO: 10552 - DNA, 25 bp, Mus musculus
aaacttccatgttttcagggatatt

SEQ ID NO: 10553 - DNA, 25 bp, Mus musculus
aaacttccatttctggtagtggcat

SEQ ID NO: 10554 - DNA, 25 bp, Mus musculus
aaacttccatttgtggtagtggcat

SEQ ID NO: 10555 - DNA, 25 bp, Mus musculus
aaacttcccctaccactgtggctga

SEQ ID NO: 10556 - DNA, 25 bp, Mus musculus
aaacttcccctagcactgtggctga

SEQ ID NO: 10557 - DNA, 25 bp, Mus musculus
aaacttccctggctgagtgtgactc

SEQ ID NO: 10558 - DNA, 25 bp, Mus musculus
aaacttccctgggtgagtgtgactc

SEQ ID NO: 10559 - DNA, 25 bp, Mus musculus
aaacttccgggcaagaacgtgccat

SEQ ID NO: 10560 - DNA, 25 bp, Mus musculus
aaacttccgggctagaacgtgccat

SEQ ID NO: 10561 - DNA, 25 bp, Mus musculus
aaacttcctcatactgtttctgagt

SEQ ID NO: 10562 - DNA, 25 bp, Mus musculus
aaacttcctcattctgtttctgagt

SEQ ID NO: 10563 - DNA, 25 bp, Mus musculus
aaacttcctctaagggtggtgcaca

SEQ ID NO: 10564 - DNA, 25 bp, Mus musculus
aaacttcctctatgggtggtgcaca

SEQ ID NO: 10565 - DNA, 25 bp, Mus musculus
aaacttcctctgaacaagcttggat

SEQ ID NO: 10566 - DNA, 25 bp, Mus musculus
aaacttcctctgtacaagcttggat

SEQ ID NO: 10567 - DNA, 25 bp, Mus musculus
aaacttcctgagaagtatcagaaca

SEQ ID NO: 10568 - DNA, 25 bp, Mus musculus
aaacttcctgagtagtatcagaaca

SEQ ID NO: 10569 - DNA, 25 bp, Mus musculus
aaacttcctggaactgactgaatta

SEQ ID NO: 10570 - DNA, 25 bp, Mus musculus
aaacttcctggatctgactgaatta

SEQ ID NO: 10571 - DNA, 25 bp, Mus musculus
aaacttccttacactgaggaagagg

SEQ ID NO: 10572 - DNA, 25 bp, Mus musculus
aaacttccttactctgaggaagagg

SEQ ID NO: 10573 - DNA, 25 bp, Mus musculus
aaacttcgatcaaaccctaatgcct

SEQ ID NO: 10574 - DNA, 25 bp, Mus musculus
aaacttcgatcataccctaatgcct

SEQ ID NO: 10575 - DNA, 25 bp, Mus musculus
aaacttcgcatcatgaaaccccagg

SEQ ID NO: 10576 - DNA, 25 bp, Mus musculus
aaacttcgcatcttgaaaccccagg

SEQ ID NO: 10577 - DNA, 25 bp, Mus musculus
aaacttcggtcaagcatcgcagtgc

SEQ ID NO: 10578 - DNA, 25 bp, Mus musculus
aaacttcggtcatgcatcgcagtgc

SEQ ID NO: 10579 - DNA, 25 bp, Mus musculus
aaacttcggttccatgtccttagca

SEQ ID NO: 10580 - DNA, 25 bp, Mus musculus
aaacttcggttcgatgtccttagca

SEQ ID NO: 10581 - DNA, 25 bp, Mus musculus
aaacttcgtcgaatccattgtgata

SEQ ID NO: 10582 - DNA, 25 bp, Mus musculus
aaacttcgtcgattccattgtgata

SEQ ID NO: 10583 - DNA, 25 bp, Mus musculus
aaacttcgtgaaccgtgactggcta

SEQ ID NO: 10584 - DNA, 25 bp, Mus musculus
aaacttcgtgaagcgtgactggcta

SEQ ID NO: 10585 - DNA, 25 bp, Mus musculus
aaacttcgtggcagcccgtgagcag

SEQ ID NO: 10586 - DNA, 25 bp, Mus musculus
aaacttcgtggctgcccgtgagcag

SEQ ID NO: 10587 - DNA, 25 bp, Mus musculus
aaacttctaatcctatcatcacact

SEQ ID NO: 10588 - DNA, 25 bp, Mus musculus
aaacttctaatcgtatcatcacact

SEQ ID NO: 10589 - DNA, 25 bp, Mus musculus
aaacttctatcaccctttccttttg

SEQ ID NO: 10590 - DNA, 25 bp, Mus musculus
aaacttctatcagcctttccttttg

SEQ ID NO: 10591 - DNA, 25 bp, Mus musculus
aaacttctcagaccatcacgtaatc

SEQ ID NO: 10592 - DNA, 25 bp, Mus musculus
aaacttctcagagcatcacgtaatc

SEQ ID NO: 10593 - DNA, 25 bp, Mus musculus
aaacttctcagtcgcagctgtgctc

SEQ ID NO: 10594 - DNA, 25 bp, Mus musculus
aaacttctcagtggcagctgtgctc

SEQ ID NO: 10595 - DNA, 25 bp, Mus musculus
aaacttctccagctgataaacaact

SEQ ID NO: 10596 - DNA, 25 bp, Mus musculus
aaacttctccaggtgataaacaact

SEQ ID NO: 10597 - DNA, 25 bp, Mus musculus
aaacttctccataattacagtgcaa

SEQ ID NO: 10598 - DNA, 25 bp, Mus musculus
aaacttctccattattacagtgcaa

SEQ ID NO: 10599 - DNA, 25 bp, Mus musculus
aaacttctccctcgcttagcaagtc

SEQ ID NO: 10600 - DNA, 25 bp, Mus musculus
aaacttctccctggcttagcaagtc

SEQ ID NO: 10601 - DNA, 25 bp, Mus musculus
aaacttctccttaagtcaacgctca

SEQ ID NO: 10602 - DNA, 25 bp, Mus musculus
aaacttctcctttagtcaacgctca

SEQ ID NO: 10603 - DNA, 25 bp, Mus musculus
aaacttctcggccttttatgaatct

SEQ ID NO: 10604 - DNA, 25 bp, Mus musculus
aaacttctcggcgttttatgaatct

SEQ ID NO: 10605 - DNA, 25 bp, Mus musculus
aaacttctctctcggatttgctgca

SEQ ID NO: 10606 - DNA, 25 bp, Mus musculus
aaacttctctctgggatttgctgca

SEQ ID NO: 10607 - DNA, 25 bp, Mus musculus
aaacttctcttacattggtctatag

SEQ ID NO: 10608 - DNA, 25 bp, Mus musculus
aaacttctcttagattggtctatag

SEQ ID NO: 10609 - DNA, 25 bp, Mus musculus
aaacttctgagaagactggacctag

SEQ ID NO: 10610 - DNA, 25 bp, Mus musculus
aaacttctgagatgactggacctag

SEQ ID NO: 10611 - DNA, 25 bp, Mus musculus
aaacttctgcacaacattcagctcc

SEQ ID NO: 10612 - DNA, 25 bp, Mus musculus
aaacttctgcacatgacttgttaca

SEQ ID NO: 10613 - DNA, 25 bp, Mus musculus
aaacttctgcactacattcagctcc

SEQ ID NO: 10614 - DNA, 25 bp, Mus musculus
aaacttctgcacttgacttgttaca

SEQ ID NO: 10615 - DNA, 25 bp, Mus musculus
aaacttctgccaagactgcgtctaa

SEQ ID NO: 10616 - DNA, 25 bp, Mus musculus
aaacttctgccactcgaaccttcaa

SEQ ID NO: 10617 - DNA, 25 bp, Mus musculus
aaacttctgccagtcgaaccttcaa

SEQ ID NO: 10618 - DNA, 25 bp, Mus musculus
aaacttctgccatgactgcgtctaa

SEQ ID NO: 10619 - DNA, 25 bp, Mus musculus
aaacttctgctcatgtcaatgcttg

SEQ ID NO: 10620 - DNA, 25 bp, Mus musculus
aaacttctgctcttgtcaatgcttg

SEQ ID NO: 10621 - DNA, 25 bp, Mus musculus
aaacttctggatactagaggatgac

SEQ ID NO: 10622 - DNA, 25 bp, Mus musculus
aaacttctggattctagaggatgac

SEQ ID NO: 10623 - DNA, 25 bp, Mus musculus
aaacttctggtaacgcctggatctg

SEQ ID NO: 10624 - DNA, 25 bp, Mus musculus
aaacttctggtatcgcctggatctg

SEQ ID NO: 10625 - DNA, 25 bp, Mus musculus
aaacttctttcaactcatttgtgtt

SEQ ID NO: 10626 - DNA, 25 bp, Mus musculus
aaacttctttcatctcatttgtgtt

SEQ ID NO: 10627 - DNA, 25 bp, Mus musculus
aaacttctttgaaggcacttattaa

SEQ ID NO: 10628 - DNA, 25 bp, Mus musculus
aaacttctttgatggcacttattaa

SEQ ID NO: 10629 - DNA, 25 bp, Mus musculus
aaacttgaactgaaggatgccatta

SEQ ID NO: 10630 - DNA, 25 bp, Mus musculus
aaacttgaactgtaggatgccatta

SEQ ID NO: 10631 - DNA, 25 bp, Mus musculus
aaacttgaatatagccacctgaagc

SEQ ID NO: 10632 - DNA, 25 bp, Mus musculus
aaacttgaatattgccacctgaagc

SEQ ID NO: 10633 - DNA, 25 bp, Mus musculus
aaacttgacgctccttatgaagcta

SEQ ID NO: 10634 - DNA, 25 bp, Mus musculus
aaacttgacgctgcttatgaagcta

SEQ ID NO: 10635 - DNA, 25 bp, Mus musculus
aaacttgactgcatcgtctacttgc

SEQ ID NO: 10636 - DNA, 25 bp, Mus musculus
aaacttgactgcttcgtctacttgc

SEQ ID NO: 10637 - DNA, 25 bp, Mus musculus
aaacttgacttgctgttgctacagg

SEQ ID NO: 10638 - DNA, 25 bp, Mus musculus
aaacttgacttggtgttgctacagg

SEQ ID NO: 10639 - DNA, 25 bp, Mus musculus
aaacttgagaccctcacgtttatgt

SEQ ID NO: 10640 - DNA, 25 bp, Mus musculus
aaacttgagaccgtcacgtttatgt

SEQ ID NO: 10641 - DNA, 25 bp, Mus musculus
aaacttgaggcaattcttactattg

SEQ ID NO: 10642 - DNA, 25 bp, Mus musculus
aaacttgaggcatttcttactattg

SEQ ID NO: 10643 - DNA, 25 bp, Mus musculus
aaacttgaggtgctcatacagtata

SEQ ID NO: 10644 - DNA, 25 bp, Mus musculus
aaacttgaggtggtcatacagtata

SEQ ID NO: 10645 - DNA, 25 bp, Mus musculus
aaacttgataatagccatttcctag

SEQ ID NO: 10646 - DNA, 25 bp, Mus musculus
aaacttgataattgccatttcctag

SEQ ID NO: 10647 - DNA, 25 bp, Mus musculus
aaacttgattttcctgaagcatcca

SEQ ID NO: 10648 - DNA, 25 bp, Mus musculus
aaacttgattttgctgaagcatcca

SEQ ID NO: 10649 - DNA, 25 bp, Mus musculus
aaacttgcacaaactaatggctggg

SEQ ID NO: 10650 - DNA, 25 bp, Mus musculus
aaacttgcacaatctaatggctggg

SEQ ID NO: 10651 - DNA, 25 bp, Mus musculus
aaacttgcacaccagtgttcacggc

SEQ ID NO: 10652 - DNA, 25 bp, Mus musculus
aaacttgcacacgagtgttcacggc

SEQ ID NO: 10653 - DNA, 25 bp, Mus musculus
aaacttgcagctataacaattgtaa

SEQ ID NO: 10654 - DNA, 25 bp, Mus musculus
aaacttgcagctttaacaattgtaa

SEQ ID NO: 10655 - DNA, 25 bp, Mus musculus
aaacttgcctcaagctgaaagctga

SEQ ID NO: 10656 - DNA, 25 bp, Mus musculus
aaacttgcctcatgctgaaagctga

SEQ ID NO: 10657 - DNA, 25 bp, Mus musculus
aaacttgcgcaacaaacctccacgt

SEQ ID NO: 10658 - DNA, 25 bp, Mus musculus
aaacttgcgcaagaaacctccacgt

SEQ ID NO: 10659 - DNA, 25 bp, Mus musculus
aaacttgcggataccagccctagca

SEQ ID NO: 10660 - DNA, 25 bp, Mus musculus
aaacttgcggattccagccctagca

SEQ ID NO: 10661 - DNA, 25 bp, Mus musculus
aaacttgctcataggtgcttgcttc

SEQ ID NO: 10662 - DNA, 25 bp, Mus musculus
aaacttgctcattggtgcttgcttc

SEQ ID NO: 10663 - DNA, 25 bp, Mus musculus
aaacttgctcgccatgtccgagata

SEQ ID NO: 10664 - DNA, 25 bp, Mus musculus
aaacttgctcgcgatgtccgagata

SEQ ID NO: 10665 - DNA, 25 bp, Mus musculus
aaacttgctctcaataccaggctgg

SEQ ID NO: 10666 - DNA, 25 bp, Mus musculus
aaacttgctctctataccaggctgg

SEQ ID NO: 10667 - DNA, 25 bp, Mus musculus
aaacttgctgagaggcctgagagaa

SEQ ID NO: 10668 - DNA, 25 bp, Mus musculus
aaacttgctgagtggcctgagagaa

SEQ ID NO: 10669 - DNA, 25 bp, Mus musculus
aaacttgctggaatcatgcagccag

SEQ ID NO: 10670 - DNA, 25 bp, Mus musculus
aaacttgctggattcatgcagccag

SEQ ID NO: 10671 - DNA, 25 bp, Mus musculus
aaacttgctgtcataggagtcctgc

SEQ ID NO: 10672 - DNA, 25 bp, Mus musculus
aaacttgctgtcttaggagtcctgc

SEQ ID NO: 10673 - DNA, 25 bp, Mus musculus
aaacttggaagtcttcttgagcaac

SEQ ID NO: 10674 - DNA, 25 bp, Mus musculus
aaacttggaagtgttcttgagcaac

SEQ ID NO: 10675 - DNA, 25 bp, Mus musculus
aaacttggacccactacccacagat

SEQ ID NO: 10676 - DNA, 25 bp, Mus musculus
aaacttggaccctctacccacagat

SEQ ID NO: 10677 - DNA, 25 bp, Mus musculus
aaacttggcatcaactcacacagac

SEQ ID NO: 10678 - DNA, 25 bp, Mus musculus
aaacttggcatctactcacacagac

SEQ ID NO: 10679 - DNA, 25 bp, Mus musculus
aaacttggccatctgttatgcactc

SEQ ID NO: 10680 - DNA, 25 bp, Mus musculus
aaacttggccatgtgttatgcactc

SEQ ID NO: 10681 - DNA, 25 bp, Mus musculus
aaacttggccgacttgagccatcct

SEQ ID NO: 10682 - DNA, 25 bp, Mus musculus
aaacttggccgagttgagccatcct

SEQ ID NO: 10683 - DNA, 25 bp, Mus musculus
aaacttggcgatcactggattcaca

SEQ ID NO: 10684 - DNA, 25 bp, Mus musculus
aaacttggcgatgactggattcaca

SEQ ID NO: 10685 - DNA, 25 bp, Mus musculus
aaacttggctaaattcagcttctgt

SEQ ID NO: 10686 - DNA, 25 bp, Mus musculus
aaacttggctaatttcagcttctgt

SEQ ID NO: 10687 - DNA, 25 bp, Mus musculus
aaacttggctgtaggcgtcggtaca

SEQ ID NO: 10688 - DNA, 25 bp, Mus musculus
aaacttggctgttggcgtcggtaca

SEQ ID NO: 10689 - DNA, 25 bp, Mus musculus
aaacttgggactattatctacctct

SEQ ID NO: 10690 - DNA, 25 bp, Mus musculus
aaacttgggacttttatctacctct

SEQ ID NO: 10691 - DNA, 25 bp, Mus musculus
aaacttgggtggcagatcttagcac

SEQ ID NO: 10692 - DNA, 25 bp, Mus musculus
aaacttgggtgggagatcttagcac

SEQ ID NO: 10693 - DNA, 25 bp, Mus musculus
aaacttggtaggaccattcagtcaa

SEQ ID NO: 10694 - DNA, 25 bp, Mus musculus
aaacttggtaggtccattcagtcaa

SEQ ID NO: 10695 - DNA, 25 bp, Mus musculus
aaacttggtcctagtgatagatgat

SEQ ID NO: 10696 - DNA, 25 bp, Mus musculus
aaacttggtccttgtgatagatgat

SEQ ID NO: 10697 - DNA, 25 bp, Mus musculus
aaacttggtgccacaaatgccccag

SEQ ID NO: 10698 - DNA, 25 bp, Mus musculus
aaacttggtgcctcaaatgccccag

SEQ ID NO: 10699 - DNA, 25 bp, Mus musculus
aaacttggtgttctgagactccctt

SEQ ID NO: 10700 - DNA, 25 bp, Mus musculus
aaacttggtgttgtgagactccctt

SEQ ID NO: 10701 - DNA, 25 bp, Mus musculus
aaacttggttcgaatcccatcactg

SEQ ID NO: 10702 - DNA, 25 bp, Mus musculus
aaacttggttcgtatcccatcactg

SEQ ID NO: 10703 - DNA, 25 bp, Mus musculus
aaacttgtagatagctcctctgtct

SEQ ID NO: 10704 - DNA, 25 bp, Mus musculus
aaacttgtagattgctcctctgtct

SEQ ID NO: 10705 - DNA, 25 bp, Mus musculus
aaacttgtagctcccttttgtgtgt

SEQ ID NO: 10706 - DNA, 25 bp, Mus musculus
aaacttgtagctgccttttgtgtgt

SEQ ID NO: 10707 - DNA, 25 bp, Mus musculus
aaacttgtatgcatctctatgaaga

SEQ ID NO: 10708 - DNA, 25 bp, Mus musculus
aaacttgtatgcttctctatgaaga

SEQ ID NO: 10709 - DNA, 25 bp, Mus musculus
aaacttgtcaacctcagtcacacag

SEQ ID NO: 10710 - DNA, 25 bp, Mus musculus
aaacttgtcaacgtcagtcacacag

SEQ ID NO: 10711 - DNA, 25 bp, Mus musculus
aaacttgtcaccagtcaccgtatct

SEQ ID NO: 10712 - DNA, 25 bp, Mus musculus
aaacttgtcacctgtcaccgtatct

SEQ ID NO: 10713 - DNA, 25 bp, Mus musculus
aaacttgtccaaactatttctgtag

SEQ ID NO: 10714 - DNA, 25 bp, Mus musculus
aaacttgtccaatctatttctgtag

SEQ ID NO: 10715 - DNA, 25 bp, Mus musculus
aaacttgtctggaatctgcagttga

SEQ ID NO: 10716 - DNA, 25 bp, Mus musculus
aaacttgtctggtatctgcagttga

SEQ ID NO: 10717 - DNA, 25 bp, Mus musculus
aaacttgtgatgcagggatttatga

SEQ ID NO: 10718 - DNA, 25 bp, Mus musculus
aaacttgtgatggagggatttatga

SEQ ID NO: 10719 - DNA, 25 bp, Mus musculus
aaacttgtggatcagtcacctgaga

SEQ ID NO: 10720 - DNA, 25 bp, Mus musculus
aaacttgtggatgagtcacctgaga

SEQ ID NO: 10721 - DNA, 25 bp, Mus musculus
aaacttgtggtcaacaggagcccag

SEQ ID NO: 10722 - DNA, 25 bp, Mus musculus
aaacttgtggtctacaggagcccag

SEQ ID NO: 10723 - DNA, 25 bp, Mus musculus
aaacttgtgtatatctcagatcttt

SEQ ID NO: 10724 - DNA, 25 bp, Mus musculus
aaacttgtgtatttctcagatcttt

SEQ ID NO: 10725 - DNA, 25 bp, Mus musculus
aaacttgtgtcaattgagcatttct

SEQ ID NO: 10726 - DNA, 25 bp, Mus musculus
aaacttgtgtcatttgagcatttct

SEQ ID NO: 10727 - DNA, 25 bp, Mus musculus
aaacttgttcttaccattttctcag

SEQ ID NO: 10728 - DNA, 25 bp, Mus musculus
aaacttgttcttctctctgccttcg

SEQ ID NO: 10729 - DNA, 25 bp, Mus musculus
aaacttgttcttgtctctgccttcg

SEQ ID NO: 10730 - DNA, 25 bp, Mus musculus
aaacttgttctttccattttctcag

SEQ ID NO: 10731 - DNA, 25 bp, Mus musculus
aaacttgttgaaactgttgcattta

SEQ ID NO: 10732 - DNA, 25 bp, Mus musculus
aaacttgttgaatctgttgcattta

SEQ ID NO: 10733 - DNA, 25 bp, Mus musculus
aaacttgttgccagttgacctcagc

SEQ ID NO: 10734 - DNA, 25 bp, Mus musculus
aaacttgttgcctgttgacctcagc

SEQ ID NO: 10735 - DNA, 25 bp, Mus musculus
aaacttgttgtcacgtgatttctaa

SEQ ID NO: 10736 - DNA, 25 bp, Mus musculus
aaacttgttgtctcgtgatttctaa

SEQ ID NO: 10737 - DNA, 25 bp, Mus musculus
aaactttaagcaacactatattatt

SEQ ID NO: 10738 - DNA, 25 bp, Mus musculus
aaactttaagcatcactatattatt

SEQ ID NO: 10739 - DNA, 25 bp, Mus musculus
aaactttacaaaatcagctgggcag

SEQ ID NO: 10740 - DNA, 25 bp, Mus musculus
aaactttacaaattcagctgggcag

SEQ ID NO: 10741 - DNA, 25 bp, Mus musculus
aaactttacaggaccctgcaggagg

SEQ ID NO: 10742 - DNA, 25 bp, Mus musculus
aaactttacaggtccctgcaggagg

SEQ ID NO: 10743 - DNA, 25 bp, Mus musculus
aaactttacattcagccatttacca

SEQ ID NO: 10744 - DNA, 25 bp, Mus musculus
aaactttacattgagccatttacca

SEQ ID NO: 10745 - DNA, 25 bp, Mus musculus
aaactttactctacagcctatctta

SEQ ID NO: 10746 - DNA, 25 bp, Mus musculus
aaactttactcttcagcctatctta

SEQ ID NO: 10747 - DNA, 25 bp, Mus musculus
aaactttagcagctgggctttccca

SEQ ID NO: 10748 - DNA, 25 bp, Mus musculus
aaactttagcaggtgggctttccca

SEQ ID NO: 10749 - DNA, 25 bp, Mus musculus
aaactttagcccatgagaggatgtt

SEQ ID NO: 10750 - DNA, 25 bp, Mus musculus
aaactttagcccttgagaggatgtt

SEQ ID NO: 10751 - DNA, 25 bp, Mus musculus
aaactttatagtcggagctctgtaa

SEQ ID NO: 10752 - DNA, 25 bp, Mus musculus
aaactttatagtgggagctctgtaa

SEQ ID NO: 10753 - DNA, 25 bp, Mus musculus
aaactttatatcagaggagtccggg

SEQ ID NO: 10754 - DNA, 25 bp, Mus musculus
aaactttatatctgaggagtccggg

SEQ ID NO: 10755 - DNA, 25 bp, Mus musculus
aaactttatatgagctttgagagcc

SEQ ID NO: 10756 - DNA, 25 bp, Mus musculus
aaactttatatgtgctttgagagcc

SEQ ID NO: 10757 - DNA, 25 bp, Mus musculus
aaactttatcttcttgcaaattgct

SEQ ID NO: 10758 - DNA, 25 bp, Mus musculus
aaactttatcttgttgcaaattgct

SEQ ID NO: 10759 - DNA, 25 bp, Mus musculus
aaactttatggtcggcttagactga

SEQ ID NO: 10760 - DNA, 25 bp, Mus musculus
aaactttatggtgggcttagactga

SEQ ID NO: 10761 - DNA, 25 bp, Mus musculus
aaactttcaaaacctgtcagttatg

SEQ ID NO: 10762 - DNA, 25 bp, Mus musculus
aaactttcaaaagctgtcagttatg

SEQ ID NO: 10763 - DNA, 25 bp, Mus musculus
aaactttcaggcaattcttggacaa

SEQ ID NO: 10764 - DNA, 25 bp, Mus musculus
aaactttcaggctattcttggacaa

SEQ ID NO: 10765 - DNA, 25 bp, Mus musculus
aaactttcattaactgcttcctggt

SEQ ID NO: 10766 - DNA, 25 bp, Mus musculus
aaactttcattatctgcttcctggt

SEQ ID NO: 10767 - DNA, 25 bp, Mus musculus
aaactttcccacagttctctgggtg

SEQ ID NO: 10768 - DNA, 25 bp, Mus musculus
aaactttcccactgttctctgggtg

SEQ ID NO: 10769 - DNA, 25 bp, Mus musculus
aaactttccctacagtctagcagac

SEQ ID NO: 10770 - DNA, 25 bp, Mus musculus
aaactttccctagagtctagcagac

SEQ ID NO: 10771 - DNA, 25 bp, Mus musculus
aaactttcccttctcgttgctgctg

SEQ ID NO: 10772 - DNA, 25 bp, Mus musculus
aaactttcccttgtcgttgctgctg

SEQ ID NO: 10773 - DNA, 25 bp, Mus musculus
aaactttcctatactagctaattca

SEQ ID NO: 10774 - DNA, 25 bp, Mus musculus
aaactttcctattctagctaattca

SEQ ID NO: 10775 - DNA, 25 bp, Mus musculus
aaactttcctctatgtcctatgtag

SEQ ID NO: 10776 - DNA, 25 bp, Mus musculus
aaactttcctctttgtcctatgtag

SEQ ID NO: 10777 - DNA, 25 bp, Mus musculus
aaactttctcaacctatatgtgaat

SEQ ID NO: 10778 - DNA, 25 bp, Mus musculus
aaactttctcaagctatatgtgaat

SEQ ID NO: 10779 - DNA, 25 bp, Mus musculus
aaactttctcacaggccaagtccag

SEQ ID NO: 10780 - DNA, 25 bp, Mus musculus
aaactttctcactggccaagtccag

SEQ ID NO: 10781 - DNA, 25 bp, Mus musculus
aaactttctctaactgggcatggac

SEQ ID NO: 10782 - DNA, 25 bp, Mus musculus
aaactttctctatctgggcatggac

SEQ ID NO: 10783 - DNA, 25 bp, Mus musculus
aaactttctctgagttaacttgcca

SEQ ID NO: 10784 - DNA, 25 bp, Mus musculus
aaactttctctgtgttaacttgcca

SEQ ID NO: 10785 - DNA, 25 bp, Mus musculus
aaactttctgacagagtgataggta

SEQ ID NO: 10786 - DNA, 25 bp, Mus musculus
aaactttctgactgagtgataggta

SEQ ID NO: 10787 - DNA, 25 bp, Mus musculus
aaactttctgctcatttcttgttaa

SEQ ID NO: 10788 - DNA, 25 bp, Mus musculus
aaactttctgctgatttcttgttaa

SEQ ID NO: 10789 - DNA, 25 bp, Mus musculus
aaactttctgggatgtagagacttt

SEQ ID NO: 10790 - DNA, 25 bp, Mus musculus
aaactttctgggttgtagagacttt

SEQ ID NO: 10791 - DNA, 25 bp, Mus musculus
aaactttctggtctactacagtaca

SEQ ID NO: 10792 - DNA, 25 bp, Mus musculus
aaactttctggtgtactacagtaca

SEQ ID NO: 10793 - DNA, 25 bp, Mus musculus
aaactttctgtgacataatacctat

SEQ ID NO: 10794 - DNA, 25 bp, Mus musculus
aaactttctgtgtcataatacctat

SEQ ID NO: 10795 - DNA, 25 bp, Mus musculus
aaactttgaacaagccccatactca

SEQ ID NO: 10796 - DNA, 25 bp, Mus musculus
aaactttgaacatgccccatactca

SEQ ID NO: 10797 - DNA, 25 bp, Mus musculus
aaactttgaagccacactgccacca

SEQ ID NO: 10798 - DNA, 25 bp, Mus musculus
aaactttgaagcgacactgccacca

SEQ ID NO: 10799 - DNA, 25 bp, Mus musculus
aaactttgagcccagttctcacagg

SEQ ID NO: 10800 - DNA, 25 bp, Mus musculus
aaactttgagccgagttctcacagg

SEQ ID NO: 10801 - DNA, 25 bp, Mus musculus
aaactttgatatctgtctatcctac

SEQ ID NO: 10802 - DNA, 25 bp, Mus musculus
aaactttgatatgtgtctatcctac

SEQ ID NO: 10803 - DNA, 25 bp, Mus musculus
aaactttgcacacccaaattctctt

SEQ ID NO: 10804 - DNA, 25 bp, Mus musculus
aaactttgcacagccaaattctctt

SEQ ID NO: 10805 - DNA, 25 bp, Mus musculus
aaactttgcatgatgcacccgtgtt

SEQ ID NO: 10806 - DNA, 25 bp, Mus musculus
aaactttgcatgttgcacccgtgtt

SEQ ID NO: 10807 - DNA, 25 bp, Mus musculus
aaactttgggaaacagagtagcact

SEQ ID NO: 10808 - DNA, 25 bp, Mus musculus
aaactttgggaatcagagtagcact

SEQ ID NO: 10809 - DNA, 25 bp, Mus musculus
aaactttgggtgcatatttgtgtgt

SEQ ID NO: 10810 - DNA, 25 bp, Mus musculus
aaactttgggtggatatttgtgtgt

SEQ ID NO: 10811 - DNA, 25 bp, Mus musculus
aaactttgggttaatgccaggcaag

SEQ ID NO: 10812 - DNA, 25 bp, Mus musculus
aaactttgggtttatgccaggcaag

SEQ ID NO: 10813 - DNA, 25 bp, Mus musculus
aaactttgtagtcgtattccctctg

SEQ ID NO: 10814 - DNA, 25 bp, Mus musculus
aaactttgtagtggtattccctctg

SEQ ID NO: 10815 - DNA, 25 bp, Mus musculus
aaactttgtgagatgtatctcttaa

SEQ ID NO: 10816 - DNA, 25 bp, Mus musculus
aaactttgtgagttgtatctcttaa

SEQ ID NO: 10817 - DNA, 25 bp, Mus musculus
aaactttgtgcacataggccttcgc

SEQ ID NO: 10818 - DNA, 25 bp, Mus musculus
aaactttgtgcagataggccttcgc

SEQ ID NO: 10819 - DNA, 25 bp, Mus musculus
aaactttgtgtcctaagctcaacag

SEQ ID NO: 10820 - DNA, 25 bp, Mus musculus
aaactttgtgtcgtaagctcaacag

SEQ ID NO: 10821 - DNA, 25 bp, Mus musculus
aaacttttaacaccctctttgcaca

SEQ ID NO: 10822 - DNA, 25 bp, Mus musculus
aaacttttaacagcctctttgcaca

SEQ ID NO: 10823 - DNA, 25 bp, Mus musculus
aaacttttacaaatgactcgaccat

SEQ ID NO: 10824 - DNA, 25 bp, Mus musculus
aaacttttacaattgactcgaccat

SEQ ID NO: 10825 - DNA, 25 bp, Mus musculus
aaacttttacataggcaataggcac

SEQ ID NO: 10826 - DNA, 25 bp, Mus musculus
aaacttttacattggcaataggcac

SEQ ID NO: 10827 - DNA, 25 bp, Mus musculus
aaacttttagtgcttaattcctcat

SEQ ID NO: 10828 - DNA, 25 bp, Mus musculus
aaacttttagtggttaattcctcat

SEQ ID NO: 10829 - DNA, 25 bp, Mus musculus
aaacttttatgcatcctgagccgtt

SEQ ID NO: 10830 - DNA, 25 bp, Mus musculus
aaacttttatgcttcctgagccgtt

SEQ ID NO: 10831 - DNA, 25 bp, Mus musculus
aaacttttcgtaccagcttctgttg

SEQ ID NO: 10832 - DNA, 25 bp, Mus musculus
aaacttttcgtagcagcttctgttg

SEQ ID NO: 10833 - DNA, 25 bp, Mus musculus
aaacttttggacaccatgcatgatg

SEQ ID NO: 10834 - DNA, 25 bp, Mus musculus
aaacttttggactccatgcatgatg

SEQ ID NO: 10835 - DNA, 25 bp, Mus musculus
aaacttttggagacagattgttcag

SEQ ID NO: 10836 - DNA, 25 bp, Mus musculus
aaacttttggagtcagattgttcag

SEQ ID NO: 10837 - DNA, 25 bp, Mus musculus
aaacttttggcaaatttgtcctcct

SEQ ID NO: 10838 - DNA, 25 bp, Mus musculus
aaacttttggcatatttgtcctcct

SEQ ID NO: 10839 - DNA, 25 bp, Mus musculus
aaacttttggttaacatttgatgca

SEQ ID NO: 10840 - DNA, 25 bp, Mus musculus
aaacttttggtttacatttgatgca

SEQ ID NO: 10841 - DNA, 25 bp, Mus musculus
aaacttttgtgcaccaccatctaag

SEQ ID NO: 10842 - DNA, 25 bp, Mus musculus
aaacttttgtgctccaccatctaag

SEQ ID NO: 10843 - DNA, 25 bp, Mus musculus
aaacttttgttacttcagccattga

SEQ ID NO: 10844 - DNA, 25 bp, Mus musculus
aaacttttgttagttcagccattga

SEQ ID NO: 10845 - DNA, 25 bp, Mus musculus
aaactttttgcaaagcagcattagc

SEQ ID NO: 10846 - DNA, 25 bp, Mus musculus
aaactttttgcatagcagcattagc

SEQ ID NO: 10847 - DNA, 25 bp, Mus musculus
aaacttttttgaaatgcctcttcca

SEQ ID NO: 10848 - DNA, 25 bp, Mus musculus
aaacttttttgatatgcctcttcca

SEQ ID NO: 10849 - DNA, 25 bp, Mus musculus
aaagaaaaagctccagtccatcttt

SEQ ID NO: 10850 - DNA, 25 bp, Mus musculus
aaagaaaaagctgcagtccatcttt

SEQ ID NO: 10851 - DNA, 25 bp, Mus musculus
aaagaaaaccccagctgagcaacca

SEQ ID NO: 10852 - DNA, 25 bp, Mus musculus
aaagaaaacccctgctgagcaacca

SEQ ID NO: 10853 - DNA, 25 bp, Mus musculus
aaagaaaactctacacagtggcctg

SEQ ID NO: 10854 - DNA, 25 bp, Mus musculus
aaagaaaactcttcacagtggcctg

SEQ ID NO: 10855 - DNA, 25 bp, Mus musculus
aaagaaaactgaccgatctgccacc

SEQ ID NO: 10856 - DNA, 25 bp, Mus musculus
aaagaaaactgagcgatctgccacc

SEQ ID NO: 10857 - DNA, 25 bp, Mus musculus
aaagaaaagctgcttccctctggga

SEQ ID NO: 10858 - DNA, 25 bp, Mus musculus
aaagaaaagctggttccctctggga

SEQ ID NO: 10859 - DNA, 25 bp, Mus musculus
aaagaaaatctcactctgcctccat

SEQ ID NO: 10860 - DNA, 25 bp, Mus musculus
aaagaaaatctctctctgcctccat

SEQ ID NO: 10861 - DNA, 25 bp, Mus musculus
aaagaaacacggagctctgccagca

SEQ ID NO: 10862 - DNA, 25 bp, Mus musculus
aaagaaacacggtgctctgccagca

SEQ ID NO: 10863 - DNA, 25 bp, Mus musculus
aaagaaaccgctaggattctggcca

SEQ ID NO: 10864 - DNA, 25 bp, Mus musculus
aaagaaaccgcttggattctggcca

SEQ ID NO: 10865 - DNA, 25 bp, Mus musculus
aaagaaacctcgaagcacactcctg

SEQ ID NO: 10866 - DNA, 25 bp, Mus musculus
aaagaaacctcgtagcacactcctg

SEQ ID NO: 10867 - DNA, 25 bp, Mus musculus
aaagaaacgcaccaagaggctccct

SEQ ID NO: 10868 - DNA, 25 bp, Mus musculus
aaagaaacgcacgaagaggctccct

SEQ ID NO: 10869 - DNA, 25 bp, Mus musculus
aaagaaacgcagcacctgtgtttgc

SEQ ID NO: 10870 - DNA, 25 bp, Mus musculus
aaagaaacgcaggacctgtgtttgc

SEQ ID NO: 10871 - DNA, 25 bp, Mus musculus
aaagaaactaggagagatgtggaac

SEQ ID NO: 10872 - DNA, 25 bp, Mus musculus
aaagaaactaggtgagatgtggaac

SEQ ID NO: 10873 - DNA, 25 bp, Mus musculus
aaagaaactgctcaaatggctgctc

SEQ ID NO: 10874 - DNA, 25 bp, Mus musculus
aaagaaactgctgaaatggctgctc

SEQ ID NO: 10875 - DNA, 25 bp, Mus musculus
aaagaaactggtctatcctgaacat

SEQ ID NO: 10876 - DNA, 25 bp, Mus musculus
aaagaaactggtgtatcctgaacat

SEQ ID NO: 10877 - DNA, 25 bp, Mus musculus
aaagaaactttcaccacactgacac

SEQ ID NO: 10878 - DNA, 25 bp, Mus musculus
aaagaaactttctccacactgacac

SEQ ID NO: 10879 - DNA, 25 bp, Mus musculus
aaagaaagatccctccaagtcaaag

SEQ ID NO: 10880 - DNA, 25 bp, Mus musculus
aaagaaagatccgtccaagtcaaag

SEQ ID NO: 10881 - DNA, 25 bp, Mus musculus
aaagaaagcccacccagcgaggacc

SEQ ID NO: 10882 - DNA, 25 bp, Mus musculus
aaagaaagcccagccagcgaggacc

SEQ ID NO: 10883 - DNA, 25 bp, Mus musculus
aaagaaagcctcagccctttcagat

SEQ ID NO: 10884 - DNA, 25 bp, Mus musculus
aaagaaagcctctgccctttcagat

SEQ ID NO: 10885 - DNA, 25 bp, Mus musculus
aaagaaagctgtatgctctcccagg

SEQ ID NO: 10886 - DNA, 25 bp, Mus musculus
aaagaaagctgtttgctctcccagg

SEQ ID NO: 10887 - DNA, 25 bp, Mus musculus
aaagaaaggccactttccagatatt

SEQ ID NO: 10888 - DNA, 25 bp, Mus musculus
aaagaaaggccagtttccagatatt

SEQ ID NO: 10889 - DNA, 25 bp, Mus musculus
aaagaaagtaccaagcttccagtga

SEQ ID NO: 10890 - DNA, 25 bp, Mus musculus
aaagaaagtacctagcttccagtga

SEQ ID NO: 10891 - DNA, 25 bp, Mus musculus
aaagaaagtatcactctccttaaga

SEQ ID NO: 10892 - DNA, 25 bp, Mus musculus
aaagaaagtatctctctccttaaga

SEQ ID NO: 10893 - DNA, 25 bp, Mus musculus
aaagaaatcactactgcctgctcaa

SEQ ID NO: 10894 - DNA, 25 bp, Mus musculus
aaagaaatcacttctgcctgctcaa

SEQ ID NO: 10895 - DNA, 25 bp, Mus musculus
aaagaaatcagaagccaccatccct

SEQ ID NO: 10896 - DNA, 25 bp, Mus musculus
aaagaaatcagaccggctttggagc

SEQ ID NO: 10897 - DNA, 25 bp, Mus musculus
aaagaaatcagagcggctttggagc

SEQ ID NO: 10898 - DNA, 25 bp, Mus musculus
aaagaaatcagatgccaccatccct

SEQ ID NO: 10899 - DNA, 25 bp, Mus musculus
aaagaaatccctctaggctccctgt

SEQ ID NO: 10900 - DNA, 25 bp, Mus musculus
aaagaaatccctgtaggctccctgt

SEQ ID NO: 10901 - DNA, 25 bp, Mus musculus
aaagaaatccgcactatactctccc

SEQ ID NO: 10902 - DNA, 25 bp, Mus musculus
aaagaaatccgctctatactctccc

SEQ ID NO: 10903 - DNA, 25 bp, Mus musculus
aaagaaatcctgagcttggccctga

SEQ ID NO: 10904 - DNA, 25 bp, Mus musculus
aaagaaatcctgtgcttggccctga

SEQ ID NO: 10905 - DNA, 25 bp, Mus musculus
aaagaaatctctccctttgcgtcac

SEQ ID NO: 10906 - DNA, 25 bp, Mus musculus
aaagaaatctctgcctttgcgtcac

SEQ ID NO: 10907 - DNA, 25 bp, Mus musculus
aaagaaatgcaccagtgtctctccc

SEQ ID NO: 10908 - DNA, 25 bp, Mus musculus
aaagaaatgcacctttatccaacat

SEQ ID NO: 10909 - DNA, 25 bp, Mus musculus
aaagaaatgcacgagtgtctctccc

SEQ ID NO: 10910 - DNA, 25 bp, Mus musculus
aaagaaatgcacgtttatccaacat

SEQ ID NO: 10911 - DNA, 25 bp, Mus musculus
aaagaaatgtatacctgctcaaata

SEQ ID NO: 10912 - DNA, 25 bp, Mus musculus
aaagaaatgtattcctgctcaaata

SEQ ID NO: 10913 - DNA, 25 bp, Mus musculus
aaagaaatgtgcatccttccacgct

SEQ ID NO: 10914 - DNA, 25 bp, Mus musculus
aaagaaatgtgcttccttccacgct

SEQ ID NO: 10915 - DNA, 25 bp, Mus musculus
aaagaaattctgcaaagtccaaact

SEQ ID NO: 10916 - DNA, 25 bp, Mus musculus
aaagaaattctggaaagtccaaact

SEQ ID NO: 10917 - DNA, 25 bp, Mus musculus
aaagaaattgccctacactagccac

SEQ ID NO: 10918 - DNA, 25 bp, Mus musculus
aaagaaattgccgtacactagccac

SEQ ID NO: 10919 - DNA, 25 bp, Mus musculus
aaagaaattgggaacaaggaatgca

SEQ ID NO: 10920 - DNA, 25 bp, Mus musculus
aaagaaattgggtacaaggaatgca

SEQ ID NO: 10921 - DNA, 25 bp, Mus musculus
aaagaaattggtcgcccattgctaa

SEQ ID NO: 10922 - DNA, 25 bp, Mus musculus
aaagaaattggtggcccattgctaa

SEQ ID NO: 10923 - DNA, 25 bp, Mus musculus
aaagaaatttaaactctctgttctt

SEQ ID NO: 10924 - DNA, 25 bp, Mus musculus
aaagaaatttaatctctctgttctt

SEQ ID NO: 10925 - DNA, 25 bp, Mus musculus
aaagaacaacttacgccattatata

SEQ ID NO: 10926 - DNA, 25 bp, Mus musculus
aaagaacaactttcgccattatata

SEQ ID NO: 10927 - DNA, 25 bp, Mus musculus
aaagaacaattgaccacctcatcgg

SEQ ID NO: 10928 - DNA, 25 bp, Mus musculus
aaagaacaattgtccacctcatcgg

SEQ ID NO: 10929 - DNA, 25 bp, Mus musculus
aaagaacactggatcacctcagcca

SEQ ID NO: 10930 - DNA, 25 bp, Mus musculus
aaagaacactggttcacctcagcca

SEQ ID NO: 10931 - DNA, 25 bp, Mus musculus
aaagaacacttgcacatgcttgcaa

SEQ ID NO: 10932 - DNA, 25 bp, Mus musculus
aaagaacacttggacatgcttgcaa

SEQ ID NO: 10933 - DNA, 25 bp, Mus musculus
aaagaacagctcccgcttcatttcc

SEQ ID NO: 10934 - DNA, 25 bp, Mus musculus
aaagaacagctcgcgcttcatttcc

SEQ ID NO: 10935 - DNA, 25 bp, Mus musculus
aaagaacaggccagggatcctcaca

SEQ ID NO: 10936 - DNA, 25 bp, Mus musculus
aaagaacaggcctgggatcctcaca

SEQ ID NO: 10937 - DNA, 25 bp, Mus musculus
aaagaacatcacctgtccgtccttt

SEQ ID NO: 10938 - DNA, 25 bp, Mus musculus
aaagaacatcacgtgtccgtccttt

SEQ ID NO: 10939 - DNA, 25 bp, Mus musculus
aaagaacatcagacttctccctacc

SEQ ID NO: 10940 - DNA, 25 bp, Mus musculus
aaagaacatcagtcttctccctacc

SEQ ID NO: 10941 - DNA, 25 bp, Mus musculus
aaagaacatccgacacaggccaggt

SEQ ID NO: 10942 - DNA, 25 bp, Mus musculus
aaagaacatccgtcacaggccaggt

SEQ ID NO: 10943 - DNA, 25 bp, Mus musculus
aaagaacatgccctgactactttca

SEQ ID NO: 10944 - DNA, 25 bp, Mus musculus
aaagaacatgccgtgactactttca

SEQ ID NO: 10945 - DNA, 25 bp, Mus musculus
aaagaacatgtaaccgtcctcatct

SEQ ID NO: 10946 - DNA, 25 bp, Mus musculus
aaagaacatgtatccgtcctcatct

SEQ ID NO: 10947 - DNA, 25 bp, Mus musculus
aaagaacattgcaggtagacacggt

SEQ ID NO: 10948 - DNA, 25 bp, Mus musculus
aaagaacattgctggtagacacggt

SEQ ID NO: 10949 - DNA, 25 bp, Mus musculus
aaagaaccaaccagtgacacagaga

SEQ ID NO: 10950 - DNA, 25 bp, Mus musculus
aaagaaccaacctgtgacacagaga

SEQ ID NO: 10951 - DNA, 25 bp, Mus musculus
aaagaaccaagccaagtcctgcctt

SEQ ID NO: 10952 - DNA, 25 bp, Mus musculus
aaagaaccaagcgaagtcctgcctt

SEQ ID NO: 10953 - DNA, 25 bp, Mus musculus
aaagaaccacacattctgcaggata

SEQ ID NO: 10954 - DNA, 25 bp, Mus musculus
aaagaaccacactttctgcaggata

SEQ ID NO: 10955 - DNA, 25 bp, Mus musculus
aaagaaccagcaagggtccttttct

SEQ ID NO: 10956 - DNA, 25 bp, Mus musculus
aaagaaccagcatgggtccttttct

SEQ ID NO: 10957 - DNA, 25 bp, Mus musculus
aaagaaccagccatcctgctcgcta

SEQ ID NO: 10958 - DNA, 25 bp, Mus musculus
aaagaaccagccttcctgctcgcta

SEQ ID NO: 10959 - DNA, 25 bp, Mus musculus
aaagaacccaagctctctgctttct

SEQ ID NO: 10960 - DNA, 25 bp, Mus musculus
aaagaacccaaggtctctgctttct

SEQ ID NO: 10961 - DNA, 25 bp, Mus musculus
aaagaacccatgacacgtgattcaa

SEQ ID NO: 10962 - DNA, 25 bp, Mus musculus
aaagaacccatgtcacgtgattcaa

SEQ ID NO: 10963 - DNA, 25 bp, Mus musculus
aaagaacccgccctgcagtcaaatt

SEQ ID NO: 10964 - DNA, 25 bp, Mus musculus
aaagaacccgccgtgcagtcaaatt

SEQ ID NO: 10965 - DNA, 25 bp, Mus musculus
aaagaaccctggaggcccatagcca

SEQ ID NO: 10966 - DNA, 25 bp, Mus musculus
aaagaaccctggtggcccatagcca

SEQ ID NO: 10967 - DNA, 25 bp, Mus musculus
aaagaacccttgagcataacgaagc

SEQ ID NO: 10968 - DNA, 25 bp, Mus musculus
aaagaacccttgtgcataacgaagc

SEQ ID NO: 10969 - DNA, 25 bp, Mus musculus
aaagaacctctcactgatgaagatg

SEQ ID NO: 10970 - DNA, 25 bp, Mus musculus
aaagaacctctctctgatgaagatg

SEQ ID NO: 10971 - DNA, 25 bp, Mus musculus
aaagaacctcttctacaactcagtc

SEQ ID NO: 10972 - DNA, 25 bp, Mus musculus
aaagaacctcttgtacaactcagtc

SEQ ID NO: 10973 - DNA, 25 bp, Mus musculus
aaagaacctgtcaccttggttaatg

SEQ ID NO: 10974 - DNA, 25 bp, Mus musculus
aaagaacctgtctccttggttaatg

SEQ ID NO: 10975 - DNA, 25 bp, Mus musculus
aaagaaccttgcctctaggatctac

SEQ ID NO: 10976 - DNA, 25 bp, Mus musculus
aaagaaccttgcgtctaggatctac

SEQ ID NO: 10977 - DNA, 25 bp, Mus musculus
aaagaacgatttcgctctgtccagg

SEQ ID NO: 10978 - DNA, 25 bp, Mus musculus
aaagaacgatttggctctgtccagg

SEQ ID NO: 10979 - DNA, 25 bp, Mus musculus
aaagaacggatacatttgtttcatg

SEQ ID NO: 10980 - DNA, 25 bp, Mus musculus
aaagaacggatagatttgtttcatg

SEQ ID NO: 10981 - DNA, 25 bp, Mus musculus
aaagaacggctacacgccgcttata

SEQ ID NO: 10982 - DNA, 25 bp, Mus musculus
aaagaacggctagacgccgcttata

SEQ ID NO: 10983 - DNA, 25 bp, Mus musculus
aaagaacgttagcaacatccaaatg

SEQ ID NO: 10984 - DNA, 25 bp, Mus musculus
aaagaacgttaggaacatccaaatg

SEQ ID NO: 10985 - DNA, 25 bp, Mus musculus
aaagaactagatctgcctgcccagt

SEQ ID NO: 10986 - DNA, 25 bp, Mus musculus
aaagaactagatgtgcctgcccagt

SEQ ID NO: 10987 - DNA, 25 bp, Mus musculus
aaagaactagtgatcccggactctg

SEQ ID NO: 10988 - DNA, 25 bp, Mus musculus
aaagaactagtgttcccggactctg

SEQ ID NO: 10989 - DNA, 25 bp, Mus musculus
aaagaactcatcacatcaggccaca

SEQ ID NO: 10990 - DNA, 25 bp, Mus musculus
aaagaactcatctcatcaggccaca

SEQ ID NO: 10991 - DNA, 25 bp, Mus musculus
aaagaactccatatcttcgagagga

SEQ ID NO: 10992 - DNA, 25 bp, Mus musculus
aaagaactccatttcttcgagagga

SEQ ID NO: 10993 - DNA, 25 bp, Mus musculus
aaagaactcgcacagcttgctagaa

SEQ ID NO: 10994 - DNA, 25 bp, Mus musculus
aaagaactcgcagagcttgctagaa

SEQ ID NO: 10995 - DNA, 25 bp, Mus musculus
aaagaactctccacataggtgagat

SEQ ID NO: 10996 - DNA, 25 bp, Mus musculus
aaagaactctcctcataggtgagat

SEQ ID NO: 10997 - DNA, 25 bp, Mus musculus
aaagaactctcgagggctagggcga

SEQ ID NO: 10998 - DNA, 25 bp, Mus musculus
aaagaactctcgtgggctagggcga

SEQ ID NO: 10999 - DNA, 25 bp, Mus musculus
aaagaactctggaagcatcggatgc

SEQ ID NO: 11000 - DNA, 25 bp, Mus musculus
aaagaactctggtagcatcggatgc

SEQ ID NO: 11001 - DNA, 25 bp, Mus musculus
aaagaactcttccaggattcttgga

SEQ ID NO: 11002 - DNA, 25 bp, Mus musculus
aaagaactcttcgaggattcttgga

SEQ ID NO: 11003 - DNA, 25 bp, Mus musculus
aaagaactgaccagtgcccttcaga

SEQ ID NO: 11004 - DNA, 25 bp, Mus musculus
aaagaactgacctgtgcccttcaga

SEQ ID NO: 11005 - DNA, 25 bp, Mus musculus
aaagaactgccccacacaggatggc

SEQ ID NO: 11006 - DNA, 25 bp, Mus musculus
aaagaactgcccgacacaggatggc

SEQ ID NO: 11007 - DNA, 25 bp, Mus musculus
aaagaactggccatacaccacacag

SEQ ID NO: 11008 - DNA, 25 bp, Mus musculus
aaagaactggccttacaccacacag

SEQ ID NO: 11009 - DNA, 25 bp, Mus musculus
aaagaactggtaaccgtattgcaga

SEQ ID NO: 11010 - DNA, 25 bp, Mus musculus
aaagaactggtatccgtattgcaga

SEQ ID NO: 11011 - DNA, 25 bp, Mus musculus
aaagaactgtcactacctcttttct

SEQ ID NO: 11012 - DNA, 25 bp, Mus musculus
aaagaactgtcagtacctcttttct

SEQ ID NO: 11013 - DNA, 25 bp, Mus musculus
aaagaactgtctataatccgggcat

SEQ ID NO: 11014 - DNA, 25 bp, Mus musculus
aaagaactgtctttaatccgggcat

SEQ ID NO: 11015 - DNA, 25 bp, Mus musculus
aaagaactgtttctctccatggtgc

SEQ ID NO: 11016 - DNA, 25 bp, Mus musculus
aaagaactgtttgtctccatggtgc

SEQ ID NO: 11017 - DNA, 25 bp, Mus musculus
aaagaacttggaactccctgagata

SEQ ID NO: 11018 - DNA, 25 bp, Mus musculus
aaagaacttggaatgctcatgctac

SEQ ID NO: 11019 - DNA, 25 bp, Mus musculus
aaagaacttggatctccctgagata

SEQ ID NO: 11020 - DNA, 25 bp, Mus musculus
aaagaacttggattgctcatgctac

SEQ ID NO: 11021 - DNA, 25 bp, Mus musculus
aaagaacttggcctcagtctgttga

SEQ ID NO: 11022 - DNA, 25 bp, Mus musculus
aaagaacttggcctcctctggaagc

SEQ ID NO: 11023 - DNA, 25 bp, Mus musculus
aaagaacttggcgtcagtctgttga

SEQ ID NO: 11024 - DNA, 25 bp, Mus musculus
aaagaacttggcgtcctctggaagc

SEQ ID NO: 11025 - DNA, 25 bp, Mus musculus
aaagaacttgtcaatcctccaggtt

SEQ ID NO: 11026 - DNA, 25 bp, Mus musculus
aaagaacttgtctatcctccaggtt

SEQ ID NO: 11027 - DNA, 25 bp, Mus musculus
aaagaactttgcaacctctgggatc

SEQ ID NO: 11028 - DNA, 25 bp, Mus musculus
aaagaactttgctacctctgggatc

SEQ ID NO: 11029 - DNA, 25 bp, Mus musculus
aaagaagaacatcctgtgctctcaa

SEQ ID NO: 11030 - DNA, 25 bp, Mus musculus
aaagaagaacatgctgtgctctcaa

SEQ ID NO: 11031 - DNA, 25 bp, Mus musculus
aaagaagaaccaaccctgagcatca

SEQ ID NO: 11032 - DNA, 25 bp, Mus musculus
aaagaagaaccatccctgagcatca

SEQ ID NO: 11033 - DNA, 25 bp, Mus musculus
aaagaagaagacagtcactctccaa

SEQ ID NO: 11034 - DNA, 25 bp, Mus musculus
aaagaagaagactgtcactctccaa

SEQ ID NO: 11035 - DNA, 25 bp, Mus musculus
aaagaagaagcgcttctgcaggatg

SEQ ID NO: 11036 - DNA, 25 bp, Mus musculus
aaagaagaagcggttctgcaggatg

SEQ ID NO: 11037 - DNA, 25 bp, Mus musculus
aaagaagaatgaccctaaacacaga

SEQ ID NO: 11038 - DNA, 25 bp, Mus musculus
aaagaagaatgagcctaaacacaga

SEQ ID NO: 11039 - DNA, 25 bp, Mus musculus
aaagaagacagcatccagcaccctt

SEQ ID NO: 11040 - DNA, 25 bp, Mus musculus
aaagaagacagcttccagcaccctt

SEQ ID NO: 11041 - DNA, 25 bp, Mus musculus
aaagaagacattatccctggttggt

SEQ ID NO: 11042 - DNA, 25 bp, Mus musculus
aaagaagacattttccctggttggt

SEQ ID NO: 11043 - DNA, 25 bp, Mus musculus
aaagaagaccacaacagcagactca

SEQ ID NO: 11044 - DNA, 25 bp, Mus musculus
aaagaagaccactacagcagactca

SEQ ID NO: 11045 - DNA, 25 bp, Mus musculus
aaagaagacccgcatggcactggag

SEQ ID NO: 11046 - DNA, 25 bp, Mus musculus
aaagaagacccggatggcactggag

SEQ ID NO: 11047 - DNA, 25 bp, Mus musculus
aaagaagaccgcagcgccagcagcg

SEQ ID NO: 11048 - DNA, 25 bp, Mus musculus
aaagaagaccgctgcgccagcagcg

SEQ ID NO: 11049 - DNA, 25 bp, Mus musculus
aaagaagacgggatgggcttgcaca

SEQ ID NO: 11050 - DNA, 25 bp, Mus musculus
aaagaagacgggttgggcttgcaca

SEQ ID NO: 11051 - DNA, 25 bp, Mus musculus
aaagaagagacgacctgggcccatc

SEQ ID NO: 11052 - DNA, 25 bp, Mus musculus
aaagaagagacgtcctgggcccatc

SEQ ID NO: 11053 - DNA, 25 bp, Mus musculus
aaagaagagcctaggctgtccctta

SEQ ID NO: 11054 - DNA, 25 bp, Mus musculus
aaagaagagccttggctgtccctta

SEQ ID NO: 11055 - DNA, 25 bp, Mus musculus
aaagaagaggccaccatcgggctga

SEQ ID NO: 11056 - DNA, 25 bp, Mus musculus
aaagaagaggcctccatcgggctga

SEQ ID NO: 11057 - DNA, 25 bp, Mus musculus
aaagaagatccaagcgctccgtgaa

SEQ ID NO: 11058 - DNA, 25 bp, Mus musculus
aaagaagatccatgcgctccgtgaa

SEQ ID NO: 11059 - DNA, 25 bp, Mus musculus
aaagaagattctagccgaaaggcgc

SEQ ID NO: 11060 - DNA, 25 bp, Mus musculus
aaagaagattcttgccgaaaggcgc

SEQ ID NO: 11061 - DNA, 25 bp, Mus musculus
aaagaagattgtcctcaggcttgag

SEQ ID NO: 11062 - DNA, 25 bp, Mus musculus
aaagaagattgtgctcaggcttgag

SEQ ID NO: 11063 - DNA, 25 bp, Mus musculus
aaagaagatttgaactgggacaagg

SEQ ID NO: 11064 - DNA, 25 bp, Mus musculus
aaagaagatttgtactgggacaagg

SEQ ID NO: 11065 - DNA, 25 bp, Mus musculus
aaagaagcacgcagccgagatggcc

SEQ ID NO: 11066 - DNA, 25 bp, Mus musculus
aaagaagcacgctgccgagatggcc

SEQ ID NO: 11067 - DNA, 25 bp, Mus musculus
aaagaagcagcccacgtcttgatgt

SEQ ID NO: 11068 - DNA, 25 bp, Mus musculus
aaagaagcagccgacgtcttgatgt

SEQ ID NO: 11069 - DNA, 25 bp, Mus musculus
aaagaagcaggtcctcttcccatgt

SEQ ID NO: 11070 - DNA, 25 bp, Mus musculus
aaagaagcaggtgctcttcccatgt

SEQ ID NO: 11071 - DNA, 25 bp, Mus musculus
aaagaagcagtcacaaccttcgcac

SEQ ID NO: 11072 - DNA, 25 bp, Mus musculus
aaagaagcagtctcaaccttcgcac

SEQ ID NO: 11073 - DNA, 25 bp, Mus musculus
aaagaagcatcaactgtccagtgaa

SEQ ID NO: 11074 - DNA, 25 bp, Mus musculus
aaagaagcatcatctgtccagtgaa

SEQ ID NO: 11075 - DNA, 25 bp, Mus musculus
aaagaagccattcctactccgtgca

SEQ ID NO: 11076 - DNA, 25 bp, Mus musculus
aaagaagccattgctactccgtgca

SEQ ID NO: 11077 - DNA, 25 bp, Mus musculus
aaagaagccccactgtttagatcgt

SEQ ID NO: 11078 - DNA, 25 bp, Mus musculus
aaagaagccccagtgtttagatcgt

SEQ ID NO: 11079 - DNA, 25 bp, Mus musculus
aaagaagcccctcaaggcggctcac

SEQ ID NO: 11080 - DNA, 25 bp, Mus musculus
aaagaagcccctgaaggcggctcac

SEQ ID NO: 11081 - DNA, 25 bp, Mus musculus
aaagaagccgaaatcaggacagtga

SEQ ID NO: 11082 - DNA, 25 bp, Mus musculus
aaagaagccgaattcaggacagtga

SEQ ID NO: 11083 - DNA, 25 bp, Mus musculus
aaagaagcctcactgttccaaccat

SEQ ID NO: 11084 - DNA, 25 bp, Mus musculus
aaagaagcctcagtgttccaaccat

SEQ ID NO: 11085 - DNA, 25 bp, Mus musculus
aaagaagctcccaaatcctaccaag

SEQ ID NO: 11086 - DNA, 25 bp, Mus musculus
aaagaagctccctaatcctaccaag

SEQ ID NO: 11087 - DNA, 25 bp, Mus musculus
aaagaagctccgacgtgtctccacg

SEQ ID NO: 11088 - DNA, 25 bp, Mus musculus
aaagaagctccgtcgtgtctccacg

SEQ ID NO: 11089 - DNA, 25 bp, Mus musculus
aaagaagctgctcatcccaggctaa

SEQ ID NO: 11090 - DNA, 25 bp, Mus musculus
aaagaagctgctgatcccaggctaa

SEQ ID NO: 11091 - DNA, 25 bp, Mus musculus
aaagaagcttggacactccagaaaa

SEQ ID NO: 11092 - DNA, 25 bp, Mus musculus
aaagaagcttggtcactccagaaaa

SEQ ID NO: 11093 - DNA, 25 bp, Mus musculus
aaagaaggacagcacttcctcttcc

SEQ ID NO: 11094 - DNA, 25 bp, Mus musculus
aaagaaggacaggacttcctcttcc

SEQ ID NO: 11095 - DNA, 25 bp, Mus musculus
aaagaaggacgcatgacctgggcct

SEQ ID NO: 11096 - DNA, 25 bp, Mus musculus
aaagaaggacgcttgacctgggcct

SEQ ID NO: 11097 - DNA, 25 bp, Mus musculus
aaagaaggcatcctcaccgaggtct

SEQ ID NO: 11098 - DNA, 25 bp, Mus musculus
aaagaaggcatcgtcaccgaggtct

SEQ ID NO: 11099 - DNA, 25 bp, Mus musculus
aaagaaggcggcagacacggctgtc

SEQ ID NO: 11100 - DNA, 25 bp, Mus musculus
aaagaaggcggctgacacggctgtc

SEQ ID NO: 11101 - DNA, 25 bp, Mus musculus
aaagaaggcttcagcgtaggctccc

SEQ ID NO: 11102 - DNA, 25 bp, Mus musculus
aaagaaggcttctgcgtaggctccc

SEQ ID NO: 11103 - DNA, 25 bp, Mus musculus
aaagaagggaccaaacccgctcatg

SEQ ID NO: 11104 - DNA, 25 bp, Mus musculus
aaagaagggacctaacccgctcatg

SEQ ID NO: 11105 - DNA, 25 bp, Mus musculus
aaagaagggaggatcccatcattaa

SEQ ID NO: 11106 - DNA, 25 bp, Mus musculus
aaagaagggaggttcccatcattaa

SEQ ID NO: 11107 - DNA, 25 bp, Mus musculus
aaagaagggcaccaccacttgatgt

SEQ ID NO: 11108 - DNA, 25 bp, Mus musculus
aaagaagggcacgaccacttgatgt

SEQ ID NO: 11109 - DNA, 25 bp, Mus musculus
aaagaagggccacattacacaccac

SEQ ID NO: 11110 - DNA, 25 bp, Mus musculus
aaagaagggccagattacacaccac

SEQ ID NO: 11111 - DNA, 25 bp, Mus musculus
aaagaaggtggtaccatctgcctcc

SEQ ID NO: 11112 - DNA, 25 bp, Mus musculus
aaagaaggtggttccatctgcctcc

SEQ ID NO: 11113 - DNA, 25 bp, Mus musculus
aaagaagtattcaccgaccacacac

SEQ ID NO: 11114 - DNA, 25 bp, Mus musculus
aaagaagtattctccgaccacacac

SEQ ID NO: 11115 - DNA, 25 bp, Mus musculus
aaagaagtcacaaacccaactccta

SEQ ID NO: 11116 - DNA, 25 bp, Mus musculus
aaagaagtcacaactctttggtctc

SEQ ID NO: 11117 - DNA, 25 bp, Mus musculus
aaagaagtcacatacccaactccta

SEQ ID NO: 11118 - DNA, 25 bp, Mus musculus
aaagaagtcacatctctttggtctc

SEQ ID NO: 11119 - DNA, 25 bp, Mus musculus
aaagaagtcatcagcccctgggaga

SEQ ID NO: 11120 - DNA, 25 bp, Mus musculus
aaagaagtcatctgcccctgggaga

SEQ ID NO: 11121 - DNA, 25 bp, Mus musculus
aaagaagtcgagcagcttgacaact

SEQ ID NO: 11122 - DNA, 25 bp, Mus musculus
aaagaagtcgaggagcttgacaact

SEQ ID NO: 11123 - DNA, 25 bp, Mus musculus
aaagaagtcgttccccatcaggaag

SEQ ID NO: 11124 - DNA, 25 bp, Mus musculus
aaagaagtcgttgcccatcaggaag

SEQ ID NO: 11125 - DNA, 25 bp, Mus musculus
aaagaagtctgtatccctctggtct

SEQ ID NO: 11126 - DNA, 25 bp, Mus musculus
aaagaagtctgtttccctctggtct

SEQ ID NO: 11127 - DNA, 25 bp, Mus musculus
aaagaagtcttaattaccagcagca

SEQ ID NO: 11128 - DNA, 25 bp, Mus musculus
aaagaagtcttatttaccagcagca

SEQ ID NO: 11129 - DNA, 25 bp, Mus musculus
aaagaagtggaacgagtttgagaga

SEQ ID NO: 11130 - DNA, 25 bp, Mus musculus
aaagaagtggaaggagtttgagaga

SEQ ID NO: 11131 - DNA, 25 bp, Mus musculus
aaagaagtgtgcactctcacagtcc

SEQ ID NO: 11132 - DNA, 25 bp, Mus musculus
aaagaagtgtgctctctcacagtcc

SEQ ID NO: 11133 - DNA, 25 bp, Mus musculus
aaagaagtgttgaagccaagcttgg

SEQ ID NO: 11134 - DNA, 25 bp, Mus musculus
aaagaagtgttgtagccaagcttgg

SEQ ID NO: 11135 - DNA, 25 bp, Mus musculus
aaagaagttgcaacccacacattga

SEQ ID NO: 11136 - DNA, 25 bp, Mus musculus
aaagaagttgcatcccacacattga

SEQ ID NO: 11137 - DNA, 25 bp, Mus musculus
aaagaatacatgcacagacctcggg

SEQ ID NO: 11138 - DNA, 25 bp, Mus musculus
aaagaatacatggacagacctcggg

SEQ ID NO: 11139 - DNA, 25 bp, Mus musculus
aaagaatactttcctgcctctattg

SEQ ID NO: 11140 - DNA, 25 bp, Mus musculus
aaagaatactttgctgcctctattg

SEQ ID NO: 11141 - DNA, 25 bp, Mus musculus
aaagaatagcagctgctcagtagca

SEQ ID NO: 11142 - DNA, 25 bp, Mus musculus
aaagaatagcaggtgctcagtagca

SEQ ID NO: 11143 - DNA, 25 bp, Mus musculus
aaagaatatctaagctagtccttaa

SEQ ID NO: 11144 - DNA, 25 bp, Mus musculus
aaagaatatctatgctagtccttaa

SEQ ID NO: 11145 - DNA, 25 bp, Mus musculus
aaagaatatgtacccttgctgccag

SEQ ID NO: 11146 - DNA, 25 bp, Mus musculus
aaagaatatgtagccttgctgccag

SEQ ID NO: 11147 - DNA, 25 bp, Mus musculus
aaagaatattaccaggcccttccag

SEQ ID NO: 11148 - DNA, 25 bp, Mus musculus
aaagaatattacgaggcccttccag

SEQ ID NO: 11149 - DNA, 25 bp, Mus musculus
aaagaatcacaacttggcatccatt

SEQ ID NO: 11150 - DNA, 25 bp, Mus musculus
aaagaatcacaagttggcatccatt

SEQ ID NO: 11151 - DNA, 25 bp, Mus musculus
aaagaatcagacactcctcatgctg

SEQ ID NO: 11152 - DNA, 25 bp, Mus musculus
aaagaatcagactctcctcatgctg

SEQ ID NO: 11153 - DNA, 25 bp, Mus musculus
aaagaatcagctcacctggatcggc

SEQ ID NO: 11154 - DNA, 25 bp, Mus musculus
aaagaatcagctgacctggatcggc

SEQ ID NO: 11155 - DNA, 25 bp, Mus musculus
aaagaatcatgaactatacgcaacc

SEQ ID NO: 11156 - DNA, 25 bp, Mus musculus
aaagaatcatgatctatacgcaacc

SEQ ID NO: 11157 - DNA, 25 bp, Mus musculus
aaagaatccagtagtcccagtattg

SEQ ID NO: 11158 - DNA, 25 bp, Mus musculus
aaagaatccagttgtcccagtattg

SEQ ID NO: 11159 - DNA, 25 bp, Mus musculus
aaagaatccccaatggcctttgcga

SEQ ID NO: 11160 - DNA, 25 bp, Mus musculus
aaagaatccccattggcctttgcga

SEQ ID NO: 11161 - DNA, 25 bp, Mus musculus
aaagaatcccttagccaagtgcatt

SEQ ID NO: 11162 - DNA, 25 bp, Mus musculus
aaagaatccctttgccaagtgcatt

SEQ ID NO: 11163 - DNA, 25 bp, Mus musculus
aaagaatccgtgagttcttcctttg

SEQ ID NO: 11164 - DNA, 25 bp, Mus musculus
aaagaatccgtgtgttcttcctttg

SEQ ID NO: 11165 - DNA, 25 bp, Mus musculus
aaagaatcctataacatctccagca

SEQ ID NO: 11166 - DNA, 25 bp, Mus musculus
aaagaatcctattacatctccagca

SEQ ID NO: 11167 - DNA, 25 bp, Mus musculus
aaagaatcctttccagaggctggat

SEQ ID NO: 11168 - DNA, 25 bp, Mus musculus
aaagaatcctttgcagaggctggat

SEQ ID NO: 11169 - DNA, 25 bp, Mus musculus
aaagaatcgggtagagatcaacgac

SEQ ID NO: 11170 - DNA, 25 bp, Mus musculus
aaagaatcgggttgagatcaacgac

SEQ ID NO: 11171 - DNA, 25 bp, Mus musculus
aaagaatctgcgctgggcttccgga

SEQ ID NO: 11172 - DNA, 25 bp, Mus musculus
aaagaatctgcggtgggcttccgga

SEQ ID NO: 11173 - DNA, 25 bp, Mus musculus
aaagaatctggtatctcctaggccg

SEQ ID NO: 11174 - DNA, 25 bp, Mus musculus
aaagaatctggtttctcctaggccg

SEQ ID NO: 11175 - DNA, 25 bp, Mus musculus
aaagaatctgtgactactcccaaac

SEQ ID NO: 11176 - DNA, 25 bp, Mus musculus
aaagaatctgtgtctactcccaaac

SEQ ID NO: 11177 - DNA, 25 bp, Mus musculus
aaagaatcttctcgatgagcataca

SEQ ID NO: 11178 - DNA, 25 bp, Mus musculus
aaagaatcttctggatgagcataca

SEQ ID NO: 11179 - DNA, 25 bp, Mus musculus
aaagaatgattcacttcacacacac

SEQ ID NO: 11180 - DNA, 25 bp, Mus musculus
aaagaatgattctcttcacacacac

SEQ ID NO: 11181 - DNA, 25 bp, Mus musculus
aaagaatgatttcttcccatgcatg

SEQ ID NO: 11182 - DNA, 25 bp, Mus musculus
aaagaatgatttgttcccatgcatg

SEQ ID NO: 11183 - DNA, 25 bp, Mus musculus
aaagaatgccacaccatgttggaca

SEQ ID NO: 11184 - DNA, 25 bp, Mus musculus
aaagaatgccactccatgttggaca

SEQ ID NO: 11185 - DNA, 25 bp, Mus musculus
aaagaatgctatcccttctctgttc

SEQ ID NO: 11186 - DNA, 25 bp, Mus musculus
aaagaatgctatgccttctctgttc

SEQ ID NO: 11187 - DNA, 25 bp, Mus musculus
aaagaatgctggctttactccccag

SEQ ID NO: 11188 - DNA, 25 bp, Mus musculus
aaagaatgctgggtttactccccag

SEQ ID NO: 11189 - DNA, 25 bp, Mus musculus
aaagaatgtagcaccgacctcagca

SEQ ID NO: 11190 - DNA, 25 bp, Mus musculus
aaagaatgtagctccgacctcagca

SEQ ID NO: 11191 - DNA, 25 bp, Mus musculus
aaagaatgttctcttgattccctgg

SEQ ID NO: 11192 - DNA, 25 bp, Mus musculus
aaagaatgttctgttgattccctgg

SEQ ID NO: 11193 - DNA, 25 bp, Mus musculus
aaagaattaaggcagttacctctgt

SEQ ID NO: 11194 - DNA, 25 bp, Mus musculus
aaagaattaagggagttacctctgt

SEQ ID NO: 11195 - DNA, 25 bp, Mus musculus
aaagaattccagactccaggtaaga

SEQ ID NO: 11196 - DNA, 25 bp, Mus musculus
aaagaattccagtctccaggtaaga

SEQ ID NO: 11197 - DNA, 25 bp, Mus musculus
aaagaattccatatccctgaactgc

SEQ ID NO: 11198 - DNA, 25 bp, Mus musculus
aaagaattccatttccctgaactgc

SEQ ID NO: 11199 - DNA, 25 bp, Mus musculus
aaagaattcccacatctatgtacat

SEQ ID NO: 11200 - DNA, 25 bp, Mus musculus
aaagaattcccagatctatgtacat

SEQ ID NO: 11201 - DNA, 25 bp, Mus musculus
aaagaattcgtgagcttcctcctac

SEQ ID NO: 11202 - DNA, 25 bp, Mus musculus
aaagaattcgtgtgcttcctcctac

SEQ ID NO: 11203 - DNA, 25 bp, Mus musculus
aaagaattctcacgcaatcacgtgc

SEQ ID NO: 11204 - DNA, 25 bp, Mus musculus
aaagaattctcaggcaatcacgtgc

SEQ ID NO: 11205 - DNA, 25 bp, Mus musculus
aaagaattctccacattccctcgtg

SEQ ID NO: 11206 - DNA, 25 bp, Mus musculus
aaagaattctcctcattccctcgtg

SEQ ID NO: 11207 - DNA, 25 bp, Mus musculus
aaagaattctctctgacttattaag

SEQ ID NO: 11208 - DNA, 25 bp, Mus musculus
aaagaattctctgtgacttattaag

SEQ ID NO: 11209 - DNA, 25 bp, Mus musculus
aaagaattctgtccctgttaccagc

SEQ ID NO: 11210 - DNA, 25 bp, Mus musculus
aaagaattctgtgcctgttaccagc

SEQ ID NO: 11211 - DNA, 25 bp, Mus musculus
aaagaattcttcctctggtggactg

SEQ ID NO: 11212 - DNA, 25 bp, Mus musculus
aaagaattcttcgtctggtggactg

SEQ ID NO: 11213 - DNA, 25 bp, Mus musculus
aaagaattctttacctggcatatga

SEQ ID NO: 11214 - DNA, 25 bp, Mus musculus
aaagaattcttttcctggcatatga

SEQ ID NO: 11215 - DNA, 25 bp, Mus musculus
aaagaattgcagctaacctcggccg

SEQ ID NO: 11216 - DNA, 25 bp, Mus musculus
aaagaattgcaggtaacctcggccg

SEQ ID NO: 11217 - DNA, 25 bp, Mus musculus
aaagaattgcatccgaagccagctt

SEQ ID NO: 11218 - DNA, 25 bp, Mus musculus
aaagaattgcatgcgaagccagctt

SEQ ID NO: 11219 - DNA, 25 bp, Mus musculus
aaagaattgccaccgatgcctgttt

SEQ ID NO: 11220 - DNA, 25 bp, Mus musculus
aaagaattgccagcgatgcctgttt

SEQ ID NO: 11221 - DNA, 25 bp, Mus musculus
aaagaattggccactcctgtgttcg

SEQ ID NO: 11222 - DNA, 25 bp, Mus musculus
aaagaattggcctctcctgtgttcg

SEQ ID NO: 11223 - DNA, 25 bp, Mus musculus
aaagaattgggaaatgaccggtata

SEQ ID NO: 11224 - DNA, 25 bp, Mus musculus
aaagaattgggatatgaccggtata

SEQ ID NO: 11225 - DNA, 25 bp, Mus musculus
aaagaattgtcgattagcctgcata

SEQ ID NO: 11226 - DNA, 25 bp, Mus musculus
aaagaattgtcgtttagcctgcata

SEQ ID NO: 11227 - DNA, 25 bp, Mus musculus
aaagaattgttccttcaccctatgg

SEQ ID NO: 11228 - DNA, 25 bp, Mus musculus
aaagaattgttcgttcaccctatgg

SEQ ID NO: 11229 - DNA, 25 bp, Mus musculus
aaagaatttactccgagctgcagga

SEQ ID NO: 11230 - DNA, 25 bp, Mus musculus
aaagaatttactgcgagctgcagga

SEQ ID NO: 11231 - DNA, 25 bp, Mus musculus
aaagaatttcctcctgtggttgact

SEQ ID NO: 11232 - DNA, 25 bp, Mus musculus
aaagaatttcctgctgtggttgact

SEQ ID NO: 11233 - DNA, 25 bp, Mus musculus
aaagaattttctcctcattggtaag

SEQ ID NO: 11234 - DNA, 25 bp, Mus musculus
aaagaattttctgctcattggtaag

SEQ ID NO: 11235 - DNA, 25 bp, Mus musculus
aaagaatttttaatgatctgggaat

SEQ ID NO: 11236 - DNA, 25 bp, Mus musculus
aaagaatttttattgatctgggaat

SEQ ID NO: 11237 - DNA, 25 bp, Mus musculus
aaagacaaagtgcttcctctggaca

SEQ ID NO: 11238 - DNA, 25 bp, Mus musculus
aaagacaaagtggttcctctggaca

SEQ ID NO: 11239 - DNA, 25 bp, Mus musculus
aaagacaacagactgcctagcccca

SEQ ID NO: 11240 - DNA, 25 bp, Mus musculus
aaagacaacagagtgcctagcccca

SEQ ID NO: 11241 - DNA, 25 bp, Mus musculus
aaagacaacctcctaaatgcctggc

SEQ ID NO: 11242 - DNA, 25 bp, Mus musculus
aaagacaacctcgtaaatgcctggc

SEQ ID NO: 11243 - DNA, 25 bp, Mus musculus
aaagacaacctgacagcccatcagg

SEQ ID NO: 11244 - DNA, 25 bp, Mus musculus
aaagacaacctgtcagcccatcagg

SEQ ID NO: 11245 - DNA, 25 bp, Mus musculus
aaagacaagattacagctctggctg

SEQ ID NO: 11246 - DNA, 25 bp, Mus musculus
aaagacaagatttcagctctggctg

SEQ ID NO: 11247 - DNA, 25 bp, Mus musculus
aaagacaagcacctcaaccaggaaa

SEQ ID NO: 11248 - DNA, 25 bp, Mus musculus
aaagacaagcacgtcaaccaggaaa

SEQ ID NO: 11249 - DNA, 25 bp, Mus musculus
aaagacaagcagaggttacgaacat

SEQ ID NO: 11250 - DNA, 25 bp, Mus musculus
aaagacaagcagtggttacgaacat

SEQ ID NO: 11251 - DNA, 25 bp, Mus musculus
aaagacaagtgcctccggatatgga

SEQ ID NO: 11252 - DNA, 25 bp, Mus musculus
aaagacaagtgcgtccggatatgga

SEQ ID NO: 11253 - DNA, 25 bp, Mus musculus
aaagacaatcacctgcttcatcttc

SEQ ID NO: 11254 - DNA, 25 bp, Mus musculus
aaagacaatcacgtgcttcatcttc

SEQ ID NO: 11255 - DNA, 25 bp, Mus musculus
aaagacaatcatctggtagtttatt

SEQ ID NO: 11256 - DNA, 25 bp, Mus musculus
aaagacaatcatgtggtagtttatt

SEQ ID NO: 11257 - DNA, 25 bp, Mus musculus
aaagacacacgcaagcacaggcaca

SEQ ID NO: 11258 - DNA, 25 bp, Mus musculus
aaagacacacgctagcacaggcaca

SEQ ID NO: 11259 - DNA, 25 bp, Mus musculus
aaagacacaggtaaacggactggat

SEQ ID NO: 11260 - DNA, 25 bp, Mus musculus
aaagacacaggttaacggactggat

SEQ ID NO: 11261 - DNA, 25 bp, Mus musculus
aaagacacagtacccattgtgtata

SEQ ID NO: 11262 - DNA, 25 bp, Mus musculus
aaagacacagtagccattgtgtata

SEQ ID NO: 11263 - DNA, 25 bp, Mus musculus
aaagacaccaagctgctgtgctata

SEQ ID NO: 11264 - DNA, 25 bp, Mus musculus
aaagacaccaaggtgctgtgctata

SEQ ID NO: 11265 - DNA, 25 bp, Mus musculus
aaagacaccgatatttcgaccagat

SEQ ID NO: 11266 - DNA, 25 bp, Mus musculus
aaagacaccgatttttcgaccagat

SEQ ID NO: 11267 - DNA, 25 bp, Mus musculus
aaagacacgcctattcccatggcag

SEQ ID NO: 11268 - DNA, 25 bp, Mus musculus
aaagacacgccttttcccatggcag

SEQ ID NO: 11269 - DNA, 25 bp, Mus musculus
aaagacactacaccgtatgttcacc

SEQ ID NO: 11270 - DNA, 25 bp, Mus musculus
aaagacactacagcgtatgttcacc

SEQ ID NO: 11271 - DNA, 25 bp, Mus musculus
aaagacactgctatcttaccctatg

SEQ ID NO: 11272 - DNA, 25 bp, Mus musculus
aaagacactgctttcttaccctatg

SEQ ID NO: 11273 - DNA, 25 bp, Mus musculus
aaagacacttcaagcttccaaccag

SEQ ID NO: 11274 - DNA, 25 bp, Mus musculus
aaagacacttcatgcttccaaccag

SEQ ID NO: 11275 - DNA, 25 bp, Mus musculus
aaagacactttgctatcccacacct

SEQ ID NO: 11276 - DNA, 25 bp, Mus musculus
aaagacactttggtatcccacacct

SEQ ID NO: 11277 - DNA, 25 bp, Mus musculus
aaagacagaatcatggcccaaaatc

SEQ ID NO: 11278 - DNA, 25 bp, Mus musculus
aaagacagaatcttggcccaaaatc

SEQ ID NO: 11279 - DNA, 25 bp, Mus musculus
aaagacagacaacggtccgctcacc

SEQ ID NO: 11280 - DNA, 25 bp, Mus musculus
aaagacagacaagggtccgctcacc

SEQ ID NO: 11281 - DNA, 25 bp, Mus musculus
aaagacagacatcgctttgggaaga

SEQ ID NO: 11282 - DNA, 25 bp, Mus musculus
aaagacagacatcttagagcagaca

SEQ ID NO: 11283 - DNA, 25 bp, Mus musculus
aaagacagacatggctttgggaaga

SEQ ID NO: 11284 - DNA, 25 bp, Mus musculus
aaagacagacatgttagagcagaca

SEQ ID NO: 11285 - DNA, 25 bp, Mus musculus
aaagacagattgacctcagcgagct

SEQ ID NO: 11286 - DNA, 25 bp, Mus musculus
aaagacagattgtcctcagcgagct

SEQ ID NO: 11287 - DNA, 25 bp, Mus musculus
aaagacagatttagctctcccagga

SEQ ID NO: 11288 - DNA, 25 bp, Mus musculus
aaagacagattttgctctcccagga

SEQ ID NO: 11289 - DNA, 25 bp, Mus musculus
aaagacagcaagactggcacagaca

SEQ ID NO: 11290 - DNA, 25 bp, Mus musculus
aaagacagcaagtctggcacagaca

SEQ ID NO: 11291 - DNA, 25 bp, Mus musculus
aaagacagcaccatttccagtcaag

SEQ ID NO: 11292 - DNA, 25 bp, Mus musculus
aaagacagcaccttttccagtcaag

SEQ ID NO: 11293 - DNA, 25 bp, Mus musculus
aaagacagcactatcgccagccaga

SEQ ID NO: 11294 - DNA, 25 bp, Mus musculus
aaagacagcactttcgccagccaga

SEQ ID NO: 11295 - DNA, 25 bp, Mus musculus
aaagacagcctaccgtcagtctggc

SEQ ID NO: 11296 - DNA, 25 bp, Mus musculus
aaagacagcctagcgtcagtctggc

SEQ ID NO: 11297 - DNA, 25 bp, Mus musculus
aaagacaggcctctttcaggcccct

SEQ ID NO: 11298 - DNA, 25 bp, Mus musculus
aaagacaggcctgtttcaggcccct

SEQ ID NO: 11299 - DNA, 25 bp, Mus musculus
aaagacaggtcacttttcctcaggc

SEQ ID NO: 11300 - DNA, 25 bp, Mus musculus
aaagacaggtcagttttcctcaggc

SEQ ID NO: 11301 - DNA, 25 bp, Mus musculus
aaagacagtgcacgagtctgggcct

SEQ ID NO: 11302 - DNA, 25 bp, Mus musculus
aaagacagtgcaggagtctgggcct

SEQ ID NO: 11303 - DNA, 25 bp, Mus musculus
aaagacataccgacgcttgctgatg

SEQ ID NO: 11304 - DNA, 25 bp, Mus musculus
aaagacataccgtcgcttgctgatg

SEQ ID NO: 11305 - DNA, 25 bp, Mus musculus
aaagacatcacaagatgccctgccc

SEQ ID NO: 11306 - DNA, 25 bp, Mus musculus
aaagacatcacatgatgccctgccc

SEQ ID NO: 11307 - DNA, 25 bp, Mus musculus
aaagacatcataaggcaagcaggaa

SEQ ID NO: 11308 - DNA, 25 bp, Mus musculus
aaagacatcataatttgcttcaaat

SEQ ID NO: 11309 - DNA, 25 bp, Mus musculus
aaagacatcatatggcaagcaggaa

SEQ ID NO: 11310 - DNA, 25 bp, Mus musculus
aaagacatcatattttgcttcaaat

SEQ ID NO: 11311 - DNA, 25 bp, Mus musculus
aaagacatccagatggctcgccgga

SEQ ID NO: 11312 - DNA, 25 bp, Mus musculus
aaagacatccagttggctcgccgga

SEQ ID NO: 11313 - DNA, 25 bp, Mus musculus
aaagacatcgtccttgcctctgtac

SEQ ID NO: 11314 - DNA, 25 bp, Mus musculus
aaagacatcgtcgttgcctctgtac

SEQ ID NO: 11315 - DNA, 25 bp, Mus musculus
aaagacatctcaataggacatatgc

SEQ ID NO: 11316 - DNA, 25 bp, Mus musculus
aaagacatctcattaggacatatgc

SEQ ID NO: 11317 - DNA, 25 bp, Mus musculus
aaagacatctctagcatgcggctgc

SEQ ID NO: 11318 - DNA, 25 bp, Mus musculus
aaagacatctcttgcatgcggctgc

SEQ ID NO: 11319 - DNA, 25 bp, Mus musculus
aaagacatgatcacctaggcacaga

SEQ ID NO: 11320 - DNA, 25 bp, Mus musculus
aaagacatgatctcctaggcacaga

SEQ ID NO: 11321 - DNA, 25 bp, Mus musculus
aaagacatggtcacaaagagacaga

SEQ ID NO: 11322 - DNA, 25 bp, Mus musculus
aaagacatggtctcaaagagacaga

SEQ ID NO: 11323 - DNA, 25 bp, Mus musculus
aaagacattggcatcttgggaggaa

SEQ ID NO: 11324 - DNA, 25 bp, Mus musculus
aaagacattggcttcttgggaggaa

SEQ ID NO: 11325 - DNA, 25 bp, Mus musculus
aaagacatttctcgtattcataaag

SEQ ID NO: 11326 - DNA, 25 bp, Mus musculus
aaagacatttctggtattcataaag

SEQ ID NO: 11327 - DNA, 25 bp, Mus musculus
aaagaccaccagcagcgcatgcttc

SEQ ID NO: 11328 - DNA, 25 bp, Mus musculus
aaagaccaccaggagcgcatgcttc

SEQ ID NO: 11329 - DNA, 25 bp, Mus musculus
aaagaccacctgacaagcagcagtc

SEQ ID NO: 11330 - DNA, 25 bp, Mus musculus
aaagaccacctgtcaagcagcagtc

SEQ ID NO: 11331 - DNA, 25 bp, Mus musculus
aaagaccacggcctctgatagagat

SEQ ID NO: 11332 - DNA, 25 bp, Mus musculus
aaagaccacggcgtctgatagagat

SEQ ID NO: 11333 - DNA, 25 bp, Mus musculus
aaagaccagaccacagtctctaaga

SEQ ID NO: 11334 - DNA, 25 bp, Mus musculus
aaagaccagacctcagtctctaaga

SEQ ID NO: 11335 - DNA, 25 bp, Mus musculus
aaagaccagcatcgccaagttccgt

SEQ ID NO: 11336 - DNA, 25 bp, Mus musculus
aaagaccagcatggccaagttccgt

SEQ ID NO: 11337 - DNA, 25 bp, Mus musculus
aaagaccagctaagaaccgtgtcat

SEQ ID NO: 11338 - DNA, 25 bp, Mus musculus
aaagaccagctatgaaccgtgtcat

SEQ ID NO: 11339 - DNA, 25 bp, Mus musculus
aaagaccaggcaactcggccatctt

SEQ ID NO: 11340 - DNA, 25 bp, Mus musculus
aaagaccaggcatctcggccatctt

SEQ ID NO: 11341 - DNA, 25 bp, Mus musculus
aaagaccagggacttccagcatgtc

SEQ ID NO: 11342 - DNA, 25 bp, Mus musculus
aaagaccagggagttccagcatgtc

SEQ ID NO: 11343 - DNA, 25 bp, Mus musculus
aaagaccagtgaacttactcagaat

SEQ ID NO: 11344 - DNA, 25 bp, Mus musculus
aaagaccagtgatcttactcagaat

SEQ ID NO: 11345 - DNA, 25 bp, Mus musculus
aaagaccatactactaagaccgtgt

SEQ ID NO: 11346 - DNA, 25 bp, Mus musculus
aaagaccatacttctaagaccgtgt

SEQ ID NO: 11347 - DNA, 25 bp, Mus musculus
aaagaccatcaaccttgacaacttg

SEQ ID NO: 11348 - DNA, 25 bp, Mus musculus
aaagaccatcaagcttgacaacttg

SEQ ID NO: 11349 - DNA, 25 bp, Mus musculus
aaagaccatggtagtgtccaaggta

SEQ ID NO: 11350 - DNA, 25 bp, Mus musculus
aaagaccatggttgtgtccaaggta

SEQ ID NO: 11351 - DNA, 25 bp, Mus musculus
aaagacccaaaccacatttcaccat

SEQ ID NO: 11352 - DNA, 25 bp, Mus musculus
aaagacccaaacgacatttcaccat

SEQ ID NO: 11353 - DNA, 25 bp, Mus musculus
aaagacccacatatccacatgattc

SEQ ID NO: 11354 - DNA, 25 bp, Mus musculus
aaagacccacatttccacatgattc

SEQ ID NO: 11355 - DNA, 25 bp, Mus musculus
aaagacccagagagatatccacctc

SEQ ID NO: 11356 - DNA, 25 bp, Mus musculus
aaagacccagagtgatatccacctc

SEQ ID NO: 11357 - DNA, 25 bp, Mus musculus
aaagacccagccaagccagtggtgg

SEQ ID NO: 11358 - DNA, 25 bp, Mus musculus
aaagacccagcctagccagtggtgg

SEQ ID NO: 11359 - DNA, 25 bp, Mus musculus
aaagacccagctagggatgctccgg

SEQ ID NO: 11360 - DNA, 25 bp, Mus musculus
aaagacccagcttgggatgctccgg

SEQ ID NO: 11361 - DNA, 25 bp, Mus musculus
aaagacccatccagagaatgccacg

SEQ ID NO: 11362 - DNA, 25 bp, Mus musculus
aaagacccatcctgagaatgccacg

SEQ ID NO: 11363 - DNA, 25 bp, Mus musculus
aaagacccattaatgcttgcactta

SEQ ID NO: 11364 - DNA, 25 bp, Mus musculus
aaagacccattattgcttgcactta

SEQ ID NO: 11365 - DNA, 25 bp, Mus musculus
aaagacccctaaaggagatccccag

SEQ ID NO: 11366 - DNA, 25 bp, Mus musculus
aaagacccctaatggagatccccag

SEQ ID NO: 11367 - DNA, 25 bp, Mus musculus
aaagacccctggcagcttctgttct

SEQ ID NO: 11368 - DNA, 25 bp, Mus musculus
aaagacccctgggagcttctgttct

SEQ ID NO: 11369 - DNA, 25 bp, Mus musculus
aaagacccgatacatgaacgctccc

SEQ ID NO: 11370 - DNA, 25 bp, Mus musculus
aaagacccgatagatgaacgctccc

SEQ ID NO: 11371 - DNA, 25 bp, Mus musculus
aaagacccgtctctaatgcgatcct

SEQ ID NO: 11372 - DNA, 25 bp, Mus musculus
aaagacccgtctgtaatgcgatcct

SEQ ID NO: 11373 - DNA, 25 bp, Mus musculus
aaagaccctatcagaacagtcatgc

SEQ ID NO: 11374 - DNA, 25 bp, Mus musculus
aaagaccctatctgaacagtcatgc

SEQ ID NO: 11375 - DNA, 25 bp, Mus musculus
aaagaccctccaacacgaagagcac

SEQ ID NO: 11376 - DNA, 25 bp, Mus musculus
aaagaccctccatcacgaagagcac

SEQ ID NO: 11377 - DNA, 25 bp, Mus musculus
aaagaccctgagactggtgtgaact

SEQ ID NO: 11378 - DNA, 25 bp, Mus musculus
aaagaccctgagtctggtgtgaact

SEQ ID NO: 11379 - DNA, 25 bp, Mus musculus
aaagaccctggaagaagccttgaag

SEQ ID NO: 11380 - DNA, 25 bp, Mus musculus
aaagaccctggatgaagccttgaag

SEQ ID NO: 11381 - DNA, 25 bp, Mus musculus
aaagaccctgtaatcctgataggct

SEQ ID NO: 11382 - DNA, 25 bp, Mus musculus
aaagaccctgtattcctgataggct

SEQ ID NO: 11383 - DNA, 25 bp, Mus musculus
aaagacccttggagcttgtgcatac

SEQ ID NO: 11384 - DNA, 25 bp, Mus musculus
aaagacccttggtgcttgtgcatac

SEQ ID NO: 11385 - DNA, 25 bp, Mus musculus
aaagaccgcttcctcatacaagatt

SEQ ID NO: 11386 - DNA, 25 bp, Mus musculus
aaagaccgcttcgtcatacaagatt

SEQ ID NO: 11387 - DNA, 25 bp, Mus musculus
aaagacctatccatcactgggctaa

SEQ ID NO: 11388 - DNA, 25 bp, Mus musculus
aaagacctatccttcactgggctaa

SEQ ID NO: 11389 - DNA, 25 bp, Mus musculus
aaagacctattgcttcccagtgatg

SEQ ID NO: 11390 - DNA, 25 bp, Mus musculus
aaagacctattggttcccagtgatg

SEQ ID NO: 11391 - DNA, 25 bp, Mus musculus
aaagacctcctcattccatataagg

SEQ ID NO: 11392 - DNA, 25 bp, Mus musculus
aaagacctcctctttccatataagg

SEQ ID NO: 11393 - DNA, 25 bp, Mus musculus
aaagacctcgagatatgtgcaataa

SEQ ID NO: 11394 - DNA, 25 bp, Mus musculus
aaagacctcgagttatgtgcaataa

SEQ ID NO: 11395 - DNA, 25 bp, Mus musculus
aaagacctcgccagggctcctagaa

SEQ ID NO: 11396 - DNA, 25 bp, Mus musculus
aaagacctcgcctgggctcctagaa

SEQ ID NO: 11397 - DNA, 25 bp, Mus musculus
aaagacctcggaaggctggaatgtg

SEQ ID NO: 11398 - DNA, 25 bp, Mus musculus
aaagacctcggatggctggaatgtg

SEQ ID NO: 11399 - DNA, 25 bp, Mus musculus
aaagacctctgaagtcttggtgccc

SEQ ID NO: 11400 - DNA, 25 bp, Mus musculus
aaagacctctgatgtcttggtgccc

SEQ ID NO: 11401 - DNA, 25 bp, Mus musculus
aaagacctcttcaaccctcagtatg

SEQ ID NO: 11402 - DNA, 25 bp, Mus musculus
aaagacctcttctaccctcagtatg

SEQ ID NO: 11403 - DNA, 25 bp, Mus musculus
aaagacctgatcatgccgggtggta

SEQ ID NO: 11404 - DNA, 25 bp, Mus musculus
aaagacctgatcttgccgggtggta

SEQ ID NO: 11405 - DNA, 25 bp, Mus musculus
aaagacctgccccatgacagttgtt

SEQ ID NO: 11406 - DNA, 25 bp, Mus musculus
aaagacctgcccgatgacagttgtt

SEQ ID NO: 11407 - DNA, 25 bp, Mus musculus
aaagacctgcgcactaatggcttca

SEQ ID NO: 11408 - DNA, 25 bp, Mus musculus
aaagacctgcgctctaatggcttca

SEQ ID NO: 11409 - DNA, 25 bp, Mus musculus
aaagacctgggccttccattccttg

SEQ ID NO: 11410 - DNA, 25 bp, Mus musculus
aaagacctgggcgttccattccttg

SEQ ID NO: 11411 - DNA, 25 bp, Mus musculus
aaagacctgtttagctgcctagatg

SEQ ID NO: 11412 - DNA, 25 bp, Mus musculus
aaagacctgttttgctgcctagatg

SEQ ID NO: 11413 - DNA, 25 bp, Mus musculus
aaagaccttattatatgaacaccaa

SEQ ID NO: 11414 - DNA, 25 bp, Mus musculus
aaagaccttattttatgaacaccaa

SEQ ID NO: 11415 - DNA, 25 bp, Mus musculus
aaagaccttccaatactgtagttca

SEQ ID NO: 11416 - DNA, 25 bp, Mus musculus
aaagaccttccattactgtagttca

SEQ ID NO: 11417 - DNA, 25 bp, Mus musculus
aaagaccttctacagtacatcataa

SEQ ID NO: 11418 - DNA, 25 bp, Mus musculus
aaagaccttctagagtacatcataa

SEQ ID NO: 11419 - DNA, 25 bp, Mus musculus
aaagaccttctcactggtcaaggag

SEQ ID NO: 11420 - DNA, 25 bp, Mus musculus
aaagaccttctctctggtcaaggag

SEQ ID NO: 11421 - DNA, 25 bp, Mus musculus
aaagaccttgccagcctcattagat

SEQ ID NO: 11422 - DNA, 25 bp, Mus musculus
aaagaccttgcctgcctcattagat

SEQ ID NO: 11423 - DNA, 25 bp, Mus musculus
aaagaccttgctcatgctgcctgga

SEQ ID NO: 11424 - DNA, 25 bp, Mus musculus
aaagaccttgctgatgctgcctgga

SEQ ID NO: 11425 - DNA, 25 bp, Mus musculus
aaagaccttgggagaccttgaaatg

SEQ ID NO: 11426 - DNA, 25 bp, Mus musculus
aaagaccttgggtgaccttgaaatg

SEQ ID NO: 11427 - DNA, 25 bp, Mus musculus
aaagaccttgttacacagagagcct

SEQ ID NO: 11428 - DNA, 25 bp, Mus musculus
aaagaccttgtttcacagagagcct

SEQ ID NO: 11429 - DNA, 25 bp, Mus musculus
aaagacctttccaaccatggagatg

SEQ ID NO: 11430 - DNA, 25 bp, Mus musculus
aaagacctttcctaccatggagatg

SEQ ID NO: 11431 - DNA, 25 bp, Mus musculus
aaagacgaagagagcattgtgtata

SEQ ID NO: 11432 - DNA, 25 bp, Mus musculus
aaagacgaagagtgcattgtgtata

SEQ ID NO: 11433 - DNA, 25 bp, Mus musculus
aaagacgacaccagtcacatccgat

SEQ ID NO: 11434 - DNA, 25 bp, Mus musculus
aaagacgacacctgtcacatccgat

SEQ ID NO: 11435 - DNA, 25 bp, Mus musculus
aaagacgactaccacagcttgctgt

SEQ ID NO: 11436 - DNA, 25 bp, Mus musculus
aaagacgactacgacagcttgctgt

SEQ ID NO: 11437 - DNA, 25 bp, Mus musculus
aaagacgactcgatatgcttcccct

SEQ ID NO: 11438 - DNA, 25 bp, Mus musculus
aaagacgactcgttatgcttcccct

SEQ ID NO: 11439 - DNA, 25 bp, Mus musculus
aaagacgagaccatcggcgagtaca

SEQ ID NO: 11440 - DNA, 25 bp, Mus musculus
aaagacgagaccttcggcgagtaca

SEQ ID NO: 11441 - DNA, 25 bp, Mus musculus
aaagacgagcgtctgctcacgttga

SEQ ID NO: 11442 - DNA, 25 bp, Mus musculus
aaagacgagcgtgtgctcacgttga

SEQ ID NO: 11443 - DNA, 25 bp, Mus musculus
aaagacgagtcacgcgccattccca

SEQ ID NO: 11444 - DNA, 25 bp, Mus musculus
aaagacgagtcaggcgccattccca

SEQ ID NO: 11445 - DNA, 25 bp, Mus musculus
aaagacgatattcccctctttgcat

SEQ ID NO: 11446 - DNA, 25 bp, Mus musculus
aaagacgatattgccctctttgcat

SEQ ID NO: 11447 - DNA, 25 bp, Mus musculus
aaagacgcaaatccctgcagaggaa

SEQ ID NO: 11448 - DNA, 25 bp, Mus musculus
aaagacgcaaatgcctgcagaggaa

SEQ ID NO: 11449 - DNA, 25 bp, Mus musculus
aaagacgcagccctgatgacaacag

SEQ ID NO: 11450 - DNA, 25 bp, Mus musculus
aaagacgcagccgtgatgacaacag

SEQ ID NO: 11451 - DNA, 25 bp, Mus musculus
aaagacgccaatcgcccgtactgag

SEQ ID NO: 11452 - DNA, 25 bp, Mus musculus
aaagacgccaatggcccgtactgag

SEQ ID NO: 11453 - DNA, 25 bp, Mus musculus
aaagacgcctttctgaggcttcggt

SEQ ID NO: 11454 - DNA, 25 bp, Mus musculus
aaagacgcctttgtgaggcttcggt

SEQ ID NO: 11455 - DNA, 25 bp, Mus musculus
aaagacgctagcaatggacaccatt

SEQ ID NO: 11456 - DNA, 25 bp, Mus musculus
aaagacgctagctatggacaccatt

SEQ ID NO: 11457 - DNA, 25 bp, Mus musculus
aaagacgctgttccctaagtgtggc

SEQ ID NO: 11458 - DNA, 25 bp, Mus musculus
aaagacgctgttgcctaagtgtggc

SEQ ID NO: 11459 - DNA, 25 bp, Mus musculus
aaagacggaccacttcttggcttca

SEQ ID NO: 11460 - DNA, 25 bp, Mus musculus
aaagacggaccagttcttggcttca

SEQ ID NO: 11461 - DNA, 25 bp, Mus musculus
aaagacggagcccaaatcagatcgg

SEQ ID NO: 11462 - DNA, 25 bp, Mus musculus
aaagacggagccgaaatcagatcgg

SEQ ID NO: 11463 - DNA, 25 bp, Mus musculus
aaagacggagttccttcctaaggca

SEQ ID NO: 11464 - DNA, 25 bp, Mus musculus
aaagacggagttgcttcctaaggca

SEQ ID NO: 11465 - DNA, 25 bp, Mus musculus
aaagacggcaagatctctcaggtct

SEQ ID NO: 11466 - DNA, 25 bp, Mus musculus
aaagacggcaagttctctcaggtct

SEQ ID NO: 11467 - DNA, 25 bp, Mus musculus
aaagacggtgatacatcgctgacac

SEQ ID NO: 11468 - DNA, 25 bp, Mus musculus
aaagacggtgattcatcgctgacac

SEQ ID NO: 11469 - DNA, 25 bp, Mus musculus
aaagacggttgtagtgcacgatgaa

SEQ ID NO: 11470 - DNA, 25 bp, Mus musculus
aaagacggttgttgtgcacgatgaa

SEQ ID NO: 11471 - DNA, 25 bp, Mus musculus
aaagacgtactgcaagtctctggaa

SEQ ID NO: 11472 - DNA, 25 bp, Mus musculus
aaagacgtactggaagtctctggaa

SEQ ID NO: 11473 - DNA, 25 bp, Mus musculus
aaagacgtattaaagccagctaaag

SEQ ID NO: 11474 - DNA, 25 bp, Mus musculus
aaagacgtattatagccagctaaag

SEQ ID NO: 11475 - DNA, 25 bp, Mus musculus
aaagacgtcattagaaggcaggcaa

SEQ ID NO: 11476 - DNA, 25 bp, Mus musculus
aaagacgtcatttgaaggcaggcaa

SEQ ID NO: 11477 - DNA, 25 bp, Mus musculus
aaagacgtctgccagtgaacttggg

SEQ ID NO: 11478 - DNA, 25 bp, Mus musculus
aaagacgtctgcgagtgaacttggg

SEQ ID NO: 11479 - DNA, 25 bp, Mus musculus
aaagacgtcttcagttcaccctgaa

SEQ ID NO: 11480 - DNA, 25 bp, Mus musculus
aaagacgtcttctgttcaccctgaa

SEQ ID NO: 11481 - DNA, 25 bp, Mus musculus
aaagacgtgactcctctaaccggac

SEQ ID NO: 11482 - DNA, 25 bp, Mus musculus
aaagacgtgactgctctaaccggac

SEQ ID NO: 11483 - DNA, 25 bp, Mus musculus
aaagacgtgctgatgtgtgtcccta

SEQ ID NO: 11484 - DNA, 25 bp, Mus musculus
aaagacgtgctgttgtgtgtcccta

SEQ ID NO: 11485 - DNA, 25 bp, Mus musculus
aaagacgtgtgccaacattgcccgg

SEQ ID NO: 11486 - DNA, 25 bp, Mus musculus
aaagacgtgtgcgaacattgcccgg

SEQ ID NO: 11487 - DNA, 25 bp, Mus musculus
aaagacgttaaccagcaggagttcg

SEQ ID NO: 11488 - DNA, 25 bp, Mus musculus
aaagacgttaacgagcaggagttcg

SEQ ID NO: 11489 - DNA, 25 bp, Mus musculus
aaagacgttatcactcagtttcctc

SEQ ID NO: 11490 - DNA, 25 bp, Mus musculus
aaagacgttatctctcagtttcctc

SEQ ID NO: 11491 - DNA, 25 bp, Mus musculus
aaagacgttctacttgcctaactct

SEQ ID NO: 11492 - DNA, 25 bp, Mus musculus
aaagacgttctagttgcctaactct

SEQ ID NO: 11493 - DNA, 25 bp, Mus musculus
aaagacgttggcatcactgcggtac

SEQ ID NO: 11494 - DNA, 25 bp, Mus musculus
aaagacgttggcttcactgcggtac

SEQ ID NO: 11495 - DNA, 25 bp, Mus musculus
aaagacgtttatcttcatgtctctg

SEQ ID NO: 11496 - DNA, 25 bp, Mus musculus
aaagacgtttatgttcatgtctctg

SEQ ID NO: 11497 - DNA, 25 bp, Mus musculus
aaagactaaggcacatcccaatgta

SEQ ID NO: 11498 - DNA, 25 bp, Mus musculus
aaagactaaggctcatcccaatgta

SEQ ID NO: 11499 - DNA, 25 bp, Mus musculus
aaagactaagttcttcagctccgcc

SEQ ID NO: 11500 - DNA, 25 bp, Mus musculus
aaagactaagttgttcagctccgcc

SEQ ID NO: 11501 - DNA, 25 bp, Mus musculus
aaagactaatccactctttacctgc

SEQ ID NO: 11502 - DNA, 25 bp, Mus musculus
aaagactaatcctctctttacctgc

SEQ ID NO: 11503 - DNA, 25 bp, Mus musculus
aaagactaatctccattttccatga

SEQ ID NO: 11504 - DNA, 25 bp, Mus musculus
aaagactaatctgcattttccatga

SEQ ID NO: 11505 - DNA, 25 bp, Mus musculus
aaagactacacacgcttgcgtgtat

SEQ ID NO: 11506 - DNA, 25 bp, Mus musculus
aaagactacacaggcttgcgtgtat

SEQ ID NO: 11507 - DNA, 25 bp, Mus musculus
aaagactacctactgcacggtgctc

SEQ ID NO: 11508 - DNA, 25 bp, Mus musculus
aaagactacctagtgcacggtgctc

SEQ ID NO: 11509 - DNA, 25 bp, Mus musculus
aaagactacgaaactggccagctat

SEQ ID NO: 11510 - DNA, 25 bp, Mus musculus
aaagactacgaatctggccagctat

SEQ ID NO: 11511 - DNA, 25 bp, Mus musculus
aaagactacttcaatgctagccgtc

SEQ ID NO: 11512 - DNA, 25 bp, Mus musculus
aaagactacttctatgctagccgtc

SEQ ID NO: 11513 - DNA, 25 bp, Mus musculus
aaagactaggttcaatagacggatt

SEQ ID NO: 11514 - DNA, 25 bp, Mus musculus
aaagactaggttgaatagacggatt

SEQ ID NO: 11515 - DNA, 25 bp, Mus musculus
aaagactagtctccatgccaactta

SEQ ID NO: 11516 - DNA, 25 bp, Mus musculus
aaagactagtctgcatgccaactta

SEQ ID NO: 11517 - DNA, 25 bp, Mus musculus
aaagactatcgcaggtgttcaaaaa

SEQ ID NO: 11518 - DNA, 25 bp, Mus musculus
aaagactatcgctggtgttcaaaaa

SEQ ID NO: 11519 - DNA, 25 bp, Mus musculus
aaagactatggcaagctgtgtgtgt

SEQ ID NO: 11520 - DNA, 25 bp, Mus musculus
aaagactatggctagctgtgtgtgt

SEQ ID NO: 11521 - DNA, 25 bp, Mus musculus
aaagactatggtccccagactcttg

SEQ ID NO: 11522 - DNA, 25 bp, Mus musculus
aaagactatggtgcccagactcttg

SEQ ID NO: 11523 - DNA, 25 bp, Mus musculus
aaagactcagagatgttggccagga

SEQ ID NO: 11524 - DNA, 25 bp, Mus musculus
aaagactcagagttgttggccagga

SEQ ID NO: 11525 - DNA, 25 bp, Mus musculus
aaagactcagcaagggtggatggac

SEQ ID NO: 11526 - DNA, 25 bp, Mus musculus
aaagactcagcacagtcaccgtgaa

SEQ ID NO: 11527 - DNA, 25 bp, Mus musculus
aaagactcagcagagtcaccgtgaa

SEQ ID NO: 11528 - DNA, 25 bp, Mus musculus
aaagactcagcatgggtggatggac

SEQ ID NO: 11529 - DNA, 25 bp, Mus musculus
aaagactcagtcattcagctcgtgc

SEQ ID NO: 11530 - DNA, 25 bp, Mus musculus
aaagactcagtctttcagctcgtgc

SEQ ID NO: 11531 - DNA, 25 bp, Mus musculus
aaagactcataaagattcgcccgcc

SEQ ID NO: 11532 - DNA, 25 bp, Mus musculus
aaagactcataatgattcgcccgcc

SEQ ID NO: 11533 - DNA, 25 bp, Mus musculus
aaagactcatgcacttgggaggccc

SEQ ID NO: 11534 - DNA, 25 bp, Mus musculus
aaagactcatgctcttgggaggccc

SEQ ID NO: 11535 - DNA, 25 bp, Mus musculus
aaagactccagacccatctgttgat

SEQ ID NO: 11536 - DNA, 25 bp, Mus musculus
aaagactccagagccatctgttgat

SEQ ID NO: 11537 - DNA, 25 bp, Mus musculus
aaagactccatcatatctctgtatg

SEQ ID NO: 11538 - DNA, 25 bp, Mus musculus
aaagactccatcttatctctgtatg

SEQ ID NO: 11539 - DNA, 25 bp, Mus musculus
aaagactcctaacagcatcagtgtc

SEQ ID NO: 11540 - DNA, 25 bp, Mus musculus
aaagactcctaagagcatcagtgtc

SEQ ID NO: 11541 - DNA, 25 bp, Mus musculus
aaagactcctagaaagaatccaact

SEQ ID NO: 11542 - DNA, 25 bp, Mus musculus
aaagactcctagtaagaatccaact

SEQ ID NO: 11543 - DNA, 25 bp, Mus musculus
aaagactcctctactcgggaagtgc

SEQ ID NO: 11544 - DNA, 25 bp, Mus musculus
aaagactcctcttctcgggaagtgc

SEQ ID NO: 11545 - DNA, 25 bp, Mus musculus
aaagactccttaccaaagcagcctg

SEQ ID NO: 11546 - DNA, 25 bp, Mus musculus
aaagactccttagcaaagcagcctg

SEQ ID NO: 11547 - DNA, 25 bp, Mus musculus
aaagactctgacaagctgtcccaca

SEQ ID NO: 11548 - DNA, 25 bp, Mus musculus
aaagactctgactagctgtcccaca

SEQ ID NO: 11549 - DNA, 25 bp, Mus musculus
aaagactctgtgattctttcatgta

SEQ ID NO: 11550 - DNA, 25 bp, Mus musculus
aaagactctgtgtttctttcatgta

SEQ ID NO: 11551 - DNA, 25 bp, Mus musculus
aaagactctgttactgactgttccc

SEQ ID NO: 11552 - DNA, 25 bp, Mus musculus
aaagactctgtttctgactgttccc

SEQ ID NO: 11553 - DNA, 25 bp, Mus musculus
aaagactcttctcggatgttgccaa

SEQ ID NO: 11554 - DNA, 25 bp, Mus musculus
aaagactcttctgggatgttgccaa

SEQ ID NO: 11555 - DNA, 25 bp, Mus musculus
aaagactgacagacaccgggaattg

SEQ ID NO: 11556 - DNA, 25 bp, Mus musculus
aaagactgacagtcaccgggaattg

SEQ ID NO: 11557 - DNA, 25 bp, Mus musculus
aaagactgaggcattttgccacacc

SEQ ID NO: 11558 - DNA, 25 bp, Mus musculus
aaagactgaggctttttgccacacc

SEQ ID NO: 11559 - DNA, 25 bp, Mus musculus
aaagactgagtcctccagatccctg

SEQ ID NO: 11560 - DNA, 25 bp, Mus musculus
aaagactgagtcgtccagatccctg

SEQ ID NO: 11561 - DNA, 25 bp, Mus musculus
aaagactgagttactaagcatttct

SEQ ID NO: 11562 - DNA, 25 bp, Mus musculus
aaagactgagtttctaagcatttct

SEQ ID NO: 11563 - DNA, 25 bp, Mus musculus
aaagactgattaccatgcctaccat

SEQ ID NO: 11564 - DNA, 25 bp, Mus musculus
aaagactgattagcatgcctaccat

SEQ ID NO: 11565 - DNA, 25 bp, Mus musculus
aaagactgcattcagctcttcacca

SEQ ID NO: 11566 - DNA, 25 bp, Mus musculus
aaagactgcattgagctcttcacca

SEQ ID NO: 11567 - DNA, 25 bp, Mus musculus
aaagactgctacacaggcttcgtat

SEQ ID NO: 11568 - DNA, 25 bp, Mus musculus
aaagactgctactcaggcttcgtat

SEQ ID NO: 11569 - DNA, 25 bp, Mus musculus
aaagactgctccaggatggacgccc

SEQ ID NO: 11570 - DNA, 25 bp, Mus musculus
aaagactgctcctggatggacgccc

SEQ ID NO: 11571 - DNA, 25 bp, Mus musculus
aaagactgctgtcccgagcccacgg

SEQ ID NO: 11572 - DNA, 25 bp, Mus musculus
aaagactgctgtgccgagcccacgg

SEQ ID NO: 11573 - DNA, 25 bp, Mus musculus
aaagactgcttgagcctgggatctc

SEQ ID NO: 11574 - DNA, 25 bp, Mus musculus
aaagactgcttgtgcctgggatctc

SEQ ID NO: 11575 - DNA, 25 bp, Mus musculus
aaagactggaagctttctccacctc

SEQ ID NO: 11576 - DNA, 25 bp, Mus musculus
aaagactggaaggtttctccacctc

SEQ ID NO: 11577 - DNA, 25 bp, Mus musculus
aaagactggcccatttccaattgtc

SEQ ID NO: 11578 - DNA, 25 bp, Mus musculus
aaagactggcccttttccaattgtc

SEQ ID NO: 11579 - DNA, 25 bp, Mus musculus
aaagactggcttacatttttatagt

SEQ ID NO: 11580 - DNA, 25 bp, Mus musculus
aaagactggctttcatttttatagt

SEQ ID NO: 11581 - DNA, 25 bp, Mus musculus
aaagactgggcaaccgcactgaagg

SEQ ID NO: 11582 - DNA, 25 bp, Mus musculus
aaagactgggcatccgcactgaagg

SEQ ID NO: 11583 - DNA, 25 bp, Mus musculus
aaagactgggcccagtccacactga

SEQ ID NO: 11584 - DNA, 25 bp, Mus musculus
aaagactgggccgagtccacactga

SEQ ID NO: 11585 - DNA, 25 bp, Mus musculus
aaagactggtcacaactgtccctct

SEQ ID NO: 11586 - DNA, 25 bp, Mus musculus
aaagactggtcagaactgtccctct

SEQ ID NO: 11587 - DNA, 25 bp, Mus musculus
aaagactggtcccattcggaccgat

SEQ ID NO: 11588 - DNA, 25 bp, Mus musculus
aaagactggtccgattcggaccgat

SEQ ID NO: 11589 - DNA, 25 bp, Mus musculus
aaagactggtggacgaatctgtcgt

SEQ ID NO: 11590 - DNA, 25 bp, Mus musculus
aaagactggtggtcgaatctgtcgt

SEQ ID NO: 11591 - DNA, 25 bp, Mus musculus
aaagactgtactcgccagtgtcctt

SEQ ID NO: 11592 - DNA, 25 bp, Mus musculus
aaagactgtactggccagtgtcctt

SEQ ID NO: 11593 - DNA, 25 bp, Mus musculus
aaagactgtccacatgtctgtccag

SEQ ID NO: 11594 - DNA, 25 bp, Mus musculus
aaagactgtccagatgtctgtccag

SEQ ID NO: 11595 - DNA, 25 bp, Mus musculus
aaagactgtgaactggtgcttctca

SEQ ID NO: 11596 - DNA, 25 bp, Mus musculus
aaagactgtgaagtggtgcttctca

SEQ ID NO: 11597 - DNA, 25 bp, Mus musculus
aaagactgttaacgcctgacacctc

SEQ ID NO: 11598 - DNA, 25 bp, Mus musculus
aaagactgttaaggcctgacacctc

SEQ ID NO: 11599 - DNA, 25 bp, Mus musculus
aaagactgttgtacactatcacctc

SEQ ID NO: 11600 - DNA, 25 bp, Mus musculus
aaagactgttgttcactatcacctc

SEQ ID NO: 11601 - DNA, 25 bp, Mus musculus
aaagacttaaatctgcttgcactag

SEQ ID NO: 11602 - DNA, 25 bp, Mus musculus
aaagacttaaatgtgcttgcactag

SEQ ID NO: 11603 - DNA, 25 bp, Mus musculus
aaagacttaattaatccactatgaa

SEQ ID NO: 11604 - DNA, 25 bp, Mus musculus
aaagacttaatttatccactatgaa

SEQ ID NO: 11605 - DNA, 25 bp, Mus musculus
aaagacttagataagcactcctgct

SEQ ID NO: 11606 - DNA, 25 bp, Mus musculus
aaagacttagattagcactcctgct

SEQ ID NO: 11607 - DNA, 25 bp, Mus musculus
aaagacttagggatattcagtgttg

SEQ ID NO: 11608 - DNA, 25 bp, Mus musculus
aaagacttagggttattcagtgttg

SEQ ID NO: 11609 - DNA, 25 bp, Mus musculus
aaagacttatttagtgggaactcag

SEQ ID NO: 11610 - DNA, 25 bp, Mus musculus
aaagacttattttgtgggaactcag

SEQ ID NO: 11611 - DNA, 25 bp, Mus musculus
aaagacttcataagtgtaccatcaa

SEQ ID NO: 11612 - DNA, 25 bp, Mus musculus
aaagacttcatatgtgtaccatcaa

SEQ ID NO: 11613 - DNA, 25 bp, Mus musculus
aaagacttcccaattgtactgagat

SEQ ID NO: 11614 - DNA, 25 bp, Mus musculus
aaagacttcccatttgtactgagat

SEQ ID NO: 11615 - DNA, 25 bp, Mus musculus
aaagacttctctatttattcggtga

SEQ ID NO: 11616 - DNA, 25 bp, Mus musculus
aaagacttctctttttattcggtga

SEQ ID NO: 11617 - DNA, 25 bp, Mus musculus
aaagacttgacacttcagcaataca

SEQ ID NO: 11618 - DNA, 25 bp, Mus musculus
aaagacttgacagttcagcaataca

SEQ ID NO: 11619 - DNA, 25 bp, Mus musculus
aaagacttgatgaacctaggttggg

SEQ ID NO: 11620 - DNA, 25 bp, Mus musculus
aaagacttgatgtacctaggttggg

SEQ ID NO: 11621 - DNA, 25 bp, Mus musculus
aaagacttggccaagcatgggcttt

SEQ ID NO: 11622 - DNA, 25 bp, Mus musculus
aaagacttggcctagcatgggcttt

SEQ ID NO: 11623 - DNA, 25 bp, Mus musculus
aaagacttgtgaactctgctgcaga

SEQ ID NO: 11624 - DNA, 25 bp, Mus musculus
aaagacttgtgatctctgctgcaga

SEQ ID NO: 11625 - DNA, 25 bp, Mus musculus
aaagacttgtgtcggctgacgcatt

SEQ ID NO: 11626 - DNA, 25 bp, Mus musculus
aaagacttgtgtgggctgacgcatt

SEQ ID NO: 11627 - DNA, 25 bp, Mus musculus
aaagactttcctcttgtcgtctagc

SEQ ID NO: 11628 - DNA, 25 bp, Mus musculus
aaagactttcctgttgtcgtctagc

SEQ ID NO: 11629 - DNA, 25 bp, Mus musculus
aaagactttggaatcattcacacaa

SEQ ID NO: 11630 - DNA, 25 bp, Mus musculus
aaagactttggattcattcacacaa

SEQ ID NO: 11631 - DNA, 25 bp, Mus musculus
aaagactttggtatctgtcctgtag

SEQ ID NO: 11632 - DNA, 25 bp, Mus musculus
aaagactttggtttctgtcctgtag

SEQ ID NO: 11633 - DNA, 25 bp, Mus musculus
aaagactttgtaactctggctaaaa

SEQ ID NO: 11634 - DNA, 25 bp, Mus musculus
aaagactttgtatctctggctaaaa

SEQ ID NO: 11635 - DNA, 25 bp, Mus musculus
aaagacttttcaactcgggtggaga

SEQ ID NO: 11636 - DNA, 25 bp, Mus musculus
aaagacttttcatctcgggtggaga

SEQ ID NO: 11637 - DNA, 25 bp, Mus musculus
aaagacttttctaatgcccacgtgc

SEQ ID NO: 11638 - DNA, 25 bp, Mus musculus
aaagacttttctacacgatcctcta

SEQ ID NO: 11639 - DNA, 25 bp, Mus musculus
aaagacttttctagctgcaatttca

SEQ ID NO: 11640 - DNA, 25 bp, Mus musculus
aaagacttttcttatgcccacgtgc

SEQ ID NO: 11641 - DNA, 25 bp, Mus musculus
aaagacttttcttcacgatcctcta

SEQ ID NO: 11642 - DNA, 25 bp, Mus musculus
aaagacttttcttgctgcaatttca

SEQ ID NO: 11643 - DNA, 25 bp, Mus musculus
aaagagaaacataatgttgcttctt

SEQ ID NO: 11644 - DNA, 25 bp, Mus musculus
aaagagaaacattatgttgcttctt

SEQ ID NO: 11645 - DNA, 25 bp, Mus musculus
aaagagaaagccaacccggtcagag

SEQ ID NO: 11646 - DNA, 25 bp, Mus musculus
aaagagaaagcctacccggtcagag

SEQ ID NO: 11647 - DNA, 25 bp, Mus musculus
aaagagaacactcccacaattctcc

SEQ ID NO: 11648 - DNA, 25 bp, Mus musculus
aaagagaacactgccacaattctcc

SEQ ID NO: 11649 - DNA, 25 bp, Mus musculus
aaagagaaccttctggctctgacca

SEQ ID NO: 11650 - DNA, 25 bp, Mus musculus
aaagagaaccttgtggctctgacca

SEQ ID NO: 11651 - DNA, 25 bp, Mus musculus
aaagagaacggcaccaggctctgca

SEQ ID NO: 11652 - DNA, 25 bp, Mus musculus
aaagagaacggctccaggctctgca

SEQ ID NO: 11653 - DNA, 25 bp, Mus musculus
aaagagaacgtgcactcaccgcttc

SEQ ID NO: 11654 - DNA, 25 bp, Mus musculus
aaagagaacgtggactcaccgcttc

SEQ ID NO: 11655 - DNA, 25 bp, Mus musculus
aaagagaactcaccatggccagctt

SEQ ID NO: 11656 - DNA, 25 bp, Mus musculus
aaagagaactcagcatggccagctt

SEQ ID NO: 11657 - DNA, 25 bp, Mus musculus
aaagagaactgtaccgcctactacg

SEQ ID NO: 11658 - DNA, 25 bp, Mus musculus
aaagagaactgttccgcctactacg

SEQ ID NO: 11659 - DNA, 25 bp, Mus musculus
aaagagaagatcaagccagcagcct

SEQ ID NO: 11660 - DNA, 25 bp, Mus musculus
aaagagaagatctagccagcagcct

SEQ ID NO: 11661 - DNA, 25 bp, Mus musculus
aaagagaagccacccgcagtcggat

SEQ ID NO: 11662 - DNA, 25 bp, Mus musculus
aaagagaagccagccgcagtcggat

SEQ ID NO: 11663 - DNA, 25 bp, Mus musculus
aaagagaagctccaaggttgcgtta

SEQ ID NO: 11664 - DNA, 25 bp, Mus musculus
aaagagaagctcgaaggttgcgtta

SEQ ID NO: 11665 - DNA, 25 bp, Mus musculus
aaagagaaggctcgaccacccacac

SEQ ID NO: 11666 - DNA, 25 bp, Mus musculus
aaagagaaggctggaccacccacac

SEQ ID NO: 11667 - DNA, 25 bp, Mus musculus
aaagagaatcgcaccaaagctatgg

SEQ ID NO: 11668 - DNA, 25 bp, Mus musculus
aaagagaatcgctccaaagctatgg

SEQ ID NO: 11669 - DNA, 25 bp, Mus musculus
aaagagaatctgactgcctttcagt

SEQ ID NO: 11670 - DNA, 25 bp, Mus musculus
aaagagaatctgtctgcctttcagt

SEQ ID NO: 11671 - DNA, 25 bp, Mus musculus
aaagagaattttccttcacattatg

SEQ ID NO: 11672 - DNA, 25 bp, Mus musculus
aaagagaattttgcttcacattatg

SEQ ID NO: 11673 - DNA, 25 bp, Mus musculus
aaagagacaaagctgcaagagcatt

SEQ ID NO: 11674 - DNA, 25 bp, Mus musculus
aaagagacaaaggtgcaagagcatt

SEQ ID NO: 11675 - DNA, 25 bp, Mus musculus
aaagagacaaggcaaccatgcagcc

SEQ ID NO: 11676 - DNA, 25 bp, Mus musculus
aaagagacaagggaaccatgcagcc

SEQ ID NO: 11677 - DNA, 25 bp, Mus musculus
aaagagacacccaaactcttgctca

SEQ ID NO: 11678 - DNA, 25 bp, Mus musculus
aaagagacaccctaactcttgctca

SEQ ID NO: 11679 - DNA, 25 bp, Mus musculus
aaagagacactcatgaccctctctt

SEQ ID NO: 11680 - DNA, 25 bp, Mus musculus
aaagagacactcttgaccctctctt

SEQ ID NO: 11681 - DNA, 25 bp, Mus musculus
aaagagacaggcagcttggacacag

SEQ ID NO: 11682 - DNA, 25 bp, Mus musculus
aaagagacaggctgcttggacacag

SEQ ID NO: 11683 - DNA, 25 bp, Mus musculus
aaagagacatgtaggtttcaccaac

SEQ ID NO: 11684 - DNA, 25 bp, Mus musculus
aaagagacatgttggtttcaccaac

SEQ ID NO: 11685 - DNA, 25 bp, Mus musculus
aaagagaccattatggctgctggag

SEQ ID NO: 11686 - DNA, 25 bp, Mus musculus
aaagagaccattcaatgtttttgaa

SEQ ID NO: 11687 - DNA, 25 bp, Mus musculus
aaagagaccattgaatgtttttgaa

SEQ ID NO: 11688 - DNA, 25 bp, Mus musculus
aaagagaccattttggctgctggag

SEQ ID NO: 11689 - DNA, 25 bp, Mus musculus
aaagagacgcccaggctctaggtcg

SEQ ID NO: 11690 - DNA, 25 bp, Mus musculus
aaagagacgccctggctctaggtcg

SEQ ID NO: 11691 - DNA, 25 bp, Mus musculus
aaagagacggacacctgttcaccta

SEQ ID NO: 11692 - DNA, 25 bp, Mus musculus
aaagagacggactcctgttcaccta

SEQ ID NO: 11693 - DNA, 25 bp, Mus musculus
aaagagagaattcgccctctctgcc

SEQ ID NO: 11694 - DNA, 25 bp, Mus musculus
aaagagagaattggccctctctgcc

SEQ ID NO: 11695 - DNA, 25 bp, Mus musculus
aaagagagagaaaccgccctgccct

SEQ ID NO: 11696 - DNA, 25 bp, Mus musculus
aaagagagagaatccgccctgccct

SEQ ID NO: 11697 - DNA, 25 bp, Mus musculus
aaagagagagtaacactattgtgta

SEQ ID NO: 11698 - DNA, 25 bp, Mus musculus
aaagagagagtatcactattgtgta

SEQ ID NO: 11699 - DNA, 25 bp, Mus musculus
aaagagagatctatcctctcctgca

SEQ ID NO: 11700 - DNA, 25 bp, Mus musculus
aaagagagatctttcctctcctgca

SEQ ID NO: 11701 - DNA, 25 bp, Mus musculus
aaagagagccacctggaggcctatg

SEQ ID NO: 11702 - DNA, 25 bp, Mus musculus
aaagagagccacgtggaggcctatg

SEQ ID NO: 11703 - DNA, 25 bp, Mus musculus
aaagagagcctcctagacctgtgac

SEQ ID NO: 11704 - DNA, 25 bp, Mus musculus
aaagagagcctcgtagacctgtgac

SEQ ID NO: 11705 - DNA, 25 bp, Mus musculus
aaagagagcctgaccccgttcagtg

SEQ ID NO: 11706 - DNA, 25 bp, Mus musculus
aaagagagcctgagttttcctcctt

SEQ ID NO: 11707 - DNA, 25 bp, Mus musculus
aaagagagcctgtccccgttcagtg

SEQ ID NO: 11708 - DNA, 25 bp, Mus musculus
aaagagagcctgtgttttcctcctt

SEQ ID NO: 11709 - DNA, 25 bp, Mus musculus
aaagagagctttctctgcattttat

SEQ ID NO: 11710 - DNA, 25 bp, Mus musculus
aaagagagctttgtctgcattttat

SEQ ID NO: 11711 - DNA, 25 bp, Mus musculus
aaagagaggccacggagttcacagt

SEQ ID NO: 11712 - DNA, 25 bp, Mus musculus
aaagagaggccagggagttcacagt

SEQ ID NO: 11713 - DNA, 25 bp, Mus musculus
aaagagagggcccttgcctggcatt

SEQ ID NO: 11714 - DNA, 25 bp, Mus musculus
aaagagagggccgttgcctggcatt

SEQ ID NO: 11715 - DNA, 25 bp, Mus musculus
aaagagaggtccaacccggacatca

SEQ ID NO: 11716 - DNA, 25 bp, Mus musculus
aaagagaggtcctacccggacatca

SEQ ID NO: 11717 - DNA, 25 bp, Mus musculus
aaagagaggttcctgctcttctgcg

SEQ ID NO: 11718 - DNA, 25 bp, Mus musculus
aaagagaggttcgtgctcttctgcg

SEQ ID NO: 11719 - DNA, 25 bp, Mus musculus
aaagagagtgaaccctccacccata

SEQ ID NO: 11720 - DNA, 25 bp, Mus musculus
aaagagagtgaagcctccacccata

SEQ ID NO: 11721 - DNA, 25 bp, Mus musculus
aaagagagttcaagcttggacccat

SEQ ID NO: 11722 - DNA, 25 bp, Mus musculus
aaagagagttcatgcttggacccat

SEQ ID NO: 11723 - DNA, 25 bp, Mus musculus
aaagagagttgtccgaagcgccaag

SEQ ID NO: 11724 - DNA, 25 bp, Mus musculus
aaagagagttgtgcgaagcgccaag

SEQ ID NO: 11725 - DNA, 25 bp, Mus musculus
aaagagataacacgctccaagcagg

SEQ ID NO: 11726 - DNA, 25 bp, Mus musculus
aaagagataacaggctccaagcagg

SEQ ID NO: 11727 - DNA, 25 bp, Mus musculus
aaagagatacgtcagacccttgtac

SEQ ID NO: 11728 - DNA, 25 bp, Mus musculus
aaagagatacgtgagacccttgtac

SEQ ID NO: 11729 - DNA, 25 bp, Mus musculus
aaagagatagccaaacccactcctg

SEQ ID NO: 11730 - DNA, 25 bp, Mus musculus
aaagagatagcctaacccactcctg

SEQ ID NO: 11731 - DNA, 25 bp, Mus musculus
aaagagatcacccaggctgcccgtg

SEQ ID NO: 11732 - DNA, 25 bp, Mus musculus
aaagagatcaccgaggctgcccgtg

SEQ ID NO: 11733 - DNA, 25 bp, Mus musculus
aaagagatccaactccgccaagaag

SEQ ID NO: 11734 - DNA, 25 bp, Mus musculus
aaagagatccaagtccgccaagaag

SEQ ID NO: 11735 - DNA, 25 bp, Mus musculus
aaagagatctacctctgttccctaa

SEQ ID NO: 11736 - DNA, 25 bp, Mus musculus
aaagagatctacgtctgttccctaa

SEQ ID NO: 11737 - DNA, 25 bp, Mus musculus
aaagagatgcccaacgagtatccca

SEQ ID NO: 11738 - DNA, 25 bp, Mus musculus
aaagagatgccctacgagtatccca

SEQ ID NO: 11739 - DNA, 25 bp, Mus musculus
aaagagatgcttacactgtgtacgg

SEQ ID NO: 11740 - DNA, 25 bp, Mus musculus
aaagagatgcttactgtccctgaag

SEQ ID NO: 11741 - DNA, 25 bp, Mus musculus
aaagagatgctttcactgtgtacgg

SEQ ID NO: 11742 - DNA, 25 bp, Mus musculus
aaagagatgctttctgtccctgaag

SEQ ID NO: 11743 - DNA, 25 bp, Mus musculus
aaagagattcccaatgatgcttatc

SEQ ID NO: 11744 - DNA, 25 bp, Mus musculus
aaagagattccctatgatgcttatc

SEQ ID NO: 11745 - DNA, 25 bp, Mus musculus
aaagagattctgatccttgcccggt

SEQ ID NO: 11746 - DNA, 25 bp, Mus musculus
aaagagattctgttccttgcccggt

SEQ ID NO: 11747 - DNA, 25 bp, Mus musculus
aaagagattgagcaggtttaccgac

SEQ ID NO: 11748 - DNA, 25 bp, Mus musculus
aaagagattgaggaggtttaccgac

SEQ ID NO: 11749 - DNA, 25 bp, Mus musculus
aaagagattgctacgtgagctgacg

SEQ ID NO: 11750 - DNA, 25 bp, Mus musculus
aaagagattgcttcgtgagctgacg

SEQ ID NO: 11751 - DNA, 25 bp, Mus musculus
aaagagattgtcagtgtcccttcat

SEQ ID NO: 11752 - DNA, 25 bp, Mus musculus
aaagagattgtctgtgtcccttcat

SEQ ID NO: 11753 - DNA, 25 bp, Mus musculus
aaagagatttccatccttacctgtg

SEQ ID NO: 11754 - DNA, 25 bp, Mus musculus
aaagagatttccttccttacctgtg

SEQ ID NO: 11755 - DNA, 25 bp, Mus musculus
aaagagcaatataggccgggcatgt

SEQ ID NO: 11756 - DNA, 25 bp, Mus musculus
aaagagcaatattggccgggcatgt

SEQ ID NO: 11757 - DNA, 25 bp, Mus musculus
aaagagcacatccaggccatcggaa

SEQ ID NO: 11758 - DNA, 25 bp, Mus musculus
aaagagcacatcgaggccatcggaa

SEQ ID NO: 11759 - DNA, 25 bp, Mus musculus
aaagagcacatgcaaccggctccag

SEQ ID NO: 11760 - DNA, 25 bp, Mus musculus
aaagagcacatggaaccggctccag

SEQ ID NO: 11761 - DNA, 25 bp, Mus musculus
aaagagcaccagaggatcctggctc

SEQ ID NO: 11762 - DNA, 25 bp, Mus musculus
aaagagcaccagtggatcctggctc

SEQ ID NO: 11763 - DNA, 25 bp, Mus musculus
aaagagcacctgaggaagctgatcc

SEQ ID NO: 11764 - DNA, 25 bp, Mus musculus
aaagagcacctgtggaagctgatcc

SEQ ID NO: 11765 - DNA, 25 bp, Mus musculus
aaagagcacgcacttgcttttgctt

SEQ ID NO: 11766 - DNA, 25 bp, Mus musculus
aaagagcacgcagttgcttttgctt

SEQ ID NO: 11767 - DNA, 25 bp, Mus musculus
aaagagcactgcacctctggctggg

SEQ ID NO: 11768 - DNA, 25 bp, Mus musculus
aaagagcactgctcctctggctggg

SEQ ID NO: 11769 - DNA, 25 bp, Mus musculus
aaagagcacttgaaagcttggcttt

SEQ ID NO: 11770 - DNA, 25 bp, Mus musculus
aaagagcacttgtaagcttggcttt

SEQ ID NO: 11771 - DNA, 25 bp, Mus musculus
aaagagcagagacagcttcctgaag

SEQ ID NO: 11772 - DNA, 25 bp, Mus musculus
aaagagcagagagagcttcctgaag

SEQ ID NO: 11773 - DNA, 25 bp, Mus musculus
aaagagcagcgtccggatccccttg

SEQ ID NO: 11774 - DNA, 25 bp, Mus musculus
aaagagcagcgtgcggatccccttg

SEQ ID NO: 11775 - DNA, 25 bp, Mus musculus
aaagagcagctgcttcgcatcaata

SEQ ID NO: 11776 - DNA, 25 bp, Mus musculus
aaagagcagctggttcgcatcaata

SEQ ID NO: 11777 - DNA, 25 bp, Mus musculus
aaagagcagggtcatgtagctgtca

SEQ ID NO: 11778 - DNA, 25 bp, Mus musculus
aaagagcagggtgatgtagctgtca

SEQ ID NO: 11779 - DNA, 25 bp, Mus musculus
aaagagcatacaagggctggttgga

SEQ ID NO: 11780 - DNA, 25 bp, Mus musculus
aaagagcatacatgggctggttgga

SEQ ID NO: 11781 - DNA, 25 bp, Mus musculus
aaagagcatagtatgggttcccatt

SEQ ID NO: 11782 - DNA, 25 bp, Mus musculus
aaagagcatagtttgggttcccatt

SEQ ID NO: 11783 - DNA, 25 bp, Mus musculus
aaagagcatcgacgccaggctgcag

SEQ ID NO: 11784 - DNA, 25 bp, Mus musculus
aaagagcatcgaggccaggctgcag

SEQ ID NO: 11785 - DNA, 25 bp, Mus musculus
aaagagcatctcacctagtatctgt

SEQ ID NO: 11786 - DNA, 25 bp, Mus musculus
aaagagcatctctcctagtatctgt

SEQ ID NO: 11787 - DNA, 25 bp, Mus musculus
aaagagccaatgaagtgacaacccc

SEQ ID NO: 11788 - DNA, 25 bp, Mus musculus
aaagagccaatgtagtgacaacccc

SEQ ID NO: 11789 - DNA, 25 bp, Mus musculus
aaagagccacaaatccacgtaccag

SEQ ID NO: 11790 - DNA, 25 bp, Mus musculus
aaagagccacaattccacgtaccag

SEQ ID NO: 11791 - DNA, 25 bp, Mus musculus
aaagagccacatatctcaccagggt

SEQ ID NO: 11792 - DNA, 25 bp, Mus musculus
aaagagccacatttctcaccagggt

SEQ ID NO: 11793 - DNA, 25 bp, Mus musculus
aaagagccagccctctacctgtgga

SEQ ID NO: 11794 - DNA, 25 bp, Mus musculus
aaagagccagccgtctacctgtgga

SEQ ID NO: 11795 - DNA, 25 bp, Mus musculus
aaagagccattcacattccaaatgt

SEQ ID NO: 11796 - DNA, 25 bp, Mus musculus
aaagagccattctcattccaaatgt

SEQ ID NO: 11797 - DNA, 25 bp, Mus musculus
aaagagcccagaataatattacaca

SEQ ID NO: 11798 - DNA, 25 bp, Mus musculus
aaagagcccagattaatattacaca

SEQ ID NO: 11799 - DNA, 25 bp, Mus musculus
aaagagcccagtacaagatacccct

SEQ ID NO: 11800 - DNA, 25 bp, Mus musculus
aaagagcccagttcaagatacccct

SEQ ID NO: 11801 - DNA, 25 bp, Mus musculus
aaagagcccttcaggtgcttttgtg

SEQ ID NO: 11802 - DNA, 25 bp, Mus musculus
aaagagcccttctggtgcttttgtg

SEQ ID NO: 11803 - DNA, 25 bp, Mus musculus
aaagagccgaggacgtttgaggtca

SEQ ID NO: 11804 - DNA, 25 bp, Mus musculus
aaagagccgaggtcgtttgaggtca

SEQ ID NO: 11805 - DNA, 25 bp, Mus musculus
aaagagccgcagcaagtcttcagag

SEQ ID NO: 11806 - DNA, 25 bp, Mus musculus
aaagagccgcaggaagtcttcagag

SEQ ID NO: 11807 - DNA, 25 bp, Mus musculus
aaagagccgccaagtgtgggccagt

SEQ ID NO: 11808 - DNA, 25 bp, Mus musculus
aaagagccgccatgtgtgggccagt

SEQ ID NO: 11809 - DNA, 25 bp, Mus musculus
aaagagccgctgagcaagctcgctg

SEQ ID NO: 11810 - DNA, 25 bp, Mus musculus
aaagagccgctgtgcaagctcgctg

SEQ ID NO: 11811 - DNA, 25 bp, Mus musculus
aaagagccgtggagcagcctggcca

SEQ ID NO: 11812 - DNA, 25 bp, Mus musculus
aaagagccgtggtgcagcctggcca

SEQ ID NO: 11813 - DNA, 25 bp, Mus musculus
aaagagcctccactagggaccacat

SEQ ID NO: 11814 - DNA, 25 bp, Mus musculus
aaagagcctccagtagggaccacat

SEQ ID NO: 11815 - DNA, 25 bp, Mus musculus
aaagagcctcccagatgaaaataag

SEQ ID NO: 11816 - DNA, 25 bp, Mus musculus
aaagagcctccctgatgaaaataag

SEQ ID NO: 11817 - DNA, 25 bp, Mus musculus
aaagagcctctcagctgcttttgtt

SEQ ID NO: 11818 - DNA, 25 bp, Mus musculus
aaagagcctctctgctgcttttgtt

SEQ ID NO: 11819 - DNA, 25 bp, Mus musculus
aaagagcctcttagtgtagcaatgt

SEQ ID NO: 11820 - DNA, 25 bp, Mus musculus
aaagagcctctttgtgtagcaatgt

SEQ ID NO: 11821 - DNA, 25 bp, Mus musculus
aaagagcctgacatgactgtcctct

SEQ ID NO: 11822 - DNA, 25 bp, Mus musculus
aaagagcctgacttgactgtcctct

SEQ ID NO: 11823 - DNA, 25 bp, Mus musculus
aaagagcctgccagttgactagtca

SEQ ID NO: 11824 - DNA, 25 bp, Mus musculus
aaagagcctgcctgttgactagtca

SEQ ID NO: 11825 - DNA, 25 bp, Mus musculus
aaagagccttccagaatcatgcaca

SEQ ID NO: 11826 - DNA, 25 bp, Mus musculus
aaagagccttcctgaatcatgcaca

SEQ ID NO: 11827 - DNA, 25 bp, Mus musculus
aaagagccttgcagttggtggttag

SEQ ID NO: 11828 - DNA, 25 bp, Mus musculus
aaagagccttgctgttggtggttag

SEQ ID NO: 11829 - DNA, 25 bp, Mus musculus
aaagagcgcagcacctccaggtgac

SEQ ID NO: 11830 - DNA, 25 bp, Mus musculus
aaagagcgcagctcctccaggtgac

SEQ ID NO: 11831 - DNA, 25 bp, Mus musculus
aaagagcggatccttgatgttcccc

SEQ ID NO: 11832 - DNA, 25 bp, Mus musculus
aaagagcggatcgttgatgttcccc

SEQ ID NO: 11833 - DNA, 25 bp, Mus musculus
aaagagctaagaatttcctgcttaa

SEQ ID NO: 11834 - DNA, 25 bp, Mus musculus
aaagagctaagattttcctgcttaa

SEQ ID NO: 11835 - DNA, 25 bp, Mus musculus
aaagagctacagagctatccccgtc

SEQ ID NO: 11836 - DNA, 25 bp, Mus musculus
aaagagctacagtgctatccccgtc

SEQ ID NO: 11837 - DNA, 25 bp, Mus musculus
aaagagctacgtactttatgctcag

SEQ ID NO: 11838 - DNA, 25 bp, Mus musculus
aaagagctacgttctttatgctcag

SEQ ID NO: 11839 - DNA, 25 bp, Mus musculus
aaagagctagtgctcactggtctgc

SEQ ID NO: 11840 - DNA, 25 bp, Mus musculus
aaagagctagtggtcactggtctgc

SEQ ID NO: 11841 - DNA, 25 bp, Mus musculus
aaagagctattgctccttctcatcc

SEQ ID NO: 11842 - DNA, 25 bp, Mus musculus
aaagagctattggtccttctcatcc

SEQ ID NO: 11843 - DNA, 25 bp, Mus musculus
aaagagctcatcatagccggcaagg

SEQ ID NO: 11844 - DNA, 25 bp, Mus musculus
aaagagctcatcttagccggcaagg

SEQ ID NO: 11845 - DNA, 25 bp, Mus musculus
aaagagctcccaatatcattcaaag

SEQ ID NO: 11846 - DNA, 25 bp, Mus musculus
aaagagctcccattatcattcaaag

SEQ ID NO: 11847 - DNA, 25 bp, Mus musculus
aaagagctcccgactggcaaaaaat

SEQ ID NO: 11848 - DNA, 25 bp, Mus musculus
aaagagctcccgtctggcaaaaaat

SEQ ID NO: 11849 - DNA, 25 bp, Mus musculus
aaagagctcgaaatggtcacccagt

SEQ ID NO: 11850 - DNA, 25 bp, Mus musculus
aaagagctcgaattggtcacccagt

SEQ ID NO: 11851 - DNA, 25 bp, Mus musculus
aaagagctctgtctctggaattgga

SEQ ID NO: 11852 - DNA, 25 bp, Mus musculus
aaagagctctgtgtctggaattgga

SEQ ID NO: 11853 - DNA, 25 bp, Mus musculus
aaagagctctttctggtccttctag

SEQ ID NO: 11854 - DNA, 25 bp, Mus musculus
aaagagctctttgtggtccttctag

SEQ ID NO: 11855 - DNA, 25 bp, Mus musculus
aaagagctgaataaattggccaaga

SEQ ID NO: 11856 - DNA, 25 bp, Mus musculus
aaagagctgaatcgcgtctcggttt

SEQ ID NO: 11857 - DNA, 25 bp, Mus musculus
aaagagctgaatggcgtctcggttt

SEQ ID NO: 11858 - DNA, 25 bp, Mus musculus
aaagagctgaattaattggccaaga

SEQ ID NO: 11859 - DNA, 25 bp, Mus musculus
aaagagctgaccctgcccgtggaca

SEQ ID NO: 11860 - DNA, 25 bp, Mus musculus
aaagagctgaccgtgcccgtggaca

SEQ ID NO: 11861 - DNA, 25 bp, Mus musculus
aaagagctgcaccattgggcaaaat

SEQ ID NO: 11862 - DNA, 25 bp, Mus musculus
aaagagctgcacgattgggcaaaat

SEQ ID NO: 11863 - DNA, 25 bp, Mus musculus
aaagagctggacctgatcactctcc

SEQ ID NO: 11864 - DNA, 25 bp, Mus musculus
aaagagctggacgtgatcactctcc

SEQ ID NO: 11865 - DNA, 25 bp, Mus musculus
aaagagctgtaactaatatgcaaag

SEQ ID NO: 11866 - DNA, 25 bp, Mus musculus
aaagagctgtaagtaatatgcaaag

SEQ ID NO: 11867 - DNA, 25 bp, Mus musculus
aaagagctgtctagtctaggcctca

SEQ ID NO: 11868 - DNA, 25 bp, Mus musculus
aaagagctgtcttgtctaggcctca

SEQ ID NO: 11869 - DNA, 25 bp, Mus musculus
aaagagctgtgtcgacatggtcatg

SEQ ID NO: 11870 - DNA, 25 bp, Mus musculus
aaagagctgtgtggacatggtcatg

SEQ ID NO: 11871 - DNA, 25 bp, Mus musculus
aaagagctgttgcttgccttgctgc

SEQ ID NO: 11872 - DNA, 25 bp, Mus musculus
aaagagctgttggttgccttgctgc

SEQ ID NO: 11873 - DNA, 25 bp, Mus musculus
aaagagcttaccatcagccactcag

SEQ ID NO: 11874 - DNA, 25 bp, Mus musculus
aaagagcttaccttcagccactcag

SEQ ID NO: 11875 - DNA, 25 bp, Mus musculus
aaagagcttcaacgtcccgttctag

SEQ ID NO: 11876 - DNA, 25 bp, Mus musculus
aaagagcttcaaggtcccgttctag

SEQ ID NO: 11877 - DNA, 25 bp, Mus musculus
aaagagcttcctatcgttgcatgcc

SEQ ID NO: 11878 - DNA, 25 bp, Mus musculus
aaagagcttcctttcgttgcatgcc

SEQ ID NO: 11879 - DNA, 25 bp, Mus musculus
aaagagcttgttcccatcctgagaa

SEQ ID NO: 11880 - DNA, 25 bp, Mus musculus
aaagagcttgttgccatcctgagaa

SEQ ID NO: 11881 - DNA, 25 bp, Mus musculus
aaagagctttatcctgtcacccttg

SEQ ID NO: 11882 - DNA, 25 bp, Mus musculus
aaagagctttatgctgtcacccttg

SEQ ID NO: 11883 - DNA, 25 bp, Mus musculus
aaagagctttccacatacagcagag

SEQ ID NO: 11884 - DNA, 25 bp, Mus musculus
aaagagctttcctcatacagcagag

SEQ ID NO: 11885 - DNA, 25 bp, Mus musculus
aaagagctttgcaggcctccaagag

SEQ ID NO: 11886 - DNA, 25 bp, Mus musculus
aaagagctttgctggcctccaagag

SEQ ID NO: 11887 - DNA, 25 bp, Mus musculus
aaagaggacactcccgcaaggcatc

SEQ ID NO: 11888 - DNA, 25 bp, Mus musculus
aaagaggacactgccgcaaggcatc

SEQ ID NO: 11889 - DNA, 25 bp, Mus musculus
aaagaggactgaccccacaggcaca

SEQ ID NO: 11890 - DNA, 25 bp, Mus musculus
aaagaggactgagcccacaggcaca

SEQ ID NO: 11891 - DNA, 25 bp, Mus musculus
aaagaggacttgctgcaaagaccct

SEQ ID NO: 11892 - DNA, 25 bp, Mus musculus
aaagaggacttggtgcaaagaccct

SEQ ID NO: 11893 - DNA, 25 bp, Mus musculus
aaagaggagcccattgtctctgcaa

SEQ ID NO: 11894 - DNA, 25 bp, Mus musculus
aaagaggagccctttgtctctgcaa

SEQ ID NO: 11895 - DNA, 25 bp, Mus musculus
aaagaggagcggacacctgcctgag

SEQ ID NO: 11896 - DNA, 25 bp, Mus musculus
aaagaggagcggtcacctgcctgag

SEQ ID NO: 11897 - DNA, 25 bp, Mus musculus
aaagaggagtcactttcccacactc

SEQ ID NO: 11898 - DNA, 25 bp, Mus musculus
aaagaggagtcagtttcccacactc

SEQ ID NO: 11899 - DNA, 25 bp, Mus musculus
aaagaggatcgcagtgtccctttaa

SEQ ID NO: 11900 - DNA, 25 bp, Mus musculus
aaagaggatcgctgtgtccctttaa

SEQ ID NO: 11901 - DNA, 25 bp, Mus musculus
aaagaggatctaagccactccccac

SEQ ID NO: 11902 - DNA, 25 bp, Mus musculus
aaagaggatctatgccactccccac

SEQ ID NO: 11903 - DNA, 25 bp, Mus musculus
aaagaggcacacagctcccctggtt

SEQ ID NO: 11904 - DNA, 25 bp, Mus musculus
aaagaggcacactgctcccctggtt

SEQ ID NO: 11905 - DNA, 25 bp, Mus musculus
aaagaggcagacctttgccagaact

SEQ ID NO: 11906 - DNA, 25 bp, Mus musculus
aaagaggcagacgtttgccagaact

SEQ ID NO: 11907 - DNA, 25 bp, Mus musculus
aaagaggcagatcgcccaaacgtct

SEQ ID NO: 11908 - DNA, 25 bp, Mus musculus
aaagaggcagatggcccaaacgtct

SEQ ID NO: 11909 - DNA, 25 bp, Mus musculus
aaagaggcagctcatagtgtttctt

SEQ ID NO: 11910 - DNA, 25 bp, Mus musculus
aaagaggcagctgatagtgtttctt

SEQ ID NO: 11911 - DNA, 25 bp, Mus musculus
aaagaggcatatattacagcttcca

SEQ ID NO: 11912 - DNA, 25 bp, Mus musculus
aaagaggcatattttacagcttcca

SEQ ID NO: 11913 - DNA, 25 bp, Mus musculus
aaagaggccaagatgcctttccacg

SEQ ID NO: 11914 - DNA, 25 bp, Mus musculus
aaagaggccaagttgcctttccacg

SEQ ID NO: 11915 - DNA, 25 bp, Mus musculus
aaagaggccatcctcagtgcctcct

SEQ ID NO: 11916 - DNA, 25 bp, Mus musculus
aaagaggccatcgtcagtgcctcct

SEQ ID NO: 11917 - DNA, 25 bp, Mus musculus
aaagaggcccttaagctgtgcacag

SEQ ID NO: 11918 - DNA, 25 bp, Mus musculus
aaagaggccctttagctgtgcacag

SEQ ID NO: 11919 - DNA, 25 bp, Mus musculus
aaagaggcctgtacactcagcactg

SEQ ID NO: 11920 - DNA, 25 bp, Mus musculus
aaagaggcctgttcactcagcactg

SEQ ID NO: 11921 - DNA, 25 bp, Mus musculus
aaagaggcctttcgttctatcagaa

SEQ ID NO: 11922 - DNA, 25 bp, Mus musculus
aaagaggcctttggttctatcagaa

SEQ ID NO: 11923 - DNA, 25 bp, Mus musculus
aaagaggctccaagcttgtccacgg

SEQ ID NO: 11924 - DNA, 25 bp, Mus musculus
aaagaggctccactcagggctgctt

SEQ ID NO: 11925 - DNA, 25 bp, Mus musculus
aaagaggctccagtcagggctgctt

SEQ ID NO: 11926 - DNA, 25 bp, Mus musculus
aaagaggctccatgcttgtccacgg

SEQ ID NO: 11927 - DNA, 25 bp, Mus musculus
aaagaggctctgcagccactgataa

SEQ ID NO: 11928 - DNA, 25 bp, Mus musculus
aaagaggctctgcagcgtctggtca

SEQ ID NO: 11929 - DNA, 25 bp, Mus musculus
aaagaggctctggagccactgataa

SEQ ID NO: 11930 - DNA, 25 bp, Mus musculus
aaagaggctctggagcgtctggtca

SEQ ID NO: 11931 - DNA, 25 bp, Mus musculus
aaagaggctgacctctaccgctttc

SEQ ID NO: 11932 - DNA, 25 bp, Mus musculus
aaagaggctgacgtctaccgctttc

SEQ ID NO: 11933 - DNA, 25 bp, Mus musculus
aaagaggcttcgctctaaagctgag

SEQ ID NO: 11934 - DNA, 25 bp, Mus musculus
aaagaggcttcggtctaaagctgag

SEQ ID NO: 11935 - DNA, 25 bp, Mus musculus
aaagaggcttgtagcccagagtgta

SEQ ID NO: 11936 - DNA, 25 bp, Mus musculus
aaagaggcttgttgcccagagtgta

SEQ ID NO: 11937 - DNA, 25 bp, Mus musculus
aaagagggaccacccaagagcgtgt

SEQ ID NO: 11938 - DNA, 25 bp, Mus musculus
aaagagggaccagccaagagcgtgt

SEQ ID NO: 11939 - DNA, 25 bp, Mus musculus
aaagagggagctacctcctggcatt

SEQ ID NO: 11940 - DNA, 25 bp, Mus musculus
aaagagggagcttcctcctggcatt

SEQ ID NO: 11941 - DNA, 25 bp, Mus musculus
aaagagggcagcaggctacccacac

SEQ ID NO: 11942 - DNA, 25 bp, Mus musculus
aaagagggcagctggctacccacac

SEQ ID NO: 11943 - DNA, 25 bp, Mus musculus
aaagagggctgtaccaggctaaagt

SEQ ID NO: 11944 - DNA, 25 bp, Mus musculus
aaagagggctgttccaggctaaagt

SEQ ID NO: 11945 - DNA, 25 bp, Mus musculus
aaagagggcttacctgttgctttag

SEQ ID NO: 11946 - DNA, 25 bp, Mus musculus
aaagagggcttagctgttgctttag

SEQ ID NO: 11947 - DNA, 25 bp, Mus musculus
aaagagggtcccagccaatcacagg

SEQ ID NO: 11948 - DNA, 25 bp, Mus musculus
aaagagggtccctgccaatcacagg

SEQ ID NO: 11949 - DNA, 25 bp, Mus musculus
aaagagggtctcacggagcgctttg

SEQ ID NO: 11950 - DNA, 25 bp, Mus musculus
aaagagggtctctcggagcgctttg

SEQ ID NO: 11951 - DNA, 25 bp, Mus musculus
aaagagggtggcatgtcacactgac

SEQ ID NO: 11952 - DNA, 25 bp, Mus musculus
aaagagggtggcttgtcacactgac

SEQ ID NO: 11953 - DNA, 25 bp, Mus musculus
aaagagggtttgaggaggcatttat

SEQ ID NO: 11954 - DNA, 25 bp, Mus musculus
aaagagggtttgtggaggcatttat

SEQ ID NO: 11955 - DNA, 25 bp, Mus musculus
aaagaggtacctattgaactgtgag

SEQ ID NO: 11956 - DNA, 25 bp, Mus musculus
aaagaggtaccttttgaactgtgag

SEQ ID NO: 11957 - DNA, 25 bp, Mus musculus
aaagaggtcactcggttgactttca

SEQ ID NO: 11958 - DNA, 25 bp, Mus musculus
aaagaggtcactgggttgactttca

SEQ ID NO: 11959 - DNA, 25 bp, Mus musculus
aaagaggtcagccatacccaggcag

SEQ ID NO: 11960 - DNA, 25 bp, Mus musculus
aaagaggtcagcgatacccaggcag

SEQ ID NO: 11961 - DNA, 25 bp, Mus musculus
aaagaggtctatatgctggatgcca

SEQ ID NO: 11962 - DNA, 25 bp, Mus musculus
aaagaggtctatttgctggatgcca

SEQ ID NO: 11963 - DNA, 25 bp, Mus musculus
aaagaggtgacaaggcctttctcag

SEQ ID NO: 11964 - DNA, 25 bp, Mus musculus
aaagaggtgacatggcctttctcag

SEQ ID NO: 11965 - DNA, 25 bp, Mus musculus
aaagaggtgacccacgatctgctct

SEQ ID NO: 11966 - DNA, 25 bp, Mus musculus
aaagaggtgaccgacgatctgctct

SEQ ID NO: 11967 - DNA, 25 bp, Mus musculus
aaagaggtgatgctccatctccatc

SEQ ID NO: 11968 - DNA, 25 bp, Mus musculus
aaagaggtgatggtccatctccatc

SEQ ID NO: 11969 - DNA, 25 bp, Mus musculus
aaagaggtgcagacccctgcaagtt

SEQ ID NO: 11970 - DNA, 25 bp, Mus musculus
aaagaggtgcagtcccctgcaagtt

SEQ ID NO: 11971 - DNA, 25 bp, Mus musculus
aaagaggtggacagaagcctgcagt

SEQ ID NO: 11972 - DNA, 25 bp, Mus musculus
aaagaggtggactgaagcctgcagt

SEQ ID NO: 11973 - DNA, 25 bp, Mus musculus
aaagaggtggatcctccttcctcca

SEQ ID NO: 11974 - DNA, 25 bp, Mus musculus
aaagaggtggatgctccttcctcca

SEQ ID NO: 11975 - DNA, 25 bp, Mus musculus
aaagaggttagtcccttttcatcct

SEQ ID NO: 11976 - DNA, 25 bp, Mus musculus
aaagaggttagtgccttttcatcct

SEQ ID NO: 11977 - DNA, 25 bp, Mus musculus
aaagaggttcacactattacatcaa

SEQ ID NO: 11978 - DNA, 25 bp, Mus musculus
aaagaggttcactctattacatcaa

SEQ ID NO: 11979 - DNA, 25 bp, Mus musculus
aaagaggttctcagggctgctacat

SEQ ID NO: 11980 - DNA, 25 bp, Mus musculus
aaagaggttctctgggctgctacat

SEQ ID NO: 11981 - DNA, 25 bp, Mus musculus
aaagaggttgctagcccaggctgga

SEQ ID NO: 11982 - DNA, 25 bp, Mus musculus
aaagaggttgcttgcccaggctgga

SEQ ID NO: 11983 - DNA, 25 bp, Mus musculus
aaagagtaccggcaccctgaaggcg

SEQ ID NO: 11984 - DNA, 25 bp, Mus musculus
aaagagtaccgggaccctgaaggcg

SEQ ID NO: 11985 - DNA, 25 bp, Mus musculus
aaagagtagcagacatttctgtagt

SEQ ID NO: 11986 - DNA, 25 bp, Mus musculus
aaagagtagcagtcatttctgtagt

SEQ ID NO: 11987 - DNA, 25 bp, Mus musculus
aaagagtagctcatgccgaggatca

SEQ ID NO: 11988 - DNA, 25 bp, Mus musculus
aaagagtagctcttgccgaggatca

SEQ ID NO: 11989 - DNA, 25 bp, Mus musculus
aaagagtcaccaacatgaagccatg

SEQ ID NO: 11990 - DNA, 25 bp, Mus musculus
aaagagtcaccatcatgaagccatg

SEQ ID NO: 11991 - DNA, 25 bp, Mus musculus
aaagagtcactgagcggagcctttc

SEQ ID NO: 11992 - DNA, 25 bp, Mus musculus
aaagagtcactgtgcggagcctttc

SEQ ID NO: 11993 - DNA, 25 bp, Mus musculus
aaagagtcacttaattcctctgccc

SEQ ID NO: 11994 - DNA, 25 bp, Mus musculus
aaagagtcactttattcctctgccc

SEQ ID NO: 11995 - DNA, 25 bp, Mus musculus
aaagagtcagtcagagcgcactgca

SEQ ID NO: 11996 - DNA, 25 bp, Mus musculus
aaagagtcagtctgagcgcactgca

SEQ ID NO: 11997 - DNA, 25 bp, Mus musculus
aaagagtccaggaatgctgccaccc

SEQ ID NO: 11998 - DNA, 25 bp, Mus musculus
aaagagtccaggtatgctgccaccc

SEQ ID NO: 11999 - DNA, 25 bp, Mus musculus
aaagagtccctgctgcagtccaaaa

SEQ ID NO: 12000 - DNA, 25 bp, Mus musculus
aaagagtccctggtgcagtccaaaa

SEQ ID NO: 12001 - DNA, 25 bp, Mus musculus
aaagagtcctgtacattggttcgag

SEQ ID NO: 12002 - DNA, 25 bp, Mus musculus
aaagagtcctgttcattggttcgag

SEQ ID NO: 12003 - DNA, 25 bp, Mus musculus
aaagagtccttgctaagtctgccag

SEQ ID NO: 12004 - DNA, 25 bp, Mus musculus
aaagagtccttggtaagtctgccag

SEQ ID NO: 12005 - DNA, 25 bp, Mus musculus
aaagagtctagcaggcagcccaaag

SEQ ID NO: 12006 - DNA, 25 bp, Mus musculus
aaagagtctagctggcagcccaaag

SEQ ID NO: 12007 - DNA, 25 bp, Mus musculus
aaagagtctagtccctgccttttga

SEQ ID NO: 12008 - DNA, 25 bp, Mus musculus
aaagagtctagtgcctgccttttga

SEQ ID NO: 12009 - DNA, 25 bp, Mus musculus
aaagagtctcgacctccagatttcc

SEQ ID NO: 12010 - DNA, 25 bp, Mus musculus
aaagagtctcgagctccagatttcc

SEQ ID NO: 12011 - DNA, 25 bp, Mus musculus
aaagagtctctacttcttctgggtt

SEQ ID NO: 12012 - DNA, 25 bp, Mus musculus
aaagagtctctagttcttctgggtt

SEQ ID NO: 12013 - DNA, 25 bp, Mus musculus
aaagagtgacttcgcacagctcggt

SEQ ID NO: 12014 - DNA, 25 bp, Mus musculus
aaagagtgacttggcacagctcggt

SEQ ID NO: 12015 - DNA, 25 bp, Mus musculus
aaagagtgataccagtaagcattct

SEQ ID NO: 12016 - DNA, 25 bp, Mus musculus
aaagagtgatacgagtaagcattct

SEQ ID NO: 12017 - DNA, 25 bp, Mus musculus
aaagagtgcctcaatcagctggcca

SEQ ID NO: 12018 - DNA, 25 bp, Mus musculus
aaagagtgcctctatcagctggcca

SEQ ID NO: 12019 - DNA, 25 bp, Mus musculus
aaagagtgctctattgatgtttcca

SEQ ID NO: 12020 - DNA, 25 bp, Mus musculus
aaagagtgctcttttgatgtttcca

SEQ ID NO: 12021 - DNA, 25 bp, Mus musculus
aaagagtgctgcctttatggctcct

SEQ ID NO: 12022 - DNA, 25 bp, Mus musculus
aaagagtgctgcgtttatggctcct

SEQ ID NO: 12023 - DNA, 25 bp, Mus musculus
aaagagtgcttgctgtttattgtta

SEQ ID NO: 12024 - DNA, 25 bp, Mus musculus
aaagagtgcttggtgtttattgtta

SEQ ID NO: 12025 - DNA, 25 bp, Mus musculus
aaagagtggacaccctgtcttccct

SEQ ID NO: 12026 - DNA, 25 bp, Mus musculus
aaagagtggacagcctgtcttccct

SEQ ID NO: 12027 - DNA, 25 bp, Mus musculus
aaagagtggactagaggttcatgat

SEQ ID NO: 12028 - DNA, 25 bp, Mus musculus
aaagagtggacttgaggttcatgat

SEQ ID NO: 12029 - DNA, 25 bp, Mus musculus
aaagagtggatacagtgtgcacacg

SEQ ID NO: 12030 - DNA, 25 bp, Mus musculus
aaagagtggatagagtgtgcacacg

SEQ ID NO: 12031 - DNA, 25 bp, Mus musculus
aaagagtggcatcaaagcctgcccc

SEQ ID NO: 12032 - DNA, 25 bp, Mus musculus
aaagagtggcatgaaagcctgcccc

SEQ ID NO: 12033 - DNA, 25 bp, Mus musculus
aaagagtggtccctagcttctattt

SEQ ID NO: 12034 - DNA, 25 bp, Mus musculus
aaagagtggtccgtagcttctattt

SEQ ID NO: 12035 - DNA, 25 bp, Mus musculus
aaagagtggtgcagcatgcgtgcct

SEQ ID NO: 12036 - DNA, 25 bp, Mus musculus
aaagagtggtgcatgccaaccttgc

SEQ ID NO: 12037 - DNA, 25 bp, Mus musculus
aaagagtggtgctgcatgcgtgcct

SEQ ID NO: 12038 - DNA, 25 bp, Mus musculus
aaagagtggtgcttgccaaccttgc

SEQ ID NO: 12039 - DNA, 25 bp, Mus musculus
aaagagtggttcactgcaaacatca

SEQ ID NO: 12040 - DNA, 25 bp, Mus musculus
aaagagtggttctctgcaaacatca

SEQ ID NO: 12041 - DNA, 25 bp, Mus musculus
aaagagtgtatgagcctcgctttct

SEQ ID NO: 12042 - DNA, 25 bp, Mus musculus
aaagagtgtatgtgcctcgctttct

SEQ ID NO: 12043 - DNA, 25 bp, Mus musculus
aaagagtgtcacacctggctgtctc

SEQ ID NO: 12044 - DNA, 25 bp, Mus musculus
aaagagtgtcactcctggctgtctc

SEQ ID NO: 12045 - DNA, 25 bp, Mus musculus
aaagagtgtggcaccacgtgttcac

SEQ ID NO: 12046 - DNA, 25 bp, Mus musculus
aaagagtgtggctccacgtgttcac

SEQ ID NO: 12047 - DNA, 25 bp, Mus musculus
aaagagtgtttcctagcctgagcta

SEQ ID NO: 12048 - DNA, 25 bp, Mus musculus
aaagagtgtttcgtagcctgagcta

SEQ ID NO: 12049 - DNA, 25 bp, Mus musculus
aaagagttaaggatgttcaccatga

SEQ ID NO: 12050 - DNA, 25 bp, Mus musculus
aaagagttaaggttgttcaccatga

SEQ ID NO: 12051 - DNA, 25 bp, Mus musculus
aaagagttacttatctccctccatg

SEQ ID NO: 12052 - DNA, 25 bp, Mus musculus
aaagagttacttttctccctccatg

SEQ ID NO: 12053 - DNA, 25 bp, Mus musculus
aaagagttcataattctggccattt

SEQ ID NO: 12054 - DNA, 25 bp, Mus musculus
aaagagttcatatttctggccattt

SEQ ID NO: 12055 - DNA, 25 bp, Mus musculus
aaagagttcatccaccatagtacat

SEQ ID NO: 12056 - DNA, 25 bp, Mus musculus
aaagagttcatcgaccatagtacat

SEQ ID NO: 12057 - DNA, 25 bp, Mus musculus
aaagagttccagacaagccaggcct

SEQ ID NO: 12058 - DNA, 25 bp, Mus musculus
aaagagttccagtcaagccaggcct

SEQ ID NO: 12059 - DNA, 25 bp, Mus musculus
aaagagttccgcacttgcctgagag

SEQ ID NO: 12060 - DNA, 25 bp, Mus musculus
aaagagttccgctcttgcctgagag

SEQ ID NO: 12061 - DNA, 25 bp, Mus musculus
aaagagttctggacgctttcctgga

SEQ ID NO: 12062 - DNA, 25 bp, Mus musculus
aaagagttctggtcgctttcctgga

SEQ ID NO: 12063 - DNA, 25 bp, Mus musculus
aaagagttgaccacgctcctggaat

SEQ ID NO: 12064 - DNA, 25 bp, Mus musculus
aaagagttgacctcgctcctggaat

SEQ ID NO: 12065 - DNA, 25 bp, Mus musculus
aaagagttgataagctcctgggcag

SEQ ID NO: 12066 - DNA, 25 bp, Mus musculus
aaagagttgatatgctcctgggcag

SEQ ID NO: 12067 - DNA, 25 bp, Mus musculus
aaagagttgctgcaaatgccctgtt

SEQ ID NO: 12068 - DNA, 25 bp, Mus musculus
aaagagttgctggaaatgccctgtt

SEQ ID NO: 12069 - DNA, 25 bp, Mus musculus
aaagagttggtaactcttccttctc

SEQ ID NO: 12070 - DNA, 25 bp, Mus musculus
aaagagttggtatctcttccttctc

SEQ ID NO: 12071 - DNA, 25 bp, Mus musculus
aaagagtttcttctgacttaagcaa

SEQ ID NO: 12072 - DNA, 25 bp, Mus musculus
aaagagtttcttgtgacttaagcaa

SEQ ID NO: 12073 - DNA, 25 bp, Mus musculus
aaagagtttggtcagacctccacac

SEQ ID NO: 12074 - DNA, 25 bp, Mus musculus
aaagagtttggtgagacctccacac

SEQ ID NO: 12075 - DNA, 25 bp, Mus musculus
aaagataaaacaatgcaacctgcag

SEQ ID NO: 12076 - DNA, 25 bp, Mus musculus
aaagataaaacattgcaacctgcag

SEQ ID NO: 12077 - DNA, 25 bp, Mus musculus
aaagataaagacacagcatgtactc

SEQ ID NO: 12078 - DNA, 25 bp, Mus musculus
aaagataaagactcagcatgtactc

SEQ ID NO: 12079 - DNA, 25 bp, Mus musculus
aaagataagactcctaccgtagcat

SEQ ID NO: 12080 - DNA, 25 bp, Mus musculus
aaagataagactgctaccgtagcat

SEQ ID NO: 12081 - DNA, 25 bp, Mus musculus
aaagataagctaagcccagagacca

SEQ ID NO: 12082 - DNA, 25 bp, Mus musculus
aaagataagctatgcccagagacca

SEQ ID NO: 12083 - DNA, 25 bp, Mus musculus
aaagataaggaaagcatcatgggtc

SEQ ID NO: 12084 - DNA, 25 bp, Mus musculus
aaagataaggaatgcatcatgggtc

SEQ ID NO: 12085 - DNA, 25 bp, Mus musculus
aaagataatccgatctgtgagttta

SEQ ID NO: 12086 - DNA, 25 bp, Mus musculus
aaagataatccgttctgtgagttta

SEQ ID NO: 12087 - DNA, 25 bp, Mus musculus
aaagataatcctctcttacttccat

SEQ ID NO: 12088 - DNA, 25 bp, Mus musculus
aaagataatcctgtcttacttccat

SEQ ID NO: 12089 - DNA, 25 bp, Mus musculus
aaagatacagttccccttttttctg

SEQ ID NO: 12090 - DNA, 25 bp, Mus musculus
aaagatacagttgcccttttttctg

SEQ ID NO: 12091 - DNA, 25 bp, Mus musculus
aaagataccactcccgatgaaccaa

SEQ ID NO: 12092 - DNA, 25 bp, Mus musculus
aaagataccactgccgatgaaccaa

SEQ ID NO: 12093 - DNA, 25 bp, Mus musculus
aaagatacccccattctgagggctg

SEQ ID NO: 12094 - DNA, 25 bp, Mus musculus
aaagataccccctttctgagggctg

SEQ ID NO: 12095 - DNA, 25 bp, Mus musculus
aaagataccccgagcttacagatcc

SEQ ID NO: 12096 - DNA, 25 bp, Mus musculus
aaagataccccgtgcttacagatcc

SEQ ID NO: 12097 - DNA, 25 bp, Mus musculus
aaagatacgctgctgtgaagatcca

SEQ ID NO: 12098 - DNA, 25 bp, Mus musculus
aaagatacgctggtgtgaagatcca

SEQ ID NO: 12099 - DNA, 25 bp, Mus musculus
aaagatactccgatgtctcccatta

SEQ ID NO: 12100 - DNA, 25 bp, Mus musculus
aaagatactccgttgtctcccatta

SEQ ID NO: 12101 - DNA, 25 bp, Mus musculus
aaagatactctgagcgttattttgc

SEQ ID NO: 12102 - DNA, 25 bp, Mus musculus
aaagatactctgtgcgttattttgc

SEQ ID NO: 12103 - DNA, 25 bp, Mus musculus
aaagatacttgcaacctggctggac

SEQ ID NO: 12104 - DNA, 25 bp, Mus musculus
aaagatacttgctacctggctggac

SEQ ID NO: 12105 - DNA, 25 bp, Mus musculus
aaagatagaaaccagccctgccaca

SEQ ID NO: 12106 - DNA, 25 bp, Mus musculus
aaagatagaaacgagccctgccaca

SEQ ID NO: 12107 - DNA, 25 bp, Mus musculus
aaagatagcctgagttttgttgttg

SEQ ID NO: 12108 - DNA, 25 bp, Mus musculus
aaagatagcctgtgttttgttgttg

SEQ ID NO: 12109 - DNA, 25 bp, Mus musculus
aaagatagcgttaccagtgtgacct

SEQ ID NO: 12110 - DNA, 25 bp, Mus musculus
aaagatagcgtttccagtgtgacct

SEQ ID NO: 12111 - DNA, 25 bp, Mus musculus
aaagatagctcaagcattgacggga

SEQ ID NO: 12112 - DNA, 25 bp, Mus musculus
aaagatagctcatgcattgacggga

SEQ ID NO: 12113 - DNA, 25 bp, Mus musculus
aaagatagctggatatgcctccttc

SEQ ID NO: 12114 - DNA, 25 bp, Mus musculus
aaagatagctggttatgcctccttc

SEQ ID NO: 12115 - DNA, 25 bp, Mus musculus
aaagatagttcgctgcgtgagcatc

SEQ ID NO: 12116 - DNA, 25 bp, Mus musculus
aaagatagttcggtgcgtgagcatc

SEQ ID NO: 12117 - DNA, 25 bp, Mus musculus
aaagatatacttcaaccaccgttgc

SEQ ID NO: 12118 - DNA, 25 bp, Mus musculus
aaagatatacttcctcccgcaagac

SEQ ID NO: 12119 - DNA, 25 bp, Mus musculus
aaagatatacttgaaccaccgttgc

SEQ ID NO: 12120 - DNA, 25 bp, Mus musculus
aaagatatacttgctcccgcaagac

SEQ ID NO: 12121 - DNA, 25 bp, Mus musculus
aaagatatagttagtcctctcccct

SEQ ID NO: 12122 - DNA, 25 bp, Mus musculus
aaagatatagtttgtcctctcccct

SEQ ID NO: 12123 - DNA, 25 bp, Mus musculus
aaagatatccagctagcacgccgca

SEQ ID NO: 12124 - DNA, 25 bp, Mus musculus
aaagatatccaggtagcacgccgca

SEQ ID NO: 12125 - DNA, 25 bp, Mus musculus
aaagatatccatagtcacagttcag

SEQ ID NO: 12126 - DNA, 25 bp, Mus musculus
aaagatatccattgtcacagttcag

SEQ ID NO: 12127 - DNA, 25 bp, Mus musculus
aaagatatctatccatgcctgaagc

SEQ ID NO: 12128 - DNA, 25 bp, Mus musculus
aaagatatctatgcatgcctgaagc

SEQ ID NO: 12129 - DNA, 25 bp, Mus musculus
aaagatatgcttatccatcctaaat

SEQ ID NO: 12130 - DNA, 25 bp, Mus musculus
aaagatatgcttttccatcctaaat

SEQ ID NO: 12131 - DNA, 25 bp, Mus musculus
aaagatattcaacaagtctccagtt

SEQ ID NO: 12132 - DNA, 25 bp, Mus musculus
aaagatattcaagaagtctccagtt

SEQ ID NO: 12133 - DNA, 25 bp, Mus musculus
aaagatattccacattgcccgtgtg

SEQ ID NO: 12134 - DNA, 25 bp, Mus musculus
aaagatattccagattgcccgtgtg

SEQ ID NO: 12135 - DNA, 25 bp, Mus musculus
aaagatattggccaacctgctcacc

SEQ ID NO: 12136 - DNA, 25 bp, Mus musculus
aaagatattggcgaacctgctcacc

SEQ ID NO: 12137 - DNA, 25 bp, Mus musculus
aaagatcaacgcagtccggaacggg

SEQ ID NO: 12138 - DNA, 25 bp, Mus musculus
aaagatcaacgctgtccggaacggg

SEQ ID NO: 12139 - DNA, 25 bp, Mus musculus
aaagatcaatgaccacagggccgtg

SEQ ID NO: 12140 - DNA, 25 bp, Mus musculus
aaagatcaatgagcacagggccgtg

SEQ ID NO: 12141 - DNA, 25 bp, Mus musculus
aaagatcacgggaaggccatgggca

SEQ ID NO: 12142 - DNA, 25 bp, Mus musculus
aaagatcacgggtaggccatgggca

SEQ ID NO: 12143 - DNA, 25 bp, Mus musculus
aaagatcaggaaaccaggccagggt

SEQ ID NO: 12144 - DNA, 25 bp, Mus musculus
aaagatcaggaatccaggccagggt

SEQ ID NO: 12145 - DNA, 25 bp, Mus musculus
aaagatcatattcgtcagagtcaaa

SEQ ID NO: 12146 - DNA, 25 bp, Mus musculus
aaagatcatattggtcagagtcaaa

SEQ ID NO: 12147 - DNA, 25 bp, Mus musculus
aaagatcatgacaccatccataaga

SEQ ID NO: 12148 - DNA, 25 bp, Mus musculus
aaagatcatgactccatccataaga

SEQ ID NO: 12149 - DNA, 25 bp, Mus musculus
aaagatcattcaatcagccttggga

SEQ ID NO: 12150 - DNA, 25 bp, Mus musculus
aaagatcattcattcagccttggga

SEQ ID NO: 12151 - DNA, 25 bp, Mus musculus
aaagatccacagagggtaccctgct

SEQ ID NO: 12152 - DNA, 25 bp, Mus musculus
aaagatccacagtgggtaccctgct

SEQ ID NO: 12153 - DNA, 25 bp, Mus musculus
aaagatcccagactgggccagtgca

SEQ ID NO: 12154 - DNA, 25 bp, Mus musculus
aaagatcccagagtgggccagtgca

SEQ ID NO: 12155 - DNA, 25 bp, Mus musculus
aaagatccccaacaggaatctcaag

SEQ ID NO: 12156 - DNA, 25 bp, Mus musculus
aaagatccccaagaggaatctcaag

SEQ ID NO: 12157 - DNA, 25 bp, Mus musculus
aaagatccccatcccagcagtagat

SEQ ID NO: 12158 - DNA, 25 bp, Mus musculus
aaagatccccatgccagcagtagat

SEQ ID NO: 12159 - DNA, 25 bp, Mus musculus
aaagatccccttcaaagctatgaaa

SEQ ID NO: 12160 - DNA, 25 bp, Mus musculus
aaagatccccttgaaagctatgaaa

SEQ ID NO: 12161 - DNA, 25 bp, Mus musculus
aaagatcccggacaagcagttagat

SEQ ID NO: 12162 - DNA, 25 bp, Mus musculus
aaagatcccggagaagcagttagat

SEQ ID NO: 12163 - DNA, 25 bp, Mus musculus
aaagatccctttcctaagcgacaag

SEQ ID NO: 12164 - DNA, 25 bp, Mus musculus
aaagatccctttgctaagcgacaag

SEQ ID NO: 12165 - DNA, 25 bp, Mus musculus
aaagatccgcggacagtcttcgaat

SEQ ID NO: 12166 - DNA, 25 bp, Mus musculus
aaagatccgcggtcagtcttcgaat

SEQ ID NO: 12167 - DNA, 25 bp, Mus musculus
aaagatccgcttcgagctgggtgcc

SEQ ID NO: 12168 - DNA, 25 bp, Mus musculus
aaagatccgcttggagctgggtgcc

SEQ ID NO: 12169 - DNA, 25 bp, Mus musculus
aaagatccgtcaaggtacttgtcct

SEQ ID NO: 12170 - DNA, 25 bp, Mus musculus
aaagatccgtcatggtacttgtcct

SEQ ID NO: 12171 - DNA, 25 bp, Mus musculus
aaagatcctagaactttcgagggtg

SEQ ID NO: 12172 - DNA, 25 bp, Mus musculus
aaagatcctagatctttcgagggtg

SEQ ID NO: 12173 - DNA, 25 bp, Mus musculus
aaagatcctcagacttgatataacg

SEQ ID NO: 12174 - DNA, 25 bp, Mus musculus
aaagatcctcagcttaaaggtccag

SEQ ID NO: 12175 - DNA, 25 bp, Mus musculus
aaagatcctcaggttaaaggtccag

SEQ ID NO: 12176 - DNA, 25 bp, Mus musculus
aaagatcctcagtcttgatataacg

SEQ ID NO: 12177 - DNA, 25 bp, Mus musculus
aaagatcctctcagctggatgctct

SEQ ID NO: 12178 - DNA, 25 bp, Mus musculus
aaagatcctctctgctggatgctct

SEQ ID NO: 12179 - DNA, 25 bp, Mus musculus
aaagatcctgcacgtgttgagcgat

SEQ ID NO: 12180 - DNA, 25 bp, Mus musculus
aaagatcctgcaggtgttgagcgat

SEQ ID NO: 12181 - DNA, 25 bp, Mus musculus
aaagatcctggcactgtttaactgt

SEQ ID NO: 12182 - DNA, 25 bp, Mus musculus
aaagatcctggctctgtttaactgt

SEQ ID NO: 12183 - DNA, 25 bp, Mus musculus
aaagatcctgtcctctctaccattt

SEQ ID NO: 12184 - DNA, 25 bp, Mus musculus
aaagatcctgtcgtctctaccattt

SEQ ID NO: 12185 - DNA, 25 bp, Mus musculus
aaagatccttgcctgtcccagatac

SEQ ID NO: 12186 - DNA, 25 bp, Mus musculus
aaagatccttgcgtgtcccagatac

SEQ ID NO: 12187 - DNA, 25 bp, Mus musculus
aaagatccttgtactgtgctcttca

SEQ ID NO: 12188 - DNA, 25 bp, Mus musculus
aaagatccttgttctgtgctcttca

SEQ ID NO: 12189 - DNA, 25 bp, Mus musculus
aaagatcgctgtattgtgtactggc

SEQ ID NO: 12190 - DNA, 25 bp, Mus musculus
aaagatcgctgttttgtgtactggc

SEQ ID NO: 12191 - DNA, 25 bp, Mus musculus
aaagatcgtcctacgggtcaactag

SEQ ID NO: 12192 - DNA, 25 bp, Mus musculus
aaagatcgtccttcgggtcaactag

SEQ ID NO: 12193 - DNA, 25 bp, Mus musculus
aaagatcgttctaggatagtcaaag

SEQ ID NO: 12194 - DNA, 25 bp, Mus musculus
aaagatcgttcttggatagtcaaag

SEQ ID NO: 12195 - DNA, 25 bp, Mus musculus
aaagatctagctaccctatttgatt

SEQ ID NO: 12196 - DNA, 25 bp, Mus musculus
aaagatctagcttccctatttgatt

SEQ ID NO: 12197 - DNA, 25 bp, Mus musculus
aaagatctatccatatcatttgtca

SEQ ID NO: 12198 - DNA, 25 bp, Mus musculus
aaagatctatccttatcatttgtca

SEQ ID NO: 12199 - DNA, 25 bp, Mus musculus
aaagatctatttctgctgagggaac

SEQ ID NO: 12200 - DNA, 25 bp, Mus musculus
aaagatctatttgtgctgagggaac

SEQ ID NO: 12201 - DNA, 25 bp, Mus musculus
aaagatctcaagatttgccacatct

SEQ ID NO: 12202 - DNA, 25 bp, Mus musculus
aaagatctcaagttttgccacatct

SEQ ID NO: 12203 - DNA, 25 bp, Mus musculus
aaagatctcaccactacatgtctgt

SEQ ID NO: 12204 - DNA, 25 bp, Mus musculus
aaagatctcacctctacatgtctgt

SEQ ID NO: 12205 - DNA, 25 bp, Mus musculus
aaagatctcagcaataggccccaga

SEQ ID NO: 12206 - DNA, 25 bp, Mus musculus
aaagatctcagcacttcttggttcc

SEQ ID NO: 12207 - DNA, 25 bp, Mus musculus
aaagatctcagctataggccccaga

SEQ ID NO: 12208 - DNA, 25 bp, Mus musculus
aaagatctcagctcttcttggttcc

SEQ ID NO: 12209 - DNA, 25 bp, Mus musculus
aaagatctccaaatagcacacgccc

SEQ ID NO: 12210 - DNA, 25 bp, Mus musculus
aaagatctccaactattacctgata

SEQ ID NO: 12211 - DNA, 25 bp, Mus musculus
aaagatctccaagtattacctgata

SEQ ID NO: 12212 - DNA, 25 bp, Mus musculus
aaagatctccaattagcacacgccc

SEQ ID NO: 12213 - DNA, 25 bp, Mus musculus
aaagatctctgtcgaccacgtcact

SEQ ID NO: 12214 - DNA, 25 bp, Mus musculus
aaagatctctgtggaccacgtcact

SEQ ID NO: 12215 - DNA, 25 bp, Mus musculus
aaagatctcttcattatcatgcaaa

SEQ ID NO: 12216 - DNA, 25 bp, Mus musculus
aaagatctcttctttatcatgcaaa

SEQ ID NO: 12217 - DNA, 25 bp, Mus musculus
aaagatctgaaaatgctgctcctgt

SEQ ID NO: 12218 - DNA, 25 bp, Mus musculus
aaagatctgaaattgctgctcctgt

SEQ ID NO: 12219 - DNA, 25 bp, Mus musculus
aaagatctgaatcccagggctcagt

SEQ ID NO: 12220 - DNA, 25 bp, Mus musculus
aaagatctgaatgccagggctcagt

SEQ ID NO: 12221 - DNA, 25 bp, Mus musculus
aaagatctgatgaagcctctggccc

SEQ ID NO: 12222 - DNA, 25 bp, Mus musculus
aaagatctgatgtagcctctggccc

SEQ ID NO: 12223 - DNA, 25 bp, Mus musculus
aaagatctgcaaaggtgacgctgag

SEQ ID NO: 12224 - DNA, 25 bp, Mus musculus
aaagatctgcaatggtgacgctgag

SEQ ID NO: 12225 - DNA, 25 bp, Mus musculus
aaagatctgcctcgagtcagtgttc

SEQ ID NO: 12226 - DNA, 25 bp, Mus musculus
aaagatctgcctggagtcagtgttc

SEQ ID NO: 12227 - DNA, 25 bp, Mus musculus
aaagatctggttccagctagcatta

SEQ ID NO: 12228 - DNA, 25 bp, Mus musculus
aaagatctggttgcagctagcatta

SEQ ID NO: 12229 - DNA, 25 bp, Mus musculus
aaagatctgtccaaggaccccaatt

SEQ ID NO: 12230 - DNA, 25 bp, Mus musculus
aaagatctgtcctaggaccccaatt

SEQ ID NO: 12231 - DNA, 25 bp, Mus musculus
aaagatcttcacattttgctcatct

SEQ ID NO: 12232 - DNA, 25 bp, Mus musculus
aaagatcttcactttttgctcatct

SEQ ID NO: 12233 - DNA, 25 bp, Mus musculus
aaagatcttcatcagtttgcactgc

SEQ ID NO: 12234 - DNA, 25 bp, Mus musculus
aaagatcttcatgagtttgcactgc

SEQ ID NO: 12235 - DNA, 25 bp, Mus musculus
aaagatcttgaaagctttggagatt

SEQ ID NO: 12236 - DNA, 25 bp, Mus musculus
aaagatcttgaatgctttggagatt

SEQ ID NO: 12237 - DNA, 25 bp, Mus musculus
aaagatcttgctcctcaaaattccc

SEQ ID NO: 12238 - DNA, 25 bp, Mus musculus
aaagatcttgctgctcaaaattccc

SEQ ID NO: 12239 - DNA, 25 bp, Mus musculus
aaagatctttccctacttgacgtgt

SEQ ID NO: 12240 - DNA, 25 bp, Mus musculus
aaagatctttccgtacttgacgtgt

SEQ ID NO: 12241 - DNA, 25 bp, Mus musculus
aaagatcttttcacgctttggactg

SEQ ID NO: 12242 - DNA, 25 bp, Mus musculus
aaagatcttttctcgctttggactg

SEQ ID NO: 12243 - DNA, 25 bp, Mus musculus
aaagatgacagcagctggcctctca

SEQ ID NO: 12244 - DNA, 25 bp, Mus musculus
aaagatgacagctgctggcctctca

SEQ ID NO: 12245 - DNA, 25 bp, Mus musculus
aaagatgacagtaggaaagacggct

SEQ ID NO: 12246 - DNA, 25 bp, Mus musculus
aaagatgacagtcgcattcgctacc

SEQ ID NO: 12247 - DNA, 25 bp, Mus musculus
aaagatgacagtggcattcgctacc

SEQ ID NO: 12248 - DNA, 25 bp, Mus musculus
aaagatgacagttggaaagacggct

SEQ ID NO: 12249 - DNA, 25 bp, Mus musculus
aaagatgacccaagcctctttcctg

SEQ ID NO: 12250 - DNA, 25 bp, Mus musculus
aaagatgacccatgcctctttcctg

SEQ ID NO: 12251 - DNA, 25 bp, Mus musculus
aaagatgaccctcaaacactggaaa

SEQ ID NO: 12252 - DNA, 25 bp, Mus musculus
aaagatgaccctgaaacactggaaa

SEQ ID NO: 12253 - DNA, 25 bp, Mus musculus
aaagatgaccttagcttgtgcatat

SEQ ID NO: 12254 - DNA, 25 bp, Mus musculus
aaagatgacctttgcttgtgcatat

SEQ ID NO: 12255 - DNA, 25 bp, Mus musculus
aaagatgacgcactttctcttgtcc

SEQ ID NO: 12256 - DNA, 25 bp, Mus musculus
aaagatgacgcagtttctcttgtcc

SEQ ID NO: 12257 - DNA, 25 bp, Mus musculus
aaagatgacggtactctgggcgctt

SEQ ID NO: 12258 - DNA, 25 bp, Mus musculus
aaagatgacggttctctgggcgctt

SEQ ID NO: 12259 - DNA, 25 bp, Mus musculus
aaagatgactacactactctcctgg

SEQ ID NO: 12260 - DNA, 25 bp, Mus musculus
aaagatgactactctactctcctgg

SEQ ID NO: 12261 - DNA, 25 bp, Mus musculus
aaagatgactgtctcctttgccctg

SEQ ID NO: 12262 - DNA, 25 bp, Mus musculus
aaagatgactgtgtcctttgccctg

SEQ ID NO: 12263 - DNA, 25 bp, Mus musculus
aaagatgagagccaggctcccactg

SEQ ID NO: 12264 - DNA, 25 bp, Mus musculus
aaagatgagagcgaggctcccactg

SEQ ID NO: 12265 - DNA, 25 bp, Mus musculus
aaagatgagcttcagtcattaggag

SEQ ID NO: 12266 - DNA, 25 bp, Mus musculus
aaagatgagcttgagtcattaggag

SEQ ID NO: 12267 - DNA, 25 bp, Mus musculus
aaagatgaggcccatcggccatgat

SEQ ID NO: 12268 - DNA, 25 bp, Mus musculus
aaagatgaggccgatcggccatgat

SEQ ID NO: 12269 - DNA, 25 bp, Mus musculus
aaagatgatacaagaggaccaggaa

SEQ ID NO: 12270 - DNA, 25 bp, Mus musculus
aaagatgatacatgaggaccaggaa

SEQ ID NO: 12271 - DNA, 25 bp, Mus musculus
aaagatgattgaacggcccggccgg

SEQ ID NO: 12272 - DNA, 25 bp, Mus musculus
aaagatgattgatcggcccggccgg

SEQ ID NO: 12273 - DNA, 25 bp, Mus musculus
aaagatgcaatcaactttcttcatt

SEQ ID NO: 12274 - DNA, 25 bp, Mus musculus
aaagatgcaatctactttcttcatt

SEQ ID NO: 12275 - DNA, 25 bp, Mus musculus
aaagatgcacagacagactctgcta

SEQ ID NO: 12276 - DNA, 25 bp, Mus musculus
aaagatgcacagtcagactctgcta

SEQ ID NO: 12277 - DNA, 25 bp, Mus musculus
aaagatgcacataacttgtcattgt

SEQ ID NO: 12278 - DNA, 25 bp, Mus musculus
aaagatgcacattacttgtcattgt

SEQ ID NO: 12279 - DNA, 25 bp, Mus musculus
aaagatgcaccaaacccgacagaaa

SEQ ID NO: 12280 - DNA, 25 bp, Mus musculus
aaagatgcaccatacccgacagaaa

SEQ ID NO: 12281 - DNA, 25 bp, Mus musculus
aaagatgcactccagccaagatttc

SEQ ID NO: 12282 - DNA, 25 bp, Mus musculus
aaagatgcactcgagccaagatttc

SEQ ID NO: 12283 - DNA, 25 bp, Mus musculus
aaagatgcagaaccagagcctcttg

SEQ ID NO: 12284 - DNA, 25 bp, Mus musculus
aaagatgcagaagcagagcctcttg

SEQ ID NO: 12285 - DNA, 25 bp, Mus musculus
aaagatgcagcccacatgctacagg

SEQ ID NO: 12286 - DNA, 25 bp, Mus musculus
aaagatgcagccgacatgctacagg

SEQ ID NO: 12287 - DNA, 25 bp, Mus musculus
aaagatgcagtaacctctcctggaa

SEQ ID NO: 12288 - DNA, 25 bp, Mus musculus
aaagatgcagtatcctctcctggaa

SEQ ID NO: 12289 - DNA, 25 bp, Mus musculus
aaagatgccagaccgtgggacccac

SEQ ID NO: 12290 - DNA, 25 bp, Mus musculus
aaagatgccagagcgtgggacccac

SEQ ID NO: 12291 - DNA, 25 bp, Mus musculus
aaagatgcccatcattgtgaatgtt

SEQ ID NO: 12292 - DNA, 25 bp, Mus musculus
aaagatgcccatgattgtgaatgtt

SEQ ID NO: 12293 - DNA, 25 bp, Mus musculus
aaagatgcctgacacagccacatgc

SEQ ID NO: 12294 - DNA, 25 bp, Mus musculus
aaagatgcctgagacagccacatgc

SEQ ID NO: 12295 - DNA, 25 bp, Mus musculus
aaagatgcctgcctttgctatcacg

SEQ ID NO: 12296 - DNA, 25 bp, Mus musculus
aaagatgcctgcgtttgctatcacg

SEQ ID NO: 12297 - DNA, 25 bp, Mus musculus
aaagatgcctggatgtacctctgtg

SEQ ID NO: 12298 - DNA, 25 bp, Mus musculus
aaagatgcctggttgtacctctgtg

SEQ ID NO: 12299 - DNA, 25 bp, Mus musculus
aaagatgccttccaagagcctagac

SEQ ID NO: 12300 - DNA, 25 bp, Mus musculus
aaagatgccttcgaagagcctagac

SEQ ID NO: 12301 - DNA, 25 bp, Mus musculus
aaagatgcgctgagtctctctggtt

SEQ ID NO: 12302 - DNA, 25 bp, Mus musculus
aaagatgcgctgtgtctctctggtt

SEQ ID NO: 12303 - DNA, 25 bp, Mus musculus
aaagatgcggaactcgtcgcgcgaa

SEQ ID NO: 12304 - DNA, 25 bp, Mus musculus
aaagatgcggaagtcgtcgcgcgaa

SEQ ID NO: 12305 - DNA, 25 bp, Mus musculus
aaagatgcggacagtttcactatac

SEQ ID NO: 12306 - DNA, 25 bp, Mus musculus
aaagatgcggactgtttcactatac

SEQ ID NO: 12307 - DNA, 25 bp, Mus musculus
aaagatgctaacagccaggcatagt

SEQ ID NO: 12308 - DNA, 25 bp, Mus musculus
aaagatgctaactgccaggcatagt

SEQ ID NO: 12309 - DNA, 25 bp, Mus musculus
aaagatgctactcggcttcctgtgc

SEQ ID NO: 12310 - DNA, 25 bp, Mus musculus
aaagatgctactgggcttcctgtgc

SEQ ID NO: 12311 - DNA, 25 bp, Mus musculus
aaagatgctaggcaaccccagccgg

SEQ ID NO: 12312 - DNA, 25 bp, Mus musculus
aaagatgctagggaaccccagccgg

SEQ ID NO: 12313 - DNA, 25 bp, Mus musculus
aaagatgctcacaggatctggagac

SEQ ID NO: 12314 - DNA, 25 bp, Mus musculus
aaagatgctcactggatctggagac

SEQ ID NO: 12315 - DNA, 25 bp, Mus musculus
aaagatgctccaaagtagccctccc

SEQ ID NO: 12316 - DNA, 25 bp, Mus musculus
aaagatgctccatagtagccctccc

SEQ ID NO: 12317 - DNA, 25 bp, Mus musculus
aaagatgctcctatgcagaccattc

SEQ ID NO: 12318 - DNA, 25 bp, Mus musculus
aaagatgctcctttgcagaccattc

SEQ ID NO: 12319 - DNA, 25 bp, Mus musculus
aaagatgctgagagcctgatgcctt

SEQ ID NO: 12320 - DNA, 25 bp, Mus musculus
aaagatgctgagtgcctgatgcctt

SEQ ID NO: 12321 - DNA, 25 bp, Mus musculus
aaagatgctgccaccgctgagattt

SEQ ID NO: 12322 - DNA, 25 bp, Mus musculus
aaagatgctgcctccgctgagattt

SEQ ID NO: 12323 - DNA, 25 bp, Mus musculus
aaagatgctgtcctcacattgttgc

SEQ ID NO: 12324 - DNA, 25 bp, Mus musculus
aaagatgctgtcgtcacattgttgc

SEQ ID NO: 12325 - DNA, 25 bp, Mus musculus
aaagatgctgttacataggttggaa

SEQ ID NO: 12326 - DNA, 25 bp, Mus musculus
aaagatgctgtttcataggttggaa

SEQ ID NO: 12327 - DNA, 25 bp, Mus musculus
aaagatgcttgcatgcacttgcata

SEQ ID NO: 12328 - DNA, 25 bp, Mus musculus
aaagatgcttgcctgtttcatacag

SEQ ID NO: 12329 - DNA, 25 bp, Mus musculus
aaagatgcttgcgtgtttcatacag

SEQ ID NO: 12330 - DNA, 25 bp, Mus musculus
aaagatgcttgcttgcacttgcata

SEQ ID NO: 12331 - DNA, 25 bp, Mus musculus
aaagatgctttcaagtcacaaattg

SEQ ID NO: 12332 - DNA, 25 bp, Mus musculus
aaagatgctttctagtcacaaattg

SEQ ID NO: 12333 - DNA, 25 bp, Mus musculus
aaagatggaattctagctctcttct

SEQ ID NO: 12334 - DNA, 25 bp, Mus musculus
aaagatggaattgtagctctcttct

SEQ ID NO: 12335 - DNA, 25 bp, Mus musculus
aaagatggacaaaggctcccaagcc

SEQ ID NO: 12336 - DNA, 25 bp, Mus musculus
aaagatggacaatggctcccaagcc

SEQ ID NO: 12337 - DNA, 25 bp, Mus musculus
aaagatggactgctaggcatggcca

SEQ ID NO: 12338 - DNA, 25 bp, Mus musculus
aaagatggactggtaggcatggcca

SEQ ID NO: 12339 - DNA, 25 bp, Mus musculus
aaagatggagagatgcagctaagct

SEQ ID NO: 12340 - DNA, 25 bp, Mus musculus
aaagatggagagttgcagctaagct

SEQ ID NO: 12341 - DNA, 25 bp, Mus musculus
aaagatggaggcagcctgacttttc

SEQ ID NO: 12342 - DNA, 25 bp, Mus musculus
aaagatggaggctgcctgacttttc

SEQ ID NO: 12343 - DNA, 25 bp, Mus musculus
aaagatggcagcaatggtccacata

SEQ ID NO: 12344 - DNA, 25 bp, Mus musculus
aaagatggcagctatggtccacata

SEQ ID NO: 12345 - DNA, 25 bp, Mus musculus
aaagatggcatgcagcctggtctac

SEQ ID NO: 12346 - DNA, 25 bp, Mus musculus
aaagatggcatggagcctggtctac

SEQ ID NO: 12347 - DNA, 25 bp, Mus musculus
aaagatggccacaccgggtttgcct

SEQ ID NO: 12348 - DNA, 25 bp, Mus musculus
aaagatggccactccgggtttgcct

SEQ ID NO: 12349 - DNA, 25 bp, Mus musculus
aaagatggcccactcagaatttttt

SEQ ID NO: 12350 - DNA, 25 bp, Mus musculus
aaagatggcccagtcagaatttttt

SEQ ID NO: 12351 - DNA, 25 bp, Mus musculus
aaagatggccccagtgtcagctgat

SEQ ID NO: 12352 - DNA, 25 bp, Mus musculus
aaagatggcccctgtgtcagctgat

SEQ ID NO: 12353 - DNA, 25 bp, Mus musculus
aaagatggcctacagctacttccaa

SEQ ID NO: 12354 - DNA, 25 bp, Mus musculus
aaagatggcctagagctacttccaa

SEQ ID NO: 12355 - DNA, 25 bp, Mus musculus
aaagatggcctgatgcacgtgacca

SEQ ID NO: 12356 - DNA, 25 bp, Mus musculus
aaagatggcctgttgcacgtgacca

SEQ ID NO: 12357 - DNA, 25 bp, Mus musculus
aaagatggcgccctggtttgcagcc

SEQ ID NO: 12358 - DNA, 25 bp, Mus musculus
aaagatggcgccgtggtttgcagcc

SEQ ID NO: 12359 - DNA, 25 bp, Mus musculus
aaagatggctcacagcttgcttttc

SEQ ID NO: 12360 - DNA, 25 bp, Mus musculus
aaagatggctcagagcttgcttttc

SEQ ID NO: 12361 - DNA, 25 bp, Mus musculus
aaagatggctgacccagttttagaa

SEQ ID NO: 12362 - DNA, 25 bp, Mus musculus
aaagatggctgagccagttttagaa

SEQ ID NO: 12363 - DNA, 25 bp, Mus musculus
aaagatggctgtcaccacagtgcca

SEQ ID NO: 12364 - DNA, 25 bp, Mus musculus
aaagatggctgtgaccacagtgcca

SEQ ID NO: 12365 - DNA, 25 bp, Mus musculus
aaagatggctttagactggcactgt

SEQ ID NO: 12366 - DNA, 25 bp, Mus musculus
aaagatggcttttgactggcactgt

SEQ ID NO: 12367 - DNA, 25 bp, Mus musculus
aaagatgggccaaaaacacatagaa

SEQ ID NO: 12368 - DNA, 25 bp, Mus musculus
aaagatgggccacatgctgcatgac

SEQ ID NO: 12369 - DNA, 25 bp, Mus musculus
aaagatgggccagatgctgcatgac

SEQ ID NO: 12370 - DNA, 25 bp, Mus musculus
aaagatgggccataaacacatagaa

SEQ ID NO: 12371 - DNA, 25 bp, Mus musculus
aaagatgggcctctacacagcaagc

SEQ ID NO: 12372 - DNA, 25 bp, Mus musculus
aaagatgggcctgtacacagcaagc

SEQ ID NO: 12373 - DNA, 25 bp, Mus musculus
aaagatgggcgactgcagctgcaat

SEQ ID NO: 12374 - DNA, 25 bp, Mus musculus
aaagatgggcgagtgcagctgcaat

SEQ ID NO: 12375 - DNA, 25 bp, Mus musculus
aaagatgggctaagactccctcatg

SEQ ID NO: 12376 - DNA, 25 bp, Mus musculus
aaagatgggctatgactccctcatg

SEQ ID NO: 12377 - DNA, 25 bp, Mus musculus
aaagatgggctgaccgtgtagatac

SEQ ID NO: 12378 - DNA, 25 bp, Mus musculus
aaagatgggctgtccgtgtagatac

SEQ ID NO: 12379 - DNA, 25 bp, Mus musculus
aaagatgggttgacatttcctgtaa

SEQ ID NO: 12380 - DNA, 25 bp, Mus musculus
aaagatgggttgtcatttcctgtaa

SEQ ID NO: 12381 - DNA, 25 bp, Mus musculus
aaagatggtcatcaacacggtcccc

SEQ ID NO: 12382 - DNA, 25 bp, Mus musculus
aaagatggtcatcctgcctgtactt

SEQ ID NO: 12383 - DNA, 25 bp, Mus musculus
aaagatggtcatgaacacggtcccc

SEQ ID NO: 12384 - DNA, 25 bp, Mus musculus
aaagatggtcatgctgcctgtactt

SEQ ID NO: 12385 - DNA, 25 bp, Mus musculus
aaagatggtctaaggcttccggaag

SEQ ID NO: 12386 - DNA, 25 bp, Mus musculus
aaagatggtctatggcttccggaag

SEQ ID NO: 12387 - DNA, 25 bp, Mus musculus
aaagatggtgagattgtttgcaaaa

SEQ ID NO: 12388 - DNA, 25 bp, Mus musculus
aaagatggtgagtttgtttgcaaaa

SEQ ID NO: 12389 - DNA, 25 bp, Mus musculus
aaagatggtgtaaccttcctgcata

SEQ ID NO: 12390 - DNA, 25 bp, Mus musculus
aaagatggtgtatccttcctgcata

SEQ ID NO: 12391 - DNA, 25 bp, Mus musculus
aaagatggtgttcccactgtggaca

SEQ ID NO: 12392 - DNA, 25 bp, Mus musculus
aaagatggtgttgccactgtggaca

SEQ ID NO: 12393 - DNA, 25 bp, Mus musculus
aaagatggttatattctgttctgta

SEQ ID NO: 12394 - DNA, 25 bp, Mus musculus
aaagatggttattttctgttctgta

SEQ ID NO: 12395 - DNA, 25 bp, Mus musculus
aaagatggttctctgctgttctagc

SEQ ID NO: 12396 - DNA, 25 bp, Mus musculus
aaagatggttctgtgctgttctagc

SEQ ID NO: 12397 - DNA, 25 bp, Mus musculus
aaagatggttgacttctcgtcccag

SEQ ID NO: 12398 - DNA, 25 bp, Mus musculus
aaagatggttgagttctcgtcccag

SEQ ID NO: 12399 - DNA, 25 bp, Mus musculus
aaagatgtagccacgatacctagtg

SEQ ID NO: 12400 - DNA, 25 bp, Mus musculus
aaagatgtagcctcgatacctagtg

SEQ ID NO: 12401 - DNA, 25 bp, Mus musculus
aaagatgtcagccactgagtgtcca

SEQ ID NO: 12402 - DNA, 25 bp, Mus musculus
aaagatgtcagcgactgagtgtcca

SEQ ID NO: 12403 - DNA, 25 bp, Mus musculus
aaagatgtcaggaggttccctcact

SEQ ID NO: 12404 - DNA, 25 bp, Mus musculus
aaagatgtcaggtggttccctcact

SEQ ID NO: 12405 - DNA, 25 bp, Mus musculus
aaagatgtcagtctcacttgcctgg

SEQ ID NO: 12406 - DNA, 25 bp, Mus musculus
aaagatgtcagtgtcacttgcctgg

SEQ ID NO: 12407 - DNA, 25 bp, Mus musculus
aaagatgtccacaacccatgtatcc

SEQ ID NO: 12408 - DNA, 25 bp, Mus musculus
aaagatgtccacattactcctacac

SEQ ID NO: 12409 - DNA, 25 bp, Mus musculus
aaagatgtccactacccatgtatcc

SEQ ID NO: 12410 - DNA, 25 bp, Mus musculus
aaagatgtccactttactcctacac

SEQ ID NO: 12411 - DNA, 25 bp, Mus musculus
aaagatgtcccgcatgaggtgtatg

SEQ ID NO: 12412 - DNA, 25 bp, Mus musculus
aaagatgtcccggatgaggtgtatg

SEQ ID NO: 12413 - DNA, 25 bp, Mus musculus
aaagatgtccggaaccctgaggccg

SEQ ID NO: 12414 - DNA, 25 bp, Mus musculus
aaagatgtccggtaccctgaggccg

SEQ ID NO: 12415 - DNA, 25 bp, Mus musculus
aaagatgtcctcagctacatgagtt

SEQ ID NO: 12416 - DNA, 25 bp, Mus musculus
aaagatgtcctctgctacatgagtt

SEQ ID NO: 12417 - DNA, 25 bp, Mus musculus
aaagatgtcgccatggcccgtgggc

SEQ ID NO: 12418 - DNA, 25 bp, Mus musculus
aaagatgtcgccttggcccgtgggc

SEQ ID NO: 12419 - DNA, 25 bp, Mus musculus
aaagatgtcgctctcaggagtctgt

SEQ ID NO: 12420 - DNA, 25 bp, Mus musculus
aaagatgtcgctgtcaggagtctgt

SEQ ID NO: 12421 - DNA, 25 bp, Mus musculus
aaagatgtcggacaccgcagtggct

SEQ ID NO: 12422 - DNA, 25 bp, Mus musculus
aaagatgtcggactgcttcctgcag

SEQ ID NO: 12423 - DNA, 25 bp, Mus musculus
aaagatgtcggagaccgcagtggct

SEQ ID NO: 12424 - DNA, 25 bp, Mus musculus
aaagatgtcggagtgcttcctgcag

SEQ ID NO: 12425 - DNA, 25 bp, Mus musculus
aaagatgtctatagggtagcacagc

SEQ ID NO: 12426 - DNA, 25 bp, Mus musculus
aaagatgtctattgggtagcacagc

SEQ ID NO: 12427 - DNA, 25 bp, Mus musculus
aaagatgtctcgagtggtactgggt

SEQ ID NO: 12428 - DNA, 25 bp, Mus musculus
aaagatgtctcgtgtggtactgggt

SEQ ID NO: 12429 - DNA, 25 bp, Mus musculus
aaagatgtctgtaattgctgccaca

SEQ ID NO: 12430 - DNA, 25 bp, Mus musculus
aaagatgtctgttattgctgccaca

SEQ ID NO: 12431 - DNA, 25 bp, Mus musculus
aaagatgtcttcagagtgcctggtc

SEQ ID NO: 12432 - DNA, 25 bp, Mus musculus
aaagatgtcttctgagtgcctggtc

SEQ ID NO: 12433 - DNA, 25 bp, Mus musculus
aaagatgtgagcacgccatgtcttc

SEQ ID NO: 12434 - DNA, 25 bp, Mus musculus
aaagatgtgagctcgccatgtcttc

SEQ ID NO: 12435 - DNA, 25 bp, Mus musculus
aaagatgtgcaccactgtgcttggc

SEQ ID NO: 12436 - DNA, 25 bp, Mus musculus
aaagatgtgcacgactgtgcttggc

SEQ ID NO: 12437 - DNA, 25 bp, Mus musculus
aaagatgtgcagacttccgggaatt

SEQ ID NO: 12438 - DNA, 25 bp, Mus musculus
aaagatgtgcagtcttccgggaatt

SEQ ID NO: 12439 - DNA, 25 bp, Mus musculus
aaagatgtgcgccactacttcctgg

SEQ ID NO: 12440 - DNA, 25 bp, Mus musculus
aaagatgtgcgcgactacttcctgg

SEQ ID NO: 12441 - DNA, 25 bp, Mus musculus
aaagatgtggcactgtatgcagcac

SEQ ID NO: 12442 - DNA, 25 bp, Mus musculus
aaagatgtggcagtgtatgcagcac

SEQ ID NO: 12443 - DNA, 25 bp, Mus musculus
aaagatgtgtggctccagcctctca

SEQ ID NO: 12444 - DNA, 25 bp, Mus musculus
aaagatgtgtgggtccagcctctca

SEQ ID NO: 12445 - DNA, 25 bp, Mus musculus
aaagatgtgtgtcctgccctggttc

SEQ ID NO: 12446 - DNA, 25 bp, Mus musculus
aaagatgtgtgtgctgccctggttc

SEQ ID NO: 12447 - DNA, 25 bp, Mus musculus
aaagatgttctgctgaactattgga

SEQ ID NO: 12448 - DNA, 25 bp, Mus musculus
aaagatgttctggtgaactattgga

SEQ ID NO: 12449 - DNA, 25 bp, Mus musculus
aaagatgttgagcactggcaccaga

SEQ ID NO: 12450 - DNA, 25 bp, Mus musculus
aaagatgttgaggactggcaccaga

SEQ ID NO: 12451 - DNA, 25 bp, Mus musculus
aaagatgttggaccttctgtggaga

SEQ ID NO: 12452 - DNA, 25 bp, Mus musculus
aaagatgttggagcttctgtggaga

SEQ ID NO: 12453 - DNA, 25 bp, Mus musculus
aaagatgtttgccttcacggagcca

SEQ ID NO: 12454 - DNA, 25 bp, Mus musculus
aaagatgtttgcgttcacggagcca

SEQ ID NO: 12455 - DNA, 25 bp, Mus musculus
aaagatgtttggacagccgtcgctc

SEQ ID NO: 12456 - DNA, 25 bp, Mus musculus
aaagatgtttggtcagccgtcgctc

SEQ ID NO: 12457 - DNA, 25 bp, Mus musculus
aaagattaagaacgacccatcaatt

SEQ ID NO: 12458 - DNA, 25 bp, Mus musculus
aaagattaagaaggacccatcaatt

SEQ ID NO: 12459 - DNA, 25 bp, Mus musculus
aaagattaatttccttccagaaaag

SEQ ID NO: 12460 - DNA, 25 bp, Mus musculus
aaagattaatttgcttccagaaaag

SEQ ID NO: 12461 - DNA, 25 bp, Mus musculus
aaagattactagagcctgctttgag

SEQ ID NO: 12462 - DNA, 25 bp, Mus musculus
aaagattactagtgcctgctttgag

SEQ ID NO: 12463 - DNA, 25 bp, Mus musculus
aaagattagatcctcttcaccaaag

SEQ ID NO: 12464 - DNA, 25 bp, Mus musculus
aaagattagatcgtcttcaccaaag

SEQ ID NO: 12465 - DNA, 25 bp, Mus musculus
aaagattagctacctctgtcctgaa

SEQ ID NO: 12466 - DNA, 25 bp, Mus musculus
aaagattagctagctctgtcctgaa

SEQ ID NO: 12467 - DNA, 25 bp, Mus musculus
aaagattatagaaagcctcaaactc

SEQ ID NO: 12468 - DNA, 25 bp, Mus musculus
aaagattatagaaaggttgccactg

SEQ ID NO: 12469 - DNA, 25 bp, Mus musculus
aaagattatagatagcctcaaactc

SEQ ID NO: 12470 - DNA, 25 bp, Mus musculus
aaagattatagataggttgccactg

SEQ ID NO: 12471 - DNA, 25 bp, Mus musculus
aaagattatgacaactagtaagtaa

SEQ ID NO: 12472 - DNA, 25 bp, Mus musculus
aaagattatgactactagtaagtaa

SEQ ID NO: 12473 - DNA, 25 bp, Mus musculus
aaagattatgccaccagctctagct

SEQ ID NO: 12474 - DNA, 25 bp, Mus musculus
aaagattatgcctccagctctagct

SEQ ID NO: 12475 - DNA, 25 bp, Mus musculus
aaagattcaaatacagctgcctggc

SEQ ID NO: 12476 - DNA, 25 bp, Mus musculus
aaagattcaaattcagctgcctggc

SEQ ID NO: 12477 - DNA, 25 bp, Mus musculus
aaagattcacccattgagtaccagg

SEQ ID NO: 12478 - DNA, 25 bp, Mus musculus
aaagattcaccctttgagtaccagg

SEQ ID NO: 12479 - DNA, 25 bp, Mus musculus
aaagattcagaaactgttagctctg

SEQ ID NO: 12480 - DNA, 25 bp, Mus musculus
aaagattcagaatctgttagctctg

SEQ ID NO: 12481 - DNA, 25 bp, Mus musculus
aaagattcaggccaattgatggatt

SEQ ID NO: 12482 - DNA, 25 bp, Mus musculus
aaagattcaggcgaattgatggatt

SEQ ID NO: 12483 - DNA, 25 bp, Mus musculus
aaagattcagtcctactacaaccct

SEQ ID NO: 12484 - DNA, 25 bp, Mus musculus
aaagattcagtcgtactacaaccct

SEQ ID NO: 12485 - DNA, 25 bp, Mus musculus
aaagattcataccttggtgggcttt

SEQ ID NO: 12486 - DNA, 25 bp, Mus musculus
aaagattcatacgttggtgggcttt

SEQ ID NO: 12487 - DNA, 25 bp, Mus musculus
aaagattcatggcacagtgtggtct

SEQ ID NO: 12488 - DNA, 25 bp, Mus musculus
aaagattcatgggacagtgtggtct

SEQ ID NO: 12489 - DNA, 25 bp, Mus musculus
aaagattcattcatgcctaccagaa

SEQ ID NO: 12490 - DNA, 25 bp, Mus musculus
aaagattcattcttgcctaccagaa

SEQ ID NO: 12491 - DNA, 25 bp, Mus musculus
aaagattccatcagcttccctgatg

SEQ ID NO: 12492 - DNA, 25 bp, Mus musculus
aaagattccatccactcagatgatt

SEQ ID NO: 12493 - DNA, 25 bp, Mus musculus
aaagattccatcgactcagatgatt

SEQ ID NO: 12494 - DNA, 25 bp, Mus musculus
aaagattccatctgcttccctgatg

SEQ ID NO: 12495 - DNA, 25 bp, Mus musculus
aaagattcccttcttgttgctgttc

SEQ ID NO: 12496 - DNA, 25 bp, Mus musculus
aaagattcccttgttgttgctgttc

SEQ ID NO: 12497 - DNA, 25 bp, Mus musculus
aaagattcctccatcggaatcctca

SEQ ID NO: 12498 - DNA, 25 bp, Mus musculus
aaagattcctccttcggaatcctca

SEQ ID NO: 12499 - DNA, 25 bp, Mus musculus
aaagattcgcacacccatagacata

SEQ ID NO: 12500 - DNA, 25 bp, Mus musculus
aaagattcgcactcccatagacata

SEQ ID NO: 12501 - DNA, 25 bp, Mus musculus
aaagattcggaaccctcggaccatt

SEQ ID NO: 12502 - DNA, 25 bp, Mus musculus
aaagattcggaagcctcggaccatt

SEQ ID NO: 12503 - DNA, 25 bp, Mus musculus
aaagattctcatatcagtcaatagg

SEQ ID NO: 12504 - DNA, 25 bp, Mus musculus
aaagattctcatttcagtcaatagg

SEQ ID NO: 12505 - DNA, 25 bp, Mus musculus
aaagattctctaccattatttgaaa

SEQ ID NO: 12506 - DNA, 25 bp, Mus musculus
aaagattctctaccgtggcagaaca

SEQ ID NO: 12507 - DNA, 25 bp, Mus musculus
aaagattctctagcattatttgaaa

SEQ ID NO: 12508 - DNA, 25 bp, Mus musculus
aaagattctctagcgtggcagaaca

SEQ ID NO: 12509 - DNA, 25 bp, Mus musculus
aaagattctctcacacttgggaaaa

SEQ ID NO: 12510 - DNA, 25 bp, Mus musculus
aaagattctctctcacttgggaaaa

SEQ ID NO: 12511 - DNA, 25 bp, Mus musculus
aaagattctctgagacttgttggat

SEQ ID NO: 12512 - DNA, 25 bp, Mus musculus
aaagattctctgtgacttgttggat

SEQ ID NO: 12513 - DNA, 25 bp, Mus musculus
aaagattctgaaagcttcccaccac

SEQ ID NO: 12514 - DNA, 25 bp, Mus musculus
aaagattctgaatgcttcccaccac

SEQ ID NO: 12515 - DNA, 25 bp, Mus musculus
aaagattctgacctgccagctatga

SEQ ID NO: 12516 - DNA, 25 bp, Mus musculus
aaagattctgacgtgccagctatga

SEQ ID NO: 12517 - DNA, 25 bp, Mus musculus
aaagattctgccagcagcccgaaac

SEQ ID NO: 12518 - DNA, 25 bp, Mus musculus
aaagattctgcctgcagcccgaaac

SEQ ID NO: 12519 - DNA, 25 bp, Mus musculus
aaagattctgttctgtctgcagaca

SEQ ID NO: 12520 - DNA, 25 bp, Mus musculus
aaagattctgttgtgtctgcagaca

SEQ ID NO: 12521 - DNA, 25 bp, Mus musculus
aaagattgaagcactcagccatgaa

SEQ ID NO: 12522 - DNA, 25 bp, Mus musculus
aaagattgaagctctcagccatgaa

SEQ ID NO: 12523 - DNA, 25 bp, Mus musculus
aaagattgacccacaagtcactgta

SEQ ID NO: 12524 - DNA, 25 bp, Mus musculus
aaagattgaccctcaagtcactgta

SEQ ID NO: 12525 - DNA, 25 bp, Mus musculus
aaagattgagccctattcccaacta

SEQ ID NO: 12526 - DNA, 25 bp, Mus musculus
aaagattgagccgtattcccaacta

SEQ ID NO: 12527 - DNA, 25 bp, Mus musculus
aaagattgaggcctgcccttgactc

SEQ ID NO: 12528 - DNA, 25 bp, Mus musculus
aaagattgaggcgtgcccttgactc

SEQ ID NO: 12529 - DNA, 25 bp, Mus musculus
aaagattgccccatatttccacctg

SEQ ID NO: 12530 - DNA, 25 bp, Mus musculus
aaagattgccccttatttccacctg

SEQ ID NO: 12531 - DNA, 25 bp, Mus musculus
aaagattgccctctaactgccatgc

SEQ ID NO: 12532 - DNA, 25 bp, Mus musculus
aaagattgccctgtaactgccatgc

SEQ ID NO: 12533 - DNA, 25 bp, Mus musculus
aaagattgcgggaccagccctttgc

SEQ ID NO: 12534 - DNA, 25 bp, Mus musculus
aaagattgcgggtccagccctttgc

SEQ ID NO: 12535 - DNA, 25 bp, Mus musculus
aaagattggcataccctcactactt

SEQ ID NO: 12536 - DNA, 25 bp, Mus musculus
aaagattggcattccctcactactt

SEQ ID NO: 12537 - DNA, 25 bp, Mus musculus
aaagattggcctaatcctcttgtct

SEQ ID NO: 12538 - DNA, 25 bp, Mus musculus
aaagattggccttatcctcttgtct

SEQ ID NO: 12539 - DNA, 25 bp, Mus musculus
aaagattgggctcaggacctcttgc

SEQ ID NO: 12540 - DNA, 25 bp, Mus musculus
aaagattgggctgaggacctcttgc

SEQ ID NO: 12541 - DNA, 25 bp, Mus musculus
aaagattggttcctgcaagccccaa

SEQ ID NO: 12542 - DNA, 25 bp, Mus musculus
aaagattggttcgtgcaagccccaa

SEQ ID NO: 12543 - DNA, 25 bp, Mus musculus
aaagattgtcttagcgccgagttct

SEQ ID NO: 12544 - DNA, 25 bp, Mus musculus
aaagattgtcttccttgctctcatt

SEQ ID NO: 12545 - DNA, 25 bp, Mus musculus
aaagattgtcttgcttgctctcatt

SEQ ID NO: 12546 - DNA, 25 bp, Mus musculus
aaagattgtctttgcgccgagttct

SEQ ID NO: 12547 - DNA, 25 bp, Mus musculus
aaagattgtgacctgctggtcggtt

SEQ ID NO: 12548 - DNA, 25 bp, Mus musculus
aaagattgtgacgtgctggtcggtt

SEQ ID NO: 12549 - DNA, 25 bp, Mus musculus
aaagatttactcacattctccaaag

SEQ ID NO: 12550 - DNA, 25 bp, Mus musculus
aaagatttactctcattctccaaag

SEQ ID NO: 12551 - DNA, 25 bp, Mus musculus
aaagatttatgtcagggtctctaca

SEQ ID NO: 12552 - DNA, 25 bp, Mus musculus
aaagatttatgtgagggtctctaca

SEQ ID NO: 12553 - DNA, 25 bp, Mus musculus
aaagatttcacaatatacccatggt

SEQ ID NO: 12554 - DNA, 25 bp, Mus musculus
aaagatttcacattatacccatggt

SEQ ID NO: 12555 - DNA, 25 bp, Mus musculus
aaagatttcagccagttggtcagag

SEQ ID NO: 12556 - DNA, 25 bp, Mus musculus
aaagatttcagcgagttggtcagag

SEQ ID NO: 12557 - DNA, 25 bp, Mus musculus
aaagatttcatgcttggcccataca

SEQ ID NO: 12558 - DNA, 25 bp, Mus musculus
aaagatttcatggttggcccataca

SEQ ID NO: 12559 - DNA, 25 bp, Mus musculus
aaagatttccacatactccacaggt

SEQ ID NO: 12560 - DNA, 25 bp, Mus musculus
aaagatttccacttactccacaggt

SEQ ID NO: 12561 - DNA, 25 bp, Mus musculus
aaagatttctgcagaggtcaagagg

SEQ ID NO: 12562 - DNA, 25 bp, Mus musculus
aaagatttctgctgaggtcaagagg

SEQ ID NO: 12563 - DNA, 25 bp, Mus musculus
aaagatttgaggagccccaagtgac

SEQ ID NO: 12564 - DNA, 25 bp, Mus musculus
aaagatttgaggtgccccaagtgac

SEQ ID NO: 12565 - DNA, 25 bp, Mus musculus
aaagatttgctccaagcatccagca

SEQ ID NO: 12566 - DNA, 25 bp, Mus musculus
aaagatttgctcgaagcatccagca

SEQ ID NO: 12567 - DNA, 25 bp, Mus musculus
aaagatttggtgctgcgtttggtaa

SEQ ID NO: 12568 - DNA, 25 bp, Mus musculus
aaagatttggtggtgcgtttggtaa

SEQ ID NO: 12569 - DNA, 25 bp, Mus musculus
aaagattttattcctttctgctctt

SEQ ID NO: 12570 - DNA, 25 bp, Mus musculus
aaagattttattgctttctgctctt

SEQ ID NO: 12571 - DNA, 25 bp, Mus musculus
aaagattttctaccgcagattcaga

SEQ ID NO: 12572 - DNA, 25 bp, Mus musculus
aaagattttctagcgcagattcaga

SEQ ID NO: 12573 - DNA, 25 bp, Mus musculus
aaagattttgacctcaccccacagg

SEQ ID NO: 12574 - DNA, 25 bp, Mus musculus
aaagattttgacgtcaccccacagg

SEQ ID NO: 12575 - DNA, 25 bp, Mus musculus
aaagattttgatactaaactgtgca

SEQ ID NO: 12576 - DNA, 25 bp, Mus musculus
aaagattttgattctaaactgtgca

SEQ ID NO: 12577 - DNA, 25 bp, Mus musculus
aaagattttgctcggacatacaata

SEQ ID NO: 12578 - DNA, 25 bp, Mus musculus
aaagattttgctgggacatacaata

SEQ ID NO: 12579 - DNA, 25 bp, Mus musculus
aaagatttttatcctctccacacat

SEQ ID NO: 12580 - DNA, 25 bp, Mus musculus
aaagatttttatgctctccacacat

SEQ ID NO: 12581 - DNA, 25 bp, Mus musculus
aaagatttttgtagtcccagtcact

SEQ ID NO: 12582 - DNA, 25 bp, Mus musculus
aaagatttttgttgtcccagtcact

SEQ ID NO: 12583 - DNA, 25 bp, Mus musculus
aaagcaaaacccacttattctggct

SEQ ID NO: 12584 - DNA, 25 bp, Mus musculus
aaagcaaaaccctcttattctggct

SEQ ID NO: 12585 - DNA, 25 bp, Mus musculus
aaagcaaaatgactgctctgagctg

SEQ ID NO: 12586 - DNA, 25 bp, Mus musculus
aaagcaaaatgagtgctctgagctg

SEQ ID NO: 12587 - DNA, 25 bp, Mus musculus
aaagcaaaatgcagccaagcttggc

SEQ ID NO: 12588 - DNA, 25 bp, Mus musculus
aaagcaaaatgctgccaagcttggc

SEQ ID NO: 12589 - DNA, 25 bp, Mus musculus
aaagcaaaatggcaggctcccacga

SEQ ID NO: 12590 - DNA, 25 bp, Mus musculus
aaagcaaaatgggaggctcccacga

SEQ ID NO: 12591 - DNA, 25 bp, Mus musculus
aaagcaaacatgacccttagttcct

SEQ ID NO: 12592 - DNA, 25 bp, Mus musculus
aaagcaaacatgtcccttagttcct

SEQ ID NO: 12593 - DNA, 25 bp, Mus musculus
aaagcaaacccacatgagctttggg

SEQ ID NO: 12594 - DNA, 25 bp, Mus musculus
aaagcaaacccagatgagctttggg

SEQ ID NO: 12595 - DNA, 25 bp, Mus musculus
aaagcaaactgacggctctgctcgc

SEQ ID NO: 12596 - DNA, 25 bp, Mus musculus
aaagcaaactgagggctctgctcgc

SEQ ID NO: 12597 - DNA, 25 bp, Mus musculus
aaagcaaactggaccctgatccgta

SEQ ID NO: 12598 - DNA, 25 bp, Mus musculus
aaagcaaactggtccctgatccgta

SEQ ID NO: 12599 - DNA, 25 bp, Mus musculus
aaagcaaagcacacgagtacttgat

SEQ ID NO: 12600 - DNA, 25 bp, Mus musculus
aaagcaaagcactcgagtacttgat

SEQ ID NO: 12601 - DNA, 25 bp, Mus musculus
aaagcaaagtcaccccactcaaagt

SEQ ID NO: 12602 - DNA, 25 bp, Mus musculus
aaagcaaagtcagcccactcaaagt

SEQ ID NO: 12603 - DNA, 25 bp, Mus musculus
aaagcaaagtctcacaaggatcttg

SEQ ID NO: 12604 - DNA, 25 bp, Mus musculus
aaagcaaagtctgacaaggatcttg

SEQ ID NO: 12605 - DNA, 25 bp, Mus musculus
aaagcaaatcctactctgatgttaa

SEQ ID NO: 12606 - DNA, 25 bp, Mus musculus
aaagcaaatccttctctgatgttaa

SEQ ID NO: 12607 - DNA, 25 bp, Mus musculus
aaagcaacaggcactggctcctggg

SEQ ID NO: 12608 - DNA, 25 bp, Mus musculus
aaagcaacaggctctggctcctggg

SEQ ID NO: 12609 - DNA, 25 bp, Mus musculus
aaagcaacatttactctaccacact

SEQ ID NO: 12610 - DNA, 25 bp, Mus musculus
aaagcaacattttctctaccacact

SEQ ID NO: 12611 - DNA, 25 bp, Mus musculus
aaagcaaccaaaagtagacccatgt

SEQ ID NO: 12612 - DNA, 25 bp, Mus musculus
aaagcaaccaaatgtagacccatgt

SEQ ID NO: 12613 - DNA, 25 bp, Mus musculus
aaagcaaccactagaggatggactc

SEQ ID NO: 12614 - DNA, 25 bp, Mus musculus
aaagcaaccacttgaggatggactc

SEQ ID NO: 12615 - DNA, 25 bp, Mus musculus
aaagcaaccattagttttcgagcaa

SEQ ID NO: 12616 - DNA, 25 bp, Mus musculus
aaagcaaccattcctgtggcgcgcc

SEQ ID NO: 12617 - DNA, 25 bp, Mus musculus
aaagcaaccattgctgtggcgcgcc

SEQ ID NO: 12618 - DNA, 25 bp, Mus musculus
aaagcaaccatttgttttcgagcaa

SEQ ID NO: 12619 - DNA, 25 bp, Mus musculus
aaagcaaccccaaattactgagaat

SEQ ID NO: 12620 - DNA, 25 bp, Mus musculus
aaagcaaccccatattactgagaat

SEQ ID NO: 12621 - DNA, 25 bp, Mus musculus
aaagcaaccgcaacattgatgccaa

SEQ ID NO: 12622 - DNA, 25 bp, Mus musculus
aaagcaaccgcatcattgatgccaa

SEQ ID NO: 12623 - DNA, 25 bp, Mus musculus
aaagcaacctacaacaacacacaga

SEQ ID NO: 12624 - DNA, 25 bp, Mus musculus
aaagcaacctactacaacacacaga

SEQ ID NO: 12625 - DNA, 25 bp, Mus musculus
aaagcaacctgaataccccacagca

SEQ ID NO: 12626 - DNA, 25 bp, Mus musculus
aaagcaacctgattaccccacagca

SEQ ID NO: 12627 - DNA, 25 bp, Mus musculus
aaagcaacggccctgctgggattgt

SEQ ID NO: 12628 - DNA, 25 bp, Mus musculus
aaagcaacggccgtgctgggattgt

SEQ ID NO: 12629 - DNA, 25 bp, Mus musculus
aaagcaactctacgcacaaagaatg

SEQ ID NO: 12630 - DNA, 25 bp, Mus musculus
aaagcaactctaggcacaaagaatg

SEQ ID NO: 12631 - DNA, 25 bp, Mus musculus
aaagcaactggaattacccgaacat

SEQ ID NO: 12632 - DNA, 25 bp, Mus musculus
aaagcaactggatttacccgaacat

SEQ ID NO: 12633 - DNA, 25 bp, Mus musculus
aaagcaactgtgagaggcatcctca

SEQ ID NO: 12634 - DNA, 25 bp, Mus musculus
aaagcaactgtgattccctcaaact

SEQ ID NO: 12635 - DNA, 25 bp, Mus musculus
aaagcaactgtgtgaggcatcctca

SEQ ID NO: 12636 - DNA, 25 bp, Mus musculus
aaagcaactgtgtttccctcaaact

SEQ ID NO: 12637 - DNA, 25 bp, Mus musculus
aaagcaacttacaagcaggccggga

SEQ ID NO: 12638 - DNA, 25 bp, Mus musculus
aaagcaacttactagcaggccggga

SEQ ID NO: 12639 - DNA, 25 bp, Mus musculus
aaagcaacttgtactgttccacttc

SEQ ID NO: 12640 - DNA, 25 bp, Mus musculus
aaagcaacttgttctgttccacttc

SEQ ID NO: 12641 - DNA, 25 bp, Mus musculus
aaagcaagactccaagcgggacgcc

SEQ ID NO: 12642 - DNA, 25 bp, Mus musculus
aaagcaagactcgaagcgggacgcc

SEQ ID NO: 12643 - DNA, 25 bp, Mus musculus
aaagcaagacttactgtaccaccac

SEQ ID NO: 12644 - DNA, 25 bp, Mus musculus
aaagcaagactttctgtaccaccac

SEQ ID NO: 12645 - DNA, 25 bp, Mus musculus
aaagcaagagacatcagcggagcag

SEQ ID NO: 12646 - DNA, 25 bp, Mus musculus
aaagcaagagacttcagcggagcag

SEQ ID NO: 12647 - DNA, 25 bp, Mus musculus
aaagcaagagttcgccggcaagaga

SEQ ID NO: 12648 - DNA, 25 bp, Mus musculus
aaagcaagagttggccggcaagaga

SEQ ID NO: 12649 - DNA, 25 bp, Mus musculus
aaagcaagatgaccggcctccactg

SEQ ID NO: 12650 - DNA, 25 bp, Mus musculus
aaagcaagatgagcggcctccactg

SEQ ID NO: 12651 - DNA, 25 bp, Mus musculus
aaagcaagcaagacttcaccttctc

SEQ ID NO: 12652 - DNA, 25 bp, Mus musculus
aaagcaagcaagtcttcaccttctc

SEQ ID NO: 12653 - DNA, 25 bp, Mus musculus
aaagcaagccagctaggtgcaaaat

SEQ ID NO: 12654 - DNA, 25 bp, Mus musculus
aaagcaagccaggtaggtgcaaaat

SEQ ID NO: 12655 - DNA, 25 bp, Mus musculus
aaagcaagcgttcatcttccacgaa

SEQ ID NO: 12656 - DNA, 25 bp, Mus musculus
aaagcaagcgttgatcttccacgaa

SEQ ID NO: 12657 - DNA, 25 bp, Mus musculus
aaagcaagctccacaaagaaacctg

SEQ ID NO: 12658 - DNA, 25 bp, Mus musculus
aaagcaagctcctcaaagaaacctg

SEQ ID NO: 12659 - DNA, 25 bp, Mus musculus
aaagcaaggcaactctaccaaagaa

SEQ ID NO: 12660 - DNA, 25 bp, Mus musculus
aaagcaaggcaagtctaccaaagaa

SEQ ID NO: 12661 - DNA, 25 bp, Mus musculus
aaagcaaggcatctatttctgtgtc

SEQ ID NO: 12662 - DNA, 25 bp, Mus musculus
aaagcaaggcatgtatttctgtgtc

SEQ ID NO: 12663 - DNA, 25 bp, Mus musculus
aaagcaaggccgctctggaacaaga

SEQ ID NO: 12664 - DNA, 25 bp, Mus musculus
aaagcaaggccggtctggaacaaga

SEQ ID NO: 12665 - DNA, 25 bp, Mus musculus
aaagcaaggttacagcagcacataa

SEQ ID NO: 12666 - DNA, 25 bp, Mus musculus
aaagcaaggttagagcagcacataa

SEQ ID NO: 12667 - DNA, 25 bp, Mus musculus
aaagcaagtagtcggctcagccggt

SEQ ID NO: 12668 - DNA, 25 bp, Mus musculus
aaagcaagtagtgggctcagccggt

SEQ ID NO: 12669 - DNA, 25 bp, Mus musculus
aaagcaagtatcagtgctctgccct

SEQ ID NO: 12670 - DNA, 25 bp, Mus musculus
aaagcaagtatctgtgctctgccct

SEQ ID NO: 12671 - DNA, 25 bp, Mus musculus
aaagcaagtcacaggctctggcttc

SEQ ID NO: 12672 - DNA, 25 bp, Mus musculus
aaagcaagtcactggctctggcttc

SEQ ID NO: 12673 - DNA, 25 bp, Mus musculus
aaagcaagtcgtaagcctcagggat

SEQ ID NO: 12674 - DNA, 25 bp, Mus musculus
aaagcaagtcgttagcctcagggat

SEQ ID NO: 12675 - DNA, 25 bp, Mus musculus
aaagcaagtgacaccttacccctgg

SEQ ID NO: 12676 - DNA, 25 bp, Mus musculus
aaagcaagtgactccttacccctgg

SEQ ID NO: 12677 - DNA, 25 bp, Mus musculus
aaagcaagtgcgagctctttctttc

SEQ ID NO: 12678 - DNA, 25 bp, Mus musculus
aaagcaagtgcgtgctctttctttc

SEQ ID NO: 12679 - DNA, 25 bp, Mus musculus
aaagcaagtggtagcagcctggtgt

SEQ ID NO: 12680 - DNA, 25 bp, Mus musculus
aaagcaagtggttgcagcctggtgt

SEQ ID NO: 12681 - DNA, 25 bp, Mus musculus
aaagcaataatcatcgttactgaga

SEQ ID NO: 12682 - DNA, 25 bp, Mus musculus
aaagcaataatcttcgttactgaga

SEQ ID NO: 12683 - DNA, 25 bp, Mus musculus
aaagcaataatgattccataccatg

SEQ ID NO: 12684 - DNA, 25 bp, Mus musculus
aaagcaataatgtttccataccatg

SEQ ID NO: 12685 - DNA, 25 bp, Mus musculus
aaagcaataggaccctgccatagga

SEQ ID NO: 12686 - DNA, 25 bp, Mus musculus
aaagcaataggagcctgccatagga

SEQ ID NO: 12687 - DNA, 25 bp, Mus musculus
aaagcaatccacctctctaagaagt

SEQ ID NO: 12688 - DNA, 25 bp, Mus musculus
aaagcaatccacgtctctaagaagt

SEQ ID NO: 12689 - DNA, 25 bp, Mus musculus
aaagcaatcccaatttctccatatc

SEQ ID NO: 12690 - DNA, 25 bp, Mus musculus
aaagcaatcccattttctccatatc

SEQ ID NO: 12691 - DNA, 25 bp, Mus musculus
aaagcaatcctaagaagaacaaagc

SEQ ID NO: 12692 - DNA, 25 bp, Mus musculus
aaagcaatcctatgaagaacaaagc

SEQ ID NO: 12693 - DNA, 25 bp, Mus musculus
aaagcaatcctgactctccaataac

SEQ ID NO: 12694 - DNA, 25 bp, Mus musculus
aaagcaatcctgtctctccaataac

SEQ ID NO: 12695 - DNA, 25 bp, Mus musculus
aaagcaatcgccacacaaagacaga

SEQ ID NO: 12696 - DNA, 25 bp, Mus musculus
aaagcaatcgcctcacaaagacaga

SEQ ID NO: 12697 - DNA, 25 bp, Mus musculus
aaagcaatcgggagcatctctcggt

SEQ ID NO: 12698 - DNA, 25 bp, Mus musculus
aaagcaatcgggtgcatctctcggt

SEQ ID NO: 12699 - DNA, 25 bp, Mus musculus
aaagcaatctacattcacctatcct

SEQ ID NO: 12700 - DNA, 25 bp, Mus musculus
aaagcaatctactttcacctatcct

SEQ ID NO: 12701 - DNA, 25 bp, Mus musculus
aaagcaatctagactcacccaggtt

SEQ ID NO: 12702 - DNA, 25 bp, Mus musculus
aaagcaatctagcagcgggtccctc

SEQ ID NO: 12703 - DNA, 25 bp, Mus musculus
aaagcaatctaggagcgggtccctc

SEQ ID NO: 12704 - DNA, 25 bp, Mus musculus
aaagcaatctagtctcacccaggtt

SEQ ID NO: 12705 - DNA, 25 bp, Mus musculus
aaagcaatgactagagcagcctcag

SEQ ID NO: 12706 - DNA, 25 bp, Mus musculus
aaagcaatgacttgagcagcctcag

SEQ ID NO: 12707 - DNA, 25 bp, Mus musculus
aaagcaatgatacagcgcagcgaga

SEQ ID NO: 12708 - DNA, 25 bp, Mus musculus
aaagcaatgatagagcgcagcgaga

SEQ ID NO: 12709 - DNA, 25 bp, Mus musculus
aaagcaatgcctcctgaagcccgga

SEQ ID NO: 12710 - DNA, 25 bp, Mus musculus
aaagcaatgcctgctgaagcccgga

SEQ ID NO: 12711 - DNA, 25 bp, Mus musculus
aaagcaatggacacacctgttcctg

SEQ ID NO: 12712 - DNA, 25 bp, Mus musculus
aaagcaatggactcacctgttcctg

SEQ ID NO: 12713 - DNA, 25 bp, Mus musculus
aaagcaatgtaccttccggaacaat

SEQ ID NO: 12714 - DNA, 25 bp, Mus musculus
aaagcaatgtacgttccggaacaat

SEQ ID NO: 12715 - DNA, 25 bp, Mus musculus
aaagcaattactcctctctcagaga

SEQ ID NO: 12716 - DNA, 25 bp, Mus musculus
aaagcaattactgctctctcagaga

SEQ ID NO: 12717 - DNA, 25 bp, Mus musculus
aaagcaattcccctggatgttcctt

SEQ ID NO: 12718 - DNA, 25 bp, Mus musculus
aaagcaattcccgtggatgttcctt

SEQ ID NO: 12719 - DNA, 25 bp, Mus musculus
aaagcacaacccacaacttacggag

SEQ ID NO: 12720 - DNA, 25 bp, Mus musculus
aaagcacaaccctcaacttacggag

SEQ ID NO: 12721 - DNA, 25 bp, Mus musculus
aaagcacaacggatatccccaacag

SEQ ID NO: 12722 - DNA, 25 bp, Mus musculus
aaagcacaacggttatccccaacag

SEQ ID NO: 12723 - DNA, 25 bp, Mus musculus
aaagcacaactcattcctcaaagga

SEQ ID NO: 12724 - DNA, 25 bp, Mus musculus
aaagcacaactctttcctcaaagga

SEQ ID NO: 12725 - DNA, 25 bp, Mus musculus
aaagcacaagagcactgcagcacag

SEQ ID NO: 12726 - DNA, 25 bp, Mus musculus
aaagcacaagaggactgcagcacag

SEQ ID NO: 12727 - DNA, 25 bp, Mus musculus
aaagcacaagctaaatactctccat

SEQ ID NO: 12728 - DNA, 25 bp, Mus musculus
aaagcacaagcttaatactctccat

SEQ ID NO: 12729 - DNA, 25 bp, Mus musculus
aaagcacaaggcatcccagtatccc

SEQ ID NO: 12730 - DNA, 25 bp, Mus musculus
aaagcacaaggcttcccagtatccc

SEQ ID NO: 12731 - DNA, 25 bp, Mus musculus
aaagcacaagtccacatctgcacag

SEQ ID NO: 12732 - DNA, 25 bp, Mus musculus
aaagcacaagtcgacatctgcacag

SEQ ID NO: 12733 - DNA, 25 bp, Mus musculus
aaagcacaatgaaaggtcttaccat

SEQ ID NO: 12734 - DNA, 25 bp, Mus musculus
aaagcacaatgataggtcttaccat

SEQ ID NO: 12735 - DNA, 25 bp, Mus musculus
aaagcacaatgtcccatcgtggagc

SEQ ID NO: 12736 - DNA, 25 bp, Mus musculus
aaagcacaatgtgccatcgtggagc

SEQ ID NO: 12737 - DNA, 25 bp, Mus musculus
aaagcacaattgcaggagcgtccgt

SEQ ID NO: 12738 - DNA, 25 bp, Mus musculus
aaagcacaattggaggagcgtccgt

SEQ ID NO: 12739 - DNA, 25 bp, Mus musculus
aaagcacacaccaggatttccagac

SEQ ID NO: 12740 - DNA, 25 bp, Mus musculus
aaagcacacacctggatttccagac

SEQ ID NO: 12741 - DNA, 25 bp, Mus musculus
aaagcacacacgaagcaacggaccc

SEQ ID NO: 12742 - DNA, 25 bp, Mus musculus
aaagcacacacgtagcaacggaccc

SEQ ID NO: 12743 - DNA, 25 bp, Mus musculus
aaagcacacagtaacctttccaggg

SEQ ID NO: 12744 - DNA, 25 bp, Mus musculus
aaagcacacagttacctttccaggg

SEQ ID NO: 12745 - DNA, 25 bp, Mus musculus
aaagcacacatgctgatcttgcaga

SEQ ID NO: 12746 - DNA, 25 bp, Mus musculus
aaagcacacatggtgatcttgcaga

SEQ ID NO: 12747 - DNA, 25 bp, Mus musculus
aaagcacaccctatgtgtactgtaa

SEQ ID NO: 12748 - DNA, 25 bp, Mus musculus
aaagcacaccctttgtgtactgtaa

SEQ ID NO: 12749 - DNA, 25 bp, Mus musculus
aaagcacacgagagcctttgtagaa

SEQ ID NO: 12750 - DNA, 25 bp, Mus musculus
aaagcacacgagtgcctttgtagaa

SEQ ID NO: 12751 - DNA, 25 bp, Mus musculus
aaagcacacgcgacaatgtactacc

SEQ ID NO: 12752 - DNA, 25 bp, Mus musculus
aaagcacacgcgtcaatgtactacc

SEQ ID NO: 12753 - DNA, 25 bp, Mus musculus
aaagcacacggcaagcatgccaaga

SEQ ID NO: 12754 - DNA, 25 bp, Mus musculus
aaagcacacggctagcatgccaaga

SEQ ID NO: 12755 - DNA, 25 bp, Mus musculus
aaagcacacgtgcaaatccaagtga

SEQ ID NO: 12756 - DNA, 25 bp, Mus musculus
aaagcacacgtggaaatccaagtga

SEQ ID NO: 12757 - DNA, 25 bp, Mus musculus
aaagcacagacaaacttagctgggt

SEQ ID NO: 12758 - DNA, 25 bp, Mus musculus
aaagcacagacatacttagctgggt

SEQ ID NO: 12759 - DNA, 25 bp, Mus musculus
aaagcacagactacatgcctcagat

SEQ ID NO: 12760 - DNA, 25 bp, Mus musculus
aaagcacagacttcatgcctcagat

SEQ ID NO: 12761 - DNA, 25 bp, Mus musculus
aaagcacagcaaaaatgctgcaaaa

SEQ ID NO: 12762 - DNA, 25 bp, Mus musculus
aaagcacagcaataatgctgcaaaa

SEQ ID NO: 12763 - DNA, 25 bp, Mus musculus
aaagcacagcccaagcagacagctt

SEQ ID NO: 12764 - DNA, 25 bp, Mus musculus
aaagcacagccctagcagacagctt

SEQ ID NO: 12765 - DNA, 25 bp, Mus musculus
aaagcacagctcacggaaattgaac

SEQ ID NO: 12766 - DNA, 25 bp, Mus musculus
aaagcacagctctcggaaattgaac

SEQ ID NO: 12767 - DNA, 25 bp, Mus musculus
aaagcacaggaaacatagatgcaga

SEQ ID NO: 12768 - DNA, 25 bp, Mus musculus
aaagcacaggaatcatagatgcaga

SEQ ID NO: 12769 - DNA, 25 bp, Mus musculus
aaagcacaggagagacggaccggta

SEQ ID NO: 12770 - DNA, 25 bp, Mus musculus
aaagcacaggagcattagaacggac

SEQ ID NO: 12771 - DNA, 25 bp, Mus musculus
aaagcacaggaggattagaacggac

SEQ ID NO: 12772 - DNA, 25 bp, Mus musculus
aaagcacaggagtgacggaccggta

SEQ ID NO: 12773 - DNA, 25 bp, Mus musculus
aaagcacaggcactccaggaaaaca

SEQ ID NO: 12774 - DNA, 25 bp, Mus musculus
aaagcacaggcagtccaggaaaaca

SEQ ID NO: 12775 - DNA, 25 bp, Mus musculus
aaagcacagggaactggccacgcct

SEQ ID NO: 12776 - DNA, 25 bp, Mus musculus
aaagcacagggatctggccacgcct

SEQ ID NO: 12777 - DNA, 25 bp, Mus musculus
aaagcacagttcattgtcctggaca

SEQ ID NO: 12778 - DNA, 25 bp, Mus musculus
aaagcacagttctttgtcctggaca

SEQ ID NO: 12779 - DNA, 25 bp, Mus musculus
aaagcacatcgtcaaaactgagatg

SEQ ID NO: 12780 - DNA, 25 bp, Mus musculus
aaagcacatcgtgaaaactgagatg

SEQ ID NO: 12781 - DNA, 25 bp, Mus musculus
aaagcacatgagctgggctgtagca

SEQ ID NO: 12782 - DNA, 25 bp, Mus musculus
aaagcacatgaggtgggctgtagca

SEQ ID NO: 12783 - DNA, 25 bp, Mus musculus
aaagcacatgatattggcctagaga

SEQ ID NO: 12784 - DNA, 25 bp, Mus musculus
aaagcacatgattttggcctagaga

SEQ ID NO: 12785 - DNA, 25 bp, Mus musculus
aaagcacatgcgattgtctgaataa

SEQ ID NO: 12786 - DNA, 25 bp, Mus musculus
aaagcacatgcgtttgtctgaataa

SEQ ID NO: 12787 - DNA, 25 bp, Mus musculus
aaagcacattgtatctcaggaccac

SEQ ID NO: 12788 - DNA, 25 bp, Mus musculus
aaagcacattgtttctcaggaccac

SEQ ID NO: 12789 - DNA, 25 bp, Mus musculus
aaagcaccaagtagcttcactgcct

SEQ ID NO: 12790 - DNA, 25 bp, Mus musculus
aaagcaccaagttgcttcactgcct

SEQ ID NO: 12791 - DNA, 25 bp, Mus musculus
aaagcaccacatactgacttcacag

SEQ ID NO: 12792 - DNA, 25 bp, Mus musculus
aaagcaccacattctgacttcacag

SEQ ID NO: 12793 - DNA, 25 bp, Mus musculus
aaagcaccactgaagaaactgcgga

SEQ ID NO: 12794 - DNA, 25 bp, Mus musculus
aaagcaccactgtagaaactgcgga

SEQ ID NO: 12795 - DNA, 25 bp, Mus musculus
aaagcaccagaacactatgatattg

SEQ ID NO: 12796 - DNA, 25 bp, Mus musculus
aaagcaccagaagactatgatattg

SEQ ID NO: 12797 - DNA, 25 bp, Mus musculus
aaagcaccaggacgcagggactgca

SEQ ID NO: 12798 - DNA, 25 bp, Mus musculus
aaagcaccaggaggcagggactgca

SEQ ID NO: 12799 - DNA, 25 bp, Mus musculus
aaagcaccatctccaatcatggact

SEQ ID NO: 12800 - DNA, 25 bp, Mus musculus
aaagcaccatctgcaatcatggact

SEQ ID NO: 12801 - DNA, 25 bp, Mus musculus
aaagcaccatgcatggccaagatct

SEQ ID NO: 12802 - DNA, 25 bp, Mus musculus
aaagcaccatgcttggccaagatct

SEQ ID NO: 12803 - DNA, 25 bp, Mus musculus
aaagcaccccagaattttcctgtgt

SEQ ID NO: 12804 - DNA, 25 bp, Mus musculus
aaagcaccccagtattttcctgtgt

SEQ ID NO: 12805 - DNA, 25 bp, Mus musculus
aaagcaccctagcacatgcagtgag

SEQ ID NO: 12806 - DNA, 25 bp, Mus musculus
aaagcaccctaggacatgcagtgag

SEQ ID NO: 12807 - DNA, 25 bp, Mus musculus
aaagcaccgacaattattgttctgt

SEQ ID NO: 12808 - DNA, 25 bp, Mus musculus
aaagcaccgacatttattgttctgt

SEQ ID NO: 12809 - DNA, 25 bp, Mus musculus
aaagcaccgatcagtggttgggaca

SEQ ID NO: 12810 - DNA, 25 bp, Mus musculus
aaagcaccgatctgtggttgggaca

SEQ ID NO: 12811 - DNA, 25 bp, Mus musculus
aaagcaccggaccaattcaggcagc

SEQ ID NO: 12812 - DNA, 25 bp, Mus musculus
aaagcaccggacgaattcaggcagc

SEQ ID NO: 12813 - DNA, 25 bp, Mus musculus
aaagcaccggcaagctccttttctg

SEQ ID NO: 12814 - DNA, 25 bp, Mus musculus
aaagcaccggcatgctccttttctg

SEQ ID NO: 12815 - DNA, 25 bp, Mus musculus
aaagcaccgtctagatctcatttgg

SEQ ID NO: 12816 - DNA, 25 bp, Mus musculus
aaagcaccgtcttgatctcatttgg

SEQ ID NO: 12817 - DNA, 25 bp, Mus musculus
aaagcaccgtgtcctcaggatgccg

SEQ ID NO: 12818 - DNA, 25 bp, Mus musculus
aaagcaccgtgtgctcaggatgccg

SEQ ID NO: 12819 - DNA, 25 bp, Mus musculus
aaagcacctcttatagttaaatctg

SEQ ID NO: 12820 - DNA, 25 bp, Mus musculus
aaagcacctcttttagttaaatctg

SEQ ID NO: 12821 - DNA, 25 bp, Mus musculus
aaagcacctgaaaatgccctctgac

SEQ ID NO: 12822 - DNA, 25 bp, Mus musculus
aaagcacctgaatatgccctctgac

SEQ ID NO: 12823 - DNA, 25 bp, Mus musculus
aaagcacctgatcctgcattctgtt

SEQ ID NO: 12824 - DNA, 25 bp, Mus musculus
aaagcacctgatgctgcattctgtt

SEQ ID NO: 12825 - DNA, 25 bp, Mus musculus
aaagcacctgctcggagatcttctg

SEQ ID NO: 12826 - DNA, 25 bp, Mus musculus
aaagcacctgctgggagatcttctg

SEQ ID NO: 12827 - DNA, 25 bp, Mus musculus
aaagcacctggaaccagacctgaga

SEQ ID NO: 12828 - DNA, 25 bp, Mus musculus
aaagcacctggaattttaagagtag

SEQ ID NO: 12829 - DNA, 25 bp, Mus musculus
aaagcacctggatccagacctgaga

SEQ ID NO: 12830 - DNA, 25 bp, Mus musculus
aaagcacctggatttttaagagtag

SEQ ID NO: 12831 - DNA, 25 bp, Mus musculus
aaagcaccttttcctgatgctagga

SEQ ID NO: 12832 - DNA, 25 bp, Mus musculus
aaagcaccttttgctgatgctagga

SEQ ID NO: 12833 - DNA, 25 bp, Mus musculus
aaagcacgactcctgatgccattga

SEQ ID NO: 12834 - DNA, 25 bp, Mus musculus
aaagcacgactcgtgatgccattga

SEQ ID NO: 12835 - DNA, 25 bp, Mus musculus
aaagcacgagagaactcaacactaa

SEQ ID NO: 12836 - DNA, 25 bp, Mus musculus
aaagcacgagagtactcaacactaa

SEQ ID NO: 12837 - DNA, 25 bp, Mus musculus
aaagcacgagtcaagagtaaggcat

SEQ ID NO: 12838 - DNA, 25 bp, Mus musculus
aaagcacgagtctagagtaaggcat

SEQ ID NO: 12839 - DNA, 25 bp, Mus musculus
aaagcacgcctaccatgtgacctgc

SEQ ID NO: 12840 - DNA, 25 bp, Mus musculus
aaagcacgcctagcatgtgacctgc

SEQ ID NO: 12841 - DNA, 25 bp, Mus musculus
aaagcacgctgcacatcttcagtat

SEQ ID NO: 12842 - DNA, 25 bp, Mus musculus
aaagcacgctgctcatcttcagtat

SEQ ID NO: 12843 - DNA, 25 bp, Mus musculus
aaagcacggctgaacccacgaatag

SEQ ID NO: 12844 - DNA, 25 bp, Mus musculus
aaagcacggctgtacccacgaatag

SEQ ID NO: 12845 - DNA, 25 bp, Mus musculus
aaagcacgggccattcaaggaccga

SEQ ID NO: 12846 - DNA, 25 bp, Mus musculus
aaagcacgggcctttcaaggaccga

SEQ ID NO: 12847 - DNA, 25 bp, Mus musculus
aaagcacgggctctgatgggaactt

SEQ ID NO: 12848 - DNA, 25 bp, Mus musculus
aaagcacgggctgtgatgggaactt

SEQ ID NO: 12849 - DNA, 25 bp, Mus musculus
aaagcacgtaccaagcatgcagatg

SEQ ID NO: 12850 - DNA, 25 bp, Mus musculus
aaagcacgtacctagcatgcagatg

SEQ ID NO: 12851 - DNA, 25 bp, Mus musculus
aaagcacgtcttcaattgaggcaaa

SEQ ID NO: 12852 - DNA, 25 bp, Mus musculus
aaagcacgtcttgaattgaggcaaa

SEQ ID NO: 12853 - DNA, 25 bp, Mus musculus
aaagcacgtggcctgctatggattt

SEQ ID NO: 12854 - DNA, 25 bp, Mus musculus
aaagcacgtggcgtgctatggattt

SEQ ID NO: 12855 - DNA, 25 bp, Mus musculus
aaagcacgttttacttgttggcaga

SEQ ID NO: 12856 - DNA, 25 bp, Mus musculus
aaagcacgtttttcttgttggcaga

SEQ ID NO: 12857 - DNA, 25 bp, Mus musculus
aaagcactaagtagactatatcaga

SEQ ID NO: 12858 - DNA, 25 bp, Mus musculus
aaagcactaagtcccatgtgtcacc

SEQ ID NO: 12859 - DNA, 25 bp, Mus musculus
aaagcactaagtgccatgtgtcacc

SEQ ID NO: 12860 - DNA, 25 bp, Mus musculus
aaagcactaagttgactatatcaga

SEQ ID NO: 12861 - DNA, 25 bp, Mus musculus
aaagcactacttacttgattttgct

SEQ ID NO: 12862 - DNA, 25 bp, Mus musculus
aaagcactactttcttgattttgct

SEQ ID NO: 12863 - DNA, 25 bp, Mus musculus
aaagcactagtcacctaagcccatt

SEQ ID NO: 12864 - DNA, 25 bp, Mus musculus
aaagcactagtctcctaagcccatt

SEQ ID NO: 12865 - DNA, 25 bp, Mus musculus
aaagcactataaagcgccctgggaa

SEQ ID NO: 12866 - DNA, 25 bp, Mus musculus
aaagcactataatgcgccctgggaa

SEQ ID NO: 12867 - DNA, 25 bp, Mus musculus
aaagcactattccttcgaacgcaga

SEQ ID NO: 12868 - DNA, 25 bp, Mus musculus
aaagcactattcgttcgaacgcaga

SEQ ID NO: 12869 - DNA, 25 bp, Mus musculus
aaagcactcaacaagggccttcagg

SEQ ID NO: 12870 - DNA, 25 bp, Mus musculus
aaagcactcaactagggccttcagg

SEQ ID NO: 12871 - DNA, 25 bp, Mus musculus
aaagcactcgtcaagcagctgctgt

SEQ ID NO: 12872 - DNA, 25 bp, Mus musculus
aaagcactcgtctagcagctgctgt

SEQ ID NO: 12873 - DNA, 25 bp, Mus musculus
aaagcactctacctgggtccggaca

SEQ ID NO: 12874 - DNA, 25 bp, Mus musculus
aaagcactctacgtgggtccggaca

SEQ ID NO: 12875 - DNA, 25 bp, Mus musculus
aaagcactctgcctagtggcctgtt

SEQ ID NO: 12876 - DNA, 25 bp, Mus musculus
aaagcactctgcgtagtggcctgtt

SEQ ID NO: 12877 - DNA, 25 bp, Mus musculus
aaagcactctgtccatggttagaat

SEQ ID NO: 12878 - DNA, 25 bp, Mus musculus
aaagcactctgtgcatggttagaat

SEQ ID NO: 12879 - DNA, 25 bp, Mus musculus
aaagcactgattatcactctggatc

SEQ ID NO: 12880 - DNA, 25 bp, Mus musculus
aaagcactgattttcactctggatc

SEQ ID NO: 12881 - DNA, 25 bp, Mus musculus
aaagcactgcatagtcagtttggaa

SEQ ID NO: 12882 - DNA, 25 bp, Mus musculus
aaagcactgcattgtcagtttggaa

SEQ ID NO: 12883 - DNA, 25 bp, Mus musculus
aaagcactgctaagcatctgtggag

SEQ ID NO: 12884 - DNA, 25 bp, Mus musculus
aaagcactgctatgcatctgtggag

SEQ ID NO: 12885 - DNA, 25 bp, Mus musculus
aaagcactgcttcagaagtatgaag

SEQ ID NO: 12886 - DNA, 25 bp, Mus musculus
aaagcactgcttgagaagtatgaag

SEQ ID NO: 12887 - DNA, 25 bp, Mus musculus
aaagcactggtccaattccaggcca

SEQ ID NO: 12888 - DNA, 25 bp, Mus musculus
aaagcactggtcgaattccaggcca

SEQ ID NO: 12889 - DNA, 25 bp, Mus musculus
aaagcacttagtcggtctgactcca

SEQ ID NO: 12890 - DNA, 25 bp, Mus musculus
aaagcacttagtgggtctgactcca

SEQ ID NO: 12891 - DNA, 25 bp, Mus musculus
aaagcacttatcactaggcagccct

SEQ ID NO: 12892 - DNA, 25 bp, Mus musculus
aaagcacttatctctaggcagccct

SEQ ID NO: 12893 - DNA, 25 bp, Mus musculus
aaagcacttcatctccagtgcatcg

SEQ ID NO: 12894 - DNA, 25 bp, Mus musculus
aaagcacttcatgtccagtgcatcg

SEQ ID NO: 12895 - DNA, 25 bp, Mus musculus
aaagcacttccaacactccaatata

SEQ ID NO: 12896 - DNA, 25 bp, Mus musculus
aaagcacttccactaatcagcacct

SEQ ID NO: 12897 - DNA, 25 bp, Mus musculus
aaagcacttccagtaatcagcacct

SEQ ID NO: 12898 - DNA, 25 bp, Mus musculus
aaagcacttccatcactccaatata

SEQ ID NO: 12899 - DNA, 25 bp, Mus musculus
aaagcacttcctctgaggaggctct

SEQ ID NO: 12900 - DNA, 25 bp, Mus musculus
aaagcacttcctgtgaggaggctct

SEQ ID NO: 12901 - DNA, 25 bp, Mus musculus
aaagcacttctaaaagacccacagt

SEQ ID NO: 12902 - DNA, 25 bp, Mus musculus
aaagcacttctataagacccacagt

SEQ ID NO: 12903 - DNA, 25 bp, Mus musculus
aaagcacttgacctttgacacagcc

SEQ ID NO: 12904 - DNA, 25 bp, Mus musculus
aaagcacttgacgtttgacacagcc

SEQ ID NO: 12905 - DNA, 25 bp, Mus musculus
aaagcactttggcaaattggcaatt

SEQ ID NO: 12906 - DNA, 25 bp, Mus musculus
aaagcactttgggaaattggcaatt

SEQ ID NO: 12907 - DNA, 25 bp, Mus musculus
aaagcacttttcatcatcttcacac

SEQ ID NO: 12908 - DNA, 25 bp, Mus musculus
aaagcacttttcttcatcttcacac

SEQ ID NO: 12909 - DNA, 25 bp, Mus musculus
aaagcagaaaccacactcagcacaa

SEQ ID NO: 12910 - DNA, 25 bp, Mus musculus
aaagcagaaaccctcccactggatg

SEQ ID NO: 12911 - DNA, 25 bp, Mus musculus
aaagcagaaaccgtcccactggatg

SEQ ID NO: 12912 - DNA, 25 bp, Mus musculus
aaagcagaaacctcactcagcacaa

SEQ ID NO: 12913 - DNA, 25 bp, Mus musculus
aaagcagaactcagaggcacctcct

SEQ ID NO: 12914 - DNA, 25 bp, Mus musculus
aaagcagaactctgaggcacctcct

SEQ ID NO: 12915 - DNA, 25 bp, Mus musculus
aaagcagaacttattcccactacct

SEQ ID NO: 12916 - DNA, 25 bp, Mus musculus
aaagcagaactttttcccactacct

SEQ ID NO: 12917 - DNA, 25 bp, Mus musculus
aaagcagaagtacgttccccactct

SEQ ID NO: 12918 - DNA, 25 bp, Mus musculus
aaagcagaagtaggttccccactct

SEQ ID NO: 12919 - DNA, 25 bp, Mus musculus
aaagcagacaaaaatcctccatata

SEQ ID NO: 12920 - DNA, 25 bp, Mus musculus
aaagcagacaaatatcctccatata

SEQ ID NO: 12921 - DNA, 25 bp, Mus musculus
aaagcagacaccacaggcgccagga

SEQ ID NO: 12922 - DNA, 25 bp, Mus musculus
aaagcagacacctcaggcgccagga

SEQ ID NO: 12923 - DNA, 25 bp, Mus musculus
aaagcagacacgactgccgtggaga

SEQ ID NO: 12924 - DNA, 25 bp, Mus musculus
aaagcagacacgtctgccgtggaga

SEQ ID NO: 12925 - DNA, 25 bp, Mus musculus
aaagcagacagtagggaggcaccat

SEQ ID NO: 12926 - DNA, 25 bp, Mus musculus
aaagcagacagttgggaggcaccat

SEQ ID NO: 12927 - DNA, 25 bp, Mus musculus
aaagcagacctgctgcagtcatccc

SEQ ID NO: 12928 - DNA, 25 bp, Mus musculus
aaagcagacctggtgcagtcatccc

SEQ ID NO: 12929 - DNA, 25 bp, Mus musculus
aaagcagactcacctgtcaaaccca

SEQ ID NO: 12930 - DNA, 25 bp, Mus musculus
aaagcagactcagctgtcaaaccca

SEQ ID NO: 12931 - DNA, 25 bp, Mus musculus
aaagcagactctaccaagtaatggc

SEQ ID NO: 12932 - DNA, 25 bp, Mus musculus
aaagcagactcttccaagtaatggc

SEQ ID NO: 12933 - DNA, 25 bp, Mus musculus
aaagcagactgactgcctggtgcac

SEQ ID NO: 12934 - DNA, 25 bp, Mus musculus
aaagcagactgagtgcctggtgcac

SEQ ID NO: 12935 - DNA, 25 bp, Mus musculus
aaagcagactggaccaaggagttct

SEQ ID NO: 12936 - DNA, 25 bp, Mus musculus
aaagcagactggtccaaggagttct

SEQ ID NO: 12937 - DNA, 25 bp, Mus musculus
aaagcagagaacatctcatgtgctg

SEQ ID NO: 12938 - DNA, 25 bp, Mus musculus
aaagcagagaacttctcatgtgctg

SEQ ID NO: 12939 - DNA, 25 bp, Mus musculus
aaagcagagacaagagtggattact

SEQ ID NO: 12940 - DNA, 25 bp, Mus musculus
aaagcagagacatgagtggattact

SEQ ID NO: 12941 - DNA, 25 bp, Mus musculus
aaagcagagccacacttagagtaca

SEQ ID NO: 12942 - DNA, 25 bp, Mus musculus
aaagcagagccagacttagagtaca

SEQ ID NO: 12943 - DNA, 25 bp, Mus musculus
aaagcagagctgagtctgtagagta

SEQ ID NO: 12944 - DNA, 25 bp, Mus musculus
aaagcagagctgtgtctgtagagta

SEQ ID NO: 12945 - DNA, 25 bp, Mus musculus
aaagcagaggttagtggtattagcc

SEQ ID NO: 12946 - DNA, 25 bp, Mus musculus
aaagcagaggtttgtggtattagcc

SEQ ID NO: 12947 - DNA, 25 bp, Mus musculus
aaagcagagtttccacagcgcaagt

SEQ ID NO: 12948 - DNA, 25 bp, Mus musculus
aaagcagagtttgcacagcgcaagt

SEQ ID NO: 12949 - DNA, 25 bp, Mus musculus
aaagcagatagccaggcccctggaa

SEQ ID NO: 12950 - DNA, 25 bp, Mus musculus
aaagcagatagcgaggcccctggaa

SEQ ID NO: 12951 - DNA, 25 bp, Mus musculus
aaagcagatattcagtgcactttac

SEQ ID NO: 12952 - DNA, 25 bp, Mus musculus
aaagcagatattgagtgcactttac

SEQ ID NO: 12953 - DNA, 25 bp, Mus musculus
aaagcagatcagcactagaagatgt

SEQ ID NO: 12954 - DNA, 25 bp, Mus musculus
aaagcagatcaggactagaagatgt

SEQ ID NO: 12955 - DNA, 25 bp, Mus musculus
aaagcagatcatcggacggccagtt

SEQ ID NO: 12956 - DNA, 25 bp, Mus musculus
aaagcagatcatgggacggccagtt

SEQ ID NO: 12957 - DNA, 25 bp, Mus musculus
aaagcagatccaaagcaaatgtgtg

SEQ ID NO: 12958 - DNA, 25 bp, Mus musculus
aaagcagatccatagcaaatgtgtg

SEQ ID NO: 12959 - DNA, 25 bp, Mus musculus
aaagcagatctaagctggtgacgta

SEQ ID NO: 12960 - DNA, 25 bp, Mus musculus
aaagcagatctatgctggtgacgta

SEQ ID NO: 12961 - DNA, 25 bp, Mus musculus
aaagcagatgctctctacacgggcc

SEQ ID NO: 12962 - DNA, 25 bp, Mus musculus
aaagcagatgctgtctacacgggcc

SEQ ID NO: 12963 - DNA, 25 bp, Mus musculus
aaagcagatgggactgtccaagcaa

SEQ ID NO: 12964 - DNA, 25 bp, Mus musculus
aaagcagatgggtctgtccaagcaa

SEQ ID NO: 12965 - DNA, 25 bp, Mus musculus
aaagcagatgtacccggtcatgcct

SEQ ID NO: 12966 - DNA, 25 bp, Mus musculus
aaagcagatgtagccggtcatgcct

SEQ ID NO: 12967 - DNA, 25 bp, Mus musculus
aaagcagatgtgatcgctgtcttgg

SEQ ID NO: 12968 - DNA, 25 bp, Mus musculus
aaagcagatgtgttcgctgtcttgg

SEQ ID NO: 12969 - DNA, 25 bp, Mus musculus
aaagcagatgttactgtgtactgta

SEQ ID NO: 12970 - DNA, 25 bp, Mus musculus
aaagcagatgtttctgtgtactgta

SEQ ID NO: 12971 - DNA, 25 bp, Mus musculus
aaagcagattaaaaacttagagact

SEQ ID NO: 12972 - DNA, 25 bp, Mus musculus
aaagcagattaataacttagagact

SEQ ID NO: 12973 - DNA, 25 bp, Mus musculus
aaagcagattcgatccgtgtgacca

SEQ ID NO: 12974 - DNA, 25 bp, Mus musculus
aaagcagattcgttccgtgtgacca

SEQ ID NO: 12975 - DNA, 25 bp, Mus musculus
aaagcagattggcagcctggagtcc

SEQ ID NO: 12976 - DNA, 25 bp, Mus musculus
aaagcagattgggagcctggagtcc

SEQ ID NO: 12977 - DNA, 25 bp, Mus musculus
aaagcagcaccgaccacgtgaaggt

SEQ ID NO: 12978 - DNA, 25 bp, Mus musculus
aaagcagcaccgtccacgtgaaggt

SEQ ID NO: 12979 - DNA, 25 bp, Mus musculus
aaagcagcacgtcccttgagagcca

SEQ ID NO: 12980 - DNA, 25 bp, Mus musculus
aaagcagcacgtgccttgagagcca

SEQ ID NO: 12981 - DNA, 25 bp, Mus musculus
aaagcagcactgagtttggcaccac

SEQ ID NO: 12982 - DNA, 25 bp, Mus musculus
aaagcagcactgtgtttggcaccac

SEQ ID NO: 12983 - DNA, 25 bp, Mus musculus
aaagcagcacttacagaactaccgc

SEQ ID NO: 12984 - DNA, 25 bp, Mus musculus
aaagcagcactttcagaactaccgc

SEQ ID NO: 12985 - DNA, 25 bp, Mus musculus
aaagcagcagatccagtccattcag

SEQ ID NO: 12986 - DNA, 25 bp, Mus musculus
aaagcagcagatgcagtccattcag

SEQ ID NO: 12987 - DNA, 25 bp, Mus musculus
aaagcagcagccaatgatatatatt

SEQ ID NO: 12988 - DNA, 25 bp, Mus musculus
aaagcagcagccaggactctgggtg

SEQ ID NO: 12989 - DNA, 25 bp, Mus musculus
aaagcagcagcccttgcagccgttg

SEQ ID NO: 12990 - DNA, 25 bp, Mus musculus
aaagcagcagccgttgcagccgttg

SEQ ID NO: 12991 - DNA, 25 bp, Mus musculus
aaagcagcagcctatgatatatatt

SEQ ID NO: 12992 - DNA, 25 bp, Mus musculus
aaagcagcagcctggactctgggtg

SEQ ID NO: 12993 - DNA, 25 bp, Mus musculus
aaagcagcagtgacttggtaatctt

SEQ ID NO: 12994 - DNA, 25 bp, Mus musculus
aaagcagcagtgtcttggtaatctt

SEQ ID NO: 12995 - DNA, 25 bp, Mus musculus
aaagcagcatacatgagtgtcccag

SEQ ID NO: 12996 - DNA, 25 bp, Mus musculus
aaagcagcatacttgagtgtcccag

SEQ ID NO: 12997 - DNA, 25 bp, Mus musculus
aaagcagcattaccgctggttttaa

SEQ ID NO: 12998 - DNA, 25 bp, Mus musculus
aaagcagcattagcgctggttttaa

SEQ ID NO: 12999 - DNA, 25 bp, Mus musculus
aaagcagccaacactgcaactccgg

SEQ ID NO: 13000 - DNA, 25 bp, Mus musculus
aaagcagccaactctgcaactccgg

SEQ ID NO: 13001 - DNA, 25 bp, Mus musculus
aaagcagccactaccctgggattga

SEQ ID NO: 13002 - DNA, 25 bp, Mus musculus
aaagcagccacttccctgggattga

SEQ ID NO: 13003 - DNA, 25 bp, Mus musculus
aaagcagccagtaatttctgtgtaa

SEQ ID NO: 13004 - DNA, 25 bp, Mus musculus
aaagcagccagttatttctgtgtaa

SEQ ID NO: 13005 - DNA, 25 bp, Mus musculus
aaagcagccattaacttgggtactt

SEQ ID NO: 13006 - DNA, 25 bp, Mus musculus
aaagcagccatttacttgggtactt

SEQ ID NO: 13007 - DNA, 25 bp, Mus musculus
aaagcagcccggctcatcagcagtg

SEQ ID NO: 13008 - DNA, 25 bp, Mus musculus
aaagcagcccgggtcatcagcagtg

SEQ ID NO: 13009 - DNA, 25 bp, Mus musculus
aaagcagcccgtatccacagagcag

SEQ ID NO: 13010 - DNA, 25 bp, Mus musculus
aaagcagcccgtttccacagagcag

SEQ ID NO: 13011 - DNA, 25 bp, Mus musculus
aaagcagccggcagaaactcttcat

SEQ ID NO: 13012 - DNA, 25 bp, Mus musculus
aaagcagccggctgaaactcttcat

SEQ ID NO: 13013 - DNA, 25 bp, Mus musculus
aaagcagcctcaaggtggcatctct

SEQ ID NO: 13014 - DNA, 25 bp, Mus musculus
aaagcagcctcactttagatgcaac

SEQ ID NO: 13015 - DNA, 25 bp, Mus musculus
aaagcagcctcagtttagatgcaac

SEQ ID NO: 13016 - DNA, 25 bp, Mus musculus
aaagcagcctcatggtggcatctct

SEQ ID NO: 13017 - DNA, 25 bp, Mus musculus
aaagcagcctctatgctagagaaga

SEQ ID NO: 13018 - DNA, 25 bp, Mus musculus
aaagcagcctctttgctagagaaga

SEQ ID NO: 13019 - DNA, 25 bp, Mus musculus
aaagcagcctgaactctgatctgaa

SEQ ID NO: 13020 - DNA, 25 bp, Mus musculus
aaagcagcctgaagaaagggactgt

SEQ ID NO: 13021 - DNA, 25 bp, Mus musculus
aaagcagcctgatctctgatctgaa

SEQ ID NO: 13022 - DNA, 25 bp, Mus musculus
aaagcagcctgatgaaagggactgt

SEQ ID NO: 13023 - DNA, 25 bp, Mus musculus
aaagcagccttcacacgtgtcagtg

SEQ ID NO: 13024 - DNA, 25 bp, Mus musculus
aaagcagccttctcacgtgtcagtg

SEQ ID NO: 13025 - DNA, 25 bp, Mus musculus
aaagcagcgaatctggacctcaaaa

SEQ ID NO: 13026 - DNA, 25 bp, Mus musculus
aaagcagcgaatgtggacctcaaaa

SEQ ID NO: 13027 - DNA, 25 bp, Mus musculus
aaagcagcgattctattgcccagaa

SEQ ID NO: 13028 - DNA, 25 bp, Mus musculus
aaagcagcgattgtattgcccagaa

SEQ ID NO: 13029 - DNA, 25 bp, Mus musculus
aaagcagcgcaactggctcggtgtt

SEQ ID NO: 13030 - DNA, 25 bp, Mus musculus
aaagcagcgcaagtggctcggtgtt

SEQ ID NO: 13031 - DNA, 25 bp, Mus musculus
aaagcagcgctgatgggtccagctc

SEQ ID NO: 13032 - DNA, 25 bp, Mus musculus
aaagcagcgctgttgggtccagctc

SEQ ID NO: 13033 - DNA, 25 bp, Mus musculus
aaagcagcggcaccatttgaagtcc

SEQ ID NO: 13034 - DNA, 25 bp, Mus musculus
aaagcagcggcagcatttgaagtcc

SEQ ID NO: 13035 - DNA, 25 bp, Mus musculus
aaagcagcggtcagtcttcagagac

SEQ ID NO: 13036 - DNA, 25 bp, Mus musculus
aaagcagcggtctgtcttcagagac

SEQ ID NO: 13037 - DNA, 25 bp, Mus musculus
aaagcagcggtgatatatttgatat

SEQ ID NO: 13038 - DNA, 25 bp, Mus musculus
aaagcagcggtgttatatttgatat

SEQ ID NO: 13039 - DNA, 25 bp, Mus musculus
aaagcagcgtctctggcagtcaaga

SEQ ID NO: 13040 - DNA, 25 bp, Mus musculus
aaagcagcgtctgtggcagtcaaga

SEQ ID NO: 13041 - DNA, 25 bp, Mus musculus
aaagcagctaagaccttcagcctgg

SEQ ID NO: 13042 - DNA, 25 bp, Mus musculus
aaagcagctaagtccttcagcctgg

SEQ ID NO: 13043 - DNA, 25 bp, Mus musculus
aaagcagctaggacaaatgtctgaa

SEQ ID NO: 13044 - DNA, 25 bp, Mus musculus
aaagcagctaggtcaaatgtctgaa

SEQ ID NO: 13045 - DNA, 25 bp, Mus musculus
aaagcagctagtcgtttctttgtct

SEQ ID NO: 13046 - DNA, 25 bp, Mus musculus
aaagcagctagtggtttctttgtct

SEQ ID NO: 13047 - DNA, 25 bp, Mus musculus
aaagcagctcttatcaccatgggaa

SEQ ID NO: 13048 - DNA, 25 bp, Mus musculus
aaagcagctcttttcaccatgggaa

SEQ ID NO: 13049 - DNA, 25 bp, Mus musculus
aaagcagctgaacggaatggcgaca

SEQ ID NO: 13050 - DNA, 25 bp, Mus musculus
aaagcagctgaagggaatggcgaca

SEQ ID NO: 13051 - DNA, 25 bp, Mus musculus
aaagcagctgacatgtttccaacct

SEQ ID NO: 13052 - DNA, 25 bp, Mus musculus
aaagcagctgacttgtttccaacct

SEQ ID NO: 13053 - DNA, 25 bp, Mus musculus
aaagcagctgccatactgtgtttaa

SEQ ID NO: 13054 - DNA, 25 bp, Mus musculus
aaagcagctgccatcattacccttt

SEQ ID NO: 13055 - DNA, 25 bp, Mus musculus
aaagcagctgccttactgtgtttaa

SEQ ID NO: 13056 - DNA, 25 bp, Mus musculus
aaagcagctgccttcattacccttt

SEQ ID NO: 13057 - DNA, 25 bp, Mus musculus
aaagcagctgctaccttattttaga

SEQ ID NO: 13058 - DNA, 25 bp, Mus musculus
aaagcagctgcttccttattttaga

SEQ ID NO: 13059 - DNA, 25 bp, Mus musculus
aaagcagctggtattctcataatat

SEQ ID NO: 13060 - DNA, 25 bp, Mus musculus
aaagcagctggtccactacacggct

SEQ ID NO: 13061 - DNA, 25 bp, Mus musculus
aaagcagctggtgcactacacggct

SEQ ID NO: 13062 - DNA, 25 bp, Mus musculus
aaagcagctggttttctcataatat

SEQ ID NO: 13063 - DNA, 25 bp, Mus musculus
aaagcagctgtcaatctcctgatct

SEQ ID NO: 13064 - DNA, 25 bp, Mus musculus
aaagcagctgtctatctcctgatct

SEQ ID NO: 13065 - DNA, 25 bp, Mus musculus
aaagcagctgtgagtaggtttttct

SEQ ID NO: 13066 - DNA, 25 bp, Mus musculus
aaagcagctgtgtgtaggtttttct

SEQ ID NO: 13067 - DNA, 25 bp, Mus musculus
aaagcagcttatatacagttatctt

SEQ ID NO: 13068 - DNA, 25 bp, Mus musculus
aaagcagcttatttacagttatctt

SEQ ID NO: 13069 - DNA, 25 bp, Mus musculus
aaagcagcttggacagagaaaatga

SEQ ID NO: 13070 - DNA, 25 bp, Mus musculus
aaagcagcttggtcagagaaaatga

SEQ ID NO: 13071 - DNA, 25 bp, Mus musculus
aaagcaggaagccactctgggtgat

SEQ ID NO: 13072 - DNA, 25 bp, Mus musculus
aaagcaggaagcgactctgggtgat

SEQ ID NO: 13073 - DNA, 25 bp, Mus musculus
aaagcaggacctcttgacgggaatt

SEQ ID NO: 13074 - DNA, 25 bp, Mus musculus
aaagcaggacctgttgacgggaatt

SEQ ID NO: 13075 - DNA, 25 bp, Mus musculus
aaagcaggactacatcctcagagat

SEQ ID NO: 13076 - DNA, 25 bp, Mus musculus
aaagcaggactagatcctcagagat

SEQ ID NO: 13077 - DNA, 25 bp, Mus musculus
aaagcaggagctacctgccgactcg

SEQ ID NO: 13078 - DNA, 25 bp, Mus musculus
aaagcaggagctctcgggagtccat

SEQ ID NO: 13079 - DNA, 25 bp, Mus musculus
aaagcaggagctgtcgggagtccat

SEQ ID NO: 13080 - DNA, 25 bp, Mus musculus
aaagcaggagcttcctgccgactcg

SEQ ID NO: 13081 - DNA, 25 bp, Mus musculus
aaagcaggatgcacggtctgtaggt

SEQ ID NO: 13082 - DNA, 25 bp, Mus musculus
aaagcaggatgctcggtctgtaggt

SEQ ID NO: 13083 - DNA, 25 bp, Mus musculus
aaagcaggcaaacccaattcctgac

SEQ ID NO: 13084 - DNA, 25 bp, Mus musculus
aaagcaggcaaagccaattcctgac

SEQ ID NO: 13085 - DNA, 25 bp, Mus musculus
aaagcaggcagccacagacccattt

SEQ ID NO: 13086 - DNA, 25 bp, Mus musculus
aaagcaggcagcgacagacccattt

SEQ ID NO: 13087 - DNA, 25 bp, Mus musculus
aaagcaggcagtaatgtcattcatt

SEQ ID NO: 13088 - DNA, 25 bp, Mus musculus
aaagcaggcagttatgtcattcatt

SEQ ID NO: 13089 - DNA, 25 bp, Mus musculus
aaagcaggcattctgggaggccaaa

SEQ ID NO: 13090 - DNA, 25 bp, Mus musculus
aaagcaggcattgtgggaggccaaa

SEQ ID NO: 13091 - DNA, 25 bp, Mus musculus
aaagcaggccacatggtccttccgt

SEQ ID NO: 13092 - DNA, 25 bp, Mus musculus
aaagcaggccacttggtccttccgt

SEQ ID NO: 13093 - DNA, 25 bp, Mus musculus
aaagcaggccagattcagaaacaca

SEQ ID NO: 13094 - DNA, 25 bp, Mus musculus
aaagcaggccagtttcagaaacaca

SEQ ID NO: 13095 - DNA, 25 bp, Mus musculus
aaagcaggccttacctcagatgggt

SEQ ID NO: 13096 - DNA, 25 bp, Mus musculus
aaagcaggcctttcctcagatgggt

SEQ ID NO: 13097 - DNA, 25 bp, Mus musculus
aaagcaggcgctcaacggcctttct

SEQ ID NO: 13098 - DNA, 25 bp, Mus musculus
aaagcaggcgctgaacggcctttct

SEQ ID NO: 13099 - DNA, 25 bp, Mus musculus
aaagcaggcttcagcggtcagaata

SEQ ID NO: 13100 - DNA, 25 bp, Mus musculus
aaagcaggcttcatggcttgctctg

SEQ ID NO: 13101 - DNA, 25 bp, Mus musculus
aaagcaggcttctgcggtcagaata

SEQ ID NO: 13102 - DNA, 25 bp, Mus musculus
aaagcaggcttcttggcttgctctg

SEQ ID NO: 13103 - DNA, 25 bp, Mus musculus
aaagcagggacgcatgtaaaggaat

SEQ ID NO: 13104 - DNA, 25 bp, Mus musculus
aaagcagggacggatgtaaaggaat

SEQ ID NO: 13105 - DNA, 25 bp, Mus musculus
aaagcagggcagacattgcgatccc

SEQ ID NO: 13106 - DNA, 25 bp, Mus musculus
aaagcagggcagtcattgcgatccc

SEQ ID NO: 13107 - DNA, 25 bp, Mus musculus
aaagcagggcttactgtgagacttt

SEQ ID NO: 13108 - DNA, 25 bp, Mus musculus
aaagcagggctttctgtgagacttt

SEQ ID NO: 13109 - DNA, 25 bp, Mus musculus
aaagcagggtccctgtttgctgcct

SEQ ID NO: 13110 - DNA, 25 bp, Mus musculus
aaagcagggtccgtgtttgctgcct

SEQ ID NO: 13111 - DNA, 25 bp, Mus musculus
aaagcaggtcacatgatggtagcag

SEQ ID NO: 13112 - DNA, 25 bp, Mus musculus
aaagcaggtcacttgatggtagcag

SEQ ID NO: 13113 - DNA, 25 bp, Mus musculus
aaagcaggtctactatcgcctcaga

SEQ ID NO: 13114 - DNA, 25 bp, Mus musculus
aaagcaggtctagtatcgcctcaga

SEQ ID NO: 13115 - DNA, 25 bp, Mus musculus
aaagcaggtgtcatcctgatggcct

SEQ ID NO: 13116 - DNA, 25 bp, Mus musculus
aaagcaggtgtcttcctgatggcct

SEQ ID NO: 13117 - DNA, 25 bp, Mus musculus
aaagcaggttgactcctgtaagcca

SEQ ID NO: 13118 - DNA, 25 bp, Mus musculus
aaagcaggttgagtcctgtaagcca

SEQ ID NO: 13119 - DNA, 25 bp, Mus musculus
aaagcaggttttccactcttatggc

SEQ ID NO: 13120 - DNA, 25 bp, Mus musculus
aaagcaggttttgcactcttatggc

SEQ ID NO: 13121 - DNA, 25 bp, Mus musculus
aaagcagtaagtccagacggcctga

SEQ ID NO: 13122 - DNA, 25 bp, Mus musculus
aaagcagtaagtgcagacggcctga

SEQ ID NO: 13123 - DNA, 25 bp, Mus musculus
aaagcagtaatgcttatggcctaga

SEQ ID NO: 13124 - DNA, 25 bp, Mus musculus
aaagcagtaatggttatggcctaga

SEQ ID NO: 13125 - DNA, 25 bp, Mus musculus
aaagcagtacaaccggtcaggcacc

SEQ ID NO: 13126 - DNA, 25 bp, Mus musculus
aaagcagtacaagcggtcaggcacc

SEQ ID NO: 13127 - DNA, 25 bp, Mus musculus
aaagcagtacaccatctacatcgct

SEQ ID NO: 13128 - DNA, 25 bp, Mus musculus
aaagcagtacacgatctacatcgct

SEQ ID NO: 13129 - DNA, 25 bp, Mus musculus
aaagcagtaggaagggactctagga

SEQ ID NO: 13130 - DNA, 25 bp, Mus musculus
aaagcagtaggatgggactctagga

SEQ ID NO: 13131 - DNA, 25 bp, Mus musculus
aaagcagtcaacaggagtgcctcct

SEQ ID NO: 13132 - DNA, 25 bp, Mus musculus
aaagcagtcaacctaactggaggtg

SEQ ID NO: 13133 - DNA, 25 bp, Mus musculus
aaagcagtcaacgtaactggaggtg

SEQ ID NO: 13134 - DNA, 25 bp, Mus musculus
aaagcagtcaactggagtgcctcct

SEQ ID NO: 13135 - DNA, 25 bp, Mus musculus
aaagcagtcaccacacatagaggat

SEQ ID NO: 13136 - DNA, 25 bp, Mus musculus
aaagcagtcacctcacatagaggat

SEQ ID NO: 13137 - DNA, 25 bp, Mus musculus
aaagcagtcactcctagtccctagt

SEQ ID NO: 13138 - DNA, 25 bp, Mus musculus
aaagcagtcactctctttccgcgtt

SEQ ID NO: 13139 - DNA, 25 bp, Mus musculus
aaagcagtcactgctagtccctagt

SEQ ID NO: 13140 - DNA, 25 bp, Mus musculus
aaagcagtcactgtctttccgcgtt

SEQ ID NO: 13141 - DNA, 25 bp, Mus musculus
aaagcagtccacaaaattatagtcc

SEQ ID NO: 13142 - DNA, 25 bp, Mus musculus
aaagcagtccactaaattatagtcc

SEQ ID NO: 13143 - DNA, 25 bp, Mus musculus
aaagcagtcctgcacggctcagggt

SEQ ID NO: 13144 - DNA, 25 bp, Mus musculus
aaagcagtcctggacggctcagggt

SEQ ID NO: 13145 - DNA, 25 bp, Mus musculus
aaagcagtccttactggaggtcaga

SEQ ID NO: 13146 - DNA, 25 bp, Mus musculus
aaagcagtccttaggcatgtccaga

SEQ ID NO: 13147 - DNA, 25 bp, Mus musculus
aaagcagtcctttctggaggtcaga

SEQ ID NO: 13148 - DNA, 25 bp, Mus musculus
aaagcagtcctttggcatgtccaga

SEQ ID NO: 13149 - DNA, 25 bp, Mus musculus
aaagcagtctgcatgctattccatc

SEQ ID NO: 13150 - DNA, 25 bp, Mus musculus
aaagcagtctgcattccgacagaca

SEQ ID NO: 13151 - DNA, 25 bp, Mus musculus
aaagcagtctgcttgctattccatc

SEQ ID NO: 13152 - DNA, 25 bp, Mus musculus
aaagcagtctgctttccgacagaca

SEQ ID NO: 13153 - DNA, 25 bp, Mus musculus
aaagcagtgactagcttgccttggc

SEQ ID NO: 13154 - DNA, 25 bp, Mus musculus
aaagcagtgacttgcttgccttggc

SEQ ID NO: 13155 - DNA, 25 bp, Mus musculus
aaagcagtgccgacgtcacaaagaa

SEQ ID NO: 13156 - DNA, 25 bp, Mus musculus
aaagcagtgccgtcgtcacaaagaa

SEQ ID NO: 13157 - DNA, 25 bp, Mus musculus
aaagcagtgctccagatggtggcca

SEQ ID NO: 13158 - DNA, 25 bp, Mus musculus
aaagcagtgctcgagatggtggcca

SEQ ID NO: 13159 - DNA, 25 bp, Mus musculus
aaagcagtgcttaggtattcctaca

SEQ ID NO: 13160 - DNA, 25 bp, Mus musculus
aaagcagtgctttggtattcctaca

SEQ ID NO: 13161 - DNA, 25 bp, Mus musculus
aaagcagtggctcatcgtaccgcag

SEQ ID NO: 13162 - DNA, 25 bp, Mus musculus
aaagcagtggctgatcgtaccgcag

SEQ ID NO: 13163 - DNA, 25 bp, Mus musculus
aaagcagtgggcacacttttctgct

SEQ ID NO: 13164 - DNA, 25 bp, Mus musculus
aaagcagtgggctcacttttctgct

SEQ ID NO: 13165 - DNA, 25 bp, Mus musculus
aaagcagtggtacccaatacgatgg

SEQ ID NO: 13166 - DNA, 25 bp, Mus musculus
aaagcagtggtagccaatacgatgg

SEQ ID NO: 13167 - DNA, 25 bp, Mus musculus
aaagcagtggttatggcagcagttt

SEQ ID NO: 13168 - DNA, 25 bp, Mus musculus
aaagcagtggttttggcagcagttt

SEQ ID NO: 13169 - DNA, 25 bp, Mus musculus
aaagcagtgttcactgcatcaacta

SEQ ID NO: 13170 - DNA, 25 bp, Mus musculus
aaagcagtgttctctgcatcaacta

SEQ ID NO: 13171 - DNA, 25 bp, Mus musculus
aaagcagttacgcaccctggaagat

SEQ ID NO: 13172 - DNA, 25 bp, Mus musculus
aaagcagttacggaccctggaagat

SEQ ID NO: 13173 - DNA, 25 bp, Mus musculus
aaagcagttactcgaggactccacc

SEQ ID NO: 13174 - DNA, 25 bp, Mus musculus
aaagcagttactggaggactccacc

SEQ ID NO: 13175 - DNA, 25 bp, Mus musculus
aaagcagttcatctgtacctcagcc

SEQ ID NO: 13176 - DNA, 25 bp, Mus musculus
aaagcagttcatgtgtacctcagcc

SEQ ID NO: 13177 - DNA, 25 bp, Mus musculus
aaagcagttcccagtgttcttggaa

SEQ ID NO: 13178 - DNA, 25 bp, Mus musculus
aaagcagttcccatgaaaggacagt

SEQ ID NO: 13179 - DNA, 25 bp, Mus musculus
aaagcagttccctgtgttcttggaa

SEQ ID NO: 13180 - DNA, 25 bp, Mus musculus
aaagcagttcccttgaaaggacagt

SEQ ID NO: 13181 - DNA, 25 bp, Mus musculus
aaagcagttcttctcacacctttcc

SEQ ID NO: 13182 - DNA, 25 bp, Mus musculus
aaagcagttcttgtcacacctttcc

SEQ ID NO: 13183 - DNA, 25 bp, Mus musculus
aaagcagttgctaggtacttaccac

SEQ ID NO: 13184 - DNA, 25 bp, Mus musculus
aaagcagttgcttggtacttaccac

SEQ ID NO: 13185 - DNA, 25 bp, Mus musculus
aaagcagttgtcctcgattcttgcc

SEQ ID NO: 13186 - DNA, 25 bp, Mus musculus
aaagcagttgtcgtcgattcttgcc

SEQ ID NO: 13187 - DNA, 25 bp, Mus musculus
aaagcagttgttactagggtgggca

SEQ ID NO: 13188 - DNA, 25 bp, Mus musculus
aaagcagttgttacttgtagccatc

SEQ ID NO: 13189 - DNA, 25 bp, Mus musculus
aaagcagttgtttctagggtgggca

SEQ ID NO: 13190 - DNA, 25 bp, Mus musculus
aaagcagttgtttcttgtagccatc

SEQ ID NO: 13191 - DNA, 25 bp, Mus musculus
aaagcagtttccctcagtattcagg

SEQ ID NO: 13192 - DNA, 25 bp, Mus musculus
aaagcagtttccgtcagtattcagg

SEQ ID NO: 13193 - DNA, 25 bp, Mus musculus
aaagcagttttgctacttgctcctg

SEQ ID NO: 13194 - DNA, 25 bp, Mus musculus
aaagcagttttggtacttgctcctg

SEQ ID NO: 13195 - DNA, 25 bp, Mus musculus
aaagcataaagaagcctggcgtggc

SEQ ID NO: 13196 - DNA, 25 bp, Mus musculus
aaagcataaagatgcctggcgtggc

SEQ ID NO: 13197 - DNA, 25 bp, Mus musculus
aaagcataacgaaccttgtgtgtgt

SEQ ID NO: 13198 - DNA, 25 bp, Mus musculus
aaagcataacgatccttgtgtgtgt

SEQ ID NO: 13199 - DNA, 25 bp, Mus musculus
aaagcataacttcacgtcagtattt

SEQ ID NO: 13200 - DNA, 25 bp, Mus musculus
aaagcataacttgacgtcagtattt

SEQ ID NO: 13201 - DNA, 25 bp, Mus musculus
aaagcataccatcggatttccttac

SEQ ID NO: 13202 - DNA, 25 bp, Mus musculus
aaagcataccatgggatttccttac

SEQ ID NO: 13203 - DNA, 25 bp, Mus musculus
aaagcatacccgattctggatgaga

SEQ ID NO: 13204 - DNA, 25 bp, Mus musculus
aaagcatacccgtttctggatgaga

SEQ ID NO: 13205 - DNA, 25 bp, Mus musculus
aaagcatactcacccagacttctca

SEQ ID NO: 13206 - DNA, 25 bp, Mus musculus
aaagcatactcagccagacttctca

SEQ ID NO: 13207 - DNA, 25 bp, Mus musculus
aaagcatacttcctctcagaacaag

SEQ ID NO: 13208 - DNA, 25 bp, Mus musculus
aaagcatacttcgtctcagaacaag

SEQ ID NO: 13209 - DNA, 25 bp, Mus musculus
aaagcatagaggatgaagccataaa

SEQ ID NO: 13210 - DNA, 25 bp, Mus musculus
aaagcatagaggttgaagccataaa

SEQ ID NO: 13211 - DNA, 25 bp, Mus musculus
aaagcatagatgagccatggcacgt

SEQ ID NO: 13212 - DNA, 25 bp, Mus musculus
aaagcatagatgtgccatggcacgt

SEQ ID NO: 13213 - DNA, 25 bp, Mus musculus
aaagcatagccgagctgacctcaca

SEQ ID NO: 13214 - DNA, 25 bp, Mus musculus
aaagcatagccgtgctgacctcaca

SEQ ID NO: 13215 - DNA, 25 bp, Mus musculus
aaagcatagcgtcttctctggcaac

SEQ ID NO: 13216 - DNA, 25 bp, Mus musculus
aaagcatagcgtgttctctggcaac

SEQ ID NO: 13217 - DNA, 25 bp, Mus musculus
aaagcataggcaactccacacacga

SEQ ID NO: 13218 - DNA, 25 bp, Mus musculus
aaagcataggcatctccacacacga

SEQ ID NO: 13219 - DNA, 25 bp, Mus musculus
aaagcatagtaaaggctggccagga

SEQ ID NO: 13220 - DNA, 25 bp, Mus musculus
aaagcatagtaatggctggccagga

SEQ ID NO: 13221 - DNA, 25 bp, Mus musculus
aaagcatagtcaagtcctgtcctta

SEQ ID NO: 13222 - DNA, 25 bp, Mus musculus
aaagcatagtcatgtcctgtcctta

SEQ ID NO: 13223 - DNA, 25 bp, Mus musculus
aaagcatatacccttgttccacagg

SEQ ID NO: 13224 - DNA, 25 bp, Mus musculus
aaagcatataccgttgttccacagg

SEQ ID NO: 13225 - DNA, 25 bp, Mus musculus
aaagcatatcgaacacacattgaga

SEQ ID NO: 13226 - DNA, 25 bp, Mus musculus
aaagcatatcgatcacacattgaga

SEQ ID NO: 13227 - DNA, 25 bp, Mus musculus
aaagcatattctcccttctgtagac

SEQ ID NO: 13228 - DNA, 25 bp, Mus musculus
aaagcatattctgccttctgtagac

SEQ ID NO: 13229 - DNA, 25 bp, Mus musculus
aaagcatcaagaagtctggcatggc

SEQ ID NO: 13230 - DNA, 25 bp, Mus musculus
aaagcatcaagatgtctggcatggc

SEQ ID NO: 13231 - DNA, 25 bp, Mus musculus
aaagcatcaaggaggcctccatggc

SEQ ID NO: 13232 - DNA, 25 bp, Mus musculus
aaagcatcaaggtggcctccatggc

SEQ ID NO: 13233 - DNA, 25 bp, Mus musculus
aaagcatcactgaggtgcaggagcc

SEQ ID NO: 13234 - DNA, 25 bp, Mus musculus
aaagcatcactgtggtgcaggagcc

SEQ ID NO: 13235 - DNA, 25 bp, Mus musculus
aaagcatcagaaactcatggcatta

SEQ ID NO: 13236 - DNA, 25 bp, Mus musculus
aaagcatcagaatctcatggcatta

SEQ ID NO: 13237 - DNA, 25 bp, Mus musculus
aaagcatcagctacacacggacaag

SEQ ID NO: 13238 - DNA, 25 bp, Mus musculus
aaagcatcagcttcacacggacaag

SEQ ID NO: 13239 - DNA, 25 bp, Mus musculus
aaagcatcaggtcccatcagattta

SEQ ID NO: 13240 - DNA, 25 bp, Mus musculus
aaagcatcaggtgccatcagattta

SEQ ID NO: 13241 - DNA, 25 bp, Mus musculus
aaagcatcatcacgaggcactcagc

SEQ ID NO: 13242 - DNA, 25 bp, Mus musculus
aaagcatcatcaggaggcactcagc

SEQ ID NO: 13243 - DNA, 25 bp, Mus musculus
aaagcatcatctactgctgacctgc

SEQ ID NO: 13244 - DNA, 25 bp, Mus musculus
aaagcatcatcttctgctgacctgc

SEQ ID NO: 13245 - DNA, 25 bp, Mus musculus
aaagcatcccacaagtggagtcatg

SEQ ID NO: 13246 - DNA, 25 bp, Mus musculus
aaagcatcccactagtggagtcatg

SEQ ID NO: 13247 - DNA, 25 bp, Mus musculus
aaagcatcccagcatctctggcctt

SEQ ID NO: 13248 - DNA, 25 bp, Mus musculus
aaagcatcccaggatctctggcctt

SEQ ID NO: 13249 - DNA, 25 bp, Mus musculus
aaagcatcccctcttgttcatttta

SEQ ID NO: 13250 - DNA, 25 bp, Mus musculus
aaagcatcccctgttgttcatttta

SEQ ID NO: 13251 - DNA, 25 bp, Mus musculus
aaagcatccgagaagagaggttctt

SEQ ID NO: 13252 - DNA, 25 bp, Mus musculus
aaagcatccgagcagcatcagcagc

SEQ ID NO: 13253 - DNA, 25 bp, Mus musculus
aaagcatccgaggagcatcagcagc

SEQ ID NO: 13254 - DNA, 25 bp, Mus musculus
aaagcatccgagtagagaggttctt

SEQ ID NO: 13255 - DNA, 25 bp, Mus musculus
aaagcatccgcaacaagcatcagat

SEQ ID NO: 13256 - DNA, 25 bp, Mus musculus
aaagcatccgcatcaagcatcagat

SEQ ID NO: 13257 - DNA, 25 bp, Mus musculus
aaagcatcctctaatggcatgtcaa

SEQ ID NO: 13258 - DNA, 25 bp, Mus musculus
aaagcatcctctcccagtgttggta

SEQ ID NO: 13259 - DNA, 25 bp, Mus musculus
aaagcatcctctgccagtgttggta

SEQ ID NO: 13260 - DNA, 25 bp, Mus musculus
aaagcatcctcttatggcatgtcaa

SEQ ID NO: 13261 - DNA, 25 bp, Mus musculus
aaagcatccttaagttttccccgat

SEQ ID NO: 13262 - DNA, 25 bp, Mus musculus
aaagcatccttaccttgcccaggag

SEQ ID NO: 13263 - DNA, 25 bp, Mus musculus
aaagcatccttagcttgcccaggag

SEQ ID NO: 13264 - DNA, 25 bp, Mus musculus
aaagcatccttatgttttccccgat

SEQ ID NO: 13265 - DNA, 25 bp, Mus musculus
aaagcatccttcatctgcattccat

SEQ ID NO: 13266 - DNA, 25 bp, Mus musculus
aaagcatccttcttctgcattccat

SEQ ID NO: 13267 - DNA, 25 bp, Mus musculus
aaagcatcggctacaagtgccgtcc

SEQ ID NO: 13268 - DNA, 25 bp, Mus musculus
aaagcatcggcttcaagtgccgtcc

SEQ ID NO: 13269 - DNA, 25 bp, Mus musculus
aaagcatctgatctgtgtccactct

SEQ ID NO: 13270 - DNA, 25 bp, Mus musculus
aaagcatctgatgtgtgtccactct

SEQ ID NO: 13271 - DNA, 25 bp, Mus musculus
aaagcatctgtgaactgtaaggcca

SEQ ID NO: 13272 - DNA, 25 bp, Mus musculus
aaagcatctgtgtactgtaaggcca

SEQ ID NO: 13273 - DNA, 25 bp, Mus musculus
aaagcatgaataatcatctggaagc

SEQ ID NO: 13274 - DNA, 25 bp, Mus musculus
aaagcatgaatacctgagtttggac

SEQ ID NO: 13275 - DNA, 25 bp, Mus musculus
aaagcatgaatagctgagtttggac

SEQ ID NO: 13276 - DNA, 25 bp, Mus musculus
aaagcatgaatattcatctggaagc

SEQ ID NO: 13277 - DNA, 25 bp, Mus musculus
aaagcatgacccaggcgggtcgact

SEQ ID NO: 13278 - DNA, 25 bp, Mus musculus
aaagcatgaccctggcgggtcgact

SEQ ID NO: 13279 - DNA, 25 bp, Mus musculus
aaagcatgactcagacttgtcagca

SEQ ID NO: 13280 - DNA, 25 bp, Mus musculus
aaagcatgactctgacttgtcagca

SEQ ID NO: 13281 - DNA, 25 bp, Mus musculus
aaagcatgagcaatcctcccagaaa

SEQ ID NO: 13282 - DNA, 25 bp, Mus musculus
aaagcatgagcattcctcccagaaa

SEQ ID NO: 13283 - DNA, 25 bp, Mus musculus
aaagcatgatgtacaaagaagccag

SEQ ID NO: 13284 - DNA, 25 bp, Mus musculus
aaagcatgatgttcaaagaagccag

SEQ ID NO: 13285 - DNA, 25 bp, Mus musculus
aaagcatgcaaccttgctggtccaa

SEQ ID NO: 13286 - DNA, 25 bp, Mus musculus
aaagcatgcaacgttgctggtccaa

SEQ ID NO: 13287 - DNA, 25 bp, Mus musculus
aaagcatgcataatcctcgtgatcc

SEQ ID NO: 13288 - DNA, 25 bp, Mus musculus
aaagcatgcatattcctcgtgatcc

SEQ ID NO: 13289 - DNA, 25 bp, Mus musculus
aaagcatgcgcccagcagtggagaa

SEQ ID NO: 13290 - DNA, 25 bp, Mus musculus
aaagcatgcgccgagcagtggagaa

SEQ ID NO: 13291 - DNA, 25 bp, Mus musculus
aaagcatgctggctgagtcgcccaa

SEQ ID NO: 13292 - DNA, 25 bp, Mus musculus
aaagcatgctgggtgagtcgcccaa

SEQ ID NO: 13293 - DNA, 25 bp, Mus musculus
aaagcatggactctgccaaacaccc

SEQ ID NO: 13294 - DNA, 25 bp, Mus musculus
aaagcatggactgtgccaaacaccc

SEQ ID NO: 13295 - DNA, 25 bp, Mus musculus
aaagcatggagcaccatctgcttct

SEQ ID NO: 13296 - DNA, 25 bp, Mus musculus
aaagcatggagctccatctgcttct

SEQ ID NO: 13297 - DNA, 25 bp, Mus musculus
aaagcatggcaaccattcgatccga

SEQ ID NO: 13298 - DNA, 25 bp, Mus musculus
aaagcatggcaagcattcgatccga

SEQ ID NO: 13299 - DNA, 25 bp, Mus musculus
aaagcatggcacagggaccttgaat

SEQ ID NO: 13300 - DNA, 25 bp, Mus musculus
aaagcatggcactgggaccttgaat

SEQ ID NO: 13301 - DNA, 25 bp, Mus musculus
aaagcatggcatcacttccagcctg

SEQ ID NO: 13302 - DNA, 25 bp, Mus musculus
aaagcatggcatgacttccagcctg

SEQ ID NO: 13303 - DNA, 25 bp, Mus musculus
aaagcatgggccaccttagtgtaaa

SEQ ID NO: 13304 - DNA, 25 bp, Mus musculus
aaagcatgggcctccttagtgtaaa

SEQ ID NO: 13305 - DNA, 25 bp, Mus musculus
aaagcatgggcgagttctgttccct

SEQ ID NO: 13306 - DNA, 25 bp, Mus musculus
aaagcatgggcgtgttctgttccct

SEQ ID NO: 13307 - DNA, 25 bp, Mus musculus
aaagcatggtgcaggtaacagttca

SEQ ID NO: 13308 - DNA, 25 bp, Mus musculus
aaagcatggtgcctttaacccaaag

SEQ ID NO: 13309 - DNA, 25 bp, Mus musculus
aaagcatggtgcgtttaacccaaag

SEQ ID NO: 13310 - DNA, 25 bp, Mus musculus
aaagcatggtgctggtaacagttca

SEQ ID NO: 13311 - DNA, 25 bp, Mus musculus
aaagcatgtatcacacctgacactg

SEQ ID NO: 13312 - DNA, 25 bp, Mus musculus
aaagcatgtatctcacctgacactg

SEQ ID NO: 13313 - DNA, 25 bp, Mus musculus
aaagcatgtcccatgaactgtggcc

SEQ ID NO: 13314 - DNA, 25 bp, Mus musculus
aaagcatgtcccttgaactgtggcc

SEQ ID NO: 13315 - DNA, 25 bp, Mus musculus
aaagcatgtgctaccttgatgagga

SEQ ID NO: 13316 - DNA, 25 bp, Mus musculus
aaagcatgtgcttccttgatgagga

SEQ ID NO: 13317 - DNA, 25 bp, Mus musculus
aaagcatgtggtagcactcctggct

SEQ ID NO: 13318 - DNA, 25 bp, Mus musculus
aaagcatgtggttgcactcctggct

SEQ ID NO: 13319 - DNA, 25 bp, Mus musculus
aaagcatgtttgagtgccgatggct

SEQ ID NO: 13320 - DNA, 25 bp, Mus musculus
aaagcatgtttgtgtgccgatggct

SEQ ID NO: 13321 - DNA, 25 bp, Mus musculus
aaagcatgttttccatacccatggc

SEQ ID NO: 13322 - DNA, 25 bp, Mus musculus
aaagcatgttttgcatacccatggc

SEQ ID NO: 13323 - DNA, 25 bp, Mus musculus
aaagcattagatctcctcgtttccc

SEQ ID NO: 13324 - DNA, 25 bp, Mus musculus
aaagcattagatgtcctcgtttccc

SEQ ID NO: 13325 - DNA, 25 bp, Mus musculus
aaagcattattcaggcaaagccgat

SEQ ID NO: 13326 - DNA, 25 bp, Mus musculus
aaagcattattctggcaaagccgat

SEQ ID NO: 13327 - DNA, 25 bp, Mus musculus
aaagcattccacagttaacaccatc

SEQ ID NO: 13328 - DNA, 25 bp, Mus musculus
aaagcattccactgttaacaccatc

SEQ ID NO: 13329 - DNA, 25 bp, Mus musculus
aaagcattccccatttgcaacaaag

SEQ ID NO: 13330 - DNA, 25 bp, Mus musculus
aaagcattccccttttgcaacaaag

SEQ ID NO: 13331 - DNA, 25 bp, Mus musculus
aaagcattctcaacgttgccacagc

SEQ ID NO: 13332 - DNA, 25 bp, Mus musculus
aaagcattctcatcgttgccacagc

SEQ ID NO: 13333 - DNA, 25 bp, Mus musculus
aaagcattcttgatacatactggtc

SEQ ID NO: 13334 - DNA, 25 bp, Mus musculus
aaagcattcttgttacatactggtc

SEQ ID NO: 13335 - DNA, 25 bp, Mus musculus
aaagcattgaccaactattcccagc

SEQ ID NO: 13336 - DNA, 25 bp, Mus musculus
aaagcattgacctactattcccagc

SEQ ID NO: 13337 - DNA, 25 bp, Mus musculus
aaagcattgacgctttcctggtcca

SEQ ID NO: 13338 - DNA, 25 bp, Mus musculus
aaagcattgacggtttcctggtcca

SEQ ID NO: 13339 - DNA, 25 bp, Mus musculus
aaagcattgagaaccttgtgtttta

SEQ ID NO: 13340 - DNA, 25 bp, Mus musculus
aaagcattgagatccttgtgtttta

SEQ ID NO: 13341 - DNA, 25 bp, Mus musculus
aaagcattgcaccttatagatccag

SEQ ID NO: 13342 - DNA, 25 bp, Mus musculus
aaagcattgcacgttatagatccag

SEQ ID NO: 13343 - DNA, 25 bp, Mus musculus
aaagcattgcagctccttctttggt

SEQ ID NO: 13344 - DNA, 25 bp, Mus musculus
aaagcattgcaggtccttctttggt

SEQ ID NO: 13345 - DNA, 25 bp, Mus musculus
aaagcattgcatctttgtgacacgt

SEQ ID NO: 13346 - DNA, 25 bp, Mus musculus
aaagcattgcatgtttgtgacacgt

SEQ ID NO: 13347 - DNA, 25 bp, Mus musculus
aaagcattgggcagcacttgggaag

SEQ ID NO: 13348 - DNA, 25 bp, Mus musculus
aaagcattgggctgcacttgggaag

SEQ ID NO: 13349 - DNA, 25 bp, Mus musculus
aaagcattgtgcaagccctgtgcta

SEQ ID NO: 13350 - DNA, 25 bp, Mus musculus
aaagcattgtgctagccctgtgcta

SEQ ID NO: 13351 - DNA, 25 bp, Mus musculus
aaagcattgtgtatcggagaccaaa

SEQ ID NO: 13352 - DNA, 25 bp, Mus musculus
aaagcattgtgtttcggagaccaaa

SEQ ID NO: 13353 - DNA, 25 bp, Mus musculus
aaagcatttcaccaacctgggccaa

SEQ ID NO: 13354 - DNA, 25 bp, Mus musculus
aaagcatttcacgaacctgggccaa

SEQ ID NO: 13355 - DNA, 25 bp, Mus musculus
aaagcatttcagagcccagctgtag

SEQ ID NO: 13356 - DNA, 25 bp, Mus musculus
aaagcatttcagtgcccagctgtag

SEQ ID NO: 13357 - DNA, 25 bp, Mus musculus
aaagcatttccaccacgtaattcct

SEQ ID NO: 13358 - DNA, 25 bp, Mus musculus
aaagcatttccagcacgtaattcct

SEQ ID NO: 13359 - DNA, 25 bp, Mus musculus
aaagcatttcgaacatcctctcgct

SEQ ID NO: 13360 - DNA, 25 bp, Mus musculus
aaagcatttcgatcatcctctcgct

SEQ ID NO: 13361 - DNA, 25 bp, Mus musculus
aaagcatttctgacatcctacaatg

SEQ ID NO: 13362 - DNA, 25 bp, Mus musculus
aaagcatttctgtcatcctacaatg

SEQ ID NO: 13363 - DNA, 25 bp, Mus musculus
aaagcatttgctcctatggtttggc

SEQ ID NO: 13364 - DNA, 25 bp, Mus musculus
aaagcatttgctgctatggtttggc

SEQ ID NO: 13365 - DNA, 25 bp, Mus musculus
aaagcatttggtaggagaagatctc

SEQ ID NO: 13366 - DNA, 25 bp, Mus musculus
aaagcatttggttggagaagatctc

SEQ ID NO: 13367 - DNA, 25 bp, Mus musculus
aaagcatttgtcaatttctctgcct

SEQ ID NO: 13368 - DNA, 25 bp, Mus musculus
aaagcatttgtcactaaggtttagg

SEQ ID NO: 13369 - DNA, 25 bp, Mus musculus
aaagcatttgtctatttctctgcct

SEQ ID NO: 13370 - DNA, 25 bp, Mus musculus
aaagcatttgtctctaaggtttagg

SEQ ID NO: 13371 - DNA, 25 bp, Mus musculus
aaagcatttgttcagtttcaataaa

SEQ ID NO: 13372 - DNA, 25 bp, Mus musculus
aaagcatttgttgagtttcaataaa

SEQ ID NO: 13373 - DNA, 25 bp, Mus musculus
aaagcattttgtaccttacactgtg

SEQ ID NO: 13374 - DNA, 25 bp, Mus musculus
aaagcattttgttccttacactgtg

SEQ ID NO: 13375 - DNA, 25 bp, Mus musculus
aaagccaaacccacgaggtgcggat

SEQ ID NO: 13376 - DNA, 25 bp, Mus musculus
aaagccaaaccctcgaggtgcggat

SEQ ID NO: 13377 - DNA, 25 bp, Mus musculus
aaagccaaagcaaaacaccagaaag

SEQ ID NO: 13378 - DNA, 25 bp, Mus musculus
aaagccaaagcataacaccagaaag

SEQ ID NO: 13379 - DNA, 25 bp, Mus musculus
aaagccaaattgcatatgtgtcccg

SEQ ID NO: 13380 - DNA, 25 bp, Mus musculus
aaagccaaattggatatgtgtcccg

SEQ ID NO: 13381 - DNA, 25 bp, Mus musculus
aaagccaacaagagggttctctgca

SEQ ID NO: 13382 - DNA, 25 bp, Mus musculus
aaagccaacaagtgggttctctgca

SEQ ID NO: 13383 - DNA, 25 bp, Mus musculus
aaagccaacccacatcaccgtagat

SEQ ID NO: 13384 - DNA, 25 bp, Mus musculus
aaagccaacccagatcaccgtagat

SEQ ID NO: 13385 - DNA, 25 bp, Mus musculus
aaagccaacccgctcagaggcgagc

SEQ ID NO: 13386 - DNA, 25 bp, Mus musculus
aaagccaacccggtcagaggcgagc

SEQ ID NO: 13387 - DNA, 25 bp, Mus musculus
aaagccaacgctatgttgagccatc

SEQ ID NO: 13388 - DNA, 25 bp, Mus musculus
aaagccaacgctttgttgagccatc

SEQ ID NO: 13389 - DNA, 25 bp, Mus musculus
aaagccaacggacttcccactagct

SEQ ID NO: 13390 - DNA, 25 bp, Mus musculus
aaagccaacggagttcccactagct

SEQ ID NO: 13391 - DNA, 25 bp, Mus musculus
aaagccaagaaaagacggcgtggtg

SEQ ID NO: 13392 - DNA, 25 bp, Mus musculus
aaagccaagaaatgacggcgtggtg

SEQ ID NO: 13393 - DNA, 25 bp, Mus musculus
aaagccaagaagcacaaccggccca

SEQ ID NO: 13394 - DNA, 25 bp, Mus musculus
aaagccaagaaggacaaccggccca

SEQ ID NO: 13395 - DNA, 25 bp, Mus musculus
aaagccaagatcaacctcaaggtcc

SEQ ID NO: 13396 - DNA, 25 bp, Mus musculus
aaagccaagatctacctcaaggtcc

SEQ ID NO: 13397 - DNA, 25 bp, Mus musculus
aaagccaagctcaagccaggtgctc

SEQ ID NO: 13398 - DNA, 25 bp, Mus musculus
aaagccaagctctagccaggtgctc

SEQ ID NO: 13399 - DNA, 25 bp, Mus musculus
aaagccaagcttccatgattcagag

SEQ ID NO: 13400 - DNA, 25 bp, Mus musculus
aaagccaagcttctgttctgccaaa

SEQ ID NO: 13401 - DNA, 25 bp, Mus musculus
aaagccaagcttgcatgattcagag

SEQ ID NO: 13402 - DNA, 25 bp, Mus musculus
aaagccaagcttgtgttctgccaaa

SEQ ID NO: 13403 - DNA, 25 bp, Mus musculus
aaagccaaggcaaccttcaagccag

SEQ ID NO: 13404 - DNA, 25 bp, Mus musculus
aaagccaaggcatccttcaagccag

SEQ ID NO: 13405 - DNA, 25 bp, Mus musculus
aaagccaaggttccattggtgtcaa

SEQ ID NO: 13406 - DNA, 25 bp, Mus musculus
aaagccaaggttgcattggtgtcaa

SEQ ID NO: 13407 - DNA, 25 bp, Mus musculus
aaagccaagtgcctactccttgact

SEQ ID NO: 13408 - DNA, 25 bp, Mus musculus
aaagccaagtgcgtactccttgact

SEQ ID NO: 13409 - DNA, 25 bp, Mus musculus
aaagccaatcctatggttgtcactg

SEQ ID NO: 13410 - DNA, 25 bp, Mus musculus
aaagccaatcctttggttgtcactg

SEQ ID NO: 13411 - DNA, 25 bp, Mus musculus
aaagccaatgtacaaactggtttct

SEQ ID NO: 13412 - DNA, 25 bp, Mus musculus
aaagccaatgtagaaactggtttct

SEQ ID NO: 13413 - DNA, 25 bp, Mus musculus
aaagccacaaggagccaggtgtagt

SEQ ID NO: 13414 - DNA, 25 bp, Mus musculus
aaagccacaaggtgccaggtgtagt

SEQ ID NO: 13415 - DNA, 25 bp, Mus musculus
aaagccacactcagacatagataat

SEQ ID NO: 13416 - DNA, 25 bp, Mus musculus
aaagccacactctgacatagataat

SEQ ID NO: 13417 - DNA, 25 bp, Mus musculus
aaagccacacttattattctctcca

SEQ ID NO: 13418 - DNA, 25 bp, Mus musculus
aaagccacactttttattctctcca

SEQ ID NO: 13419 - DNA, 25 bp, Mus musculus
aaagccacagagctgcactgctcta

SEQ ID NO: 13420 - DNA, 25 bp, Mus musculus
aaagccacagaggtgcactgctcta

SEQ ID NO: 13421 - DNA, 25 bp, Mus musculus
aaagccacagatactgccacagcag

SEQ ID NO: 13422 - DNA, 25 bp, Mus musculus
aaagccacagattctgccacagcag

SEQ ID NO: 13423 - DNA, 25 bp, Mus musculus
aaagccacagctacctattggtgca

SEQ ID NO: 13424 - DNA, 25 bp, Mus musculus
aaagccacagcttcctattggtgca

SEQ ID NO: 13425 - DNA, 25 bp, Mus musculus
aaagccacaggaatgcgtcgggccc

SEQ ID NO: 13426 - DNA, 25 bp, Mus musculus
aaagccacaggaccctcgttaatta

SEQ ID NO: 13427 - DNA, 25 bp, Mus musculus
aaagccacaggagcctcgttaatta

SEQ ID NO: 13428 - DNA, 25 bp, Mus musculus
aaagccacaggattgcgtcgggccc

SEQ ID NO: 13429 - DNA, 25 bp, Mus musculus
aaagccacagtcatctctctcgaag

SEQ ID NO: 13430 - DNA, 25 bp, Mus musculus
aaagccacagtcttctctctcgaag

SEQ ID NO: 13431 - DNA, 25 bp, Mus musculus
aaagccacatctcttttctagatcc

SEQ ID NO: 13432 - DNA, 25 bp, Mus musculus
aaagccacatctgttttctagatcc

SEQ ID NO: 13433 - DNA, 25 bp, Mus musculus
aaagccacattgcttcttcccaggg

SEQ ID NO: 13434 - DNA, 25 bp, Mus musculus
aaagccacattggttcttcccaggg

SEQ ID NO: 13435 - DNA, 25 bp, Mus musculus
aaagccacatttctaccatcctggg

SEQ ID NO: 13436 - DNA, 25 bp, Mus musculus
aaagccacatttgtaccatcctggg

SEQ ID NO: 13437 - DNA, 25 bp, Mus musculus
aaagccaccacaccctgttttgttt

SEQ ID NO: 13438 - DNA, 25 bp, Mus musculus
aaagccaccacagcctgttttgttt

SEQ ID NO: 13439 - DNA, 25 bp, Mus musculus
aaagccacccacaggacatggagac

SEQ ID NO: 13440 - DNA, 25 bp, Mus musculus
aaagccacccactggacatggagac

SEQ ID NO: 13441 - DNA, 25 bp, Mus musculus
aaagccaccctacacttgggacatt

SEQ ID NO: 13442 - DNA, 25 bp, Mus musculus
aaagccaccctagacttgggacatt

SEQ ID NO: 13443 - DNA, 25 bp, Mus musculus
aaagccacccttcgcatatctagat

SEQ ID NO: 13444 - DNA, 25 bp, Mus musculus
aaagccacccttggcatatctagat

SEQ ID NO: 13445 - DNA, 25 bp, Mus musculus
aaagccacctacataacaatccact

SEQ ID NO: 13446 - DNA, 25 bp, Mus musculus
aaagccacctacttaacaatccact

SEQ ID NO: 13447 - DNA, 25 bp, Mus musculus
aaagccacctcacagccattgatac

SEQ ID NO: 13448 - DNA, 25 bp, Mus musculus
aaagccacctcacgtgaggaggcct

SEQ ID NO: 13449 - DNA, 25 bp, Mus musculus
aaagccacctcagagccattgatac

SEQ ID NO: 13450 - DNA, 25 bp, Mus musculus
aaagccacctcaggtgaggaggcct

SEQ ID NO: 13451 - DNA, 25 bp, Mus musculus
aaagccacctccagtagaagagttt

SEQ ID NO: 13452 - DNA, 25 bp, Mus musculus
aaagccacctcctgtagaagagttt

SEQ ID NO: 13453 - DNA, 25 bp, Mus musculus
aaagccacctttagcctgtcaatat

SEQ ID NO: 13454 - DNA, 25 bp, Mus musculus
aaagccaccttttgcctgtcaatat

SEQ ID NO: 13455 - DNA, 25 bp, Mus musculus
aaagccacgtaaccgccaactatga

SEQ ID NO: 13456 - DNA, 25 bp, Mus musculus
aaagccacgtaagcgccaactatga

SEQ ID NO: 13457 - DNA, 25 bp, Mus musculus
aaagccacgtctagaggccaggcac

SEQ ID NO: 13458 - DNA, 25 bp, Mus musculus
aaagccacgtcttgaggccaggcac

SEQ ID NO: 13459 - DNA, 25 bp, Mus musculus
aaagccacgtgtatgagcggttcgc

SEQ ID NO: 13460 - DNA, 25 bp, Mus musculus
aaagccacgtgtttgagcggttcgc

SEQ ID NO: 13461 - DNA, 25 bp, Mus musculus
aaagccacgttgagtcttctttggg

SEQ ID NO: 13462 - DNA, 25 bp, Mus musculus
aaagccacgttgtgtcttctttggg

SEQ ID NO: 13463 - DNA, 25 bp, Mus musculus
aaagccactccgctgagaagccgca

SEQ ID NO: 13464 - DNA, 25 bp, Mus musculus
aaagccactccggtgagaagccgca

SEQ ID NO: 13465 - DNA, 25 bp, Mus musculus
aaagccactgctagacacacttggg

SEQ ID NO: 13466 - DNA, 25 bp, Mus musculus
aaagccactgctcaaagacgccggt

SEQ ID NO: 13467 - DNA, 25 bp, Mus musculus
aaagccactgctcatttcaagaaag

SEQ ID NO: 13468 - DNA, 25 bp, Mus musculus
aaagccactgctgaaagacgccggt

SEQ ID NO: 13469 - DNA, 25 bp, Mus musculus
aaagccactgctgatttcaagaaag

SEQ ID NO: 13470 - DNA, 25 bp, Mus musculus
aaagccactgcttgacacacttggg

SEQ ID NO: 13471 - DNA, 25 bp, Mus musculus
aaagccactggactgagtttctgca

SEQ ID NO: 13472 - DNA, 25 bp, Mus musculus
aaagccactggagtgagtttctgca

SEQ ID NO: 13473 - DNA, 25 bp, Mus musculus
aaagccactgggaacctgactgtgc

SEQ ID NO: 13474 - DNA, 25 bp, Mus musculus
aaagccactgggtacctgactgtgc

SEQ ID NO: 13475 - DNA, 25 bp, Mus musculus
aaagccactgtaagctcttcacaga

SEQ ID NO: 13476 - DNA, 25 bp, Mus musculus
aaagccactgtatgctcttcacaga

SEQ ID NO: 13477 - DNA, 25 bp, Mus musculus
aaagccagaaccacatagtccacca

SEQ ID NO: 13478 - DNA, 25 bp, Mus musculus
aaagccagaacctcatagtccacca

SEQ ID NO: 13479 - DNA, 25 bp, Mus musculus
aaagccagaagacgaggttgcacag

SEQ ID NO: 13480 - DNA, 25 bp, Mus musculus
aaagccagaagaggaggttgcacag

SEQ ID NO: 13481 - DNA, 25 bp, Mus musculus
aaagccagaagcaatgatgatctct

SEQ ID NO: 13482 - DNA, 25 bp, Mus musculus
aaagccagaagccatgcatgtccgc

SEQ ID NO: 13483 - DNA, 25 bp, Mus musculus
aaagccagaagcgatgcatgtccgc

SEQ ID NO: 13484 - DNA, 25 bp, Mus musculus
aaagccagaagctatgatgatctct

SEQ ID NO: 13485 - DNA, 25 bp, Mus musculus
aaagccagacaaattctagacctaa

SEQ ID NO: 13486 - DNA, 25 bp, Mus musculus
aaagccagacaatttctagacctaa

SEQ ID NO: 13487 - DNA, 25 bp, Mus musculus
aaagccagacctccgctggaggacc

SEQ ID NO: 13488 - DNA, 25 bp, Mus musculus
aaagccagacctgcgctggaggacc

SEQ ID NO: 13489 - DNA, 25 bp, Mus musculus
aaagccagagcaaataactctctag

SEQ ID NO: 13490 - DNA, 25 bp, Mus musculus
aaagccagagcatataactctctag

SEQ ID NO: 13491 - DNA, 25 bp, Mus musculus
aaagccagagtcaccctcagatatt

SEQ ID NO: 13492 - DNA, 25 bp, Mus musculus
aaagccagagtctccctcagatatt

SEQ ID NO: 13493 - DNA, 25 bp, Mus musculus
aaagccagattgaggttcgttttgt

SEQ ID NO: 13494 - DNA, 25 bp, Mus musculus
aaagccagattgtggttcgttttgt

SEQ ID NO: 13495 - DNA, 25 bp, Mus musculus
aaagccagcaaccttgggcagtgca

SEQ ID NO: 13496 - DNA, 25 bp, Mus musculus
aaagccagcaacgttgggcagtgca

SEQ ID NO: 13497 - DNA, 25 bp, Mus musculus
aaagccagcaatactgtgtggcggc

SEQ ID NO: 13498 - DNA, 25 bp, Mus musculus
aaagccagcaattctgtgtggcggc

SEQ ID NO: 13499 - DNA, 25 bp, Mus musculus
aaagccagcactccaatcttccgtt

SEQ ID NO: 13500 - DNA, 25 bp, Mus musculus
aaagccagcactgcaatcttccgtt

SEQ ID NO: 13501 - DNA, 25 bp, Mus musculus
aaagccagcaggctagtctgatggc

SEQ ID NO: 13502 - DNA, 25 bp, Mus musculus
aaagccagcagggtagtctgatggc

SEQ ID NO: 13503 - DNA, 25 bp, Mus musculus
aaagccagcattaccacatgtctct

SEQ ID NO: 13504 - DNA, 25 bp, Mus musculus
aaagccagcatttccacatgtctct

SEQ ID NO: 13505 - DNA, 25 bp, Mus musculus
aaagccagcccacaatctcaggagc

SEQ ID NO: 13506 - DNA, 25 bp, Mus musculus
aaagccagcccagaatctcaggagc

SEQ ID NO: 13507 - DNA, 25 bp, Mus musculus
aaagccagccccagaatcactagtc

SEQ ID NO: 13508 - DNA, 25 bp, Mus musculus
aaagccagccccattgagggcacag

SEQ ID NO: 13509 - DNA, 25 bp, Mus musculus
aaagccagcccctgaatcactagtc

SEQ ID NO: 13510 - DNA, 25 bp, Mus musculus
aaagccagcccctttgagggcacag

SEQ ID NO: 13511 - DNA, 25 bp, Mus musculus
aaagccagccgacccttacttgtct

SEQ ID NO: 13512 - DNA, 25 bp, Mus musculus
aaagccagccgagccttacttgtct

SEQ ID NO: 13513 - DNA, 25 bp, Mus musculus
aaagccagcctcctgattgattgat

SEQ ID NO: 13514 - DNA, 25 bp, Mus musculus
aaagccagcctcgtgattgattgat

SEQ ID NO: 13515 - DNA, 25 bp, Mus musculus
aaagccagccttagggctgacagct

SEQ ID NO: 13516 - DNA, 25 bp, Mus musculus
aaagccagcctttgggctgacagct

SEQ ID NO: 13517 - DNA, 25 bp, Mus musculus
aaagccagcgccatatacaacagga

SEQ ID NO: 13518 - DNA, 25 bp, Mus musculus
aaagccagcgccttatacaacagga

SEQ ID NO: 13519 - DNA, 25 bp, Mus musculus
aaagccagcggccagcaggacagac

SEQ ID NO: 13520 - DNA, 25 bp, Mus musculus
aaagccagcggcgagcaggacagac

SEQ ID NO: 13521 - DNA, 25 bp, Mus musculus
aaagccagctagctccttctggtga

SEQ ID NO: 13522 - DNA, 25 bp, Mus musculus
aaagccagctaggtccttctggtga

SEQ ID NO: 13523 - DNA, 25 bp, Mus musculus
aaagccagctatcaagggatcctct

SEQ ID NO: 13524 - DNA, 25 bp, Mus musculus
aaagccagctatgaagggatcctct

SEQ ID NO: 13525 - DNA, 25 bp, Mus musculus
aaagccagctttcatattaggaatc

SEQ ID NO: 13526 - DNA, 25 bp, Mus musculus
aaagccagctttcgtacaggccaca

SEQ ID NO: 13527 - DNA, 25 bp, Mus musculus
aaagccagctttgatattaggaatc

SEQ ID NO: 13528 - DNA, 25 bp, Mus musculus
aaagccagctttggtacaggccaca

SEQ ID NO: 13529 - DNA, 25 bp, Mus musculus
aaagccaggacgcagggcgccggct

SEQ ID NO: 13530 - DNA, 25 bp, Mus musculus
aaagccaggacggagggcgccggct

SEQ ID NO: 13531 - DNA, 25 bp, Mus musculus
aaagccaggagaatatctttctata

SEQ ID NO: 13532 - DNA, 25 bp, Mus musculus
aaagccaggagattatctttctata

SEQ ID NO: 13533 - DNA, 25 bp, Mus musculus
aaagccaggccgacagtgtgcagct

SEQ ID NO: 13534 - DNA, 25 bp, Mus musculus
aaagccaggccgtcagtgtgcagct

SEQ ID NO: 13535 - DNA, 25 bp, Mus musculus
aaagccaggctaagaatttgtgcaa

SEQ ID NO: 13536 - DNA, 25 bp, Mus musculus
aaagccaggctatgaatttgtgcaa

SEQ ID NO: 13537 - DNA, 25 bp, Mus musculus
aaagccaggctgaatcagtcagcat

SEQ ID NO: 13538 - DNA, 25 bp, Mus musculus
aaagccaggctgtatcagtcagcat

SEQ ID NO: 13539 - DNA, 25 bp, Mus musculus
aaagccaggcttatgatctcgggag

SEQ ID NO: 13540 - DNA, 25 bp, Mus musculus
aaagccaggcttcatggtgtccacc

SEQ ID NO: 13541 - DNA, 25 bp, Mus musculus
aaagccaggcttgatggtgtccacc

SEQ ID NO: 13542 - DNA, 25 bp, Mus musculus
aaagccaggcttttgatctcgggag

SEQ ID NO: 13543 - DNA, 25 bp, Mus musculus
aaagccagggagctcgggatctcct

SEQ ID NO: 13544 - DNA, 25 bp, Mus musculus
aaagccagggaggtcgggatctcct

SEQ ID NO: 13545 - DNA, 25 bp, Mus musculus
aaagccagggatacagtgtaccaga

SEQ ID NO: 13546 - DNA, 25 bp, Mus musculus
aaagccagggattcagtgtaccaga

SEQ ID NO: 13547 - DNA, 25 bp, Mus musculus
aaagccagggtcatacctgggaagt

SEQ ID NO: 13548 - DNA, 25 bp, Mus musculus
aaagccagggtcttacctgggaagt

SEQ ID NO: 13549 - DNA, 25 bp, Mus musculus
aaagccagtaatcaccattatccct

SEQ ID NO: 13550 - DNA, 25 bp, Mus musculus
aaagccagtaatgaccattatccct

SEQ ID NO: 13551 - DNA, 25 bp, Mus musculus
aaagccagtcaacaacgcacggatt

SEQ ID NO: 13552 - DNA, 25 bp, Mus musculus
aaagccagtcaagaacgcacggatt

SEQ ID NO: 13553 - DNA, 25 bp, Mus musculus
aaagccagtcaccatcacggtgcga

SEQ ID NO: 13554 - DNA, 25 bp, Mus musculus
aaagccagtcacgatcacggtgcga

SEQ ID NO: 13555 - DNA, 25 bp, Mus musculus
aaagccagtcggacttccagacaaa

SEQ ID NO: 13556 - DNA, 25 bp, Mus musculus
aaagccagtcggtcttccagacaaa

SEQ ID NO: 13557 - DNA, 25 bp, Mus musculus
aaagccagtgccaccttatagagag

SEQ ID NO: 13558 - DNA, 25 bp, Mus musculus
aaagccagtgcctccttatagagag

SEQ ID NO: 13559 - DNA, 25 bp, Mus musculus
aaagccagtgcgagtctgtgattcc

SEQ ID NO: 13560 - DNA, 25 bp, Mus musculus
aaagccagtgcgtgtctgtgattcc

SEQ ID NO: 13561 - DNA, 25 bp, Mus musculus
aaagccagttgaacacagggagcct

SEQ ID NO: 13562 - DNA, 25 bp, Mus musculus
aaagccagttgatcacagggagcct

SEQ ID NO: 13563 - DNA, 25 bp, Mus musculus
aaagccagttgcacacgaagggtcg

SEQ ID NO: 13564 - DNA, 25 bp, Mus musculus
aaagccagttgctcacgaagggtcg

SEQ ID NO: 13565 - DNA, 25 bp, Mus musculus
aaagccataaacctaacaccgacat

SEQ ID NO: 13566 - DNA, 25 bp, Mus musculus
aaagccataaacgtaacaccgacat

SEQ ID NO: 13567 - DNA, 25 bp, Mus musculus
aaagccatacatactgttctcactt

SEQ ID NO: 13568 - DNA, 25 bp, Mus musculus
aaagccatacattctgttctcactt

SEQ ID NO: 13569 - DNA, 25 bp, Mus musculus
aaagccatagctagctttttccctg

SEQ ID NO: 13570 - DNA, 25 bp, Mus musculus
aaagccatagcttgctttttccctg

SEQ ID NO: 13571 - DNA, 25 bp, Mus musculus
aaagccatcaagctcctctgtgttt

SEQ ID NO: 13572 - DNA, 25 bp, Mus musculus
aaagccatcaaggtcctctgtgttt

SEQ ID NO: 13573 - DNA, 25 bp, Mus musculus
aaagccatcaccaaggctcagaaaa

SEQ ID NO: 13574 - DNA, 25 bp, Mus musculus
aaagccatcacctaggctcagaaaa

SEQ ID NO: 13575 - DNA, 25 bp, Mus musculus
aaagccatcagcatcactagtcaca

SEQ ID NO: 13576 - DNA, 25 bp, Mus musculus
aaagccatcagcttcactagtcaca

SEQ ID NO: 13577 - DNA, 25 bp, Mus musculus
aaagccatcagtagtgcctaagcca

SEQ ID NO: 13578 - DNA, 25 bp, Mus musculus
aaagccatcagttgtgcctaagcca

SEQ ID NO: 13579 - DNA, 25 bp, Mus musculus
aaagccatcatcaggaatcctgcgt

SEQ ID NO: 13580 - DNA, 25 bp, Mus musculus
aaagccatcatcattttggtatcac

SEQ ID NO: 13581 - DNA, 25 bp, Mus musculus
aaagccatcatctggaatcctgcgt

SEQ ID NO: 13582 - DNA, 25 bp, Mus musculus
aaagccatcatctttttggtatcac

SEQ ID NO: 13583 - DNA, 25 bp, Mus musculus
aaagccatcatgacgctggtctctg

SEQ ID NO: 13584 - DNA, 25 bp, Mus musculus
aaagccatcatgtcgctggtctctg

SEQ ID NO: 13585 - DNA, 25 bp, Mus musculus
aaagccatcccaaggcctgatgata

SEQ ID NO: 13586 - DNA, 25 bp, Mus musculus
aaagccatcccatggcctgatgata

SEQ ID NO: 13587 - DNA, 25 bp, Mus musculus
aaagccatcctgacagaactgaagt

SEQ ID NO: 13588 - DNA, 25 bp, Mus musculus
aaagccatcctgcagatgggcagtt

SEQ ID NO: 13589 - DNA, 25 bp, Mus musculus
aaagccatcctggagatgggcagtt

SEQ ID NO: 13590 - DNA, 25 bp, Mus musculus
aaagccatcctgtcagaactgaagt

SEQ ID NO: 13591 - DNA, 25 bp, Mus musculus
aaagccatcgagaataaagttcaag

SEQ ID NO: 13592 - DNA, 25 bp, Mus musculus
aaagccatcgagtataaagttcaag

SEQ ID NO: 13593 - DNA, 25 bp, Mus musculus
aaagccatcgccagggctgtaatga

SEQ ID NO: 13594 - DNA, 25 bp, Mus musculus
aaagccatcgcctgggctgtaatga

SEQ ID NO: 13595 - DNA, 25 bp, Mus musculus
aaagccatcgtgaagtctggtgaac

SEQ ID NO: 13596 - DNA, 25 bp, Mus musculus
aaagccatcgtgtagtctggtgaac

SEQ ID NO: 13597 - DNA, 25 bp, Mus musculus
aaagccatcgttcctagagcatctg

SEQ ID NO: 13598 - DNA, 25 bp, Mus musculus
aaagccatcgttgctagagcatctg

SEQ ID NO: 13599 - DNA, 25 bp, Mus musculus
aaagccatctaaatacgccggcctg

SEQ ID NO: 13600 - DNA, 25 bp, Mus musculus
aaagccatctaattacgccggcctg

SEQ ID NO: 13601 - DNA, 25 bp, Mus musculus
aaagccatctggagccgagcagata

SEQ ID NO: 13602 - DNA, 25 bp, Mus musculus
aaagccatctggtgccgagcagata

SEQ ID NO: 13603 - DNA, 25 bp, Mus musculus
aaagccatcttcacagatttctctg

SEQ ID NO: 13604 - DNA, 25 bp, Mus musculus
aaagccatcttcagtagctgctgtt

SEQ ID NO: 13605 - DNA, 25 bp, Mus musculus
aaagccatcttctcagatttctctg

SEQ ID NO: 13606 - DNA, 25 bp, Mus musculus
aaagccatcttctgtagctgctgtt

SEQ ID NO: 13607 - DNA, 25 bp, Mus musculus
aaagccatctttagattgccctcgt

SEQ ID NO: 13608 - DNA, 25 bp, Mus musculus
aaagccatcttttgattgccctcgt

SEQ ID NO: 13609 - DNA, 25 bp, Mus musculus
aaagccatgacccatactcatttgg

SEQ ID NO: 13610 - DNA, 25 bp, Mus musculus
aaagccatgaccgatactcatttgg

SEQ ID NO: 13611 - DNA, 25 bp, Mus musculus
aaagccatgactcctggaacccaaa

SEQ ID NO: 13612 - DNA, 25 bp, Mus musculus
aaagccatgactgctggaacccaaa

SEQ ID NO: 13613 - DNA, 25 bp, Mus musculus
aaagccatgagtagacccagaagtc

SEQ ID NO: 13614 - DNA, 25 bp, Mus musculus
aaagccatgagttgacccagaagtc

SEQ ID NO: 13615 - DNA, 25 bp, Mus musculus
aaagccatgatcatcaagggtgaga

SEQ ID NO: 13616 - DNA, 25 bp, Mus musculus
aaagccatgatcttcaagggtgaga

SEQ ID NO: 13617 - DNA, 25 bp, Mus musculus
aaagccatgcacacttagtaatgac

SEQ ID NO: 13618 - DNA, 25 bp, Mus musculus
aaagccatgcactcttagtaatgac

SEQ ID NO: 13619 - DNA, 25 bp, Mus musculus
aaagccatgcagaacaatgccaaat

SEQ ID NO: 13620 - DNA, 25 bp, Mus musculus
aaagccatgcagtacaatgccaaat

SEQ ID NO: 13621 - DNA, 25 bp, Mus musculus
aaagccatgcgtattctgtaagtat

SEQ ID NO: 13622 - DNA, 25 bp, Mus musculus
aaagccatgcgttttctgtaagtat

SEQ ID NO: 13623 - DNA, 25 bp, Mus musculus
aaagccatggagaccttcctgtttg

SEQ ID NO: 13624 - DNA, 25 bp, Mus musculus
aaagccatggagtccttcctgtttg

SEQ ID NO: 13625 - DNA, 25 bp, Mus musculus
aaagccatgtccaggtttctgtgta

SEQ ID NO: 13626 - DNA, 25 bp, Mus musculus
aaagccatgtcctggtttctgtgta

SEQ ID NO: 13627 - DNA, 25 bp, Mus musculus
aaagccatgtgtattgtcacttcga

SEQ ID NO: 13628 - DNA, 25 bp, Mus musculus
aaagccatgtgttttgtcacttcga

SEQ ID NO: 13629 - DNA, 25 bp, Mus musculus
aaagccatgttcagcagcagcgttt

SEQ ID NO: 13630 - DNA, 25 bp, Mus musculus
aaagccatgttctgcagcagcgttt

SEQ ID NO: 13631 - DNA, 25 bp, Mus musculus
aaagccattccaatagcctaggtag

SEQ ID NO: 13632 - DNA, 25 bp, Mus musculus
aaagccattccattagcctaggtag

SEQ ID NO: 13633 - DNA, 25 bp, Mus musculus
aaagccattgatcttaatttagtta

SEQ ID NO: 13634 - DNA, 25 bp, Mus musculus
aaagccattgatgttaatttagtta

SEQ ID NO: 13635 - DNA, 25 bp, Mus musculus
aaagccattgccatgtgggccaggt

SEQ ID NO: 13636 - DNA, 25 bp, Mus musculus
aaagccattgccttgtgggccaggt

SEQ ID NO: 13637 - DNA, 25 bp, Mus musculus
aaagccattggcactggcttgagct

SEQ ID NO: 13638 - DNA, 25 bp, Mus musculus
aaagccattggctctggcttgagct

SEQ ID NO: 13639 - DNA, 25 bp, Mus musculus
aaagccattggtactgactgtggta

SEQ ID NO: 13640 - DNA, 25 bp, Mus musculus
aaagccattggttctgactgtggta

SEQ ID NO: 13641 - DNA, 25 bp, Mus musculus
aaagccattgtccagttatttgtgt

SEQ ID NO: 13642 - DNA, 25 bp, Mus musculus
aaagccattgtcgagttatttgtgt

SEQ ID NO: 13643 - DNA, 25 bp, Mus musculus
aaagccattgttactggttattaat

SEQ ID NO: 13644 - DNA, 25 bp, Mus musculus
aaagccattgtttctggttattaat

SEQ ID NO: 13645 - DNA, 25 bp, Mus musculus
aaagccatttccacaccaaaagaag

SEQ ID NO: 13646 - DNA, 25 bp, Mus musculus
aaagccatttccagtttgcaactgg

SEQ ID NO: 13647 - DNA, 25 bp, Mus musculus
aaagccatttcctcaccaaaagaag

SEQ ID NO: 13648 - DNA, 25 bp, Mus musculus
aaagccatttcctgtttgcaactgg

SEQ ID NO: 13649 - DNA, 25 bp, Mus musculus
aaagccattttcactctgcaatgca

SEQ ID NO: 13650 - DNA, 25 bp, Mus musculus
aaagccattttctctctgcaatgca

SEQ ID NO: 13651 - DNA, 25 bp, Mus musculus
aaagccattttgactggaaactcag

SEQ ID NO: 13652 - DNA, 25 bp, Mus musculus
aaagccattttgtctggaaactcag

SEQ ID NO: 13653 - DNA, 25 bp, Mus musculus
aaagccatttttctggtagcactat

SEQ ID NO: 13654 - DNA, 25 bp, Mus musculus
aaagccatttttgtggtagcactat

SEQ ID NO: 13655 - DNA, 25 bp, Mus musculus
aaagcccaaactccttcctgtgaca

SEQ ID NO: 13656 - DNA, 25 bp, Mus musculus
aaagcccaaactgcttcctgtgaca

SEQ ID NO: 13657 - DNA, 25 bp, Mus musculus
aaagcccaagtgactaggagcatga

SEQ ID NO: 13658 - DNA, 25 bp, Mus musculus
aaagcccaagtgtctaggagcatga

SEQ ID NO: 13659 - DNA, 25 bp, Mus musculus
aaagcccaagttactacacagcaaa

SEQ ID NO: 13660 - DNA, 25 bp, Mus musculus
aaagcccaagtttctacacagcaaa

SEQ ID NO: 13661 - DNA, 25 bp, Mus musculus
aaagcccacaaacgccatctgctga

SEQ ID NO: 13662 - DNA, 25 bp, Mus musculus
aaagcccacaaaggccatctgctga

SEQ ID NO: 13663 - DNA, 25 bp, Mus musculus
aaagcccacaccaagaccggagatt

SEQ ID NO: 13664 - DNA, 25 bp, Mus musculus
aaagcccacacctagaccggagatt

SEQ ID NO: 13665 - DNA, 25 bp, Mus musculus
aaagcccacatgctaaccctggact

SEQ ID NO: 13666 - DNA, 25 bp, Mus musculus
aaagcccacatggtaaccctggact

SEQ ID NO: 13667 - DNA, 25 bp, Mus musculus
aaagcccaccttattcattggctgc

SEQ ID NO: 13668 - DNA, 25 bp, Mus musculus
aaagcccacctttttcattggctgc

SEQ ID NO: 13669 - DNA, 25 bp, Mus musculus
aaagcccactctatctctagttagc

SEQ ID NO: 13670 - DNA, 25 bp, Mus musculus
aaagcccactctttctctagttagc

SEQ ID NO: 13671 - DNA, 25 bp, Mus musculus
aaagcccacttgcatgaagctcgga

SEQ ID NO: 13672 - DNA, 25 bp, Mus musculus
aaagcccacttggatgaagctcgga

SEQ ID NO: 13673 - DNA, 25 bp, Mus musculus
aaagcccagacgagcctttgagaag

SEQ ID NO: 13674 - DNA, 25 bp, Mus musculus
aaagcccagacgtgcctttgagaag

SEQ ID NO: 13675 - DNA, 25 bp, Mus musculus
aaagcccagagccagggttcctcac

SEQ ID NO: 13676 - DNA, 25 bp, Mus musculus
aaagcccagagccagttgcaagagc

SEQ ID NO: 13677 - DNA, 25 bp, Mus musculus
aaagcccagagcgagggttcctcac

SEQ ID NO: 13678 - DNA, 25 bp, Mus musculus
aaagcccagagcgagttgcaagagc

SEQ ID NO: 13679 - DNA, 25 bp, Mus musculus
aaagcccagatcatcttggatggat

SEQ ID NO: 13680 - DNA, 25 bp, Mus musculus
aaagcccagatcttcttggatggat

SEQ ID NO: 13681 - DNA, 25 bp, Mus musculus
aaagcccagcacatgaattgttctt

SEQ ID NO: 13682 - DNA, 25 bp, Mus musculus
aaagcccagcacttgaattgttctt

SEQ ID NO: 13683 - DNA, 25 bp, Mus musculus
aaagcccagcagctatatgtattct

SEQ ID NO: 13684 - DNA, 25 bp, Mus musculus
aaagcccagcaggtatatgtattct

SEQ ID NO: 13685 - DNA, 25 bp, Mus musculus
aaagcccagcccagcttgtgagagt

SEQ ID NO: 13686 - DNA, 25 bp, Mus musculus
aaagcccagccctgcttgtgagagt

SEQ ID NO: 13687 - DNA, 25 bp, Mus musculus
aaagcccagcggatactgaagcagt

SEQ ID NO: 13688 - DNA, 25 bp, Mus musculus
aaagcccagcggttactgaagcagt

SEQ ID NO: 13689 - DNA, 25 bp, Mus musculus
aaagcccagcttagtggtacccaga

SEQ ID NO: 13690 - DNA, 25 bp, Mus musculus
aaagcccagcttccatcggccaggt

SEQ ID NO: 13691 - DNA, 25 bp, Mus musculus
aaagcccagcttgcatcggccaggt

SEQ ID NO: 13692 - DNA, 25 bp, Mus musculus
aaagcccagctttgtggtacccaga

SEQ ID NO: 13693 - DNA, 25 bp, Mus musculus
aaagcccaggatcgcgttgtttcgc

SEQ ID NO: 13694 - DNA, 25 bp, Mus musculus
aaagcccaggatggcgttgtttcgc

SEQ ID NO: 13695 - DNA, 25 bp, Mus musculus
aaagcccaggcgcttgcctgagctg

SEQ ID NO: 13696 - DNA, 25 bp, Mus musculus
aaagcccaggcggttgcctgagctg

SEQ ID NO: 13697 - DNA, 25 bp, Mus musculus
aaagcccaggctactcagaaaacgt

SEQ ID NO: 13698 - DNA, 25 bp, Mus musculus
aaagcccaggcttctcagaaaacgt

SEQ ID NO: 13699 - DNA, 25 bp, Mus musculus
aaagcccagggccaagtatctcaga

SEQ ID NO: 13700 - DNA, 25 bp, Mus musculus
aaagcccagggcgaagtatctcaga

SEQ ID NO: 13701 - DNA, 25 bp, Mus musculus
aaagcccaggtcaaactgtgatgat

SEQ ID NO: 13702 - DNA, 25 bp, Mus musculus
aaagcccaggtcagcttgacggatc

SEQ ID NO: 13703 - DNA, 25 bp, Mus musculus
aaagcccaggtctaactgtgatgat

SEQ ID NO: 13704 - DNA, 25 bp, Mus musculus
aaagcccaggtctgcttgacggatc

SEQ ID NO: 13705 - DNA, 25 bp, Mus musculus
aaagcccaggtgacaataggcactg

SEQ ID NO: 13706 - DNA, 25 bp, Mus musculus
aaagcccaggtgtcaataggcactg

SEQ ID NO: 13707 - DNA, 25 bp, Mus musculus
aaagcccagtatccctgaggaacac

SEQ ID NO: 13708 - DNA, 25 bp, Mus musculus
aaagcccagtatgcctgaggaacac

SEQ ID NO: 13709 - DNA, 25 bp, Mus musculus
aaagcccagtccaagtttagcgtct

SEQ ID NO: 13710 - DNA, 25 bp, Mus musculus
aaagcccagtcctagtttagcgtct

SEQ ID NO: 13711 - DNA, 25 bp, Mus musculus
aaagcccagtttacttttctgatgg

SEQ ID NO: 13712 - DNA, 25 bp, Mus musculus
aaagcccagttttcttttctgatgg

SEQ ID NO: 13713 - DNA, 25 bp, Mus musculus
aaagcccatgcaacttcctcctaga

SEQ ID NO: 13714 - DNA, 25 bp, Mus musculus
aaagcccatgcatcttcctcctaga

SEQ ID NO: 13715 - DNA, 25 bp, Mus musculus
aaagcccatgtcagtttatctacaa

SEQ ID NO: 13716 - DNA, 25 bp, Mus musculus
aaagcccatgtctgtttatctacaa

SEQ ID NO: 13717 - DNA, 25 bp, Mus musculus
aaagcccatgttcaatcctctgtga

SEQ ID NO: 13718 - DNA, 25 bp, Mus musculus
aaagcccatgttgaatcctctgtga

SEQ ID NO: 13719 - DNA, 25 bp, Mus musculus
aaagccccaacactctcctgttttg

SEQ ID NO: 13720 - DNA, 25 bp, Mus musculus
aaagccccaacagtctcctgttttg

SEQ ID NO: 13721 - DNA, 25 bp, Mus musculus
aaagccccagctccaatttgagaag

SEQ ID NO: 13722 - DNA, 25 bp, Mus musculus
aaagccccagctgcaatttgagaag

SEQ ID NO: 13723 - DNA, 25 bp, Mus musculus
aaagccccatcactgctatcataaa

SEQ ID NO: 13724 - DNA, 25 bp, Mus musculus
aaagccccatcagtgctatcataaa

SEQ ID NO: 13725 - DNA, 25 bp, Mus musculus
aaagccccatcgagaggttccacaa

SEQ ID NO: 13726 - DNA, 25 bp, Mus musculus
aaagccccatcgtgaggttccacaa

SEQ ID NO: 13727 - DNA, 25 bp, Mus musculus
aaagcccccaatcctgctaggagga

SEQ ID NO: 13728 - DNA, 25 bp, Mus musculus
aaagcccccaatgctgctaggagga

SEQ ID NO: 13729 - DNA, 25 bp, Mus musculus
aaagccccggctaggatgtcacaaa

SEQ ID NO: 13730 - DNA, 25 bp, Mus musculus
aaagccccggcttggatgtcacaaa

SEQ ID NO: 13731 - DNA, 25 bp, Mus musculus
aaagcccctattcatgtcacatctg

SEQ ID NO: 13732 - DNA, 25 bp, Mus musculus
aaagcccctattgatgtcacatctg

SEQ ID NO: 13733 - DNA, 25 bp, Mus musculus
aaagcccctcatatgtcacttgaat

SEQ ID NO: 13734 - DNA, 25 bp, Mus musculus
aaagcccctcatttgtcacttgaat

SEQ ID NO: 13735 - DNA, 25 bp, Mus musculus
aaagcccctctgatgagtcaggccc

SEQ ID NO: 13736 - DNA, 25 bp, Mus musculus
aaagcccctctgttgagtcaggccc

SEQ ID NO: 13737 - DNA, 25 bp, Mus musculus
aaagcccctcttcctgatcatgtta

SEQ ID NO: 13738 - DNA, 25 bp, Mus musculus
aaagcccctcttgctgatcatgtta

SEQ ID NO: 13739 - DNA, 25 bp, Mus musculus
aaagcccctgctccctgtgtttgag

SEQ ID NO: 13740 - DNA, 25 bp, Mus musculus
aaagcccctgctgcctgtgtttgag

SEQ ID NO: 13741 - DNA, 25 bp, Mus musculus
aaagcccctggtagaagtgtctgtc

SEQ ID NO: 13742 - DNA, 25 bp, Mus musculus
aaagcccctggttgaagtgtctgtc

SEQ ID NO: 13743 - DNA, 25 bp, Mus musculus
aaagccccttgtagaaacggatgag

SEQ ID NO: 13744 - DNA, 25 bp, Mus musculus
aaagccccttgttgaaacggatgag

SEQ ID NO: 13745 - DNA, 25 bp, Mus musculus
aaagcccctttaaaagttgatcatg

SEQ ID NO: 13746 - DNA, 25 bp, Mus musculus
aaagcccctttataagttgatcatg

SEQ ID NO: 13747 - DNA, 25 bp, Mus musculus
aaagcccgacaaacctgactcggag

SEQ ID NO: 13748 - DNA, 25 bp, Mus musculus
aaagcccgacaatcctgactcggag

SEQ ID NO: 13749 - DNA, 25 bp, Mus musculus
aaagcccgagccagaaggagttcca

SEQ ID NO: 13750 - DNA, 25 bp, Mus musculus
aaagcccgagcctgaaggagttcca

SEQ ID NO: 13751 - DNA, 25 bp, Mus musculus
aaagcccgcctgaagtacaatggta

SEQ ID NO: 13752 - DNA, 25 bp, Mus musculus
aaagcccgcctgtagtacaatggta

SEQ ID NO: 13753 - DNA, 25 bp, Mus musculus
aaagcccggagaagtgacccatagc

SEQ ID NO: 13754 - DNA, 25 bp, Mus musculus
aaagcccggagatgtgacccatagc

SEQ ID NO: 13755 - DNA, 25 bp, Mus musculus
aaagcccggtggagacagctcatgt

SEQ ID NO: 13756 - DNA, 25 bp, Mus musculus
aaagcccggtggtgacagctcatgt

SEQ ID NO: 13757 - DNA, 25 bp, Mus musculus
aaagcccgtgcgctgggactctcgc

SEQ ID NO: 13758 - DNA, 25 bp, Mus musculus
aaagcccgtgcggtgggactctcgc

SEQ ID NO: 13759 - DNA, 25 bp, Mus musculus
aaagccctaagcacaatgctcggtg

SEQ ID NO: 13760 - DNA, 25 bp, Mus musculus
aaagccctaagctcaatgctcggtg

SEQ ID NO: 13761 - DNA, 25 bp, Mus musculus
aaagccctaggaattgtgccaaatc

SEQ ID NO: 13762 - DNA, 25 bp, Mus musculus
aaagccctaggatttgtgccaaatc

SEQ ID NO: 13763 - DNA, 25 bp, Mus musculus
aaagccctagtcaatgtagccagcc

SEQ ID NO: 13764 - DNA, 25 bp, Mus musculus
aaagccctagtctatgtagccagcc

SEQ ID NO: 13765 - DNA, 25 bp, Mus musculus
aaagccctatgtcaaacagcacagc

SEQ ID NO: 13766 - DNA, 25 bp, Mus musculus
aaagccctatgtgaaacagcacagc

SEQ ID NO: 13767 - DNA, 25 bp, Mus musculus
aaagccctattgctgtagccactgt

SEQ ID NO: 13768 - DNA, 25 bp, Mus musculus
aaagccctattggtgtagccactgt

SEQ ID NO: 13769 - DNA, 25 bp, Mus musculus
aaagccctcaatacacatcctgcta

SEQ ID NO: 13770 - DNA, 25 bp, Mus musculus
aaagccctcaattcacatcctgcta

SEQ ID NO: 13771 - DNA, 25 bp, Mus musculus
aaagccctcatgaaggctgtggcga

SEQ ID NO: 13772 - DNA, 25 bp, Mus musculus
aaagccctcatgtaggctgtggcga

SEQ ID NO: 13773 - DNA, 25 bp, Mus musculus
aaagccctcgtgcacatggcaaaac

SEQ ID NO: 13774 - DNA, 25 bp, Mus musculus
aaagccctcgtggacatggcaaaac

SEQ ID NO: 13775 - DNA, 25 bp, Mus musculus
aaagccctcgttctccaaggctgag

SEQ ID NO: 13776 - DNA, 25 bp, Mus musculus
aaagccctcgttgtccaaggctgag

SEQ ID NO: 13777 - DNA, 25 bp, Mus musculus
aaagccctctttcactacgatccta

SEQ ID NO: 13778 - DNA, 25 bp, Mus musculus
aaagccctctttcagaaagcatcga

SEQ ID NO: 13779 - DNA, 25 bp, Mus musculus
aaagccctctttgactacgatccta

SEQ ID NO: 13780 - DNA, 25 bp, Mus musculus
aaagccctctttgagaaagcatcga

SEQ ID NO: 13781 - DNA, 25 bp, Mus musculus
aaagccctgaatatggtcctcagct

SEQ ID NO: 13782 - DNA, 25 bp, Mus musculus
aaagccctgaatttggtcctcagct

SEQ ID NO: 13783 - DNA, 25 bp, Mus musculus
aaagccctgacactccattgcatcg

SEQ ID NO: 13784 - DNA, 25 bp, Mus musculus
aaagccctgacagtccattgcatcg

SEQ ID NO: 13785 - DNA, 25 bp, Mus musculus
aaagccctgagaatgttgccgacca

SEQ ID NO: 13786 - DNA, 25 bp, Mus musculus
aaagccctgagattgttgccgacca

SEQ ID NO: 13787 - DNA, 25 bp, Mus musculus
aaagccctgagcagaaggcctttgc

SEQ ID NO: 13788 - DNA, 25 bp, Mus musculus
aaagccctgagcatacctcagctgg

SEQ ID NO: 13789 - DNA, 25 bp, Mus musculus
aaagccctgagctgaaggcctttgc

SEQ ID NO: 13790 - DNA, 25 bp, Mus musculus
aaagccctgagcttacctcagctgg

SEQ ID NO: 13791 - DNA, 25 bp, Mus musculus
aaagccctgccaagatgggtgctca

SEQ ID NO: 13792 - DNA, 25 bp, Mus musculus
aaagccctgccatgatgggtgctca

SEQ ID NO: 13793 - DNA, 25 bp, Mus musculus
aaagccctgctaatatacaatgttc

SEQ ID NO: 13794 - DNA, 25 bp, Mus musculus
aaagccctgctattatacaatgttc

SEQ ID NO: 13795 - DNA, 25 bp, Mus musculus
aaagccctgctcaggactcctctgg

SEQ ID NO: 13796 - DNA, 25 bp, Mus musculus
aaagccctgctctggactcctctgg

SEQ ID NO: 13797 - DNA, 25 bp, Mus musculus
aaagccctgctgagagtaaagactg

SEQ ID NO: 13798 - DNA, 25 bp, Mus musculus
aaagccctgctgtgagtaaagactg

SEQ ID NO: 13799 - DNA, 25 bp, Mus musculus
aaagccctggagaacttagaacact

SEQ ID NO: 13800 - DNA, 25 bp, Mus musculus
aaagccctggagtacttagaacact

SEQ ID NO: 13801 - DNA, 25 bp, Mus musculus
aaagccctgggtctttctgtctaat

SEQ ID NO: 13802 - DNA, 25 bp, Mus musculus
aaagccctgggtgtttctgtctaat

SEQ ID NO: 13803 - DNA, 25 bp, Mus musculus
aaagccctgtagatcagggctacat

SEQ ID NO: 13804 - DNA, 25 bp, Mus musculus
aaagccctgtagttcagggctacat

SEQ ID NO: 13805 - DNA, 25 bp, Mus musculus
aaagccctgtcaccagaaactctgg

SEQ ID NO: 13806 - DNA, 25 bp, Mus musculus
aaagccctgtcagcagaaactctgg

SEQ ID NO: 13807 - DNA, 25 bp, Mus musculus
aaagccctgtgaatgtggtcccctt

SEQ ID NO: 13808 - DNA, 25 bp, Mus musculus
aaagccctgtgattgtggtcccctt

SEQ ID NO: 13809 - DNA, 25 bp, Mus musculus
aaagccctgtggatcttgggcctat

SEQ ID NO: 13810 - DNA, 25 bp, Mus musculus
aaagccctgtggttcttgggcctat

SEQ ID NO: 13811 - DNA, 25 bp, Mus musculus
aaagccctgttaagccacagaaatg

SEQ ID NO: 13812 - DNA, 25 bp, Mus musculus
aaagccctgttatgccacagaaatg

SEQ ID NO: 13813 - DNA, 25 bp, Mus musculus
aaagccctgttcatttggcatacgt

SEQ ID NO: 13814 - DNA, 25 bp, Mus musculus
aaagccctgttcttttggcatacgt

SEQ ID NO: 13815 - DNA, 25 bp, Mus musculus
aaagccctgtttagggtcctcgctg

SEQ ID NO: 13816 - DNA, 25 bp, Mus musculus
aaagccctgttttgggtcctcgctg

SEQ ID NO: 13817 - DNA, 25 bp, Mus musculus
aaagcccttaacaaattcatcacat

SEQ ID NO: 13818 - DNA, 25 bp, Mus musculus
aaagcccttaactaattcatcacat

SEQ ID NO: 13819 - DNA, 25 bp, Mus musculus
aaagcccttacaatctacaactaca

SEQ ID NO: 13820 - DNA, 25 bp, Mus musculus
aaagcccttacattctacaactaca

SEQ ID NO: 13821 - DNA, 25 bp, Mus musculus
aaagcccttacgctggacaggcatg

SEQ ID NO: 13822 - DNA, 25 bp, Mus musculus
aaagcccttacggtggacaggcatg

SEQ ID NO: 13823 - DNA, 25 bp, Mus musculus
aaagcccttatcattttcggtactg

SEQ ID NO: 13824 - DNA, 25 bp, Mus musculus
aaagcccttatctttttcggtactg

SEQ ID NO: 13825 - DNA, 25 bp, Mus musculus
aaagcccttccacaggatgcgaaga

SEQ ID NO: 13826 - DNA, 25 bp, Mus musculus
aaagcccttccagaggatgcgaaga

SEQ ID NO: 13827 - DNA, 25 bp, Mus musculus
aaagcccttcgccattgtggaatga

SEQ ID NO: 13828 - DNA, 25 bp, Mus musculus
aaagcccttcgcgattgtggaatga

SEQ ID NO: 13829 - DNA, 25 bp, Mus musculus
aaagcccttctaccctagagtcatg

SEQ ID NO: 13830 - DNA, 25 bp, Mus musculus
aaagcccttctagcctagagtcatg

SEQ ID NO: 13831 - DNA, 25 bp, Mus musculus
aaagcccttctgattggcagaggac

SEQ ID NO: 13832 - DNA, 25 bp, Mus musculus
aaagcccttctgcagtggcaacctg

SEQ ID NO: 13833 - DNA, 25 bp, Mus musculus
aaagcccttctggagtggcaacctg

SEQ ID NO: 13834 - DNA, 25 bp, Mus musculus
aaagcccttctgtttggcagaggac

SEQ ID NO: 13835 - DNA, 25 bp, Mus musculus
aaagcccttggaactacgcatcaaa

SEQ ID NO: 13836 - DNA, 25 bp, Mus musculus
aaagcccttggatctacgcatcaaa

SEQ ID NO: 13837 - DNA, 25 bp, Mus musculus
aaagcccttggcatatccactgaag

SEQ ID NO: 13838 - DNA, 25 bp, Mus musculus
aaagcccttggcttatccactgaag

SEQ ID NO: 13839 - DNA, 25 bp, Mus musculus
aaagccctttacactttggagccag

SEQ ID NO: 13840 - DNA, 25 bp, Mus musculus
aaagccctttactctttggagccag

SEQ ID NO: 13841 - DNA, 25 bp, Mus musculus
aaagccgacacaagtcacagctctg

SEQ ID NO: 13842 - DNA, 25 bp, Mus musculus
aaagccgacacatgtcacagctctg

SEQ ID NO: 13843 - DNA, 25 bp, Mus musculus
aaagccgaccagcacctgctttttg

SEQ ID NO: 13844 - DNA, 25 bp, Mus musculus
aaagccgaccaggacctgctttttg

SEQ ID NO: 13845 - DNA, 25 bp, Mus musculus
aaagccgagaacagcgccgccctgt

SEQ ID NO: 13846 - DNA, 25 bp, Mus musculus
aaagccgagaactgcgccgccctgt

SEQ ID NO: 13847 - DNA, 25 bp, Mus musculus
aaagccgagctccatatgctagcaa

SEQ ID NO: 13848 - DNA, 25 bp, Mus musculus
aaagccgagctcgatatgctagcaa

SEQ ID NO: 13849 - DNA, 25 bp, Mus musculus
aaagccgaggcacacaagattttcc

SEQ ID NO: 13850 - DNA, 25 bp, Mus musculus
aaagccgaggcagacaagattttcc

SEQ ID NO: 13851 - DNA, 25 bp, Mus musculus
aaagccgaggctattagacatttat

SEQ ID NO: 13852 - DNA, 25 bp, Mus musculus
aaagccgaggcttttagacatttat

SEQ ID NO: 13853 - DNA, 25 bp, Mus musculus
aaagccgagggacgcgcacagaaca

SEQ ID NO: 13854 - DNA, 25 bp, Mus musculus
aaagccgagggaggcgcacagaaca

SEQ ID NO: 13855 - DNA, 25 bp, Mus musculus
aaagccgatggaattcagggagcct

SEQ ID NO: 13856 - DNA, 25 bp, Mus musculus
aaagccgatggatttcagggagcct

SEQ ID NO: 13857 - DNA, 25 bp, Mus musculus
aaagccgatgttactggttcagcct

SEQ ID NO: 13858 - DNA, 25 bp, Mus musculus
aaagccgatgtttctggttcagcct

SEQ ID NO: 13859 - DNA, 25 bp, Mus musculus
aaagccgcaccacaatgaacactgt

SEQ ID NO: 13860 - DNA, 25 bp, Mus musculus
aaagccgcaccagaatgaacactgt

SEQ ID NO: 13861 - DNA, 25 bp, Mus musculus
aaagccgcacttaataccccaactg

SEQ ID NO: 13862 - DNA, 25 bp, Mus musculus
aaagccgcactttataccccaactg

SEQ ID NO: 13863 - DNA, 25 bp, Mus musculus
aaagccgcatgcatggcattcctct

SEQ ID NO: 13864 - DNA, 25 bp, Mus musculus
aaagccgcatgcttggcattcctct

SEQ ID NO: 13865 - DNA, 25 bp, Mus musculus
aaagccgccgttagcttctccaggt

SEQ ID NO: 13866 - DNA, 25 bp, Mus musculus
aaagccgccgtttgcttctccaggt

SEQ ID NO: 13867 - DNA, 25 bp, Mus musculus
aaagccgcctccacagggatggcaa

SEQ ID NO: 13868 - DNA, 25 bp, Mus musculus
aaagccgcctcctcagggatggcaa

SEQ ID NO: 13869 - DNA, 25 bp, Mus musculus
aaagccgcgaagaccttagggatca

SEQ ID NO: 13870 - DNA, 25 bp, Mus musculus
aaagccgcgaagtccttagggatca

SEQ ID NO: 13871 - DNA, 25 bp, Mus musculus
aaagccgctggtattctatgaagga

SEQ ID NO: 13872 - DNA, 25 bp, Mus musculus
aaagccgctggttttctatgaagga

SEQ ID NO: 13873 - DNA, 25 bp, Mus musculus
aaagccggaggactccagttctctt

SEQ ID NO: 13874 - DNA, 25 bp, Mus musculus
aaagccggaggagtccagttctctt

SEQ ID NO: 13875 - DNA, 25 bp, Mus musculus
aaagccggaggtacatggcgctttt

SEQ ID NO: 13876 - DNA, 25 bp, Mus musculus
aaagccggaggttcatggcgctttt

SEQ ID NO: 13877 - DNA, 25 bp, Mus musculus
aaagccggcctgatgggaactctag

SEQ ID NO: 13878 - DNA, 25 bp, Mus musculus
aaagccggcctgttgggaactctag

SEQ ID NO: 13879 - DNA, 25 bp, Mus musculus
aaagccgggaccaagagcccagcgg

SEQ ID NO: 13880 - DNA, 25 bp, Mus musculus
aaagccgggacctagagcccagcgg

SEQ ID NO: 13881 - DNA, 25 bp, Mus musculus
aaagccgggcacaggtgacacatgc

SEQ ID NO: 13882 - DNA, 25 bp, Mus musculus
aaagccgggcactggtgacacatgc

SEQ ID NO: 13883 - DNA, 25 bp, Mus musculus
aaagccggtccaacagctctggctg

SEQ ID NO: 13884 - DNA, 25 bp, Mus musculus
aaagccggtccatcagctctggctg

SEQ ID NO: 13885 - DNA, 25 bp, Mus musculus
aaagccggtggtcactttgctacgg

SEQ ID NO: 13886 - DNA, 25 bp, Mus musculus
aaagccggtggtgactttgctacgg

SEQ ID NO: 13887 - DNA, 25 bp, Mus musculus
aaagccggttcactcagccaacctg

SEQ ID NO: 13888 - DNA, 25 bp, Mus musculus
aaagccggttcagtcagccaacctg

SEQ ID NO: 13889 - DNA, 25 bp, Mus musculus
aaagccgtatcaatgtagcgagtgt

SEQ ID NO: 13890 - DNA, 25 bp, Mus musculus
aaagccgtatcattgtagcgagtgt

SEQ ID NO: 13891 - DNA, 25 bp, Mus musculus
aaagccgtcagtattccatgggccc

SEQ ID NO: 13892 - DNA, 25 bp, Mus musculus
aaagccgtcagttttccatgggccc

SEQ ID NO: 13893 - DNA, 25 bp, Mus musculus
aaagccgtcattcgaggtgaccaca

SEQ ID NO: 13894 - DNA, 25 bp, Mus musculus
aaagccgtcattggaggtgaccaca

SEQ ID NO: 13895 - DNA, 25 bp, Mus musculus
aaagccgtgcaacacttctacagtg

SEQ ID NO: 13896 - DNA, 25 bp, Mus musculus
aaagccgtgcaagacttctacagtg

SEQ ID NO: 13897 - DNA, 25 bp, Mus musculus
aaagccgtgcccctggacagacaag

SEQ ID NO: 13898 - DNA, 25 bp, Mus musculus
aaagccgtgcccgtggacagacaag

SEQ ID NO: 13899 - DNA, 25 bp, Mus musculus
aaagccgtgtcactgggatatccag

SEQ ID NO: 13900 - DNA, 25 bp, Mus musculus
aaagccgtgtcagtgggatatccag

SEQ ID NO: 13901 - DNA, 25 bp, Mus musculus
aaagccgtgtgtacagcgcaatgcc

SEQ ID NO: 13902 - DNA, 25 bp, Mus musculus
aaagccgtgtgttcagcgcaatgcc

SEQ ID NO: 13903 - DNA, 25 bp, Mus musculus
aaagccgttggactctggctccgtg

SEQ ID NO: 13904 - DNA, 25 bp, Mus musculus
aaagccgttggagtctggctccgtg

SEQ ID NO: 13905 - DNA, 25 bp, Mus musculus
aaagccgttggccaatcagttggag

SEQ ID NO: 13906 - DNA, 25 bp, Mus musculus
aaagccgttggcgaatcagttggag

SEQ ID NO: 13907 - DNA, 25 bp, Mus musculus
aaagccgttgtaaccacgagaacac

SEQ ID NO: 13908 - DNA, 25 bp, Mus musculus
aaagccgttgtatccacgagaacac

SEQ ID NO: 13909 - DNA, 25 bp, Mus musculus
aaagccgtttcactgtccatgggac

SEQ ID NO: 13910 - DNA, 25 bp, Mus musculus
aaagccgtttcagtgtccatgggac

SEQ ID NO: 13911 - DNA, 25 bp, Mus musculus
aaagcctaagctcaagggttgtgaa

SEQ ID NO: 13912 - DNA, 25 bp, Mus musculus
aaagcctaagctgaagggttgtgaa

SEQ ID NO: 13913 - DNA, 25 bp, Mus musculus
aaagcctaagtaatctcatagacta

SEQ ID NO: 13914 - DNA, 25 bp, Mus musculus
aaagcctaagtattctcatagacta

SEQ ID NO: 13915 - DNA, 25 bp, Mus musculus
aaagcctacacaaatcgcctgtacg

SEQ ID NO: 13916 - DNA, 25 bp, Mus musculus
aaagcctacacacgtgctacgggtg

SEQ ID NO: 13917 - DNA, 25 bp, Mus musculus
aaagcctacacaggtgctacgggtg

SEQ ID NO: 13918 - DNA, 25 bp, Mus musculus
aaagcctacacatatcgcctgtacg

SEQ ID NO: 13919 - DNA, 25 bp, Mus musculus
aaagcctacataaccttcacctaaa

SEQ ID NO: 13920 - DNA, 25 bp, Mus musculus
aaagcctacatatccttcacctaaa

SEQ ID NO: 13921 - DNA, 25 bp, Mus musculus
aaagcctacctcctctaccagtgat

SEQ ID NO: 13922 - DNA, 25 bp, Mus musculus
aaagcctacctcgtctaccagtgat

SEQ ID NO: 13923 - DNA, 25 bp, Mus musculus
aaagcctactacctaactgagaatg

SEQ ID NO: 13924 - DNA, 25 bp, Mus musculus
aaagcctactacgtaactgagaatg

SEQ ID NO: 13925 - DNA, 25 bp, Mus musculus
aaagcctactttactttgctgccat

SEQ ID NO: 13926 - DNA, 25 bp, Mus musculus
aaagcctacttttctttgctgccat

SEQ ID NO: 13927 - DNA, 25 bp, Mus musculus
aaagcctagagccacctcagaggga

SEQ ID NO: 13928 - DNA, 25 bp, Mus musculus
aaagcctagagcgacctcagaggga

SEQ ID NO: 13929 - DNA, 25 bp, Mus musculus
aaagcctaggataactgccatctgg

SEQ ID NO: 13930 - DNA, 25 bp, Mus musculus
aaagcctaggattactgccatctgg

SEQ ID NO: 13931 - DNA, 25 bp, Mus musculus
aaagcctaggccattaccagtcctg

SEQ ID NO: 13932 - DNA, 25 bp, Mus musculus
aaagcctaggcctttaccagtcctg

SEQ ID NO: 13933 - DNA, 25 bp, Mus musculus
aaagcctatcagctgtacatctaca

SEQ ID NO: 13934 - DNA, 25 bp, Mus musculus
aaagcctatcaggtgtacatctaca

SEQ ID NO: 13935 - DNA, 25 bp, Mus musculus
aaagcctatccaacatcgttcaagc

SEQ ID NO: 13936 - DNA, 25 bp, Mus musculus
aaagcctatccatcatcgttcaagc

SEQ ID NO: 13937 - DNA, 25 bp, Mus musculus
aaagcctatcccatcgttcaagtat

SEQ ID NO: 13938 - DNA, 25 bp, Mus musculus
aaagcctatcccttcgttcaagtat

SEQ ID NO: 13939 - DNA, 25 bp, Mus musculus
aaagcctatgagagttattattaaa

SEQ ID NO: 13940 - DNA, 25 bp, Mus musculus
aaagcctatgagtgttattattaaa

SEQ ID NO: 13941 - DNA, 25 bp, Mus musculus
aaagcctatttcagccatggcaaat

SEQ ID NO: 13942 - DNA, 25 bp, Mus musculus
aaagcctatttctgccatggcaaat

SEQ ID NO: 13943 - DNA, 25 bp, Mus musculus
aaagcctcaagccttccatcgagac

SEQ ID NO: 13944 - DNA, 25 bp, Mus musculus
aaagcctcaagcgttccatcgagac

SEQ ID NO: 13945 - DNA, 25 bp, Mus musculus
aaagcctcacaaaatgatccataag

SEQ ID NO: 13946 - DNA, 25 bp, Mus musculus
aaagcctcacaatatgatccataag

SEQ ID NO: 13947 - DNA, 25 bp, Mus musculus
aaagcctcacagaactgtgcacagg

SEQ ID NO: 13948 - DNA, 25 bp, Mus musculus
aaagcctcacagcagcggtcagagc

SEQ ID NO: 13949 - DNA, 25 bp, Mus musculus
aaagcctcacaggagcggtcagagc

SEQ ID NO: 13950 - DNA, 25 bp, Mus musculus
aaagcctcacagtactgtgcacagg

SEQ ID NO: 13951 - DNA, 25 bp, Mus musculus
aaagcctcaggacctcaatcgaagc

SEQ ID NO: 13952 - DNA, 25 bp, Mus musculus
aaagcctcaggagctcaatcgaagc

SEQ ID NO: 13953 - DNA, 25 bp, Mus musculus
aaagcctcaggcacaagtttcaacg

SEQ ID NO: 13954 - DNA, 25 bp, Mus musculus
aaagcctcaggctcaagtttcaacg

SEQ ID NO: 13955 - DNA, 25 bp, Mus musculus
aaagcctcatccagtgcctttttag

SEQ ID NO: 13956 - DNA, 25 bp, Mus musculus
aaagcctcatcctgtgcctttttag

SEQ ID NO: 13957 - DNA, 25 bp, Mus musculus
aaagcctcatgaataccgccaggag

SEQ ID NO: 13958 - DNA, 25 bp, Mus musculus
aaagcctcatgattaccgccaggag

SEQ ID NO: 13959 - DNA, 25 bp, Mus musculus
aaagcctccactctctgtggaagat

SEQ ID NO: 13960 - DNA, 25 bp, Mus musculus
aaagcctccactgtctgtggaagat

SEQ ID NO: 13961 - DNA, 25 bp, Mus musculus
aaagcctccatgataaccagggctc

SEQ ID NO: 13962 - DNA, 25 bp, Mus musculus
aaagcctccatgttaaccagggctc

SEQ ID NO: 13963 - DNA, 25 bp, Mus musculus
aaagcctcctgacaccacctgtgtt

SEQ ID NO: 13964 - DNA, 25 bp, Mus musculus
aaagcctcctgacatctcttttcta

SEQ ID NO: 13965 - DNA, 25 bp, Mus musculus
aaagcctcctgagaccacctgtgtt

SEQ ID NO: 13966 - DNA, 25 bp, Mus musculus
aaagcctcctgagatctcttttcta

SEQ ID NO: 13967 - DNA, 25 bp, Mus musculus
aaagcctcctgcacaatgagtttct

SEQ ID NO: 13968 - DNA, 25 bp, Mus musculus
aaagcctcctgctcaatgagtttct

SEQ ID NO: 13969 - DNA, 25 bp, Mus musculus
aaagcctccttgagcaatggtctgt

SEQ ID NO: 13970 - DNA, 25 bp, Mus musculus
aaagcctccttgtgcaatggtctgt

SEQ ID NO: 13971 - DNA, 25 bp, Mus musculus
aaagcctcgagtagagtattctctt

SEQ ID NO: 13972 - DNA, 25 bp, Mus musculus
aaagcctcgagttgagtattctctt

SEQ ID NO: 13973 - DNA, 25 bp, Mus musculus
aaagcctcgggtcacagactcagta

SEQ ID NO: 13974 - DNA, 25 bp, Mus musculus
aaagcctcgggtgacagactcagta

SEQ ID NO: 13975 - DNA, 25 bp, Mus musculus
aaagcctcgtgaaatgtcactcatt

SEQ ID NO: 13976 - DNA, 25 bp, Mus musculus
aaagcctcgtgatatgtcactcatt

SEQ ID NO: 13977 - DNA, 25 bp, Mus musculus
aaagcctcgtggagttccagggccg

SEQ ID NO: 13978 - DNA, 25 bp, Mus musculus
aaagcctcgtggtgttccagggccg

SEQ ID NO: 13979 - DNA, 25 bp, Mus musculus
aaagcctcttaactggtgggctctc

SEQ ID NO: 13980 - DNA, 25 bp, Mus musculus
aaagcctcttaagtggtgggctctc

SEQ ID NO: 13981 - DNA, 25 bp, Mus musculus
aaagcctctttgatctaaaatattt

SEQ ID NO: 13982 - DNA, 25 bp, Mus musculus
aaagcctctttgttctaaaatattt

SEQ ID NO: 13983 - DNA, 25 bp, Mus musculus
aaagcctgaagactcgcctgctgag

SEQ ID NO: 13984 - DNA, 25 bp, Mus musculus
aaagcctgaagagtcgcctgctgag

SEQ ID NO: 13985 - DNA, 25 bp, Mus musculus
aaagcctgaagtcacctgttaccca

SEQ ID NO: 13986 - DNA, 25 bp, Mus musculus
aaagcctgaagtgacctgttaccca

SEQ ID NO: 13987 - DNA, 25 bp, Mus musculus
aaagcctgaatcagtacaattttat

SEQ ID NO: 13988 - DNA, 25 bp, Mus musculus
aaagcctgaatctgtacaattttat

SEQ ID NO: 13989 - DNA, 25 bp, Mus musculus
aaagcctgacaccttggctactggg

SEQ ID NO: 13990 - DNA, 25 bp, Mus musculus
aaagcctgacacgttggctactggg

SEQ ID NO: 13991 - DNA, 25 bp, Mus musculus
aaagcctgaccaactttaagacctt

SEQ ID NO: 13992 - DNA, 25 bp, Mus musculus
aaagcctgaccatctttaagacctt

SEQ ID NO: 13993 - DNA, 25 bp, Mus musculus
aaagcctgactgagctgttctctgt

SEQ ID NO: 13994 - DNA, 25 bp, Mus musculus
aaagcctgactgtgctgttctctgt

SEQ ID NO: 13995 - DNA, 25 bp, Mus musculus
aaagcctgacttcgcagtgtgcatg

SEQ ID NO: 13996 - DNA, 25 bp, Mus musculus
aaagcctgacttggcagtgtgcatg

SEQ ID NO: 13997 - DNA, 25 bp, Mus musculus
aaagcctgagctctaatctgaaaac

SEQ ID NO: 13998 - DNA, 25 bp, Mus musculus
aaagcctgagctgtaatctgaaaac

SEQ ID NO: 13999 - DNA, 25 bp, Mus musculus
aaagcctgatagaataaatctgcca

SEQ ID NO: 14000 - DNA, 25 bp, Mus musculus
aaagcctgatagcagctgaactgga

SEQ ID NO: 14001 - DNA, 25 bp, Mus musculus
aaagcctgataggagctgaactgga

SEQ ID NO: 14002 - DNA, 25 bp, Mus musculus
aaagcctgatagtataaatctgcca

SEQ ID NO: 14003 - DNA, 25 bp, Mus musculus
aaagcctgatgtcttgcgtctgtag

SEQ ID NO: 14004 - DNA, 25 bp, Mus musculus
aaagcctgatgtgttgcgtctgtag

SEQ ID NO: 14005 - DNA, 25 bp, Mus musculus
aaagcctgcaacatttcattctaat

SEQ ID NO: 14006 - DNA, 25 bp, Mus musculus
aaagcctgcaacttttcattctaat

SEQ ID NO: 14007 - DNA, 25 bp, Mus musculus
aaagcctgcaatacttgcttcctga

SEQ ID NO: 14008 - DNA, 25 bp, Mus musculus
aaagcctgcaattcttgcttcctga

SEQ ID NO: 14009 - DNA, 25 bp, Mus musculus
aaagcctgcactacattgaggacac

SEQ ID NO: 14010 - DNA, 25 bp, Mus musculus
aaagcctgcacttcattgaggacac

SEQ ID NO: 14011 - DNA, 25 bp, Mus musculus
aaagcctgcatcaaccagcacctga

SEQ ID NO: 14012 - DNA, 25 bp, Mus musculus
aaagcctgcatcctcatttcatgtg

SEQ ID NO: 14013 - DNA, 25 bp, Mus musculus
aaagcctgcatcgtcatttcatgtg

SEQ ID NO: 14014 - DNA, 25 bp, Mus musculus
aaagcctgcatctaccagcacctga

SEQ ID NO: 14015 - DNA, 25 bp, Mus musculus
aaagcctgcctcatcagcttgggtt

SEQ ID NO: 14016 - DNA, 25 bp, Mus musculus
aaagcctgcctcttcagcttgggtt

SEQ ID NO: 14017 - DNA, 25 bp, Mus musculus
aaagcctgccttacagaggaagcca

SEQ ID NO: 14018 - DNA, 25 bp, Mus musculus
aaagcctgcctttcagaggaagcca

SEQ ID NO: 14019 - DNA, 25 bp, Mus musculus
aaagcctgcgctcagtctacaactt

SEQ ID NO: 14020 - DNA, 25 bp, Mus musculus
aaagcctgcgctgagtctacaactt

SEQ ID NO: 14021 - DNA, 25 bp, Mus musculus
aaagcctgctccaaatgccacattt

SEQ ID NO: 14022 - DNA, 25 bp, Mus musculus
aaagcctgctcctaatgccacattt

SEQ ID NO: 14023 - DNA, 25 bp, Mus musculus
aaagcctgcttgctctggacccaaa

SEQ ID NO: 14024 - DNA, 25 bp, Mus musculus
aaagcctgcttggtctggacccaaa

SEQ ID NO: 14025 - DNA, 25 bp, Mus musculus
aaagcctggaaactgtagcgcccgg

SEQ ID NO: 14026 - DNA, 25 bp, Mus musculus
aaagcctggaaagtgtagcgcccgg

SEQ ID NO: 14027 - DNA, 25 bp, Mus musculus
aaagcctggaacacaatggtactca

SEQ ID NO: 14028 - DNA, 25 bp, Mus musculus
aaagcctggaactcaatggtactca

SEQ ID NO: 14029 - DNA, 25 bp, Mus musculus
aaagcctggactacagctcttacag

SEQ ID NO: 14030 - DNA, 25 bp, Mus musculus
aaagcctggacttcagctcttacag

SEQ ID NO: 14031 - DNA, 25 bp, Mus musculus
aaagcctggagcctaagatgacaaa

SEQ ID NO: 14032 - DNA, 25 bp, Mus musculus
aaagcctggagcgtaagatgacaaa

SEQ ID NO: 14033 - DNA, 25 bp, Mus musculus
aaagcctggagtcgctcctgtccaa

SEQ ID NO: 14034 - DNA, 25 bp, Mus musculus
aaagcctggagtggctcctgtccaa

SEQ ID NO: 14035 - DNA, 25 bp, Mus musculus
aaagcctggcgtcgttcatttgaat

SEQ ID NO: 14036 - DNA, 25 bp, Mus musculus
aaagcctggcgtggttcatttgaat

SEQ ID NO: 14037 - DNA, 25 bp, Mus musculus
aaagcctggctaaaacggttgacat

SEQ ID NO: 14038 - DNA, 25 bp, Mus musculus
aaagcctggctataacggttgacat

SEQ ID NO: 14039 - DNA, 25 bp, Mus musculus
aaagcctggctcatttggcttccgt

SEQ ID NO: 14040 - DNA, 25 bp, Mus musculus
aaagcctggctcttttggcttccgt

SEQ ID NO: 14041 - DNA, 25 bp, Mus musculus
aaagcctgggtgagcgtgcgctccc

SEQ ID NO: 14042 - DNA, 25 bp, Mus musculus
aaagcctgggtgctgagcccactgt

SEQ ID NO: 14043 - DNA, 25 bp, Mus musculus
aaagcctgggtggtgagcccactgt

SEQ ID NO: 14044 - DNA, 25 bp, Mus musculus
aaagcctgggtgtgcgtgcgctccc

SEQ ID NO: 14045 - DNA, 25 bp, Mus musculus
aaagcctggtccagtgtgctctgta

SEQ ID NO: 14046 - DNA, 25 bp, Mus musculus
aaagcctggtcctgtgtgctctgta

SEQ ID NO: 14047 - DNA, 25 bp, Mus musculus
aaagcctggtgtagctgaggtccaa

SEQ ID NO: 14048 - DNA, 25 bp, Mus musculus
aaagcctggtgttgctgaggtccaa

SEQ ID NO: 14049 - DNA, 25 bp, Mus musculus
aaagcctggttgaggatctctgtgt

SEQ ID NO: 14050 - DNA, 25 bp, Mus musculus
aaagcctggttgtggatctctgtgt

SEQ ID NO: 14051 - DNA, 25 bp, Mus musculus
aaagcctgtaacctggaggtgcttg

SEQ ID NO: 14052 - DNA, 25 bp, Mus musculus
aaagcctgtaacgtggaggtgcttg

SEQ ID NO: 14053 - DNA, 25 bp, Mus musculus
aaagcctgtgatcggctagtggcca

SEQ ID NO: 14054 - DNA, 25 bp, Mus musculus
aaagcctgtgatgggctagtggcca

SEQ ID NO: 14055 - DNA, 25 bp, Mus musculus
aaagcctgttcccaagaccattgac

SEQ ID NO: 14056 - DNA, 25 bp, Mus musculus
aaagcctgttccgaagaccattgac

SEQ ID NO: 14057 - DNA, 25 bp, Mus musculus
aaagccttaagtcacttcctcctca

SEQ ID NO: 14058 - DNA, 25 bp, Mus musculus
aaagccttaagtgacttcctcctca

SEQ ID NO: 14059 - DNA, 25 bp, Mus musculus
aaagccttaggtcggacatcagcgg

SEQ ID NO: 14060 - DNA, 25 bp, Mus musculus
aaagccttaggtgggacatcagcgg

SEQ ID NO: 14061 - DNA, 25 bp, Mus musculus
aaagccttatgtctgcgacacctgc

SEQ ID NO: 14062 - DNA, 25 bp, Mus musculus
aaagccttatgtgtgcgacacctgc

SEQ ID NO: 14063 - DNA, 25 bp, Mus musculus
aaagccttattgcatctgatcagat

SEQ ID NO: 14064 - DNA, 25 bp, Mus musculus
aaagccttattggatctgatcagat

SEQ ID NO: 14065 - DNA, 25 bp, Mus musculus
aaagccttcaaaactccaagatgga

SEQ ID NO: 14066 - DNA, 25 bp, Mus musculus
aaagccttcaaacacaagtctcacc

SEQ ID NO: 14067 - DNA, 25 bp, Mus musculus
aaagccttcaaaccaggcccagtgg

SEQ ID NO: 14068 - DNA, 25 bp, Mus musculus
aaagccttcaaagacaagtctcacc

SEQ ID NO: 14069 - DNA, 25 bp, Mus musculus
aaagccttcaaagcaggcccagtgg

SEQ ID NO: 14070 - DNA, 25 bp, Mus musculus
aaagccttcaaatctccaagatgga

SEQ ID NO: 14071 - DNA, 25 bp, Mus musculus
aaagccttcacacgtcaggtagacc

SEQ ID NO: 14072 - DNA, 25 bp, Mus musculus
aaagccttcacaggtcaggtagacc

SEQ ID NO: 14073 - DNA, 25 bp, Mus musculus
aaagccttcactcgcgagggccaga

SEQ ID NO: 14074 - DNA, 25 bp, Mus musculus
aaagccttcactggcgagggccaga

SEQ ID NO: 14075 - DNA, 25 bp, Mus musculus
aaagccttcatgattgtcatggaaa

SEQ ID NO: 14076 - DNA, 25 bp, Mus musculus
aaagccttcatgtttgtcatggaaa

SEQ ID NO: 14077 - DNA, 25 bp, Mus musculus
aaagccttccaaaaggtgccaacct

SEQ ID NO: 14078 - DNA, 25 bp, Mus musculus
aaagccttccaataggtgccaacct

SEQ ID NO: 14079 - DNA, 25 bp, Mus musculus
aaagccttccacagagattttgaaa

SEQ ID NO: 14080 - DNA, 25 bp, Mus musculus
aaagccttccactgagattttgaaa

SEQ ID NO: 14081 - DNA, 25 bp, Mus musculus
aaagccttcccaagcagaagcggct

SEQ ID NO: 14082 - DNA, 25 bp, Mus musculus
aaagccttcccacaatatccttggg

SEQ ID NO: 14083 - DNA, 25 bp, Mus musculus
aaagccttcccacttttagtctgag

SEQ ID NO: 14084 - DNA, 25 bp, Mus musculus
aaagccttcccagaatatccttggg

SEQ ID NO: 14085 - DNA, 25 bp, Mus musculus
aaagccttcccagttttagtctgag

SEQ ID NO: 14086 - DNA, 25 bp, Mus musculus
aaagccttcccatgcagaagcggct

SEQ ID NO: 14087 - DNA, 25 bp, Mus musculus
aaagccttccttacacagttactgc

SEQ ID NO: 14088 - DNA, 25 bp, Mus musculus
aaagccttcctttcacagttactgc

SEQ ID NO: 14089 - DNA, 25 bp, Mus musculus
aaagccttctctaaacaacatggaa

SEQ ID NO: 14090 - DNA, 25 bp, Mus musculus
aaagccttctcttaacaacatggaa

SEQ ID NO: 14091 - DNA, 25 bp, Mus musculus
aaagccttctgaatcactcgctttg

SEQ ID NO: 14092 - DNA, 25 bp, Mus musculus
aaagccttctgattcactcgctttg

SEQ ID NO: 14093 - DNA, 25 bp, Mus musculus
aaagccttgagcactgaatacaaca

SEQ ID NO: 14094 - DNA, 25 bp, Mus musculus
aaagccttgagctctgaatacaaca

SEQ ID NO: 14095 - DNA, 25 bp, Mus musculus
aaagccttgattagtggtgttgaaa

SEQ ID NO: 14096 - DNA, 25 bp, Mus musculus
aaagccttgatttgtggtgttgaaa

SEQ ID NO: 14097 - DNA, 25 bp, Mus musculus
aaagccttgcccaaagattttctct

SEQ ID NO: 14098 - DNA, 25 bp, Mus musculus
aaagccttgcccaggaagtccaaag

SEQ ID NO: 14099 - DNA, 25 bp, Mus musculus
aaagccttgccctaagattttctct

SEQ ID NO: 14100 - DNA, 25 bp, Mus musculus
aaagccttgccctggaagtccaaag

SEQ ID NO: 14101 - DNA, 25 bp, Mus musculus
aaagccttgcgtactgctacctaag

SEQ ID NO: 14102 - DNA, 25 bp, Mus musculus
aaagccttgcgttctgctacctaag

SEQ ID NO: 14103 - DNA, 25 bp, Mus musculus
aaagccttggacagagttccacaac

SEQ ID NO: 14104 - DNA, 25 bp, Mus musculus
aaagccttggactgagttccacaac

SEQ ID NO: 14105 - DNA, 25 bp, Mus musculus
aaagccttggctattctcagtgtgg

SEQ ID NO: 14106 - DNA, 25 bp, Mus musculus
aaagccttggctctgttaacactcc

SEQ ID NO: 14107 - DNA, 25 bp, Mus musculus
aaagccttggctgtgttaacactcc

SEQ ID NO: 14108 - DNA, 25 bp, Mus musculus
aaagccttggcttttctcagtgtgg

SEQ ID NO: 14109 - DNA, 25 bp, Mus musculus
aaagccttggtcatccaggagtctg

SEQ ID NO: 14110 - DNA, 25 bp, Mus musculus
aaagccttggtcttccaggagtctg

SEQ ID NO: 14111 - DNA, 25 bp, Mus musculus
aaagccttgtcaaggcagccaggag

SEQ ID NO: 14112 - DNA, 25 bp, Mus musculus
aaagccttgtcatggcagccaggag

SEQ ID NO: 14113 - DNA, 25 bp, Mus musculus
aaagccttgtgtctaaatcagtgta

SEQ ID NO: 14114 - DNA, 25 bp, Mus musculus
aaagccttgtgtgtaaatcagtgta

SEQ ID NO: 14115 - DNA, 25 bp, Mus musculus
aaagccttgttaatggtcaagcggg

SEQ ID NO: 14116 - DNA, 25 bp, Mus musculus
aaagccttgttattggtcaagcggg

SEQ ID NO: 14117 - DNA, 25 bp, Mus musculus
aaagcctttaggcatcagtgcatct

SEQ ID NO: 14118 - DNA, 25 bp, Mus musculus
aaagcctttagggatcagtgcatct

SEQ ID NO: 14119 - DNA, 25 bp, Mus musculus
aaagcctttatgaatcatagttctc

SEQ ID NO: 14120 - DNA, 25 bp, Mus musculus
aaagcctttatgtatcatagttctc

SEQ ID NO: 14121 - DNA, 25 bp, Mus musculus
aaagcctttcacagttgtttctctg

SEQ ID NO: 14122 - DNA, 25 bp, Mus musculus
aaagcctttcaccaaacaataccag

SEQ ID NO: 14123 - DNA, 25 bp, Mus musculus
aaagcctttcacgaaacaataccag

SEQ ID NO: 14124 - DNA, 25 bp, Mus musculus
aaagcctttcactgttgtttctctg

SEQ ID NO: 14125 - DNA, 25 bp, Mus musculus
aaagcctttccaaatttttgatgag

SEQ ID NO: 14126 - DNA, 25 bp, Mus musculus
aaagcctttccatatttttgatgag

SEQ ID NO: 14127 - DNA, 25 bp, Mus musculus
aaagcctttctgatctatcatggca

SEQ ID NO: 14128 - DNA, 25 bp, Mus musculus
aaagcctttctgttctatcatggca

SEQ ID NO: 14129 - DNA, 25 bp, Mus musculus
aaagcctttgcacagtttggacgtc

SEQ ID NO: 14130 - DNA, 25 bp, Mus musculus
aaagcctttgcagagtttggacgtc

SEQ ID NO: 14131 - DNA, 25 bp, Mus musculus
aaagcctttgccaggcatcatcatg

SEQ ID NO: 14132 - DNA, 25 bp, Mus musculus
aaagcctttgccatgaatgtaagtc

SEQ ID NO: 14133 - DNA, 25 bp, Mus musculus
aaagcctttgcctggcatcatcatg

SEQ ID NO: 14134 - DNA, 25 bp, Mus musculus
aaagcctttgccttgaatgtaagtc

SEQ ID NO: 14135 - DNA, 25 bp, Mus musculus
aaagcctttgcgaggaggtggttat

SEQ ID NO: 14136 - DNA, 25 bp, Mus musculus
aaagcctttgcgtggaggtggttat

SEQ ID NO: 14137 - DNA, 25 bp, Mus musculus
aaagcctttgtacatctgtcttaga

SEQ ID NO: 14138 - DNA, 25 bp, Mus musculus
aaagcctttgtacgttcaagtgatc

SEQ ID NO: 14139 - DNA, 25 bp, Mus musculus
aaagcctttgtagatctgtcttaga

SEQ ID NO: 14140 - DNA, 25 bp, Mus musculus
aaagcctttgtaggttcaagtgatc

SEQ ID NO: 14141 - DNA, 25 bp, Mus musculus
aaagcctttgttaacaggctcccat

SEQ ID NO: 14142 - DNA, 25 bp, Mus musculus
aaagcctttgttatccaggccatgg

SEQ ID NO: 14143 - DNA, 25 bp, Mus musculus
aaagcctttgtttacaggctcccat

SEQ ID NO: 14144 - DNA, 25 bp, Mus musculus
aaagcctttgttttccaggccatgg

SEQ ID NO: 14145 - DNA, 25 bp, Mus musculus
aaagccttttcacatggtagttatc

SEQ ID NO: 14146 - DNA, 25 bp, Mus musculus
aaagccttttcagatggtagttatc

SEQ ID NO: 14147 - DNA, 25 bp, Mus musculus
aaagccttttcccagcattataatc

SEQ ID NO: 14148 - DNA, 25 bp, Mus musculus
aaagccttttccgagcattataatc

SEQ ID NO: 14149 - DNA, 25 bp, Mus musculus
aaagccttttgcataatcacactaa

SEQ ID NO: 14150 - DNA, 25 bp, Mus musculus
aaagccttttgcttaatcacactaa

SEQ ID NO: 14151 - DNA, 25 bp, Mus musculus
aaagcctttttgctgctatctagga

SEQ ID NO: 14152 - DNA, 25 bp, Mus musculus
aaagcctttttggtgctatctagga

SEQ ID NO: 14153 - DNA, 25 bp, Mus musculus
aaagcgaactgaagccggcgcgtgt

SEQ ID NO: 14154 - DNA, 25 bp, Mus musculus
aaagcgaactgatgccggcgcgtgt

SEQ ID NO: 14155 - DNA, 25 bp, Mus musculus
aaagcgaagctgaatccgttgtgca

SEQ ID NO: 14156 - DNA, 25 bp, Mus musculus
aaagcgaagctgtatccgttgtgca

SEQ ID NO: 14157 - DNA, 25 bp, Mus musculus
aaagcgaagttcacccatgggcctc

SEQ ID NO: 14158 - DNA, 25 bp, Mus musculus
aaagcgaagttctcccatgggcctc

SEQ ID NO: 14159 - DNA, 25 bp, Mus musculus
aaagcgacagcacattgaagggcct

SEQ ID NO: 14160 - DNA, 25 bp, Mus musculus
aaagcgacagcagattgaagggcct

SEQ ID NO: 14161 - DNA, 25 bp, Mus musculus
aaagcgacccttccattgtattact

SEQ ID NO: 14162 - DNA, 25 bp, Mus musculus
aaagcgacccttgcattgtattact

SEQ ID NO: 14163 - DNA, 25 bp, Mus musculus
aaagcgacctagcatgaccgaacac

SEQ ID NO: 14164 - DNA, 25 bp, Mus musculus
aaagcgacctaggatgaccgaacac

SEQ ID NO: 14165 - DNA, 25 bp, Mus musculus
aaagcgacgcatcactgcctacttt

SEQ ID NO: 14166 - DNA, 25 bp, Mus musculus
aaagcgacgcatgactgcctacttt

SEQ ID NO: 14167 - DNA, 25 bp, Mus musculus
aaagcgacggttaaagactcacaat

SEQ ID NO: 14168 - DNA, 25 bp, Mus musculus
aaagcgacggtttaagactcacaat

SEQ ID NO: 14169 - DNA, 25 bp, Mus musculus
aaagcgagcagccactgatcttcaa

SEQ ID NO: 14170 - DNA, 25 bp, Mus musculus
aaagcgagcagcgactgatcttcaa

SEQ ID NO: 14171 - DNA, 25 bp, Mus musculus
aaagcgagcccgagcaagggccgac

SEQ ID NO: 14172 - DNA, 25 bp, Mus musculus
aaagcgagcccgtgcaagggccgac

SEQ ID NO: 14173 - DNA, 25 bp, Mus musculus
aaagcgagctgcacgagcggtacat

SEQ ID NO: 14174 - DNA, 25 bp, Mus musculus
aaagcgagctgctcgagcggtacat

SEQ ID NO: 14175 - DNA, 25 bp, Mus musculus
aaagcgagggaaatgatggtctctc

SEQ ID NO: 14176 - DNA, 25 bp, Mus musculus
aaagcgagggaattgatggtctctc

SEQ ID NO: 14177 - DNA, 25 bp, Mus musculus
aaagcgagtcctcttttatggaata

SEQ ID NO: 14178 - DNA, 25 bp, Mus musculus
aaagcgagtcctgttttatggaata

SEQ ID NO: 14179 - DNA, 25 bp, Mus musculus
aaagcgagtcgaccgccagcgaggg

SEQ ID NO: 14180 - DNA, 25 bp, Mus musculus
aaagcgagtcgagcgccagcgaggg

SEQ ID NO: 14181 - DNA, 25 bp, Mus musculus
aaagcgagtcttctcactaacagtt

SEQ ID NO: 14182 - DNA, 25 bp, Mus musculus
aaagcgagtcttgtcactaacagtt

SEQ ID NO: 14183 - DNA, 25 bp, Mus musculus
aaagcgagttccctcaggccgtgta

SEQ ID NO: 14184 - DNA, 25 bp, Mus musculus
aaagcgagttccgtcaggccgtgta

SEQ ID NO: 14185 - DNA, 25 bp, Mus musculus
aaagcgatatctcatcttgggcccg

SEQ ID NO: 14186 - DNA, 25 bp, Mus musculus
aaagcgatatctgatcttgggcccg

SEQ ID NO: 14187 - DNA, 25 bp, Mus musculus
aaagcgatcatccacttattcctga

SEQ ID NO: 14188 - DNA, 25 bp, Mus musculus
aaagcgatcatcgacttattcctga

SEQ ID NO: 14189 - DNA, 25 bp, Mus musculus
aaagcgatgcccctgctggagaatg

SEQ ID NO: 14190 - DNA, 25 bp, Mus musculus
aaagcgatgcccgtgctggagaatg

SEQ ID NO: 14191 - DNA, 25 bp, Mus musculus
aaagcgattcctaacaatgtgtgtg

SEQ ID NO: 14192 - DNA, 25 bp, Mus musculus
aaagcgattccttacaatgtgtgtg

SEQ ID NO: 14193 - DNA, 25 bp, Mus musculus
aaagcgcaagtacccaatccgctgt

SEQ ID NO: 14194 - DNA, 25 bp, Mus musculus
aaagcgcaagtagccaatccgctgt

SEQ ID NO: 14195 - DNA, 25 bp, Mus musculus
aaagcgcaatgtcgtggtcactgcc

SEQ ID NO: 14196 - DNA, 25 bp, Mus musculus
aaagcgcaatgtggtggtcactgcc

SEQ ID NO: 14197 - DNA, 25 bp, Mus musculus
aaagcgcaccatccagtttgtagat

SEQ ID NO: 14198 - DNA, 25 bp, Mus musculus
aaagcgcaccatgcagtttgtagat

SEQ ID NO: 14199 - DNA, 25 bp, Mus musculus
aaagcgcacgccctgcagagtgagt

SEQ ID NO: 14200 - DNA, 25 bp, Mus musculus
aaagcgcacgccgtgcagagtgagt

SEQ ID NO: 14201 - DNA, 25 bp, Mus musculus
aaagcgcacgtcagggcgatgcagc

SEQ ID NO: 14202 - DNA, 25 bp, Mus musculus
aaagcgcacgtctgggcgatgcagc

SEQ ID NO: 14203 - DNA, 25 bp, Mus musculus
aaagcgcagcagcattccaggttgg

SEQ ID NO: 14204 - DNA, 25 bp, Mus musculus
aaagcgcagcaggattccaggttgg

SEQ ID NO: 14205 - DNA, 25 bp, Mus musculus
aaagcgcagggccagcttgtccaat

SEQ ID NO: 14206 - DNA, 25 bp, Mus musculus
aaagcgcagggcgagcttgtccaat

SEQ ID NO: 14207 - DNA, 25 bp, Mus musculus
aaagcgcaggtgaaacaagcaagga

SEQ ID NO: 14208 - DNA, 25 bp, Mus musculus
aaagcgcaggtgtaacaagcaagga

SEQ ID NO: 14209 - DNA, 25 bp, Mus musculus
aaagcgcatcagctaagggtggaaa

SEQ ID NO: 14210 - DNA, 25 bp, Mus musculus
aaagcgcatcaggtaagggtggaaa

SEQ ID NO: 14211 - DNA, 25 bp, Mus musculus
aaagcgcatgaaactccgactggaa

SEQ ID NO: 14212 - DNA, 25 bp, Mus musculus
aaagcgcatgaatctccgactggaa

SEQ ID NO: 14213 - DNA, 25 bp, Mus musculus
aaagcgccagatagggtggtttcca

SEQ ID NO: 14214 - DNA, 25 bp, Mus musculus
aaagcgccagatattttcagtcagg

SEQ ID NO: 14215 - DNA, 25 bp, Mus musculus
aaagcgccagattgggtggtttcca

SEQ ID NO: 14216 - DNA, 25 bp, Mus musculus
aaagcgccagattttttcagtcagg

SEQ ID NO: 14217 - DNA, 25 bp, Mus musculus
aaagcgccagttacatctaagacca

SEQ ID NO: 14218 - DNA, 25 bp, Mus musculus
aaagcgccagtttcatctaagacca

SEQ ID NO: 14219 - DNA, 25 bp, Mus musculus
aaagcgcccccaacggaacagattg

SEQ ID NO: 14220 - DNA, 25 bp, Mus musculus
aaagcgcccccatcggaacagattg

SEQ ID NO: 14221 - DNA, 25 bp, Mus musculus
aaagcgccccttcataaggcagagt

SEQ ID NO: 14222 - DNA, 25 bp, Mus musculus
aaagcgccccttgataaggcagagt

SEQ ID NO: 14223 - DNA, 25 bp, Mus musculus
aaagcgccgtagcagcccttttggg

SEQ ID NO: 14224 - DNA, 25 bp, Mus musculus
aaagcgccgtaggagcccttttggg

SEQ ID NO: 14225 - DNA, 25 bp, Mus musculus
aaagcgcgtaccctcaggggtgctc

SEQ ID NO: 14226 - DNA, 25 bp, Mus musculus
aaagcgcgtaccgtcaggggtgctc

SEQ ID NO: 14227 - DNA, 25 bp, Mus musculus
aaagcgctactgaaggaagtgctgc

SEQ ID NO: 14228 - DNA, 25 bp, Mus musculus
aaagcgctactgtaggaagtgctgc

SEQ ID NO: 14229 - DNA, 25 bp, Mus musculus
aaagcgctagtacctagggtcccag

SEQ ID NO: 14230 - DNA, 25 bp, Mus musculus
aaagcgctagtagctagggtcccag

SEQ ID NO: 14231 - DNA, 25 bp, Mus musculus
aaagcgctatcacgccttggagcat

SEQ ID NO: 14232 - DNA, 25 bp, Mus musculus
aaagcgctatcaggccttggagcat

SEQ ID NO: 14233 - DNA, 25 bp, Mus musculus
aaagcgctatcgatcacgccgaggg

SEQ ID NO: 14234 - DNA, 25 bp, Mus musculus
aaagcgctatcgttcacgccgaggg

SEQ ID NO: 14235 - DNA, 25 bp, Mus musculus
aaagcgctcatgaactgtgaccatg

SEQ ID NO: 14236 - DNA, 25 bp, Mus musculus
aaagcgctcatgtactgtgaccatg

SEQ ID NO: 14237 - DNA, 25 bp, Mus musculus
aaagcgctgataactggcccaagaa

SEQ ID NO: 14238 - DNA, 25 bp, Mus musculus
aaagcgctgatatctggcccaagaa

SEQ ID NO: 14239 - DNA, 25 bp, Mus musculus
aaagcgctgcttcctgttgtcagga

SEQ ID NO: 14240 - DNA, 25 bp, Mus musculus
aaagcgctgcttgctgttgtcagga

SEQ ID NO: 14241 - DNA, 25 bp, Mus musculus
aaagcgctgtaaaactgaaccacct

SEQ ID NO: 14242 - DNA, 25 bp, Mus musculus
aaagcgctgtaatactgaaccacct

SEQ ID NO: 14243 - DNA, 25 bp, Mus musculus
aaagcgctgtatctcacctgaaaat

SEQ ID NO: 14244 - DNA, 25 bp, Mus musculus
aaagcgctgtatgtcacctgaaaat

SEQ ID NO: 14245 - DNA, 25 bp, Mus musculus
aaagcgctgtggagaattggtttaa

SEQ ID NO: 14246 - DNA, 25 bp, Mus musculus
aaagcgctgtggtgaattggtttaa

SEQ ID NO: 14247 - DNA, 25 bp, Mus musculus
aaagcgctgtgtagtctactgcatg

SEQ ID NO: 14248 - DNA, 25 bp, Mus musculus
aaagcgctgtgttgtctactgcatg

SEQ ID NO: 14249 - DNA, 25 bp, Mus musculus
aaagcgcttcagaggcactagccta

SEQ ID NO: 14250 - DNA, 25 bp, Mus musculus
aaagcgcttcagtggcactagccta

SEQ ID NO: 14251 - DNA, 25 bp, Mus musculus
aaagcggaactcctatgccaactgc

SEQ ID NO: 14252 - DNA, 25 bp, Mus musculus
aaagcggaactcgtatgccaactgc

SEQ ID NO: 14253 - DNA, 25 bp, Mus musculus
aaagcggaccctctattgtagttct

SEQ ID NO: 14254 - DNA, 25 bp, Mus musculus
aaagcggaccctgtattgtagttct

SEQ ID NO: 14255 - DNA, 25 bp, Mus musculus
aaagcggagaccaacctgcgggtca

SEQ ID NO: 14256 - DNA, 25 bp, Mus musculus
aaagcggagacctacctgcgggtca

SEQ ID NO: 14257 - DNA, 25 bp, Mus musculus
aaagcggagctgctccttagggcca

SEQ ID NO: 14258 - DNA, 25 bp, Mus musculus
aaagcggagctggtccttagggcca

SEQ ID NO: 14259 - DNA, 25 bp, Mus musculus
aaagcggatgttagctgagggtact

SEQ ID NO: 14260 - DNA, 25 bp, Mus musculus
aaagcggatgttcctttctgcagac

SEQ ID NO: 14261 - DNA, 25 bp, Mus musculus
aaagcggatgttgctttctgcagac

SEQ ID NO: 14262 - DNA, 25 bp, Mus musculus
aaagcggatgtttgctgagggtact

SEQ ID NO: 14263 - DNA, 25 bp, Mus musculus
aaagcggcacagacgagatgagtca

SEQ ID NO: 14264 - DNA, 25 bp, Mus musculus
aaagcggcacagtcgagatgagtca

SEQ ID NO: 14265 - DNA, 25 bp, Mus musculus
aaagcggcaggaaccgtggtacaat

SEQ ID NO: 14266 - DNA, 25 bp, Mus musculus
aaagcggcaggatccgtggtacaat

SEQ ID NO: 14267 - DNA, 25 bp, Mus musculus
aaagcggcaggcagatctggacact

SEQ ID NO: 14268 - DNA, 25 bp, Mus musculus
aaagcggcaggctgatctggacact

SEQ ID NO: 14269 - DNA, 25 bp, Mus musculus
aaagcggccaccaggaaggtgctgc

SEQ ID NO: 14270 - DNA, 25 bp, Mus musculus
aaagcggccacctggaaggtgctgc

SEQ ID NO: 14271 - DNA, 25 bp, Mus musculus
aaagcggccctccagaagcctgttt

SEQ ID NO: 14272 - DNA, 25 bp, Mus musculus
aaagcggccctcgagaagcctgttt

SEQ ID NO: 14273 - DNA, 25 bp, Mus musculus
aaagcggcctcaaaaggcaccgaat

SEQ ID NO: 14274 - DNA, 25 bp, Mus musculus
aaagcggcctcataaggcaccgaat

SEQ ID NO: 14275 - DNA, 25 bp, Mus musculus
aaagcggccttacctgagactgacg

SEQ ID NO: 14276 - DNA, 25 bp, Mus musculus
aaagcggccttagctgagactgacg

SEQ ID NO: 14277 - DNA, 25 bp, Mus musculus
aaagcggctcgacagtcctgcaggt

SEQ ID NO: 14278 - DNA, 25 bp, Mus musculus
aaagcggctcgagagtcctgcaggt

SEQ ID NO: 14279 - DNA, 25 bp, Mus musculus
aaagcggctggacctaaatttgtga

SEQ ID NO: 14280 - DNA, 25 bp, Mus musculus
aaagcggctggagctaaatttgtga

SEQ ID NO: 14281 - DNA, 25 bp, Mus musculus
aaagcgggagcaactttgcctccgg

SEQ ID NO: 14282 - DNA, 25 bp, Mus musculus
aaagcgggagcatctttgcctccgg

SEQ ID NO: 14283 - DNA, 25 bp, Mus musculus
aaagcgggagttacacctatcacac

SEQ ID NO: 14284 - DNA, 25 bp, Mus musculus
aaagcgggagtttcacctatcacac

SEQ ID NO: 14285 - DNA, 25 bp, Mus musculus
aaagcgggcacaatcagcctgtcat

SEQ ID NO: 14286 - DNA, 25 bp, Mus musculus
aaagcgggcacattcagcctgtcat

SEQ ID NO: 14287 - DNA, 25 bp, Mus musculus
aaagcgggcttccagacagtgctgc

SEQ ID NO: 14288 - DNA, 25 bp, Mus musculus
aaagcgggcttcgagacagtgctgc

SEQ ID NO: 14289 - DNA, 25 bp, Mus musculus
aaagcgggtcagcaatgacgcaacc

SEQ ID NO: 14290 - DNA, 25 bp, Mus musculus
aaagcgggtcaggaatgacgcaacc

SEQ ID NO: 14291 - DNA, 25 bp, Mus musculus
aaagcggtatcacttcttccataag

SEQ ID NO: 14292 - DNA, 25 bp, Mus musculus
aaagcggtatcagttcttccataag

SEQ ID NO: 14293 - DNA, 25 bp, Mus musculus
aaagcggtatcgctggaccacggat

SEQ ID NO: 14294 - DNA, 25 bp, Mus musculus
aaagcggtatcggtggaccacggat

SEQ ID NO: 14295 - DNA, 25 bp, Mus musculus
aaagcggtgcgcactggatgtgttt

SEQ ID NO: 14296 - DNA, 25 bp, Mus musculus
aaagcggtgcgctctggatgtgttt

SEQ ID NO: 14297 - DNA, 25 bp, Mus musculus
aaagcggtgctgaggagactgataa

SEQ ID NO: 14298 - DNA, 25 bp, Mus musculus
aaagcggtgctgtggagactgataa

SEQ ID NO: 14299 - DNA, 25 bp, Mus musculus
aaagcggttgagcacgccatcgctc

SEQ ID NO: 14300 - DNA, 25 bp, Mus musculus
aaagcggttgaggacgccatcgctc

SEQ ID NO: 14301 - DNA, 25 bp, Mus musculus
aaagcggttgcacatctaggatgtg

SEQ ID NO: 14302 - DNA, 25 bp, Mus musculus
aaagcggttgcagatctaggatgtg

SEQ ID NO: 14303 - DNA, 25 bp, Mus musculus
aaagcgtaagaaatcaagtcctagt

SEQ ID NO: 14304 - DNA, 25 bp, Mus musculus
aaagcgtaagaattcaagtcctagt

SEQ ID NO: 14305 - DNA, 25 bp, Mus musculus
aaagcgtagggcagcactgtgatgt

SEQ ID NO: 14306 - DNA, 25 bp, Mus musculus
aaagcgtagggctgcactgtgatgt

SEQ ID NO: 14307 - DNA, 25 bp, Mus musculus
aaagcgtatgttacgcactgctctt

SEQ ID NO: 14308 - DNA, 25 bp, Mus musculus
aaagcgtatgtttcgcactgctctt

SEQ ID NO: 14309 - DNA, 25 bp, Mus musculus
aaagcgtcactgctacacgttttca

SEQ ID NO: 14310 - DNA, 25 bp, Mus musculus
aaagcgtcactggtacacgttttca

SEQ ID NO: 14311 - DNA, 25 bp, Mus musculus
aaagcgtccgcaccgtgttcaagga

SEQ ID NO: 14312 - DNA, 25 bp, Mus musculus
aaagcgtccgcagcgtgttcaagga

SEQ ID NO: 14313 - DNA, 25 bp, Mus musculus
aaagcgtcctatacatcatctgtga

SEQ ID NO: 14314 - DNA, 25 bp, Mus musculus
aaagcgtcctattcatcatctgtga

SEQ ID NO: 14315 - DNA, 25 bp, Mus musculus
aaagcgtgcagcagaccacttggaa

SEQ ID NO: 14316 - DNA, 25 bp, Mus musculus
aaagcgtgcagctgaccacttggaa

SEQ ID NO: 14317 - DNA, 25 bp, Mus musculus
aaagcgtggactcactgcatcctaa

SEQ ID NO: 14318 - DNA, 25 bp, Mus musculus
aaagcgtggactgactgcatcctaa

SEQ ID NO: 14319 - DNA, 25 bp, Mus musculus
aaagcgtggagtcttcagtcatgaa

SEQ ID NO: 14320 - DNA, 25 bp, Mus musculus
aaagcgtggagtgttcagtcatgaa

SEQ ID NO: 14321 - DNA, 25 bp, Mus musculus
aaagcgtgtatccagttactatgta

SEQ ID NO: 14322 - DNA, 25 bp, Mus musculus
aaagcgtgtatcgagttactatgta

SEQ ID NO: 14323 - DNA, 25 bp, Mus musculus
aaagcgtgtcagaactaccacaaga

SEQ ID NO: 14324 - DNA, 25 bp, Mus musculus
aaagcgtgtcagtactaccacaaga

SEQ ID NO: 14325 - DNA, 25 bp, Mus musculus
aaagcgttaaacatctccctgcttg

SEQ ID NO: 14326 - DNA, 25 bp, Mus musculus
aaagcgttaaacttctccctgcttg

SEQ ID NO: 14327 - DNA, 25 bp, Mus musculus
aaagcgttcacacctggctctagag

SEQ ID NO: 14328 - DNA, 25 bp, Mus musculus
aaagcgttcacagctggctctagag

SEQ ID NO: 14329 - DNA, 25 bp, Mus musculus
aaagcgttcattcaagggactcagt

SEQ ID NO: 14330 - DNA, 25 bp, Mus musculus
aaagcgttcattgaagggactcagt

SEQ ID NO: 14331 - DNA, 25 bp, Mus musculus
aaagcgttgcaaatggcaggctcct

SEQ ID NO: 14332 - DNA, 25 bp, Mus musculus
aaagcgttgcaattggcaggctcct

SEQ ID NO: 14333 - DNA, 25 bp, Mus musculus
aaagcgttgcttagactcattccct

SEQ ID NO: 14334 - DNA, 25 bp, Mus musculus
aaagcgttgctttgactcattccct

SEQ ID NO: 14335 - DNA, 25 bp, Mus musculus
aaagcgttgtttcaccaccaaagag

SEQ ID NO: 14336 - DNA, 25 bp, Mus musculus
aaagcgttgtttgaccaccaaagag

SEQ ID NO: 14337 - DNA, 25 bp, Mus musculus
aaagcgttttctaatggtcctgcaa

SEQ ID NO: 14338 - DNA, 25 bp, Mus musculus
aaagcgttttcttatggtcctgcaa

SEQ ID NO: 14339 - DNA, 25 bp, Mus musculus
aaagctaaactaccagtctgggcgt

SEQ ID NO: 14340 - DNA, 25 bp, Mus musculus
aaagctaaactagcagtctgggcgt

SEQ ID NO: 14341 - DNA, 25 bp, Mus musculus
aaagctaacacaatggaatttgaca

SEQ ID NO: 14342 - DNA, 25 bp, Mus musculus
aaagctaacacattggaatttgaca

SEQ ID NO: 14343 - DNA, 25 bp, Mus musculus
aaagctaacattcgccgggcatggt

SEQ ID NO: 14344 - DNA, 25 bp, Mus musculus
aaagctaacattggccgggcatggt

SEQ ID NO: 14345 - DNA, 25 bp, Mus musculus
aaagctaagcctctggactggcgtg

SEQ ID NO: 14346 - DNA, 25 bp, Mus musculus
aaagctaagcctgtggactggcgtg

SEQ ID NO: 14347 - DNA, 25 bp, Mus musculus
aaagctaagttcacagtcgctggtg

SEQ ID NO: 14348 - DNA, 25 bp, Mus musculus
aaagctaagttctcagtcgctggtg

SEQ ID NO: 14349 - DNA, 25 bp, Mus musculus
aaagctaagttgatggtgtgaccta

SEQ ID NO: 14350 - DNA, 25 bp, Mus musculus
aaagctaagttgttggtgtgaccta

SEQ ID NO: 14351 - DNA, 25 bp, Mus musculus
aaagctaatagacttcctggagaga

SEQ ID NO: 14352 - DNA, 25 bp, Mus musculus
aaagctaatagagttcctggagaga

SEQ ID NO: 14353 - DNA, 25 bp, Mus musculus
aaagctaatccaacgaagtccttaa

SEQ ID NO: 14354 - DNA, 25 bp, Mus musculus
aaagctaatccatcgaagtccttaa

SEQ ID NO: 14355 - DNA, 25 bp, Mus musculus
aaagctaatctgctgcagctctcaa

SEQ ID NO: 14356 - DNA, 25 bp, Mus musculus
aaagctaatctggtgcagctctcaa

SEQ ID NO: 14357 - DNA, 25 bp, Mus musculus
aaagctacaatcatgcctcgagggc

SEQ ID NO: 14358 - DNA, 25 bp, Mus musculus
aaagctacaatcttgcctcgagggc

SEQ ID NO: 14359 - DNA, 25 bp, Mus musculus
aaagctacacagacgcatagaggat

SEQ ID NO: 14360 - DNA, 25 bp, Mus musculus
aaagctacacagtcgcatagaggat

SEQ ID NO: 14361 - DNA, 25 bp, Mus musculus
aaagctacagccaggccagtctctt

SEQ ID NO: 14362 - DNA, 25 bp, Mus musculus
aaagctacagccagggcagcatcta

SEQ ID NO: 14363 - DNA, 25 bp, Mus musculus
aaagctacagcctggccagtctctt

SEQ ID NO: 14364 - DNA, 25 bp, Mus musculus
aaagctacagcctgggcagcatcta

SEQ ID NO: 14365 - DNA, 25 bp, Mus musculus
aaagctacatggctgtaaggcttaa

SEQ ID NO: 14366 - DNA, 25 bp, Mus musculus
aaagctacatgggtgtaaggcttaa

SEQ ID NO: 14367 - DNA, 25 bp, Mus musculus
aaagctaccacacgctcatgaagtc

SEQ ID NO: 14368 - DNA, 25 bp, Mus musculus
aaagctaccacaggctcatgaagtc

SEQ ID NO: 14369 - DNA, 25 bp, Mus musculus
aaagctaccatccatcccaaggaag

SEQ ID NO: 14370 - DNA, 25 bp, Mus musculus
aaagctaccatcgatcccaaggaag

SEQ ID NO: 14371 - DNA, 25 bp, Mus musculus
aaagctacccctcctgtttcaaaga

SEQ ID NO: 14372 - DNA, 25 bp, Mus musculus
aaagctacccctgctgtttcaaaga

SEQ ID NO: 14373 - DNA, 25 bp, Mus musculus
aaagctacctaccataggtgacatg

SEQ ID NO: 14374 - DNA, 25 bp, Mus musculus
aaagctacctacgataggtgacatg

SEQ ID NO: 14375 - DNA, 25 bp, Mus musculus
aaagctacctagagtttgagcccct

SEQ ID NO: 14376 - DNA, 25 bp, Mus musculus
aaagctacctagtgtttgagcccct

SEQ ID NO: 14377 - DNA, 25 bp, Mus musculus
aaagctacctatcgttcagacacac

SEQ ID NO: 14378 - DNA, 25 bp, Mus musculus
aaagctacctatggttcagacacac

SEQ ID NO: 14379 - DNA, 25 bp, Mus musculus
aaagctacctccaaaactctagtgg

SEQ ID NO: 14380 - DNA, 25 bp, Mus musculus
aaagctacctcctaaactctagtgg

SEQ ID NO: 14381 - DNA, 25 bp, Mus musculus
aaagctactacacactaaatttatg

SEQ ID NO: 14382 - DNA, 25 bp, Mus musculus
aaagctactacagactaaatttatg

SEQ ID NO: 14383 - DNA, 25 bp, Mus musculus
aaagctacttcaatcccgtggcctg

SEQ ID NO: 14384 - DNA, 25 bp, Mus musculus
aaagctacttcattcccgtggcctg

SEQ ID NO: 14385 - DNA, 25 bp, Mus musculus
aaagctacttcccacatctgggaca

SEQ ID NO: 14386 - DNA, 25 bp, Mus musculus
aaagctacttccgacatctgggaca

SEQ ID NO: 14387 - DNA, 25 bp, Mus musculus
aaagctacttgactctcttgacatt

SEQ ID NO: 14388 - DNA, 25 bp, Mus musculus
aaagctacttgagtctcttgacatt

SEQ ID NO: 14389 - DNA, 25 bp, Mus musculus
aaagctactttaaacctgcagtaca

SEQ ID NO: 14390 - DNA, 25 bp, Mus musculus
aaagctactttatacctgcagtaca

SEQ ID NO: 14391 - DNA, 25 bp, Mus musculus
aaagctagaacgagcttcccactac

SEQ ID NO: 14392 - DNA, 25 bp, Mus musculus
aaagctagaacgtgcttcccactac

SEQ ID NO: 14393 - DNA, 25 bp, Mus musculus
aaagctagaagcctgacatttttct

SEQ ID NO: 14394 - DNA, 25 bp, Mus musculus
aaagctagaagcgtgacatttttct

SEQ ID NO: 14395 - DNA, 25 bp, Mus musculus
aaagctagacgcagcaggagcagga

SEQ ID NO: 14396 - DNA, 25 bp, Mus musculus
aaagctagacgctgcaggagcagga

SEQ ID NO: 14397 - DNA, 25 bp, Mus musculus
aaagctagactgatctacagggcaa

SEQ ID NO: 14398 - DNA, 25 bp, Mus musculus
aaagctagactgttctacagggcaa

SEQ ID NO: 14399 - DNA, 25 bp, Mus musculus
aaagctagacttatctccagtcctc

SEQ ID NO: 14400 - DNA, 25 bp, Mus musculus
aaagctagacttttctccagtcctc

SEQ ID NO: 14401 - DNA, 25 bp, Mus musculus
aaagctagatcgaagcctgatttcc

SEQ ID NO: 14402 - DNA, 25 bp, Mus musculus
aaagctagatcgtagcctgatttcc

SEQ ID NO: 14403 - DNA, 25 bp, Mus musculus
aaagctagatgccaaagccgcagaa

SEQ ID NO: 14404 - DNA, 25 bp, Mus musculus
aaagctagatgcgaaagccgcagaa

SEQ ID NO: 14405 - DNA, 25 bp, Mus musculus
aaagctagcagcacacttgtagtgc

SEQ ID NO: 14406 - DNA, 25 bp, Mus musculus
aaagctagcagctcacttgtagtgc

SEQ ID NO: 14407 - DNA, 25 bp, Mus musculus
aaagctagccacatgtttccattct

SEQ ID NO: 14408 - DNA, 25 bp, Mus musculus
aaagctagccacttgtttccattct

SEQ ID NO: 14409 - DNA, 25 bp, Mus musculus
aaagctagccctacctagtcttctt

SEQ ID NO: 14410 - DNA, 25 bp, Mus musculus
aaagctagcccttcctagtcttctt

SEQ ID NO: 14411 - DNA, 25 bp, Mus musculus
aaagctagccttcataattataaat

SEQ ID NO: 14412 - DNA, 25 bp, Mus musculus
aaagctagccttgataattataaat

SEQ ID NO: 14413 - DNA, 25 bp, Mus musculus
aaagctagcgcgcagcctggctttt

SEQ ID NO: 14414 - DNA, 25 bp, Mus musculus
aaagctagcgcggagcctggctttt

SEQ ID NO: 14415 - DNA, 25 bp, Mus musculus
aaagctagcgtgacaacctacattg

SEQ ID NO: 14416 - DNA, 25 bp, Mus musculus
aaagctagcgtgtcaacctacattg

SEQ ID NO: 14417 - DNA, 25 bp, Mus musculus
aaagctagctaaccatcagcccagg

SEQ ID NO: 14418 - DNA, 25 bp, Mus musculus
aaagctagctaagcatcagcccagg

SEQ ID NO: 14419 - DNA, 25 bp, Mus musculus
aaagctagctagacgtggtgaggta

SEQ ID NO: 14420 - DNA, 25 bp, Mus musculus
aaagctagctagctggcactccgtg

SEQ ID NO: 14421 - DNA, 25 bp, Mus musculus
aaagctagctaggtggcactccgtg

SEQ ID NO: 14422 - DNA, 25 bp, Mus musculus
aaagctagctagtcgtggtgaggta

SEQ ID NO: 14423 - DNA, 25 bp, Mus musculus
aaagctagctatcatggttaatgcc

SEQ ID NO: 14424 - DNA, 25 bp, Mus musculus
aaagctagctatgatggttaatgcc

SEQ ID NO: 14425 - DNA, 25 bp, Mus musculus
aaagctaggacgatcctgtgacaca

SEQ ID NO: 14426 - DNA, 25 bp, Mus musculus
aaagctaggacgttcctgtgacaca

SEQ ID NO: 14427 - DNA, 25 bp, Mus musculus
aaagctaggactaagcagagtgcca

SEQ ID NO: 14428 - DNA, 25 bp, Mus musculus
aaagctaggacttagcagagtgcca

SEQ ID NO: 14429 - DNA, 25 bp, Mus musculus
aaagctagggaaaccccaggattgt

SEQ ID NO: 14430 - DNA, 25 bp, Mus musculus
aaagctagggaatccccaggattgt

SEQ ID NO: 14431 - DNA, 25 bp, Mus musculus
aaagctagggcactggccgttccag

SEQ ID NO: 14432 - DNA, 25 bp, Mus musculus
aaagctagggcagtggccgttccag

SEQ ID NO: 14433 - DNA, 25 bp, Mus musculus
aaagctaggtccacatgcgtgcatg

SEQ ID NO: 14434 - DNA, 25 bp, Mus musculus
aaagctaggtcctcatgcgtgcatg

SEQ ID NO: 14435 - DNA, 25 bp, Mus musculus
aaagctaggtctccactgtggttcc

SEQ ID NO: 14436 - DNA, 25 bp, Mus musculus
aaagctaggtctgcactgtggttcc

SEQ ID NO: 14437 - DNA, 25 bp, Mus musculus
aaagctaggtttcttgtatctgaac

SEQ ID NO: 14438 - DNA, 25 bp, Mus musculus
aaagctaggtttgttgtatctgaac

SEQ ID NO: 14439 - DNA, 25 bp, Mus musculus
aaagctagtctgacttgaaacttgt

SEQ ID NO: 14440 - DNA, 25 bp, Mus musculus
aaagctagtctgtcttgaaacttgt

SEQ ID NO: 14441 - DNA, 25 bp, Mus musculus
aaagctagtcttccaacacacacac

SEQ ID NO: 14442 - DNA, 25 bp, Mus musculus
aaagctagtcttgcaacacacacac

SEQ ID NO: 14443 - DNA, 25 bp, Mus musculus
aaagctagtgccaccaatcctatgc

SEQ ID NO: 14444 - DNA, 25 bp, Mus musculus
aaagctagtgcctccaatcctatgc

SEQ ID NO: 14445 - DNA, 25 bp, Mus musculus
aaagctagtgtcactaagatcttag

SEQ ID NO: 14446 - DNA, 25 bp, Mus musculus
aaagctagtgtctctaagatcttag

SEQ ID NO: 14447 - DNA, 25 bp, Mus musculus
aaagctagttttcctgagtcagtct

SEQ ID NO: 14448 - DNA, 25 bp, Mus musculus
aaagctagttttgctgagtcagtct

SEQ ID NO: 14449 - DNA, 25 bp, Mus musculus
aaagctatagcaatttcacggtaaa

SEQ ID NO: 14450 - DNA, 25 bp, Mus musculus
aaagctatagcattttcacggtaaa

SEQ ID NO: 14451 - DNA, 25 bp, Mus musculus
aaagctatagcgaggtccctgtgag

SEQ ID NO: 14452 - DNA, 25 bp, Mus musculus
aaagctatagcgtggtccctgtgag

SEQ ID NO: 14453 - DNA, 25 bp, Mus musculus
aaagctatataaagtggccgtctca

SEQ ID NO: 14454 - DNA, 25 bp, Mus musculus
aaagctatataatgtggccgtctca

SEQ ID NO: 14455 - DNA, 25 bp, Mus musculus
aaagctatatccaagttatcagtga

SEQ ID NO: 14456 - DNA, 25 bp, Mus musculus
aaagctatatcctagttatcagtga

SEQ ID NO: 14457 - DNA, 25 bp, Mus musculus
aaagctatatgactgtgctctctaa

SEQ ID NO: 14458 - DNA, 25 bp, Mus musculus
aaagctatatgagtgtgctctctaa

SEQ ID NO: 14459 - DNA, 25 bp, Mus musculus
aaagctatcctgcagcgtcgagtct

SEQ ID NO: 14460 - DNA, 25 bp, Mus musculus
aaagctatcctggagcgtcgagtct

SEQ ID NO: 14461 - DNA, 25 bp, Mus musculus
aaagctatcgggattctctggttct

SEQ ID NO: 14462 - DNA, 25 bp, Mus musculus
aaagctatcgggtttctctggttct

SEQ ID NO: 14463 - DNA, 25 bp, Mus musculus
aaagctatctgactccagaactggg

SEQ ID NO: 14464 - DNA, 25 bp, Mus musculus
aaagctatctgagtccagaactggg

SEQ ID NO: 14465 - DNA, 25 bp, Mus musculus
aaagctatcttaactatcaactcgg

SEQ ID NO: 14466 - DNA, 25 bp, Mus musculus
aaagctatcttatctatcaactcgg

SEQ ID NO: 14467 - DNA, 25 bp, Mus musculus
aaagctatgaagaagtatccctgag

SEQ ID NO: 14468 - DNA, 25 bp, Mus musculus
aaagctatgaagtagtatccctgag

SEQ ID NO: 14469 - DNA, 25 bp, Mus musculus
aaagctatgagcctagctgcccctt

SEQ ID NO: 14470 - DNA, 25 bp, Mus musculus
aaagctatgagcgtagctgcccctt

SEQ ID NO: 14471 - DNA, 25 bp, Mus musculus
aaagctatgcatctgtcctgaagga

SEQ ID NO: 14472 - DNA, 25 bp, Mus musculus
aaagctatgcatgtgtcctgaagga

SEQ ID NO: 14473 - DNA, 25 bp, Mus musculus
aaagctatgctcctagcgcttatgt

SEQ ID NO: 14474 - DNA, 25 bp, Mus musculus
aaagctatgctcgtagcgcttatgt

SEQ ID NO: 14475 - DNA, 25 bp, Mus musculus
aaagctatggtcaggactgtcctcc

SEQ ID NO: 14476 - DNA, 25 bp, Mus musculus
aaagctatggtctggactgtcctcc

SEQ ID NO: 14477 - DNA, 25 bp, Mus musculus
aaagctatgtacacagtccctgtct

SEQ ID NO: 14478 - DNA, 25 bp, Mus musculus
aaagctatgtactcagtccctgtct

SEQ ID NO: 14479 - DNA, 25 bp, Mus musculus
aaagctattattattcacacagtgc

SEQ ID NO: 14480 - DNA, 25 bp, Mus musculus
aaagctattatttttcacacagtgc

SEQ ID NO: 14481 - DNA, 25 bp, Mus musculus
aaagctattcttcgtgtggcggata

SEQ ID NO: 14482 - DNA, 25 bp, Mus musculus
aaagctattcttggtgtggcggata

SEQ ID NO: 14483 - DNA, 25 bp, Mus musculus
aaagctatttctcgattgtcagggt

SEQ ID NO: 14484 - DNA, 25 bp, Mus musculus
aaagctatttctggattgtcagggt

SEQ ID NO: 14485 - DNA, 25 bp, Mus musculus
aaagctatttgtccacaagttcttg

SEQ ID NO: 14486 - DNA, 25 bp, Mus musculus
aaagctatttgtgcacaagttcttg

SEQ ID NO: 14487 - DNA, 25 bp, Mus musculus
aaagctcaaacaactagtatataac

SEQ ID NO: 14488 - DNA, 25 bp, Mus musculus
aaagctcaaacatctagtatataac

SEQ ID NO: 14489 - DNA, 25 bp, Mus musculus
aaagctcaacaacacaattcctaat

SEQ ID NO: 14490 - DNA, 25 bp, Mus musculus
aaagctcaacaagacaattcctaat

SEQ ID NO: 14491 - DNA, 25 bp, Mus musculus
aaagctcaacatagtcagctgcccc

SEQ ID NO: 14492 - DNA, 25 bp, Mus musculus
aaagctcaacattgtcagctgcccc

SEQ ID NO: 14493 - DNA, 25 bp, Mus musculus
aaagctcaacgtagccactgaccaa

SEQ ID NO: 14494 - DNA, 25 bp, Mus musculus
aaagctcaacgttgccactgaccaa

SEQ ID NO: 14495 - DNA, 25 bp, Mus musculus
aaagctcaagaaatcctctccagga

SEQ ID NO: 14496 - DNA, 25 bp, Mus musculus
aaagctcaagaattcctctccagga

SEQ ID NO: 14497 - DNA, 25 bp, Mus musculus
aaagctcaagccagtgggacttaag

SEQ ID NO: 14498 - DNA, 25 bp, Mus musculus
aaagctcaagcctgtgggacttaag

SEQ ID NO: 14499 - DNA, 25 bp, Mus musculus
aaagctcaaggactgcctgggcaac

SEQ ID NO: 14500 - DNA, 25 bp, Mus musculus
aaagctcaaggagtgcctgggcaac

SEQ ID NO: 14501 - DNA, 25 bp, Mus musculus
aaagctcaagttctgctgggcagtg

SEQ ID NO: 14502 - DNA, 25 bp, Mus musculus
aaagctcaagttgtgctgggcagtg

SEQ ID NO: 14503 - DNA, 25 bp, Mus musculus
aaagctcaattcaaatcctgtttta

SEQ ID NO: 14504 - DNA, 25 bp, Mus musculus
aaagctcaattctaatcctgtttta

SEQ ID NO: 14505 - DNA, 25 bp, Mus musculus
aaagctcacatcaagcgactgaaca

SEQ ID NO: 14506 - DNA, 25 bp, Mus musculus
aaagctcacatctagcgactgaaca

SEQ ID NO: 14507 - DNA, 25 bp, Mus musculus
aaagctcacattctgccagcatcat

SEQ ID NO: 14508 - DNA, 25 bp, Mus musculus
aaagctcacattgtgccagcatcat

SEQ ID NO: 14509 - DNA, 25 bp, Mus musculus
aaagctcacccacatgtattttgat

SEQ ID NO: 14510 - DNA, 25 bp, Mus musculus
aaagctcacccaccatagggcaatt

SEQ ID NO: 14511 - DNA, 25 bp, Mus musculus
aaagctcacccagatgtattttgat

SEQ ID NO: 14512 - DNA, 25 bp, Mus musculus
aaagctcacccagcatagggcaatt

SEQ ID NO: 14513 - DNA, 25 bp, Mus musculus
aaagctcacgagaagcacactccct

SEQ ID NO: 14514 - DNA, 25 bp, Mus musculus
aaagctcacgagtagcacactccct

SEQ ID NO: 14515 - DNA, 25 bp, Mus musculus
aaagctcacgccaagtacgcacaag

SEQ ID NO: 14516 - DNA, 25 bp, Mus musculus
aaagctcacgcctagtacgcacaag

SEQ ID NO: 14517 - DNA, 25 bp, Mus musculus
aaagctcacggtagtgtcagtagat

SEQ ID NO: 14518 - DNA, 25 bp, Mus musculus
aaagctcacggttgtgtcagtagat

SEQ ID NO: 14519 - DNA, 25 bp, Mus musculus
aaagctcactctcaagacgttagaa

SEQ ID NO: 14520 - DNA, 25 bp, Mus musculus
aaagctcactctgaagacgttagaa

SEQ ID NO: 14521 - DNA, 25 bp, Mus musculus
aaagctcactgtcatcagtattttt

SEQ ID NO: 14522 - DNA, 25 bp, Mus musculus
aaagctcactgtgatcagtattttt

SEQ ID NO: 14523 - DNA, 25 bp, Mus musculus
aaagctcagcatcccttatgaaagt

SEQ ID NO: 14524 - DNA, 25 bp, Mus musculus
aaagctcagcatgccttatgaaagt

SEQ ID NO: 14525 - DNA, 25 bp, Mus musculus
aaagctcagcgccatctaggctatc

SEQ ID NO: 14526 - DNA, 25 bp, Mus musculus
aaagctcagcgcgatctaggctatc

SEQ ID NO: 14527 - DNA, 25 bp, Mus musculus
aaagctcagcttatggtcaatcccc

SEQ ID NO: 14528 - DNA, 25 bp, Mus musculus
aaagctcagcttttggtcaatcccc

SEQ ID NO: 14529 - DNA, 25 bp, Mus musculus
aaagctcaggtaatccaggtcatca

SEQ ID NO: 14530 - DNA, 25 bp, Mus musculus
aaagctcaggtattccaggtcatca

SEQ ID NO: 14531 - DNA, 25 bp, Mus musculus
aaagctcaggttctcggtagtcaag

SEQ ID NO: 14532 - DNA, 25 bp, Mus musculus
aaagctcaggttgtcggtagtcaag

SEQ ID NO: 14533 - DNA, 25 bp, Mus musculus
aaagctcagtagagtccagctagga

SEQ ID NO: 14534 - DNA, 25 bp, Mus musculus
aaagctcagtagtgtccagctagga

SEQ ID NO: 14535 - DNA, 25 bp, Mus musculus
aaagctcagtcactttgccggcgct

SEQ ID NO: 14536 - DNA, 25 bp, Mus musculus
aaagctcagtcagtttgccggcgct

SEQ ID NO: 14537 - DNA, 25 bp, Mus musculus
aaagctcatagcaccatacacgaag

SEQ ID NO: 14538 - DNA, 25 bp, Mus musculus
aaagctcatagctccatacacgaag

SEQ ID NO: 14539 - DNA, 25 bp, Mus musculus
aaagctcatcaacaaggtctaacta

SEQ ID NO: 14540 - DNA, 25 bp, Mus musculus
aaagctcatcaagaaggtctaacta

SEQ ID NO: 14541 - DNA, 25 bp, Mus musculus
aaagctcatctgacttttccactgg

SEQ ID NO: 14542 - DNA, 25 bp, Mus musculus
aaagctcatctgtcttttccactgg

SEQ ID NO: 14543 - DNA, 25 bp, Mus musculus
aaagctcattgccaatcactgtccc

SEQ ID NO: 14544 - DNA, 25 bp, Mus musculus
aaagctcattgcgaatcactgtccc

SEQ ID NO: 14545 - DNA, 25 bp, Mus musculus
aaagctcatttaaatcctgggtcaa

SEQ ID NO: 14546 - DNA, 25 bp, Mus musculus
aaagctcatttatatcctgggtcaa

SEQ ID NO: 14547 - DNA, 25 bp, Mus musculus
aaagctccaagaaagttttcccatc

SEQ ID NO: 14548 - DNA, 25 bp, Mus musculus
aaagctccaagatagttttcccatc

SEQ ID NO: 14549 - DNA, 25 bp, Mus musculus
aaagctccactcaggctctgtatac

SEQ ID NO: 14550 - DNA, 25 bp, Mus musculus
aaagctccactctggctctgtatac

SEQ ID NO: 14551 - DNA, 25 bp, Mus musculus
aaagctccagagaacatcacctcaa

SEQ ID NO: 14552 - DNA, 25 bp, Mus musculus
aaagctccagagtacatcacctcaa

SEQ ID NO: 14553 - DNA, 25 bp, Mus musculus
aaagctccagctaaggcccaggctt

SEQ ID NO: 14554 - DNA, 25 bp, Mus musculus
aaagctccagcttaggcccaggctt

SEQ ID NO: 14555 - DNA, 25 bp, Mus musculus
aaagctccaggaacatgccccagga

SEQ ID NO: 14556 - DNA, 25 bp, Mus musculus
aaagctccaggaccagatcttcaat

SEQ ID NO: 14557 - DNA, 25 bp, Mus musculus
aaagctccaggagcagatcttcaat

SEQ ID NO: 14558 - DNA, 25 bp, Mus musculus
aaagctccaggatcatgccccagga

SEQ ID NO: 14559 - DNA, 25 bp, Mus musculus
aaagctccaggcctttctggaagaa

SEQ ID NO: 14560 - DNA, 25 bp, Mus musculus
aaagctccaggcgtttctggaagaa

SEQ ID NO: 14561 - DNA, 25 bp, Mus musculus
aaagctccaggtactggaacactac

SEQ ID NO: 14562 - DNA, 25 bp, Mus musculus
aaagctccaggtcttttcttcaagt

SEQ ID NO: 14563 - DNA, 25 bp, Mus musculus
aaagctccaggtgttttcttcaagt

SEQ ID NO: 14564 - DNA, 25 bp, Mus musculus
aaagctccaggttctggaacactac

SEQ ID NO: 14565 - DNA, 25 bp, Mus musculus
aaagctccattcatttgcacaaagt

SEQ ID NO: 14566 - DNA, 25 bp, Mus musculus
aaagctccattcttttgcacaaagt

SEQ ID NO: 14567 - DNA, 25 bp, Mus musculus
aaagctcccagaagtcaaggcccat

SEQ ID NO: 14568 - DNA, 25 bp, Mus musculus
aaagctcccagatgtcaaggcccat

SEQ ID NO: 14569 - DNA, 25 bp, Mus musculus
aaagctcccaggctcagacagccaa

SEQ ID NO: 14570 - DNA, 25 bp, Mus musculus
aaagctcccagggtcagacagccaa

SEQ ID NO: 14571 - DNA, 25 bp, Mus musculus
aaagctcccatgaagacttcctgaa

SEQ ID NO: 14572 - DNA, 25 bp, Mus musculus
aaagctcccatgtagacttcctgaa

SEQ ID NO: 14573 - DNA, 25 bp, Mus musculus
aaagctccctctagacatcaattac

SEQ ID NO: 14574 - DNA, 25 bp, Mus musculus
aaagctccctcttgacatcaattac

SEQ ID NO: 14575 - DNA, 25 bp, Mus musculus
aaagctccctgcatgcacatgtatg

SEQ ID NO: 14576 - DNA, 25 bp, Mus musculus
aaagctccctgcttgcacatgtatg

SEQ ID NO: 14577 - DNA, 25 bp, Mus musculus
aaagctccgagactgtaggccatgc

SEQ ID NO: 14578 - DNA, 25 bp, Mus musculus
aaagctccgagagtgtaggccatgc

SEQ ID NO: 14579 - DNA, 25 bp, Mus musculus
aaagctccgttcatacagatatctg

SEQ ID NO: 14580 - DNA, 25 bp, Mus musculus
aaagctccgttcttacagatatctg

SEQ ID NO: 14581 - DNA, 25 bp, Mus musculus
aaagctcctactacaagccttccag

SEQ ID NO: 14582 - DNA, 25 bp, Mus musculus
aaagctcctacttcaagccttccag

SEQ ID NO: 14583 - DNA, 25 bp, Mus musculus
aaagctcctaggacttctcaagcag

SEQ ID NO: 14584 - DNA, 25 bp, Mus musculus
aaagctcctaggtcttctcaagcag

SEQ ID NO: 14585 - DNA, 25 bp, Mus musculus
aaagctcctagtaaccccatctgca

SEQ ID NO: 14586 - DNA, 25 bp, Mus musculus
aaagctcctagttaccccatctgca

SEQ ID NO: 14587 - DNA, 25 bp, Mus musculus
aaagctcctcacaaagtgtttcttt

SEQ ID NO: 14588 - DNA, 25 bp, Mus musculus
aaagctcctcactaagtgtttcttt

SEQ ID NO: 14589 - DNA, 25 bp, Mus musculus
aaagctcctgagatgcccaaaccaa

SEQ ID NO: 14590 - DNA, 25 bp, Mus musculus
aaagctcctgagttgcccaaaccaa

SEQ ID NO: 14591 - DNA, 25 bp, Mus musculus
aaagctcctgatagacagtgtacac

SEQ ID NO: 14592 - DNA, 25 bp, Mus musculus
aaagctcctgattgacagtgtacac

SEQ ID NO: 14593 - DNA, 25 bp, Mus musculus
aaagctcctgcgatttgcccagaaa

SEQ ID NO: 14594 - DNA, 25 bp, Mus musculus
aaagctcctgcgttttgcccagaaa

SEQ ID NO: 14595 - DNA, 25 bp, Mus musculus
aaagctcctgtgacacttgagggtg

SEQ ID NO: 14596 - DNA, 25 bp, Mus musculus
aaagctcctgtgtcacttgagggtg

SEQ ID NO: 14597 - DNA, 25 bp, Mus musculus
aaagctccttccaatacttgcaggg

SEQ ID NO: 14598 - DNA, 25 bp, Mus musculus
aaagctccttcctatacttgcaggg

SEQ ID NO: 14599 - DNA, 25 bp, Mus musculus
aaagctccttgcagttgttaccgat

SEQ ID NO: 14600 - DNA, 25 bp, Mus musculus
aaagctccttgctgttgttaccgat

SEQ ID NO: 14601 - DNA, 25 bp, Mus musculus
aaagctccttttccccataaacatt

SEQ ID NO: 14602 - DNA, 25 bp, Mus musculus
aaagctccttttgcccataaacatt

SEQ ID NO: 14603 - DNA, 25 bp, Mus musculus
aaagctcgaagcagcgtacttgccc

SEQ ID NO: 14604 - DNA, 25 bp, Mus musculus
aaagctcgaagctgcgtacttgccc

SEQ ID NO: 14605 - DNA, 25 bp, Mus musculus
aaagctcgaggccaggctgcacctc

SEQ ID NO: 14606 - DNA, 25 bp, Mus musculus
aaagctcgaggcgaggctgcacctc

SEQ ID NO: 14607 - DNA, 25 bp, Mus musculus
aaagctcgccaaagtagcactccgg

SEQ ID NO: 14608 - DNA, 25 bp, Mus musculus
aaagctcgccaatgtagcactccgg

SEQ ID NO: 14609 - DNA, 25 bp, Mus musculus
aaagctcggcagaatacacagtggt

SEQ ID NO: 14610 - DNA, 25 bp, Mus musculus
aaagctcggcagaggcaaacccagt

SEQ ID NO: 14611 - DNA, 25 bp, Mus musculus
aaagctcggcagtatacacagtggt

SEQ ID NO: 14612 - DNA, 25 bp, Mus musculus
aaagctcggcagtggcaaacccagt

SEQ ID NO: 14613 - DNA, 25 bp, Mus musculus
aaagctcggctgcagttggcttcct

SEQ ID NO: 14614 - DNA, 25 bp, Mus musculus
aaagctcggctggagttggcttcct

SEQ ID NO: 14615 - DNA, 25 bp, Mus musculus
aaagctcgtcagaacatgcgggtgt

SEQ ID NO: 14616 - DNA, 25 bp, Mus musculus
aaagctcgtcagtacatgcgggtgt

SEQ ID NO: 14617 - DNA, 25 bp, Mus musculus
aaagctcgtgtacatatctccgtgt

SEQ ID NO: 14618 - DNA, 25 bp, Mus musculus
aaagctcgtgtagatatctccgtgt

SEQ ID NO: 14619 - DNA, 25 bp, Mus musculus
aaagctctaagaagacccaggcctc

SEQ ID NO: 14620 - DNA, 25 bp, Mus musculus
aaagctctaagatgacccaggcctc

SEQ ID NO: 14621 - DNA, 25 bp, Mus musculus
aaagctctaaggctatggtccagaa

SEQ ID NO: 14622 - DNA, 25 bp, Mus musculus
aaagctctaagggtatggtccagaa

SEQ ID NO: 14623 - DNA, 25 bp, Mus musculus
aaagctctacgcagtcaacgctgaa

SEQ ID NO: 14624 - DNA, 25 bp, Mus musculus
aaagctctacgctgtcaacgctgaa

SEQ ID NO: 14625 - DNA, 25 bp, Mus musculus
aaagctctagccagggtaacttgat

SEQ ID NO: 14626 - DNA, 25 bp, Mus musculus
aaagctctagcctgggtaacttgat

SEQ ID NO: 14627 - DNA, 25 bp, Mus musculus
aaagctctagctaaccagttcctgg

SEQ ID NO: 14628 - DNA, 25 bp, Mus musculus
aaagctctagcttaccagttcctgg

SEQ ID NO: 14629 - DNA, 25 bp, Mus musculus
aaagctctatcaatatttgtgggtc

SEQ ID NO: 14630 - DNA, 25 bp, Mus musculus
aaagctctatcattatttgtgggtc

SEQ ID NO: 14631 - DNA, 25 bp, Mus musculus
aaagctctcacaatgaacaagtcag

SEQ ID NO: 14632 - DNA, 25 bp, Mus musculus
aaagctctcacattgaacaagtcag

SEQ ID NO: 14633 - DNA, 25 bp, Mus musculus
aaagctctcactcaggaagcaccca

SEQ ID NO: 14634 - DNA, 25 bp, Mus musculus
aaagctctcactgaggaagcaccca

SEQ ID NO: 14635 - DNA, 25 bp, Mus musculus
aaagctctcaggcaattgatgtgtt

SEQ ID NO: 14636 - DNA, 25 bp, Mus musculus
aaagctctcaggctggcatttgctc

SEQ ID NO: 14637 - DNA, 25 bp, Mus musculus
aaagctctcagggaattgatgtgtt

SEQ ID NO: 14638 - DNA, 25 bp, Mus musculus
aaagctctcagggtggcatttgctc

SEQ ID NO: 14639 - DNA, 25 bp, Mus musculus
aaagctctccacagacttagtattt

SEQ ID NO: 14640 - DNA, 25 bp, Mus musculus
aaagctctccactgacttagtattt

SEQ ID NO: 14641 - DNA, 25 bp, Mus musculus
aaagctctccgtaaattctcatttt

SEQ ID NO: 14642 - DNA, 25 bp, Mus musculus
aaagctctccgttaattctcatttt

SEQ ID NO: 14643 - DNA, 25 bp, Mus musculus
aaagctctgatcctctgcagcccag

SEQ ID NO: 14644 - DNA, 25 bp, Mus musculus
aaagctctgatcgtctgcagcccag

SEQ ID NO: 14645 - DNA, 25 bp, Mus musculus
aaagctctgccacgcttataccaga

SEQ ID NO: 14646 - DNA, 25 bp, Mus musculus
aaagctctgccaggcttataccaga

SEQ ID NO: 14647 - DNA, 25 bp, Mus musculus
aaagctctgcccattccaagaaaag

SEQ ID NO: 14648 - DNA, 25 bp, Mus musculus
aaagctctgccctttccaagaaaag

SEQ ID NO: 14649 - DNA, 25 bp, Mus musculus
aaagctctgcgcaccgtatggcatt

SEQ ID NO: 14650 - DNA, 25 bp, Mus musculus
aaagctctgcgctccgtatggcatt

SEQ ID NO: 14651 - DNA, 25 bp, Mus musculus
aaagctctgcttccggattccaaac

SEQ ID NO: 14652 - DNA, 25 bp, Mus musculus
aaagctctgcttgcggattccaaac

SEQ ID NO: 14653 - DNA, 25 bp, Mus musculus
aaagctctggccctaggtgccacag

SEQ ID NO: 14654 - DNA, 25 bp, Mus musculus
aaagctctggccgtaggtgccacag

SEQ ID NO: 14655 - DNA, 25 bp, Mus musculus
aaagctctggctctcattgaccatg

SEQ ID NO: 14656 - DNA, 25 bp, Mus musculus
aaagctctggctgtcattgaccatg

SEQ ID NO: 14657 - DNA, 25 bp, Mus musculus
aaagctctgggcaacagggcctttt

SEQ ID NO: 14658 - DNA, 25 bp, Mus musculus
aaagctctgggcctgggctttgcca

SEQ ID NO: 14659 - DNA, 25 bp, Mus musculus
aaagctctgggcgtgggctttgcca

SEQ ID NO: 14660 - DNA, 25 bp, Mus musculus
aaagctctgggctacagggcctttt

SEQ ID NO: 14661 - DNA, 25 bp, Mus musculus
aaagctctggtgctatttgtgatga

SEQ ID NO: 14662 - DNA, 25 bp, Mus musculus
aaagctctggtggtatttgtgatga

SEQ ID NO: 14663 - DNA, 25 bp, Mus musculus
aaagctctgtcaatgtcgggtgtac

SEQ ID NO: 14664 - DNA, 25 bp, Mus musculus
aaagctctgtcattgtcgggtgtac

SEQ ID NO: 14665 - DNA, 25 bp, Mus musculus
aaagctctgtcccagtaagtcagct

SEQ ID NO: 14666 - DNA, 25 bp, Mus musculus
aaagctctgtccgagtaagtcagct

SEQ ID NO: 14667 - DNA, 25 bp, Mus musculus
aaagctctgtctaaaaatgtcttct

SEQ ID NO: 14668 - DNA, 25 bp, Mus musculus
aaagctctgtcttaaaatgtcttct

SEQ ID NO: 14669 - DNA, 25 bp, Mus musculus
aaagctctgtgcatggctcttctgg

SEQ ID NO: 14670 - DNA, 25 bp, Mus musculus
aaagctctgtgcttggctcttctgg

SEQ ID NO: 14671 - DNA, 25 bp, Mus musculus
aaagctctgtggcaacaaccattaa

SEQ ID NO: 14672 - DNA, 25 bp, Mus musculus
aaagctctgtgggaacaaccattaa

SEQ ID NO: 14673 - DNA, 25 bp, Mus musculus
aaagctctgttgacctcatttttaa

SEQ ID NO: 14674 - DNA, 25 bp, Mus musculus
aaagctctgttgtcctcatttttaa

SEQ ID NO: 14675 - DNA, 25 bp, Mus musculus
aaagctcttacaccagcctgacaga

SEQ ID NO: 14676 - DNA, 25 bp, Mus musculus
aaagctcttacacccaccagaggat

SEQ ID NO: 14677 - DNA, 25 bp, Mus musculus
aaagctcttacactgaagactcaat

SEQ ID NO: 14678 - DNA, 25 bp, Mus musculus
aaagctcttacagcagcctgacaga

SEQ ID NO: 14679 - DNA, 25 bp, Mus musculus
aaagctcttacagccaccagaggat

SEQ ID NO: 14680 - DNA, 25 bp, Mus musculus
aaagctcttacagtgaagactcaat

SEQ ID NO: 14681 - DNA, 25 bp, Mus musculus
aaagctcttccactctgtagtaagg

SEQ ID NO: 14682 - DNA, 25 bp, Mus musculus
aaagctcttccagtctgtagtaagg

SEQ ID NO: 14683 - DNA, 25 bp, Mus musculus
aaagctcttctaacctcaaaggcaa

SEQ ID NO: 14684 - DNA, 25 bp, Mus musculus
aaagctcttctatcctcaaaggcaa

SEQ ID NO: 14685 - DNA, 25 bp, Mus musculus
aaagctcttctgaagtgtgaatcaa

SEQ ID NO: 14686 - DNA, 25 bp, Mus musculus
aaagctcttctgactcattggttga

SEQ ID NO: 14687 - DNA, 25 bp, Mus musculus
aaagctcttctgtagtgtgaatcaa

SEQ ID NO: 14688 - DNA, 25 bp, Mus musculus
aaagctcttctgtctcattggttga

SEQ ID NO: 14689 - DNA, 25 bp, Mus musculus
aaagctcttgacatctactctaggg

SEQ ID NO: 14690 - DNA, 25 bp, Mus musculus
aaagctcttgacttctactctaggg

SEQ ID NO: 14691 - DNA, 25 bp, Mus musculus
aaagctcttgagctacactgtacta

SEQ ID NO: 14692 - DNA, 25 bp, Mus musculus
aaagctcttgaggtacactgtacta

SEQ ID NO: 14693 - DNA, 25 bp, Mus musculus
aaagctcttgctagagcctcagctg

SEQ ID NO: 14694 - DNA, 25 bp, Mus musculus
aaagctcttgcttgagcctcagctg

SEQ ID NO: 14695 - DNA, 25 bp, Mus musculus
aaagctcttggtcaagcgtccttgt

SEQ ID NO: 14696 - DNA, 25 bp, Mus musculus
aaagctcttggtgaagcgtccttgt

SEQ ID NO: 14697 - DNA, 25 bp, Mus musculus
aaagctctttacagtgatctgtgac

SEQ ID NO: 14698 - DNA, 25 bp, Mus musculus
aaagctctttactgtgatctgtgac

SEQ ID NO: 14699 - DNA, 25 bp, Mus musculus
aaagctctttgccacagtcctgttg

SEQ ID NO: 14700 - DNA, 25 bp, Mus musculus
aaagctctttgcgacagtcctgttg

SEQ ID NO: 14701 - DNA, 25 bp, Mus musculus
aaagctctttggagttaatgaatat

SEQ ID NO: 14702 - DNA, 25 bp, Mus musculus
aaagctctttggtgttaatgaatat

SEQ ID NO: 14703 - DNA, 25 bp, Mus musculus
aaagctgaaaagagccctggatctg

SEQ ID NO: 14704 - DNA, 25 bp, Mus musculus
aaagctgaaaagtgccctggatctg

SEQ ID NO: 14705 - DNA, 25 bp, Mus musculus
aaagctgaaacaaggcgtattggca

SEQ ID NO: 14706 - DNA, 25 bp, Mus musculus
aaagctgaaacatggcgtattggca

SEQ ID NO: 14707 - DNA, 25 bp, Mus musculus
aaagctgaacccagtgggatcccgg

SEQ ID NO: 14708 - DNA, 25 bp, Mus musculus
aaagctgaaccctgtgggatcccgg

SEQ ID NO: 14709 - DNA, 25 bp, Mus musculus
aaagctgaactgactctcacaaatt

SEQ ID NO: 14710 - DNA, 25 bp, Mus musculus
aaagctgaactgtctctcacaaatt

SEQ ID NO: 14711 - DNA, 25 bp, Mus musculus
aaagctgaagctctttgtggtacta

SEQ ID NO: 14712 - DNA, 25 bp, Mus musculus
aaagctgaagctgtttgtggtacta

SEQ ID NO: 14713 - DNA, 25 bp, Mus musculus
aaagctgaaggtacccaggcgcaat

SEQ ID NO: 14714 - DNA, 25 bp, Mus musculus
aaagctgaaggttcccaggcgcaat

SEQ ID NO: 14715 - DNA, 25 bp, Mus musculus
aaagctgaatccagtttggctgtgg

SEQ ID NO: 14716 - DNA, 25 bp, Mus musculus
aaagctgaatcctgtttggctgtgg

SEQ ID NO: 14717 - DNA, 25 bp, Mus musculus
aaagctgaattcattaggctacgga

SEQ ID NO: 14718 - DNA, 25 bp, Mus musculus
aaagctgaattctttaggctacgga

SEQ ID NO: 14719 - DNA, 25 bp, Mus musculus
aaagctgacaagaacgcgtccggga

SEQ ID NO: 14720 - DNA, 25 bp, Mus musculus
aaagctgacaagtacgcgtccggga

SEQ ID NO: 14721 - DNA, 25 bp, Mus musculus
aaagctgacaggagtctgctgggaa

SEQ ID NO: 14722 - DNA, 25 bp, Mus musculus
aaagctgacaggtgtctgctgggaa

SEQ ID NO: 14723 - DNA, 25 bp, Mus musculus
aaagctgaccgacaagatatggaga

SEQ ID NO: 14724 - DNA, 25 bp, Mus musculus
aaagctgaccgagaagatatggaga

SEQ ID NO: 14725 - DNA, 25 bp, Mus musculus
aaagctgaccgtcctcaaactgtgg

SEQ ID NO: 14726 - DNA, 25 bp, Mus musculus
aaagctgaccgtgctcaaactgtgg

SEQ ID NO: 14727 - DNA, 25 bp, Mus musculus
aaagctgacctcatgtagccttaaa

SEQ ID NO: 14728 - DNA, 25 bp, Mus musculus
aaagctgacctcttgtagccttaaa

SEQ ID NO: 14729 - DNA, 25 bp, Mus musculus
aaagctgactcccttcttggttgaa

SEQ ID NO: 14730 - DNA, 25 bp, Mus musculus
aaagctgactccgttcttggttgaa

SEQ ID NO: 14731 - DNA, 25 bp, Mus musculus
aaagctgagaataattgaggtgaaa

SEQ ID NO: 14732 - DNA, 25 bp, Mus musculus
aaagctgagaattattgaggtgaaa

SEQ ID NO: 14733 - DNA, 25 bp, Mus musculus
aaagctgagcaccatccttatatcc

SEQ ID NO: 14734 - DNA, 25 bp, Mus musculus
aaagctgagcacgatccttatatcc

SEQ ID NO: 14735 - DNA, 25 bp, Mus musculus
aaagctgagccgatggatactgatg

SEQ ID NO: 14736 - DNA, 25 bp, Mus musculus
aaagctgagccgttggatactgatg

SEQ ID NO: 14737 - DNA, 25 bp, Mus musculus
aaagctgagcgaacttgagaagtcc

SEQ ID NO: 14738 - DNA, 25 bp, Mus musculus
aaagctgagcgatcttgagaagtcc

SEQ ID NO: 14739 - DNA, 25 bp, Mus musculus
aaagctgagcgtcgtcttctcattg

SEQ ID NO: 14740 - DNA, 25 bp, Mus musculus
aaagctgagcgtggtcttctcattg

SEQ ID NO: 14741 - DNA, 25 bp, Mus musculus
aaagctgaggcactgacccttcttc

SEQ ID NO: 14742 - DNA, 25 bp, Mus musculus
aaagctgaggcagtgacccttcttc

SEQ ID NO: 14743 - DNA, 25 bp, Mus musculus
aaagctgaggctagtatttgatcat

SEQ ID NO: 14744 - DNA, 25 bp, Mus musculus
aaagctgaggcttgtatttgatcat

SEQ ID NO: 14745 - DNA, 25 bp, Mus musculus
aaagctgagtgaaagccccacctct

SEQ ID NO: 14746 - DNA, 25 bp, Mus musculus
aaagctgagtgatagccccacctct

SEQ ID NO: 14747 - DNA, 25 bp, Mus musculus
aaagctgatagtatggaatggacct

SEQ ID NO: 14748 - DNA, 25 bp, Mus musculus
aaagctgatagtttggaatggacct

SEQ ID NO: 14749 - DNA, 25 bp, Mus musculus
aaagctgatcatctctgctcttgat

SEQ ID NO: 14750 - DNA, 25 bp, Mus musculus
aaagctgatcatgtctgctcttgat

SEQ ID NO: 14751 - DNA, 25 bp, Mus musculus
aaagctgatgatcctctggaggcca

SEQ ID NO: 14752 - DNA, 25 bp, Mus musculus
aaagctgatgatgctctggaggcca

SEQ ID NO: 14753 - DNA, 25 bp, Mus musculus
aaagctgatgcgagcctgtatgcag

SEQ ID NO: 14754 - DNA, 25 bp, Mus musculus
aaagctgatgcgtgcctgtatgcag

SEQ ID NO: 14755 - DNA, 25 bp, Mus musculus
aaagctgatgctagatcttgcacaa

SEQ ID NO: 14756 - DNA, 25 bp, Mus musculus
aaagctgatgcttgatcttgcacaa

SEQ ID NO: 14757 - DNA, 25 bp, Mus musculus
aaagctgatggtacatgaccctcat

SEQ ID NO: 14758 - DNA, 25 bp, Mus musculus
aaagctgatggttcatgaccctcat

SEQ ID NO: 14759 - DNA, 25 bp, Mus musculus
aaagctgatgtacagccctgtgtac

SEQ ID NO: 14760 - DNA, 25 bp, Mus musculus
aaagctgatgtagagccctgtgtac

SEQ ID NO: 14761 - DNA, 25 bp, Mus musculus
aaagctgatgtcaacaaggaaccca

SEQ ID NO: 14762 - DNA, 25 bp, Mus musculus
aaagctgatgtcctattttcatggg

SEQ ID NO: 14763 - DNA, 25 bp, Mus musculus
aaagctgatgtcgtattttcatggg

SEQ ID NO: 14764 - DNA, 25 bp, Mus musculus
aaagctgatgtctacaaggaaccca

SEQ ID NO: 14765 - DNA, 25 bp, Mus musculus
aaagctgattgcaggctgagagccc

SEQ ID NO: 14766 - DNA, 25 bp, Mus musculus
aaagctgattgctggctgagagccc

SEQ ID NO: 14767 - DNA, 25 bp, Mus musculus
aaagctgcaagtcgcctttcttttt

SEQ ID NO: 14768 - DNA, 25 bp, Mus musculus
aaagctgcaagtggcctttcttttt

SEQ ID NO: 14769 - DNA, 25 bp, Mus musculus
aaagctgcacaaagcccctcaatta

SEQ ID NO: 14770 - DNA, 25 bp, Mus musculus
aaagctgcacaatgcccctcaatta

SEQ ID NO: 14771 - DNA, 25 bp, Mus musculus
aaagctgcacgacagacccagaatc

SEQ ID NO: 14772 - DNA, 25 bp, Mus musculus
aaagctgcacgagagacccagaatc

SEQ ID NO: 14773 - DNA, 25 bp, Mus musculus
aaagctgcacttcaatggactgaaa

SEQ ID NO: 14774 - DNA, 25 bp, Mus musculus
aaagctgcacttgaatggactgaaa

SEQ ID NO: 14775 - DNA, 25 bp, Mus musculus
aaagctgcagacatgaaacatccat

SEQ ID NO: 14776 - DNA, 25 bp, Mus musculus
aaagctgcagacttgaaacatccat

SEQ ID NO: 14777 - DNA, 25 bp, Mus musculus
aaagctgcagccaagtgaggaagta

SEQ ID NO: 14778 - DNA, 25 bp, Mus musculus
aaagctgcagccaatgccgaggtgc

SEQ ID NO: 14779 - DNA, 25 bp, Mus musculus
aaagctgcagcctagtgaggaagta

SEQ ID NO: 14780 - DNA, 25 bp, Mus musculus
aaagctgcagcctatgccgaggtgc

SEQ ID NO: 14781 - DNA, 25 bp, Mus musculus
aaagctgcagctctagtcctcagaa

SEQ ID NO: 14782 - DNA, 25 bp, Mus musculus
aaagctgcagctgtagtcctcagaa

SEQ ID NO: 14783 - DNA, 25 bp, Mus musculus
aaagctgcaggaccaccttcggcaa

SEQ ID NO: 14784 - DNA, 25 bp, Mus musculus
aaagctgcaggagcaccttcggcaa

SEQ ID NO: 14785 - DNA, 25 bp, Mus musculus
aaagctgcagggacagagtccggcc

SEQ ID NO: 14786 - DNA, 25 bp, Mus musculus
aaagctgcagggtcagagtccggcc

SEQ ID NO: 14787 - DNA, 25 bp, Mus musculus
aaagctgcagttcatcattatgagc

SEQ ID NO: 14788 - DNA, 25 bp, Mus musculus
aaagctgcagttgatcattatgagc

SEQ ID NO: 14789 - DNA, 25 bp, Mus musculus
aaagctgcatcaaatacaagacggg

SEQ ID NO: 14790 - DNA, 25 bp, Mus musculus
aaagctgcatcatatacaagacggg

SEQ ID NO: 14791 - DNA, 25 bp, Mus musculus
aaagctgcattcacttacaatagga

SEQ ID NO: 14792 - DNA, 25 bp, Mus musculus
aaagctgcattctcttacaatagga

SEQ ID NO: 14793 - DNA, 25 bp, Mus musculus
aaagctgccaaaatgattccaggat

SEQ ID NO: 14794 - DNA, 25 bp, Mus musculus
aaagctgccaaattgattccaggat

SEQ ID NO: 14795 - DNA, 25 bp, Mus musculus
aaagctgccaagatacttcactgga

SEQ ID NO: 14796 - DNA, 25 bp, Mus musculus
aaagctgccaagttacttcactgga

SEQ ID NO: 14797 - DNA, 25 bp, Mus musculus
aaagctgccactcggtcgttttgac

SEQ ID NO: 14798 - DNA, 25 bp, Mus musculus
aaagctgccactgggtcgttttgac

SEQ ID NO: 14799 - DNA, 25 bp, Mus musculus
aaagctgccagcacagaactgatct

SEQ ID NO: 14800 - DNA, 25 bp, Mus musculus
aaagctgccagcctattctatcttg

SEQ ID NO: 14801 - DNA, 25 bp, Mus musculus
aaagctgccagcgtattctatcttg

SEQ ID NO: 14802 - DNA, 25 bp, Mus musculus
aaagctgccagctcagaactgatct

SEQ ID NO: 14803 - DNA, 25 bp, Mus musculus
aaagctgccatgaaggccctgttgt

SEQ ID NO: 14804 - DNA, 25 bp, Mus musculus
aaagctgccatgtaggccctgttgt

SEQ ID NO: 14805 - DNA, 25 bp, Mus musculus
aaagctgccattaaacttacatgta

SEQ ID NO: 14806 - DNA, 25 bp, Mus musculus
aaagctgccattccggcggctgcag

SEQ ID NO: 14807 - DNA, 25 bp, Mus musculus
aaagctgccattgcggcggctgcag

SEQ ID NO: 14808 - DNA, 25 bp, Mus musculus
aaagctgccatttaacttacatgta

SEQ ID NO: 14809 - DNA, 25 bp, Mus musculus
aaagctgcccacctcatgattggtg

SEQ ID NO: 14810 - DNA, 25 bp, Mus musculus
aaagctgcccacgtcatgattggtg

SEQ ID NO: 14811 - DNA, 25 bp, Mus musculus
aaagctgccccacaccagatagcag

SEQ ID NO: 14812 - DNA, 25 bp, Mus musculus
aaagctgccccagaccagatagcag

SEQ ID NO: 14813 - DNA, 25 bp, Mus musculus
aaagctgccctgctcagtggtgctg

SEQ ID NO: 14814 - DNA, 25 bp, Mus musculus
aaagctgccctggtcagtggtgctg

SEQ ID NO: 14815 - DNA, 25 bp, Mus musculus
aaagctgcctgaattgaggtttctt

SEQ ID NO: 14816 - DNA, 25 bp, Mus musculus
aaagctgcctgatttgaggtttctt

SEQ ID NO: 14817 - DNA, 25 bp, Mus musculus
aaagctgcctggcaactttgcaaga

SEQ ID NO: 14818 - DNA, 25 bp, Mus musculus
aaagctgcctgggaactttgcaaga

SEQ ID NO: 14819 - DNA, 25 bp, Mus musculus
aaagctgcgcaaaagccggctggag

SEQ ID NO: 14820 - DNA, 25 bp, Mus musculus
aaagctgcgcaatagccggctggag

SEQ ID NO: 14821 - DNA, 25 bp, Mus musculus
aaagctgcggaaacgccaggatgaa

SEQ ID NO: 14822 - DNA, 25 bp, Mus musculus
aaagctgcggaatcgccaggatgaa

SEQ ID NO: 14823 - DNA, 25 bp, Mus musculus
aaagctgcgggtactaattgctgcc

SEQ ID NO: 14824 - DNA, 25 bp, Mus musculus
aaagctgcgggttctaattgctgcc

SEQ ID NO: 14825 - DNA, 25 bp, Mus musculus
aaagctgcgttcaacccagtggaga

SEQ ID NO: 14826 - DNA, 25 bp, Mus musculus
aaagctgcgttctacccagtggaga

SEQ ID NO: 14827 - DNA, 25 bp, Mus musculus
aaagctgctaaaactccctctattt

SEQ ID NO: 14828 - DNA, 25 bp, Mus musculus
aaagctgctaaatctccctctattt

SEQ ID NO: 14829 - DNA, 25 bp, Mus musculus
aaagctgctattaagtttcaactct

SEQ ID NO: 14830 - DNA, 25 bp, Mus musculus
aaagctgctatttagtttcaactct

SEQ ID NO: 14831 - DNA, 25 bp, Mus musculus
aaagctgctcacctcatggatgtgg

SEQ ID NO: 14832 - DNA, 25 bp, Mus musculus
aaagctgctcacgtcatggatgtgg

SEQ ID NO: 14833 - DNA, 25 bp, Mus musculus
aaagctgctcgcaagctgcgggtgc

SEQ ID NO: 14834 - DNA, 25 bp, Mus musculus
aaagctgctcgctagctgcgggtgc

SEQ ID NO: 14835 - DNA, 25 bp, Mus musculus
aaagctgctgagacggcttggccag

SEQ ID NO: 14836 - DNA, 25 bp, Mus musculus
aaagctgctgagtcggcttggccag

SEQ ID NO: 14837 - DNA, 25 bp, Mus musculus
aaagctgctgctatcgagatcaccc

SEQ ID NO: 14838 - DNA, 25 bp, Mus musculus
aaagctgctgctttcgagatcaccc

SEQ ID NO: 14839 - DNA, 25 bp, Mus musculus
aaagctgctgtcagagttggaccaa

SEQ ID NO: 14840 - DNA, 25 bp, Mus musculus
aaagctgctgtctgagttggaccaa

SEQ ID NO: 14841 - DNA, 25 bp, Mus musculus
aaagctgctgtgaaatttaacttgt

SEQ ID NO: 14842 - DNA, 25 bp, Mus musculus
aaagctgctgtgctggcatctggtt

SEQ ID NO: 14843 - DNA, 25 bp, Mus musculus
aaagctgctgtggtggcatctggtt

SEQ ID NO: 14844 - DNA, 25 bp, Mus musculus
aaagctgctgtgtaatttaacttgt

SEQ ID NO: 14845 - DNA, 25 bp, Mus musculus
aaagctgcttaaatcgggcgtcctc

SEQ ID NO: 14846 - DNA, 25 bp, Mus musculus
aaagctgcttaattcgggcgtcctc

SEQ ID NO: 14847 - DNA, 25 bp, Mus musculus
aaagctgcttgaaaggacaccaaca

SEQ ID NO: 14848 - DNA, 25 bp, Mus musculus
aaagctgcttgactatcacatacaa

SEQ ID NO: 14849 - DNA, 25 bp, Mus musculus
aaagctgcttgagtatcacatacaa

SEQ ID NO: 14850 - DNA, 25 bp, Mus musculus
aaagctgcttgataggacaccaaca

SEQ ID NO: 14851 - DNA, 25 bp, Mus musculus
aaagctgctttactgagttctcaag

SEQ ID NO: 14852 - DNA, 25 bp, Mus musculus
aaagctgctttagtgagttctcaag

SEQ ID NO: 14853 - DNA, 25 bp, Mus musculus
aaagctgcttttcatttctaacgaa

SEQ ID NO: 14854 - DNA, 25 bp, Mus musculus
aaagctgcttttgatttctaacgaa

SEQ ID NO: 14855 - DNA, 25 bp, Mus musculus
aaagctggaaaaaattttagtgaag

SEQ ID NO: 14856 - DNA, 25 bp, Mus musculus
aaagctggaaaatattttagtgaag

SEQ ID NO: 14857 - DNA, 25 bp, Mus musculus
aaagctggaagtactcccctaatct

SEQ ID NO: 14858 - DNA, 25 bp, Mus musculus
aaagctggaagttctcccctaatct

SEQ ID NO: 14859 - DNA, 25 bp, Mus musculus
aaagctggacaaacaccttcagttt

SEQ ID NO: 14860 - DNA, 25 bp, Mus musculus
aaagctggacaatcaccttcagttt

SEQ ID NO: 14861 - DNA, 25 bp, Mus musculus
aaagctggacacacctagtgcaggg

SEQ ID NO: 14862 - DNA, 25 bp, Mus musculus
aaagctggacactcctagtgcaggg

SEQ ID NO: 14863 - DNA, 25 bp, Mus musculus
aaagctggacagaggtttctccatc

SEQ ID NO: 14864 - DNA, 25 bp, Mus musculus
aaagctggacagtggtttctccatc

SEQ ID NO: 14865 - DNA, 25 bp, Mus musculus
aaagctggacataactaaccttaga

SEQ ID NO: 14866 - DNA, 25 bp, Mus musculus
aaagctggacattactaaccttaga

SEQ ID NO: 14867 - DNA, 25 bp, Mus musculus
aaagctggaccaaggttccatcttt

SEQ ID NO: 14868 - DNA, 25 bp, Mus musculus
aaagctggaccatggttccatcttt

SEQ ID NO: 14869 - DNA, 25 bp, Mus musculus
aaagctggagctaatgtcccatctg

SEQ ID NO: 14870 - DNA, 25 bp, Mus musculus
aaagctggagcttatgtcccatctg

SEQ ID NO: 14871 - DNA, 25 bp, Mus musculus
aaagctggaggcatctagctaggga

SEQ ID NO: 14872 - DNA, 25 bp, Mus musculus
aaagctggaggcttctagctaggga

SEQ ID NO: 14873 - DNA, 25 bp, Mus musculus
aaagctggatgacctttaccaacaa

SEQ ID NO: 14874 - DNA, 25 bp, Mus musculus
aaagctggatgagctttaccaacaa

SEQ ID NO: 14875 - DNA, 25 bp, Mus musculus
aaagctggatttagacaagttcaat

SEQ ID NO: 14876 - DNA, 25 bp, Mus musculus
aaagctggattttgacaagttcaat

SEQ ID NO: 14877 - DNA, 25 bp, Mus musculus
aaagctggcacaagcagcgggaggg

SEQ ID NO: 14878 - DNA, 25 bp, Mus musculus
aaagctggcacatgcagcgggaggg

SEQ ID NO: 14879 - DNA, 25 bp, Mus musculus
aaagctggcaccattaggcacactt

SEQ ID NO: 14880 - DNA, 25 bp, Mus musculus
aaagctggcacctttaggcacactt

SEQ ID NO: 14881 - DNA, 25 bp, Mus musculus
aaagctggcagaagtcttctgcaaa

SEQ ID NO: 14882 - DNA, 25 bp, Mus musculus
aaagctggcagatgtcttctgcaaa

SEQ ID NO: 14883 - DNA, 25 bp, Mus musculus
aaagctggcagtcatctacccaacc

SEQ ID NO: 14884 - DNA, 25 bp, Mus musculus
aaagctggcagtgatctacccaacc

SEQ ID NO: 14885 - DNA, 25 bp, Mus musculus
aaagctggccttagctcacgtgctc

SEQ ID NO: 14886 - DNA, 25 bp, Mus musculus
aaagctggcctttgctcacgtgctc

SEQ ID NO: 14887 - DNA, 25 bp, Mus musculus
aaagctggcgcgactgttgactcag

SEQ ID NO: 14888 - DNA, 25 bp, Mus musculus
aaagctggcgcgtctgttgactcag

SEQ ID NO: 14889 - DNA, 25 bp, Mus musculus
aaagctggctggaggtatttcccat

SEQ ID NO: 14890 - DNA, 25 bp, Mus musculus
aaagctggctggtggtatttcccat

SEQ ID NO: 14891 - DNA, 25 bp, Mus musculus
aaagctgggaaactctgctggcaat

SEQ ID NO: 14892 - DNA, 25 bp, Mus musculus
aaagctgggaaagtctgctggcaat

SEQ ID NO: 14893 - DNA, 25 bp, Mus musculus
aaagctgggcgacaccaacgaacga

SEQ ID NO: 14894 - DNA, 25 bp, Mus musculus
aaagctgggcgagaccaacgaacga

SEQ ID NO: 14895 - DNA, 25 bp, Mus musculus
aaagctgggctcacagttcagggta

SEQ ID NO: 14896 - DNA, 25 bp, Mus musculus
aaagctgggctctcagttcagggta

SEQ ID NO: 14897 - DNA, 25 bp, Mus musculus
aaagctgggctgagtcttaaggaca

SEQ ID NO: 14898 - DNA, 25 bp, Mus musculus
aaagctgggctgtgtcttaaggaca

SEQ ID NO: 14899 - DNA, 25 bp, Mus musculus
aaagctgggtttctctgtcctctga

SEQ ID NO: 14900 - DNA, 25 bp, Mus musculus
aaagctgggtttgtctgtcctctga

SEQ ID NO: 14901 - DNA, 25 bp, Mus musculus
aaagctggtagccttgaaaatgtca

SEQ ID NO: 14902 - DNA, 25 bp, Mus musculus
aaagctggtagcgttgaaaatgtca

SEQ ID NO: 14903 - DNA, 25 bp, Mus musculus
aaagctggtaggatactcagaccaa

SEQ ID NO: 14904 - DNA, 25 bp, Mus musculus
aaagctggtaggttactcagaccaa

SEQ ID NO: 14905 - DNA, 25 bp, Mus musculus
aaagctggtatgacctgtgtgtccc

SEQ ID NO: 14906 - DNA, 25 bp, Mus musculus
aaagctggtatgtcctgtgtgtccc

SEQ ID NO: 14907 - DNA, 25 bp, Mus musculus
aaagctggtcatctattccgcacac

SEQ ID NO: 14908 - DNA, 25 bp, Mus musculus
aaagctggtcatgtattccgcacac

SEQ ID NO: 14909 - DNA, 25 bp, Mus musculus
aaagctggtctcagacatccacctt

SEQ ID NO: 14910 - DNA, 25 bp, Mus musculus
aaagctggtctctgacatccacctt

SEQ ID NO: 14911 - DNA, 25 bp, Mus musculus
aaagctggtgatcaacggtggcaat

SEQ ID NO: 14912 - DNA, 25 bp, Mus musculus
aaagctggtgatgaacggtggcaat

SEQ ID NO: 14913 - DNA, 25 bp, Mus musculus
aaagctggtgcactctgtctttccg

SEQ ID NO: 14914 - DNA, 25 bp, Mus musculus
aaagctggtgcagtctgtctttccg

SEQ ID NO: 14915 - DNA, 25 bp, Mus musculus
aaagctggtgccaggagtcatgcct

SEQ ID NO: 14916 - DNA, 25 bp, Mus musculus
aaagctggtgcctggagtcatgcct

SEQ ID NO: 14917 - DNA, 25 bp, Mus musculus
aaagctggtggactccgccatccag

SEQ ID NO: 14918 - DNA, 25 bp, Mus musculus
aaagctggtggagtccgccatccag

SEQ ID NO: 14919 - DNA, 25 bp, Mus musculus
aaagctggtttgacaatccactctc

SEQ ID NO: 14920 - DNA, 25 bp, Mus musculus
aaagctggtttgtcaatccactctc

SEQ ID NO: 14921 - DNA, 25 bp, Mus musculus
aaagctgtagctagtttccatcgtg

SEQ ID NO: 14922 - DNA, 25 bp, Mus musculus
aaagctgtagcttgtttccatcgtg

SEQ ID NO: 14923 - DNA, 25 bp, Mus musculus
aaagctgtatccagtagtgagtgcc

SEQ ID NO: 14924 - DNA, 25 bp, Mus musculus
aaagctgtatcctgtagtgagtgcc

SEQ ID NO: 14925 - DNA, 25 bp, Mus musculus
aaagctgtatttctgtcacattgtg

SEQ ID NO: 14926 - DNA, 25 bp, Mus musculus
aaagctgtatttgtgtcacattgtg

SEQ ID NO: 14927 - DNA, 25 bp, Mus musculus
aaagctgtcaagacaggtttgcaaa

SEQ ID NO: 14928 - DNA, 25 bp, Mus musculus
aaagctgtcaagatctgctgcctga

SEQ ID NO: 14929 - DNA, 25 bp, Mus musculus
aaagctgtcaagtcaggtttgcaaa

SEQ ID NO: 14930 - DNA, 25 bp, Mus musculus
aaagctgtcaagttctgctgcctga

SEQ ID NO: 14931 - DNA, 25 bp, Mus musculus
aaagctgtcaatccctgttcagagg

SEQ ID NO: 14932 - DNA, 25 bp, Mus musculus
aaagctgtcaatgcctgttcagagg

SEQ ID NO: 14933 - DNA, 25 bp, Mus musculus
aaagctgtcacaccaccgtaaggat

SEQ ID NO: 14934 - DNA, 25 bp, Mus musculus
aaagctgtcacagcaccgtaaggat

SEQ ID NO: 14935 - DNA, 25 bp, Mus musculus
aaagctgtcaccaacttcattcgaa

SEQ ID NO: 14936 - DNA, 25 bp, Mus musculus
aaagctgtcacctacttcattcgaa

SEQ ID NO: 14937 - DNA, 25 bp, Mus musculus
aaagctgtcagaccgttctggcctc

SEQ ID NO: 14938 - DNA, 25 bp, Mus musculus
aaagctgtcagagcgttctggcctc

SEQ ID NO: 14939 - DNA, 25 bp, Mus musculus
aaagctgtcagcaggacttcttggc

SEQ ID NO: 14940 - DNA, 25 bp, Mus musculus
aaagctgtcagcagtatcctcctca

SEQ ID NO: 14941 - DNA, 25 bp, Mus musculus
aaagctgtcagctggacttcttggc

SEQ ID NO: 14942 - DNA, 25 bp, Mus musculus
aaagctgtcagctgtatcctcctca

SEQ ID NO: 14943 - DNA, 25 bp, Mus musculus
aaagctgtcaggatatggcggtaaa

SEQ ID NO: 14944 - DNA, 25 bp, Mus musculus
aaagctgtcaggttatggcggtaaa

SEQ ID NO: 14945 - DNA, 25 bp, Mus musculus
aaagctgtcatcaatcccaggccta

SEQ ID NO: 14946 - DNA, 25 bp, Mus musculus
aaagctgtcatctatcccaggccta

SEQ ID NO: 14947 - DNA, 25 bp, Mus musculus
aaagctgtccaacctgcgtgggcaa

SEQ ID NO: 14948 - DNA, 25 bp, Mus musculus
aaagctgtccaagctgcgtgggcaa

SEQ ID NO: 14949 - DNA, 25 bp, Mus musculus
aaagctgtccacaatgaaattcgga

SEQ ID NO: 14950 - DNA, 25 bp, Mus musculus
aaagctgtccactatgaaattcgga

SEQ ID NO: 14951 - DNA, 25 bp, Mus musculus
aaagctgtccataaatcttcccttg

SEQ ID NO: 14952 - DNA, 25 bp, Mus musculus
aaagctgtccatacaattccaaata

SEQ ID NO: 14953 - DNA, 25 bp, Mus musculus
aaagctgtccattaatcttcccttg

SEQ ID NO: 14954 - DNA, 25 bp, Mus musculus
aaagctgtccattcaattccaaata

SEQ ID NO: 14955 - DNA, 25 bp, Mus musculus
aaagctgtccggctggcagattttg

SEQ ID NO: 14956 - DNA, 25 bp, Mus musculus
aaagctgtccgggtggcagattttg

SEQ ID NO: 14957 - DNA, 25 bp, Mus musculus
aaagctgtctataggcgaagaatgc

SEQ ID NO: 14958 - DNA, 25 bp, Mus musculus
aaagctgtctattggcgaagaatgc

SEQ ID NO: 14959 - DNA, 25 bp, Mus musculus
aaagctgtctccattgacgtgatcg

SEQ ID NO: 14960 - DNA, 25 bp, Mus musculus
aaagctgtctcctttgacgtgatcg

SEQ ID NO: 14961 - DNA, 25 bp, Mus musculus
aaagctgtctggactcacagtagtt

SEQ ID NO: 14962 - DNA, 25 bp, Mus musculus
aaagctgtctggtctcacagtagtt

SEQ ID NO: 14963 - DNA, 25 bp, Mus musculus
aaagctgtcttgaatacctatttaa

SEQ ID NO: 14964 - DNA, 25 bp, Mus musculus
aaagctgtcttgtatacctatttaa

SEQ ID NO: 14965 - DNA, 25 bp, Mus musculus
aaagctgtgaaaatgaccctgaaga

SEQ ID NO: 14966 - DNA, 25 bp, Mus musculus
aaagctgtgaaattgaccctgaaga

SEQ ID NO: 14967 - DNA, 25 bp, Mus musculus
aaagctgtgaagctcctgcagtcct

SEQ ID NO: 14968 - DNA, 25 bp, Mus musculus
aaagctgtgaaggtcctgcagtcct

SEQ ID NO: 14969 - DNA, 25 bp, Mus musculus
aaagctgtgacactcatggcactgt

SEQ ID NO: 14970 - DNA, 25 bp, Mus musculus
aaagctgtgacagtcatggcactgt

SEQ ID NO: 14971 - DNA, 25 bp, Mus musculus
aaagctgtgactccatatccagaga

SEQ ID NO: 14972 - DNA, 25 bp, Mus musculus
aaagctgtgactgcatatccagaga

SEQ ID NO: 14973 - DNA, 25 bp, Mus musculus
aaagctgtgatcatccagagacctg

SEQ ID NO: 14974 - DNA, 25 bp, Mus musculus
aaagctgtgatcttccagagacctg

SEQ ID NO: 14975 - DNA, 25 bp, Mus musculus
aaagctgtgcgtctcaggttagtct

SEQ ID NO: 14976 - DNA, 25 bp, Mus musculus
aaagctgtgcgtgtcaggttagtct

SEQ ID NO: 14977 - DNA, 25 bp, Mus musculus
aaagctgtgctcacacttggacaga

SEQ ID NO: 14978 - DNA, 25 bp, Mus musculus
aaagctgtgctctcacttggacaga

SEQ ID NO: 14979 - DNA, 25 bp, Mus musculus
aaagctgtgctgagataatgagaaa

SEQ ID NO: 14980 - DNA, 25 bp, Mus musculus
aaagctgtgctgtgataatgagaaa

SEQ ID NO: 14981 - DNA, 25 bp, Mus musculus
aaagctgtgcttacaggttaaacca

SEQ ID NO: 14982 - DNA, 25 bp, Mus musculus
aaagctgtgctttcaggttaaacca

SEQ ID NO: 14983 - DNA, 25 bp, Mus musculus
aaagctgtggccatctttgacgaca

SEQ ID NO: 14984 - DNA, 25 bp, Mus musculus
aaagctgtggccttctttgacgaca

SEQ ID NO: 14985 - DNA, 25 bp, Mus musculus
aaagctgtggctagggcttcctaca

SEQ ID NO: 14986 - DNA, 25 bp, Mus musculus
aaagctgtggcttgggcttcctaca

SEQ ID NO: 14987 - DNA, 25 bp, Mus musculus
aaagctgtgggaagctgccactctc

SEQ ID NO: 14988 - DNA, 25 bp, Mus musculus
aaagctgtgggatgctgccactctc

SEQ ID NO: 14989 - DNA, 25 bp, Mus musculus
aaagctgtgggtcttgcaccttctc

SEQ ID NO: 14990 - DNA, 25 bp, Mus musculus
aaagctgtgggtgttgcaccttctc

SEQ ID NO: 14991 - DNA, 25 bp, Mus musculus
aaagctgtggtcatacctggcatgt

SEQ ID NO: 14992 - DNA, 25 bp, Mus musculus
aaagctgtggtcttacctggcatgt

SEQ ID NO: 14993 - DNA, 25 bp, Mus musculus
aaagctgtgtgcagctttatgcagg

SEQ ID NO: 14994 - DNA, 25 bp, Mus musculus
aaagctgtgtgcatatttttcaaag

SEQ ID NO: 14995 - DNA, 25 bp, Mus musculus
aaagctgtgtgctgctttatgcagg

SEQ ID NO: 14996 - DNA, 25 bp, Mus musculus
aaagctgtgtgcttatttttcaaag

SEQ ID NO: 14997 - DNA, 25 bp, Mus musculus
aaagctgtgtggagcaacgccatct

SEQ ID NO: 14998 - DNA, 25 bp, Mus musculus
aaagctgtgtggtgcaacgccatct

SEQ ID NO: 14999 - DNA, 25 bp, Mus musculus
aaagctgtgtgtcttaagtgcggac

SEQ ID NO: 15000 - DNA, 25 bp, Mus musculus
aaagctgtgtgtgttaagtgcggac

SEQ ID NO: 15001 - DNA, 25 bp, Mus musculus
aaagctgtgttcagccctgacagaa

SEQ ID NO: 15002 - DNA, 25 bp, Mus musculus
aaagctgtgttctgccctgacagaa

SEQ ID NO: 15003 - DNA, 25 bp, Mus musculus
aaagctgtgttgagctcttcctctg

SEQ ID NO: 15004 - DNA, 25 bp, Mus musculus
aaagctgtgttgtgctcttcctctg

SEQ ID NO: 15005 - DNA, 25 bp, Mus musculus
aaagctgttacacacctgtttctct

SEQ ID NO: 15006 - DNA, 25 bp, Mus musculus
aaagctgttacacagccttcctgtc

SEQ ID NO: 15007 - DNA, 25 bp, Mus musculus
aaagctgttacagacctgtttctct

SEQ ID NO: 15008 - DNA, 25 bp, Mus musculus
aaagctgttacagagccttcctgtc

SEQ ID NO: 15009 - DNA, 25 bp, Mus musculus
aaagctgttattaccttgtccaatt

SEQ ID NO: 15010 - DNA, 25 bp, Mus musculus
aaagctgttattatcctcatgaatg

SEQ ID NO: 15011 - DNA, 25 bp, Mus musculus
aaagctgttatttccttgtccaatt

SEQ ID NO: 15012 - DNA, 25 bp, Mus musculus
aaagctgttattttcctcatgaatg

SEQ ID NO: 15013 - DNA, 25 bp, Mus musculus
aaagctgttcatacaataactgctt

SEQ ID NO: 15014 - DNA, 25 bp, Mus musculus
aaagctgttcatcctactcacggag

SEQ ID NO: 15015 - DNA, 25 bp, Mus musculus
aaagctgttcatctggttaccctgt

SEQ ID NO: 15016 - DNA, 25 bp, Mus musculus
aaagctgttcatgctactcacggag

SEQ ID NO: 15017 - DNA, 25 bp, Mus musculus
aaagctgttcatgtggttaccctgt

SEQ ID NO: 15018 - DNA, 25 bp, Mus musculus
aaagctgttcattcaataactgctt

SEQ ID NO: 15019 - DNA, 25 bp, Mus musculus
aaagctgttcccatttatgtacagg

SEQ ID NO: 15020 - DNA, 25 bp, Mus musculus
aaagctgttcccttttatgtacagg

SEQ ID NO: 15021 - DNA, 25 bp, Mus musculus
aaagctgttcctacctcaccatgag

SEQ ID NO: 15022 - DNA, 25 bp, Mus musculus
aaagctgttccttcctcaccatgag

SEQ ID NO: 15023 - DNA, 25 bp, Mus musculus
aaagctgttgaacacatggtggcca

SEQ ID NO: 15024 - DNA, 25 bp, Mus musculus
aaagctgttgaagacatggtggcca

SEQ ID NO: 15025 - DNA, 25 bp, Mus musculus
aaagctgttgatatgtagtgtgttg

SEQ ID NO: 15026 - DNA, 25 bp, Mus musculus
aaagctgttgatcttatggattcca

SEQ ID NO: 15027 - DNA, 25 bp, Mus musculus
aaagctgttgatgttatggattcca

SEQ ID NO: 15028 - DNA, 25 bp, Mus musculus
aaagctgttgatttgtagtgtgttg

SEQ ID NO: 15029 - DNA, 25 bp, Mus musculus
aaagctgttggtatccagaccttga

SEQ ID NO: 15030 - DNA, 25 bp, Mus musculus
aaagctgttggtttccagaccttga

SEQ ID NO: 15031 - DNA, 25 bp, Mus musculus
aaagctgttgttatggtctttccaa

SEQ ID NO: 15032 - DNA, 25 bp, Mus musculus
aaagctgttgttttggtctttccaa

SEQ ID NO: 15033 - DNA, 25 bp, Mus musculus
aaagctgtttccagtgcgtagcctt

SEQ ID NO: 15034 - DNA, 25 bp, Mus musculus
aaagctgtttcctgtgcgtagcctt

SEQ ID NO: 15035 - DNA, 25 bp, Mus musculus
aaagctgtttctaagttcaagtcat

SEQ ID NO: 15036 - DNA, 25 bp, Mus musculus
aaagctgtttcttagttcaagtcat

SEQ ID NO: 15037 - DNA, 25 bp, Mus musculus
aaagcttaaaatctctccctccaag

SEQ ID NO: 15038 - DNA, 25 bp, Mus musculus
aaagcttaaaatgtctccctccaag

SEQ ID NO: 15039 - DNA, 25 bp, Mus musculus
aaagcttaaagcacaccctcagtgt

SEQ ID NO: 15040 - DNA, 25 bp, Mus musculus
aaagcttaaagctcaccctcagtgt

SEQ ID NO: 15041 - DNA, 25 bp, Mus musculus
aaagcttaagttccactggacatgg

SEQ ID NO: 15042 - DNA, 25 bp, Mus musculus
aaagcttaagttgcactggacatgg

SEQ ID NO: 15043 - DNA, 25 bp, Mus musculus
aaagcttacattagatccctggcaa

SEQ ID NO: 15044 - DNA, 25 bp, Mus musculus
aaagcttacatttgatccctggcaa

SEQ ID NO: 15045 - DNA, 25 bp, Mus musculus
aaagcttaccagacctcaagtcagc

SEQ ID NO: 15046 - DNA, 25 bp, Mus musculus
aaagcttaccagtcctcaagtcagc

SEQ ID NO: 15047 - DNA, 25 bp, Mus musculus
aaagcttaccttacagatatatcat

SEQ ID NO: 15048 - DNA, 25 bp, Mus musculus
aaagcttaccttccagattcctaag

SEQ ID NO: 15049 - DNA, 25 bp, Mus musculus
aaagcttaccttgcagattcctaag

SEQ ID NO: 15050 - DNA, 25 bp, Mus musculus
aaagcttacctttcagatatatcat

SEQ ID NO: 15051 - DNA, 25 bp, Mus musculus
aaagcttactctatttgtccactgg

SEQ ID NO: 15052 - DNA, 25 bp, Mus musculus
aaagcttactctttttgtccactgg

SEQ ID NO: 15053 - DNA, 25 bp, Mus musculus
aaagcttagcggacggtctgtctgt

SEQ ID NO: 15054 - DNA, 25 bp, Mus musculus
aaagcttagcggtcggtctgtctgt

SEQ ID NO: 15055 - DNA, 25 bp, Mus musculus
aaagcttagctcagcgtacaggcaa

SEQ ID NO: 15056 - DNA, 25 bp, Mus musculus
aaagcttagctctgcgtacaggcaa

SEQ ID NO: 15057 - DNA, 25 bp, Mus musculus
aaagcttagcttcccttaaaactag

SEQ ID NO: 15058 - DNA, 25 bp, Mus musculus
aaagcttagcttgccttaaaactag

SEQ ID NO: 15059 - DNA, 25 bp, Mus musculus
aaagcttagtatagactttatctaa

SEQ ID NO: 15060 - DNA, 25 bp, Mus musculus
aaagcttagtattgactttatctaa

SEQ ID NO: 15061 - DNA, 25 bp, Mus musculus
aaagcttagtgaatgaccggccgcg

SEQ ID NO: 15062 - DNA, 25 bp, Mus musculus
aaagcttagtgaccatctccgtcct

SEQ ID NO: 15063 - DNA, 25 bp, Mus musculus
aaagcttagtgagcatctccgtcct

SEQ ID NO: 15064 - DNA, 25 bp, Mus musculus
aaagcttagtgattgaccggccgcg

SEQ ID NO: 15065 - DNA, 25 bp, Mus musculus
aaagcttatattctgagagcagtgt

SEQ ID NO: 15066 - DNA, 25 bp, Mus musculus
aaagcttatattgtgagagcagtgt

SEQ ID NO: 15067 - DNA, 25 bp, Mus musculus
aaagcttatcagacaaggtgttttg

SEQ ID NO: 15068 - DNA, 25 bp, Mus musculus
aaagcttatcagtcaaggtgttttg

SEQ ID NO: 15069 - DNA, 25 bp, Mus musculus
aaagcttatcttctatctgtggtga

SEQ ID NO: 15070 - DNA, 25 bp, Mus musculus
aaagcttatcttgtatctgtggtga

SEQ ID NO: 15071 - DNA, 25 bp, Mus musculus
aaagcttcaagtattcacagataat

SEQ ID NO: 15072 - DNA, 25 bp, Mus musculus
aaagcttcaagttttcacagataat

SEQ ID NO: 15073 - DNA, 25 bp, Mus musculus
aaagcttcacacactgtatcccagg

SEQ ID NO: 15074 - DNA, 25 bp, Mus musculus
aaagcttcacactctgtatcccagg

SEQ ID NO: 15075 - DNA, 25 bp, Mus musculus
aaagcttcacagctgcctgcgcctt

SEQ ID NO: 15076 - DNA, 25 bp, Mus musculus
aaagcttcacaggtgcctgcgcctt

SEQ ID NO: 15077 - DNA, 25 bp, Mus musculus
aaagcttcagagaaccctctcaaaa

SEQ ID NO: 15078 - DNA, 25 bp, Mus musculus
aaagcttcagagtaccctctcaaaa

SEQ ID NO: 15079 - DNA, 25 bp, Mus musculus
aaagcttcaggtcctcttagatgct

SEQ ID NO: 15080 - DNA, 25 bp, Mus musculus
aaagcttcaggtgctcttagatgct

SEQ ID NO: 15081 - DNA, 25 bp, Mus musculus
aaagcttcatacaccctctactgtg

SEQ ID NO: 15082 - DNA, 25 bp, Mus musculus
aaagcttcatactccctctactgtg

SEQ ID NO: 15083 - DNA, 25 bp, Mus musculus
aaagcttccaatacaaatgcctcag

SEQ ID NO: 15084 - DNA, 25 bp, Mus musculus
aaagcttccaattcaaatgcctcag

SEQ ID NO: 15085 - DNA, 25 bp, Mus musculus
aaagcttccagaacaagcactgtgg

SEQ ID NO: 15086 - DNA, 25 bp, Mus musculus
aaagcttccagaattgcaggcgtaa

SEQ ID NO: 15087 - DNA, 25 bp, Mus musculus
aaagcttccagatcaagcactgtgg

SEQ ID NO: 15088 - DNA, 25 bp, Mus musculus
aaagcttccagatttgcaggcgtaa

SEQ ID NO: 15089 - DNA, 25 bp, Mus musculus
aaagcttcccagcacgagtgatgac

SEQ ID NO: 15090 - DNA, 25 bp, Mus musculus
aaagcttcccagctgtgtggcgaac

SEQ ID NO: 15091 - DNA, 25 bp, Mus musculus
aaagcttcccaggacgagtgatgac

SEQ ID NO: 15092 - DNA, 25 bp, Mus musculus
aaagcttcccaggtgtgtggcgaac

SEQ ID NO: 15093 - DNA, 25 bp, Mus musculus
aaagcttccgggaacagcctgttct

SEQ ID NO: 15094 - DNA, 25 bp, Mus musculus
aaagcttccgggactcctaagacag

SEQ ID NO: 15095 - DNA, 25 bp, Mus musculus
aaagcttccgggtacagcctgttct

SEQ ID NO: 15096 - DNA, 25 bp, Mus musculus
aaagcttccgggtctcctaagacag

SEQ ID NO: 15097 - DNA, 25 bp, Mus musculus
aaagcttcctaacagcggctggaga

SEQ ID NO: 15098 - DNA, 25 bp, Mus musculus
aaagcttcctaagagcggctggaga

SEQ ID NO: 15099 - DNA, 25 bp, Mus musculus
aaagcttcctcgcttatgtggacat

SEQ ID NO: 15100 - DNA, 25 bp, Mus musculus
aaagcttcctcggttatgtggacat

SEQ ID NO: 15101 - DNA, 25 bp, Mus musculus
aaagcttcctggagttcattagcca

SEQ ID NO: 15102 - DNA, 25 bp, Mus musculus
aaagcttcctggtgttcattagcca

SEQ ID NO: 15103 - DNA, 25 bp, Mus musculus
aaagcttcgttgagttagtctgcaa

SEQ ID NO: 15104 - DNA, 25 bp, Mus musculus
aaagcttcgttgtgttagtctgcaa

SEQ ID NO: 15105 - DNA, 25 bp, Mus musculus
aaagcttctaatacgctcaccaatt

SEQ ID NO: 15106 - DNA, 25 bp, Mus musculus
aaagcttctaattcgctcaccaatt

SEQ ID NO: 15107 - DNA, 25 bp, Mus musculus
aaagcttctatacctgcaacatcaa

SEQ ID NO: 15108 - DNA, 25 bp, Mus musculus
aaagcttctatagctgcaacatcaa

SEQ ID NO: 15109 - DNA, 25 bp, Mus musculus
aaagcttctggaagacaaatgacac

SEQ ID NO: 15110 - DNA, 25 bp, Mus musculus
aaagcttctggatgacaaatgacac

SEQ ID NO: 15111 - DNA, 25 bp, Mus musculus
aaagcttgaagcctctattactgaa

SEQ ID NO: 15112 - DNA, 25 bp, Mus musculus
aaagcttgaagcgtctattactgaa

SEQ ID NO: 15113 - DNA, 25 bp, Mus musculus
aaagcttgacaaagggagtgctggt

SEQ ID NO: 15114 - DNA, 25 bp, Mus musculus
aaagcttgacaatgggagtgctggt

SEQ ID NO: 15115 - DNA, 25 bp, Mus musculus
aaagcttgactgctcgtagctatgg

SEQ ID NO: 15116 - DNA, 25 bp, Mus musculus
aaagcttgactggtcgtagctatgg

SEQ ID NO: 15117 - DNA, 25 bp, Mus musculus
aaagcttgagacctagcccctagga

SEQ ID NO: 15118 - DNA, 25 bp, Mus musculus
aaagcttgagacgtagcccctagga

SEQ ID NO: 15119 - DNA, 25 bp, Mus musculus
aaagcttgagggacactggagcact

SEQ ID NO: 15120 - DNA, 25 bp, Mus musculus
aaagcttgagggtcactggagcact

SEQ ID NO: 15121 - DNA, 25 bp, Mus musculus
aaagcttgagtaatttgtgacgttc

SEQ ID NO: 15122 - DNA, 25 bp, Mus musculus
aaagcttgagtattttgtgacgttc

SEQ ID NO: 15123 - DNA, 25 bp, Mus musculus
aaagcttgcagcctgtgacagttca

SEQ ID NO: 15124 - DNA, 25 bp, Mus musculus
aaagcttgcagcgtgtgacagttca

SEQ ID NO: 15125 - DNA, 25 bp, Mus musculus
aaagcttgcagtcgtgtgacccatg

SEQ ID NO: 15126 - DNA, 25 bp, Mus musculus
aaagcttgcagtggtgtgacccatg

SEQ ID NO: 15127 - DNA, 25 bp, Mus musculus
aaagcttgcatacctgttcagtgaa

SEQ ID NO: 15128 - DNA, 25 bp, Mus musculus
aaagcttgcatagctgttcagtgaa

SEQ ID NO: 15129 - DNA, 25 bp, Mus musculus
aaagcttgcattctcatccatgccc

SEQ ID NO: 15130 - DNA, 25 bp, Mus musculus
aaagcttgcattctctccactgctg

SEQ ID NO: 15131 - DNA, 25 bp, Mus musculus
aaagcttgcattgtcatccatgccc

SEQ ID NO: 15132 - DNA, 25 bp, Mus musculus
aaagcttgcattgtctccactgctg

SEQ ID NO: 15133 - DNA, 25 bp, Mus musculus
aaagcttgccaacacattgttgaca

SEQ ID NO: 15134 - DNA, 25 bp, Mus musculus
aaagcttgccaagacattgttgaca

SEQ ID NO: 15135 - DNA, 25 bp, Mus musculus
aaagcttggcctcgagcttctggta

SEQ ID NO: 15136 - DNA, 25 bp, Mus musculus
aaagcttggcctggagcttctggta

SEQ ID NO: 15137 - DNA, 25 bp, Mus musculus
aaagcttggctactcggcacaggtc

SEQ ID NO: 15138 - DNA, 25 bp, Mus musculus
aaagcttggctagtcggcacaggtc

SEQ ID NO: 15139 - DNA, 25 bp, Mus musculus
aaagcttggctcatggatggcgtgt

SEQ ID NO: 15140 - DNA, 25 bp, Mus musculus
aaagcttggctcttggatggcgtgt

SEQ ID NO: 15141 - DNA, 25 bp, Mus musculus
aaagcttgggagaaggcggatatca

SEQ ID NO: 15142 - DNA, 25 bp, Mus musculus
aaagcttgggagtaggcggatatca

SEQ ID NO: 15143 - DNA, 25 bp, Mus musculus
aaagcttgggatatgtgcagatggt

SEQ ID NO: 15144 - DNA, 25 bp, Mus musculus
aaagcttgggatttgtgcagatggt

SEQ ID NO: 15145 - DNA, 25 bp, Mus musculus
aaagcttggtccatgtgccttttcg

SEQ ID NO: 15146 - DNA, 25 bp, Mus musculus
aaagcttggtccttgtgccttttcg

SEQ ID NO: 15147 - DNA, 25 bp, Mus musculus
aaagcttgtgtcatcagatggcaga

SEQ ID NO: 15148 - DNA, 25 bp, Mus musculus
aaagcttgtgtcttcagatggcaga

SEQ ID NO: 15149 - DNA, 25 bp, Mus musculus
aaagcttgttggatttccttcatat

SEQ ID NO: 15150 - DNA, 25 bp, Mus musculus
aaagcttgttggcagaatgtgacct

SEQ ID NO: 15151 - DNA, 25 bp, Mus musculus
aaagcttgttgggagaatgtgacct

SEQ ID NO: 15152 - DNA, 25 bp, Mus musculus
aaagcttgttggttttccttcatat

SEQ ID NO: 15153 - DNA, 25 bp, Mus musculus
aaagctttaacaagaacctgggcat

SEQ ID NO: 15154 - DNA, 25 bp, Mus musculus
aaagctttaacatgaacctgggcat

SEQ ID NO: 15155 - DNA, 25 bp, Mus musculus
aaagctttaattagtagtgctcaag

SEQ ID NO: 15156 - DNA, 25 bp, Mus musculus
aaagctttaatttgtagtgctcaag

SEQ ID NO: 15157 - DNA, 25 bp, Mus musculus
aaagctttatctaccagagttctgg

SEQ ID NO: 15158 - DNA, 25 bp, Mus musculus
aaagctttatcttccagagttctgg

SEQ ID NO: 15159 - DNA, 25 bp, Mus musculus
aaagctttatgaatacaagtgtgca

SEQ ID NO: 15160 - DNA, 25 bp, Mus musculus
aaagctttatgattacaagtgtgca

SEQ ID NO: 15161 - DNA, 25 bp, Mus musculus
aaagctttcaagacaggactaccat

SEQ ID NO: 15162 - DNA, 25 bp, Mus musculus
aaagctttcaagtcaggactaccat

SEQ ID NO: 15163 - DNA, 25 bp, Mus musculus
aaagctttcaggatgcagggtcagg

SEQ ID NO: 15164 - DNA, 25 bp, Mus musculus
aaagctttcaggttgcagggtcagg

SEQ ID NO: 15165 - DNA, 25 bp, Mus musculus
aaagctttcataaatttcattccta

SEQ ID NO: 15166 - DNA, 25 bp, Mus musculus
aaagctttcataagtaactcccaag

SEQ ID NO: 15167 - DNA, 25 bp, Mus musculus
aaagctttcatatatttcattccta

SEQ ID NO: 15168 - DNA, 25 bp, Mus musculus
aaagctttcatatgtaactcccaag

SEQ ID NO: 15169 - DNA, 25 bp, Mus musculus
aaagctttcatcctgcgtgagactc

SEQ ID NO: 15170 - DNA, 25 bp, Mus musculus
aaagctttcatcgtgcgtgagactc

SEQ ID NO: 15171 - DNA, 25 bp, Mus musculus
aaagctttccccatatctgtcattg

SEQ ID NO: 15172 - DNA, 25 bp, Mus musculus
aaagctttccccttatctgtcattg

SEQ ID NO: 15173 - DNA, 25 bp, Mus musculus
aaagctttccttcttgtgtcattct

SEQ ID NO: 15174 - DNA, 25 bp, Mus musculus
aaagctttccttgttgtgtcattct

SEQ ID NO: 15175 - DNA, 25 bp, Mus musculus
aaagctttgagaacaagccctcgaa

SEQ ID NO: 15176 - DNA, 25 bp, Mus musculus
aaagctttgagatcaagccctcgaa

SEQ ID NO: 15177 - DNA, 25 bp, Mus musculus
aaagctttgattatgtccaaacaat

SEQ ID NO: 15178 - DNA, 25 bp, Mus musculus
aaagctttgattttgtccaaacaat

SEQ ID NO: 15179 - DNA, 25 bp, Mus musculus
aaagctttgctcacactgcttttat

SEQ ID NO: 15180 - DNA, 25 bp, Mus musculus
aaagctttgctctcactgcttttat

SEQ ID NO: 15181 - DNA, 25 bp, Mus musculus
aaagctttgcttacagcgtttctta

SEQ ID NO: 15182 - DNA, 25 bp, Mus musculus
aaagctttgctttcagcgtttctta

SEQ ID NO: 15183 - DNA, 25 bp, Mus musculus
aaagctttggaaaggcgaggtagcc

SEQ ID NO: 15184 - DNA, 25 bp, Mus musculus
aaagctttggaatggcgaggtagcc

SEQ ID NO: 15185 - DNA, 25 bp, Mus musculus
aaagctttggcaagtgttcactaaa

SEQ ID NO: 15186 - DNA, 25 bp, Mus musculus
aaagctttggcatgtgttcactaaa

SEQ ID NO: 15187 - DNA, 25 bp, Mus musculus
aaagctttggcgattgttcagagtc

SEQ ID NO: 15188 - DNA, 25 bp, Mus musculus
aaagctttggcgtttgttcagagtc

SEQ ID NO: 15189 - DNA, 25 bp, Mus musculus
aaagctttgggcacttacagaacaa

SEQ ID NO: 15190 - DNA, 25 bp, Mus musculus
aaagctttgggcagatggaagaact

SEQ ID NO: 15191 - DNA, 25 bp, Mus musculus
aaagctttgggctcttacagaacaa

SEQ ID NO: 15192 - DNA, 25 bp, Mus musculus
aaagctttgggctgatggaagaact

SEQ ID NO: 15193 - DNA, 25 bp, Mus musculus
aaagctttgtatattgactgctata

SEQ ID NO: 15194 - DNA, 25 bp, Mus musculus
aaagctttgtattttgactgctata

SEQ ID NO: 15195 - DNA, 25 bp, Mus musculus
aaagctttgtggagctcatccctac

SEQ ID NO: 15196 - DNA, 25 bp, Mus musculus
aaagctttgtggtgctcatccctac

SEQ ID NO: 15197 - DNA, 25 bp, Mus musculus
aaagctttgttaccaaccctcagaa

SEQ ID NO: 15198 - DNA, 25 bp, Mus musculus
aaagctttgttagcaaccctcagaa

SEQ ID NO: 15199 - DNA, 25 bp, Mus musculus
aaagcttttaggcatatcgtagtgt

SEQ ID NO: 15200 - DNA, 25 bp, Mus musculus
aaagcttttagggatatcgtagtgt

SEQ ID NO: 15201 - DNA, 25 bp, Mus musculus
aaagcttttcttcctcaggagtatg

SEQ ID NO: 15202 - DNA, 25 bp, Mus musculus
aaagcttttcttgctcaggagtatg

SEQ ID NO: 15203 - DNA, 25 bp, Mus musculus
aaagcttttggactgctgaaggccc

SEQ ID NO: 15204 - DNA, 25 bp, Mus musculus
aaagcttttggagtgctgaaggccc

SEQ ID NO: 15205 - DNA, 25 bp, Mus musculus
aaagctttttagaaggtgccacctg

SEQ ID NO: 15206 - DNA, 25 bp, Mus musculus
aaagctttttagtaggtgccacctg

SEQ ID NO: 15207 - DNA, 25 bp, Mus musculus
aaagctttttctcacactgatcccc

SEQ ID NO: 15208 - DNA, 25 bp, Mus musculus
aaagctttttctcctgcttggcttt

SEQ ID NO: 15209 - DNA, 25 bp, Mus musculus
aaagctttttctgacactgatcccc

SEQ ID NO: 15210 - DNA, 25 bp, Mus musculus
aaagctttttctgctgcttggcttt

SEQ ID NO: 15211 - DNA, 25 bp, Mus musculus
aaagcttttttcatgcagggtgatt

SEQ ID NO: 15212 - DNA, 25 bp, Mus musculus
aaagcttttttcttgcagggtgatt

SEQ ID NO: 15213 - DNA, 25 bp, Mus musculus
aaaggaaaccaactcactgactctc

SEQ ID NO: 15214 - DNA, 25 bp, Mus musculus
aaaggaaaccaagtcactgactctc

SEQ ID NO: 15215 - DNA, 25 bp, Mus musculus
aaaggaaacccaccaatgccagaga

SEQ ID NO: 15216 - DNA, 25 bp, Mus musculus
aaaggaaacccagcaatgccagaga

SEQ ID NO: 15217 - DNA, 25 bp, Mus musculus
aaaggaaacctcacgacagtcataa

SEQ ID NO: 15218 - DNA, 25 bp, Mus musculus
aaaggaaacctcattcaaggactga

SEQ ID NO: 15219 - DNA, 25 bp, Mus musculus
aaaggaaacctctcgacagtcataa

SEQ ID NO: 15220 - DNA, 25 bp, Mus musculus
aaaggaaacctctttcaaggactga

SEQ ID NO: 15221 - DNA, 25 bp, Mus musculus
aaaggaaagacgcttcacctcgcct

SEQ ID NO: 15222 - DNA, 25 bp, Mus musculus
aaaggaaagacggttcacctcgcct

SEQ ID NO: 15223 - DNA, 25 bp, Mus musculus
aaaggaaatatgcacaggcaatcac

SEQ ID NO: 15224 - DNA, 25 bp, Mus musculus
aaaggaaatatggacaggcaatcac

SEQ ID NO: 15225 - DNA, 25 bp, Mus musculus
aaaggaaatcacagcactggctccc

SEQ ID NO: 15226 - DNA, 25 bp, Mus musculus
aaaggaaatcactgcactggctccc

SEQ ID NO: 15227 - DNA, 25 bp, Mus musculus
aaaggaaatgctcccgttgagccct

SEQ ID NO: 15228 - DNA, 25 bp, Mus musculus
aaaggaaatgctgccgttgagccct

SEQ ID NO: 15229 - DNA, 25 bp, Mus musculus
aaaggaacaagccaagccctgccct

SEQ ID NO: 15230 - DNA, 25 bp, Mus musculus
aaaggaacaagcgaagccctgccct

SEQ ID NO: 15231 - DNA, 25 bp, Mus musculus
aaaggaacccagacagcgcaaagat

SEQ ID NO: 15232 - DNA, 25 bp, Mus musculus
aaaggaacccagtcagcgcaaagat

SEQ ID NO: 15233 - DNA, 25 bp, Mus musculus
aaaggaacccggacgagctggcaga

SEQ ID NO: 15234 - DNA, 25 bp, Mus musculus
aaaggaacccggtcgagctggcaga

SEQ ID NO: 15235 - DNA, 25 bp, Mus musculus
aaaggaaccttgcaagctcgctgga

SEQ ID NO: 15236 - DNA, 25 bp, Mus musculus
aaaggaaccttggaagctcgctgga

SEQ ID NO: 15237 - DNA, 25 bp, Mus musculus
aaaggaacggacctcagttctcact

SEQ ID NO: 15238 - DNA, 25 bp, Mus musculus
aaaggaacggacgtcagttctcact

SEQ ID NO: 15239 - DNA, 25 bp, Mus musculus
aaaggaacgggcacagctacctgca

SEQ ID NO: 15240 - DNA, 25 bp, Mus musculus
aaaggaacgggcagactgtccatcc

SEQ ID NO: 15241 - DNA, 25 bp, Mus musculus
aaaggaacgggctcagctacctgca

SEQ ID NO: 15242 - DNA, 25 bp, Mus musculus
aaaggaacgggctgactgtccatcc

SEQ ID NO: 15243 - DNA, 25 bp, Mus musculus
aaaggaacgtgcagtctccggtcag

SEQ ID NO: 15244 - DNA, 25 bp, Mus musculus
aaaggaacgtgctgtctccggtcag

SEQ ID NO: 15245 - DNA, 25 bp, Mus musculus
aaaggaactgcacggccttcggagt

SEQ ID NO: 15246 - DNA, 25 bp, Mus musculus
aaaggaactgcagggccttcggagt

SEQ ID NO: 15247 - DNA, 25 bp, Mus musculus
aaaggaactttcacatgccctgtgt

SEQ ID NO: 15248 - DNA, 25 bp, Mus musculus
aaaggaactttctcatgccctgtgt

SEQ ID NO: 15249 - DNA, 25 bp, Mus musculus
aaaggaagacaaccaggaggtttag

SEQ ID NO: 15250 - DNA, 25 bp, Mus musculus
aaaggaagacaagcaggaggtttag

SEQ ID NO: 15251 - DNA, 25 bp, Mus musculus
aaaggaagacgaacacggatgccgg

SEQ ID NO: 15252 - DNA, 25 bp, Mus musculus
aaaggaagacgatcacggatgccgg

SEQ ID NO: 15253 - DNA, 25 bp, Mus musculus
aaaggaagactacccacctgacttg

SEQ ID NO: 15254 - DNA, 25 bp, Mus musculus
aaaggaagactagccacctgacttg

SEQ ID NO: 15255 - DNA, 25 bp, Mus musculus
aaaggaagagagacctcctccacct

SEQ ID NO: 15256 - DNA, 25 bp, Mus musculus
aaaggaagagagtcctcctccacct

SEQ ID NO: 15257 - DNA, 25 bp, Mus musculus
aaaggaagagcacacccccacggag

SEQ ID NO: 15258 - DNA, 25 bp, Mus musculus
aaaggaagagcagacccccacggag

SEQ ID NO: 15259 - DNA, 25 bp, Mus musculus
aaaggaagagcgatcctccttcaca

SEQ ID NO: 15260 - DNA, 25 bp, Mus musculus
aaaggaagagcgttcctccttcaca

SEQ ID NO: 15261 - DNA, 25 bp, Mus musculus
aaaggaagatagctgtggctttctc

SEQ ID NO: 15262 - DNA, 25 bp, Mus musculus
aaaggaagataggtgtggctttctc

SEQ ID NO: 15263 - DNA, 25 bp, Mus musculus
aaaggaagcactcccaagtctggcc

SEQ ID NO: 15264 - DNA, 25 bp, Mus musculus
aaaggaagcactgccaagtctggcc

SEQ ID NO: 15265 - DNA, 25 bp, Mus musculus
aaaggaagcatcactgttaatagaa

SEQ ID NO: 15266 - DNA, 25 bp, Mus musculus
aaaggaagcatctctgttaatagaa

SEQ ID NO: 15267 - DNA, 25 bp, Mus musculus
aaaggaagccgactgtctggcccca

SEQ ID NO: 15268 - DNA, 25 bp, Mus musculus
aaaggaagccgagtgtctggcccca

SEQ ID NO: 15269 - DNA, 25 bp, Mus musculus
aaaggaagccggctcctaacactgc

SEQ ID NO: 15270 - DNA, 25 bp, Mus musculus
aaaggaagccgggtcctaacactgc

SEQ ID NO: 15271 - DNA, 25 bp, Mus musculus
aaaggaagcctaccagttagcgcac

SEQ ID NO: 15272 - DNA, 25 bp, Mus musculus
aaaggaagcctagcagttagcgcac

SEQ ID NO: 15273 - DNA, 25 bp, Mus musculus
aaaggaagcctgatctgtctggtcc

SEQ ID NO: 15274 - DNA, 25 bp, Mus musculus
aaaggaagcctgttctgtctggtcc

SEQ ID NO: 15275 - DNA, 25 bp, Mus musculus
aaaggaagctatcccctagatgtag

SEQ ID NO: 15276 - DNA, 25 bp, Mus musculus
aaaggaagctatgccctagatgtag

SEQ ID NO: 15277 - DNA, 25 bp, Mus musculus
aaaggaagcttaacctcagtagaga

SEQ ID NO: 15278 - DNA, 25 bp, Mus musculus
aaaggaagcttatcctcagtagaga

SEQ ID NO: 15279 - DNA, 25 bp, Mus musculus
aaaggaagcttcctgtctagggaca

SEQ ID NO: 15280 - DNA, 25 bp, Mus musculus
aaaggaagcttcgtgtctagggaca

SEQ ID NO: 15281 - DNA, 25 bp, Mus musculus
aaaggaaggcagacagaccctgggc

SEQ ID NO: 15282 - DNA, 25 bp, Mus musculus
aaaggaaggcagtcagaccctgggc

SEQ ID NO: 15283 - DNA, 25 bp, Mus musculus
aaaggaaggcccctgaacctgtgag

SEQ ID NO: 15284 - DNA, 25 bp, Mus musculus
aaaggaaggcccgtgaacctgtgag

SEQ ID NO: 15285 - DNA, 25 bp, Mus musculus
aaaggaaggcctccacgtgacttgc

SEQ ID NO: 15286 - DNA, 25 bp, Mus musculus
aaaggaaggcctgcacgtgacttgc

SEQ ID NO: 15287 - DNA, 25 bp, Mus musculus
aaaggaaggcttctctgtctgaaag

SEQ ID NO: 15288 - DNA, 25 bp, Mus musculus
aaaggaaggcttgtctgtctgaaag

SEQ ID NO: 15289 - DNA, 25 bp, Mus musculus
aaaggaagtattagctgcagttttt

SEQ ID NO: 15290 - DNA, 25 bp, Mus musculus
aaaggaagtatttgctgcagttttt

SEQ ID NO: 15291 - DNA, 25 bp, Mus musculus
aaaggaagtgcccaacaagcccttg

SEQ ID NO: 15292 - DNA, 25 bp, Mus musculus
aaaggaagtgccgaacaagcccttg

SEQ ID NO: 15293 - DNA, 25 bp, Mus musculus
aaaggaagtggcagattaagggcat

SEQ ID NO: 15294 - DNA, 25 bp, Mus musculus
aaaggaagtggctgattaagggcat

SEQ ID NO: 15295 - DNA, 25 bp, Mus musculus
aaaggaagtgtgctgtcttctctct

SEQ ID NO: 15296 - DNA, 25 bp, Mus musculus
aaaggaagtgtggtgtcttctctct

SEQ ID NO: 15297 - DNA, 25 bp, Mus musculus
aaaggaatactcatgctctgaggcc

SEQ ID NO: 15298 - DNA, 25 bp, Mus musculus
aaaggaatactcttgctctgaggcc

SEQ ID NO: 15299 - DNA, 25 bp, Mus musculus
aaaggaatattacacgaggctcgga

SEQ ID NO: 15300 - DNA, 25 bp, Mus musculus
aaaggaatattagacgaggctcgga

SEQ ID NO: 15301 - DNA, 25 bp, Mus musculus
aaaggaatccatcaggacccgcagc

SEQ ID NO: 15302 - DNA, 25 bp, Mus musculus
aaaggaatccatgaggacccgcagc

SEQ ID NO: 15303 - DNA, 25 bp, Mus musculus
aaaggaatcctgactgcctggagca

SEQ ID NO: 15304 - DNA, 25 bp, Mus musculus
aaaggaatcctgtctgcctggagca

SEQ ID NO: 15305 - DNA, 25 bp, Mus musculus
aaaggaatcgttccaagagttaaag

SEQ ID NO: 15306 - DNA, 25 bp, Mus musculus
aaaggaatcgttgcaagagttaaag

SEQ ID NO: 15307 - DNA, 25 bp, Mus musculus
aaaggaatctggctctgtcccacga

SEQ ID NO: 15308 - DNA, 25 bp, Mus musculus
aaaggaatctgggtctgtcccacga

SEQ ID NO: 15309 - DNA, 25 bp, Mus musculus
aaaggaatgaatccgtgccccatgg

SEQ ID NO: 15310 - DNA, 25 bp, Mus musculus
aaaggaatgaatgcgtgccccatgg

SEQ ID NO: 15311 - DNA, 25 bp, Mus musculus
aaaggaatgcttacaaggtgcgagg

SEQ ID NO: 15312 - DNA, 25 bp, Mus musculus
aaaggaatgctttcaaggtgcgagg

SEQ ID NO: 15313 - DNA, 25 bp, Mus musculus
aaaggaatttcactagctactacta

SEQ ID NO: 15314 - DNA, 25 bp, Mus musculus
aaaggaatttcagtagctactacta

SEQ ID NO: 15315 - DNA, 25 bp, Mus musculus
aaaggaatttgtatcaagctgtctc

SEQ ID NO: 15316 - DNA, 25 bp, Mus musculus
aaaggaatttgtttcaagctgtctc

SEQ ID NO: 15317 - DNA, 25 bp, Mus musculus
aaaggacaatccatcgactccgcgc

SEQ ID NO: 15318 - DNA, 25 bp, Mus musculus
aaaggacaatccttcgactccgcgc

SEQ ID NO: 15319 - DNA, 25 bp, Mus musculus
aaaggacaccttccagtctggagcc

SEQ ID NO: 15320 - DNA, 25 bp, Mus musculus
aaaggacaccttgcagtctggagcc

SEQ ID NO: 15321 - DNA, 25 bp, Mus musculus
aaaggacactgacctacaacctcag

SEQ ID NO: 15322 - DNA, 25 bp, Mus musculus
aaaggacactgagctacaacctcag

SEQ ID NO: 15323 - DNA, 25 bp, Mus musculus
aaaggacactggaaatactgcctgt

SEQ ID NO: 15324 - DNA, 25 bp, Mus musculus
aaaggacactggtaatactgcctgt

SEQ ID NO: 15325 - DNA, 25 bp, Mus musculus
aaaggacacttcacattatactgga

SEQ ID NO: 15326 - DNA, 25 bp, Mus musculus
aaaggacacttctcattatactgga

SEQ ID NO: 15327 - DNA, 25 bp, Mus musculus
aaaggacacttgcagaggccaggca

SEQ ID NO: 15328 - DNA, 25 bp, Mus musculus
aaaggacacttggagaggccaggca

SEQ ID NO: 15329 - DNA, 25 bp, Mus musculus
aaaggacactttcagcgacagctat

SEQ ID NO: 15330 - DNA, 25 bp, Mus musculus
aaaggacactttgagcgacagctat

SEQ ID NO: 15331 - DNA, 25 bp, Mus musculus
aaaggacagcaaacccagttcctgc

SEQ ID NO: 15332 - DNA, 25 bp, Mus musculus
aaaggacagcaatcccagttcctgc

SEQ ID NO: 15333 - DNA, 25 bp, Mus musculus
aaaggacagcgtcgtgcacaccttc

SEQ ID NO: 15334 - DNA, 25 bp, Mus musculus
aaaggacagcgtggtgcacaccttc

SEQ ID NO: 15335 - DNA, 25 bp, Mus musculus
aaaggacagctccagtctcaccagc

SEQ ID NO: 15336 - DNA, 25 bp, Mus musculus
aaaggacagctcgagtctcaccagc

SEQ ID NO: 15337 - DNA, 25 bp, Mus musculus
aaaggacagggtcctaggctccgtt

SEQ ID NO: 15338 - DNA, 25 bp, Mus musculus
aaaggacagggtgctaggctccgtt

SEQ ID NO: 15339 - DNA, 25 bp, Mus musculus
aaaggacagtgactgcagctgtgct

SEQ ID NO: 15340 - DNA, 25 bp, Mus musculus
aaaggacagtgagtgcagctgtgct

SEQ ID NO: 15341 - DNA, 25 bp, Mus musculus
aaaggacagttacggcttcaagaat

SEQ ID NO: 15342 - DNA, 25 bp, Mus musculus
aaaggacagttagggcttcaagaat

SEQ ID NO: 15343 - DNA, 25 bp, Mus musculus
aaaggacatactcgctctgcttgca

SEQ ID NO: 15344 - DNA, 25 bp, Mus musculus
aaaggacatactggctctgcttgca

SEQ ID NO: 15345 - DNA, 25 bp, Mus musculus
aaaggacatcgaagagcagacccag

SEQ ID NO: 15346 - DNA, 25 bp, Mus musculus
aaaggacatcgatgagcagacccag

SEQ ID NO: 15347 - DNA, 25 bp, Mus musculus
aaaggacatgcaattgcccgtccca

SEQ ID NO: 15348 - DNA, 25 bp, Mus musculus
aaaggacatgcatttgcccgtccca

SEQ ID NO: 15349 - DNA, 25 bp, Mus musculus
aaaggacatgttatcacctgcatcc

SEQ ID NO: 15350 - DNA, 25 bp, Mus musculus
aaaggacatgttttcacctgcatcc

SEQ ID NO: 15351 - DNA, 25 bp, Mus musculus
aaaggacattgtcatctgtgatatg

SEQ ID NO: 15352 - DNA, 25 bp, Mus musculus
aaaggacattgtgatctgtgatatg

SEQ ID NO: 15353 - DNA, 25 bp, Mus musculus
aaaggacattttatgccgcccgagt

SEQ ID NO: 15354 - DNA, 25 bp, Mus musculus
aaaggacattttttgccgcccgagt

SEQ ID NO: 15355 - DNA, 25 bp, Mus musculus
aaaggaccaaagcatctcaccaatg

SEQ ID NO: 15356 - DNA, 25 bp, Mus musculus
aaaggaccaaaggatctcaccaatg

SEQ ID NO: 15357 - DNA, 25 bp, Mus musculus
aaaggaccaattacctgggcatggc

SEQ ID NO: 15358 - DNA, 25 bp, Mus musculus
aaaggaccaatttcctgggcatggc

SEQ ID NO: 15359 - DNA, 25 bp, Mus musculus
aaaggaccagatactgccgtggaga

SEQ ID NO: 15360 - DNA, 25 bp, Mus musculus
aaaggaccagattctgccgtggaga

SEQ ID NO: 15361 - DNA, 25 bp, Mus musculus
aaaggaccattcctctggctaccta

SEQ ID NO: 15362 - DNA, 25 bp, Mus musculus
aaaggaccattcgtctggctaccta

SEQ ID NO: 15363 - DNA, 25 bp, Mus musculus
aaaggacccaccaagagctctagag

SEQ ID NO: 15364 - DNA, 25 bp, Mus musculus
aaaggacccacctagagctctagag

SEQ ID NO: 15365 - DNA, 25 bp, Mus musculus
aaaggacccatgcatctgttgccat

SEQ ID NO: 15366 - DNA, 25 bp, Mus musculus
aaaggacccatgcattttgtgtatc

SEQ ID NO: 15367 - DNA, 25 bp, Mus musculus
aaaggacccatggatctgttgccat

SEQ ID NO: 15368 - DNA, 25 bp, Mus musculus
aaaggacccatggattttgtgtatc

SEQ ID NO: 15369 - DNA, 25 bp, Mus musculus
aaaggaccctctattctgatgtgat

SEQ ID NO: 15370 - DNA, 25 bp, Mus musculus
aaaggaccctcttttctgatgtgat

SEQ ID NO: 15371 - DNA, 25 bp, Mus musculus
aaaggaccctggagcatcaattccc

SEQ ID NO: 15372 - DNA, 25 bp, Mus musculus
aaaggaccctggtgcatcaattccc

SEQ ID NO: 15373 - DNA, 25 bp, Mus musculus
aaaggaccctttactgatgacagcc

SEQ ID NO: 15374 - DNA, 25 bp, Mus musculus
aaaggacccttttctgatgacagcc

SEQ ID NO: 15375 - DNA, 25 bp, Mus musculus
aaaggaccgcgacgccaacagacag

SEQ ID NO: 15376 - DNA, 25 bp, Mus musculus
aaaggaccgcgaggccaacagacag

SEQ ID NO: 15377 - DNA, 25 bp, Mus musculus
aaaggacctactcataacaccactc

SEQ ID NO: 15378 - DNA, 25 bp, Mus musculus
aaaggacctactgataacaccactc

SEQ ID NO: 15379 - DNA, 25 bp, Mus musculus
aaaggacctcgtctctggtgagaaa

SEQ ID NO: 15380 - DNA, 25 bp, Mus musculus
aaaggacctcgtgtctggtgagaaa

SEQ ID NO: 15381 - DNA, 25 bp, Mus musculus
aaaggacctctccaaagcatggaat

SEQ ID NO: 15382 - DNA, 25 bp, Mus musculus
aaaggacctctcgaaagcatggaat

SEQ ID NO: 15383 - DNA, 25 bp, Mus musculus
aaaggacctcttcaatggcagaaat

SEQ ID NO: 15384 - DNA, 25 bp, Mus musculus
aaaggacctcttcactcataagttt

SEQ ID NO: 15385 - DNA, 25 bp, Mus musculus
aaaggacctcttgaatggcagaaat

SEQ ID NO: 15386 - DNA, 25 bp, Mus musculus
aaaggacctcttgactcataagttt

SEQ ID NO: 15387 - DNA, 25 bp, Mus musculus
aaaggacctgcaaattaaagattaa

SEQ ID NO: 15388 - DNA, 25 bp, Mus musculus
aaaggacctgcatattaaagattaa

SEQ ID NO: 15389 - DNA, 25 bp, Mus musculus
aaaggacctggcacgataagcaaat

SEQ ID NO: 15390 - DNA, 25 bp, Mus musculus
aaaggacctggctcgataagcaaat

SEQ ID NO: 15391 - DNA, 25 bp, Mus musculus
aaaggacctgggattgagtttggat

SEQ ID NO: 15392 - DNA, 25 bp, Mus musculus
aaaggacctgggtttgagtttggat

SEQ ID NO: 15393 - DNA, 25 bp, Mus musculus
aaaggaccttctctcaccatgggta

SEQ ID NO: 15394 - DNA, 25 bp, Mus musculus
aaaggaccttctgtcaccatgggta

SEQ ID NO: 15395 - DNA, 25 bp, Mus musculus
aaaggacgaactacccaggcatcag

SEQ ID NO: 15396 - DNA, 25 bp, Mus musculus
aaaggacgaacttcccaggcatcag

SEQ ID NO: 15397 - DNA, 25 bp, Mus musculus
aaaggacgacgtatagatgacagaa

SEQ ID NO: 15398 - DNA, 25 bp, Mus musculus
aaaggacgacgtttagatgacagaa

SEQ ID NO: 15399 - DNA, 25 bp, Mus musculus
aaaggacgatttcctgggctagaaa

SEQ ID NO: 15400 - DNA, 25 bp, Mus musculus
aaaggacgatttgctgggctagaaa

SEQ ID NO: 15401 - DNA, 25 bp, Mus musculus
aaaggacgcatcaaaaccagcaggg

SEQ ID NO: 15402 - DNA, 25 bp, Mus musculus
aaaggacgcatctaaaccagcaggg

SEQ ID NO: 15403 - DNA, 25 bp, Mus musculus
aaaggacgggtcctggttcatccag

SEQ ID NO: 15404 - DNA, 25 bp, Mus musculus
aaaggacgggtcgtggttcatccag

SEQ ID NO: 15405 - DNA, 25 bp, Mus musculus
aaaggacgtgcccatctctggactc

SEQ ID NO: 15406 - DNA, 25 bp, Mus musculus
aaaggacgtgccgatctctggactc

SEQ ID NO: 15407 - DNA, 25 bp, Mus musculus
aaaggactatcccaggcagtgccct

SEQ ID NO: 15408 - DNA, 25 bp, Mus musculus
aaaggactatccgaggcagtgccct

SEQ ID NO: 15409 - DNA, 25 bp, Mus musculus
aaaggactcaatctctgtgctactg

SEQ ID NO: 15410 - DNA, 25 bp, Mus musculus
aaaggactcaatgtctgtgctactg

SEQ ID NO: 15411 - DNA, 25 bp, Mus musculus
aaaggactcataatgctattggatg

SEQ ID NO: 15412 - DNA, 25 bp, Mus musculus
aaaggactcatattgctattggatg

SEQ ID NO: 15413 - DNA, 25 bp, Mus musculus
aaaggactcccacgctagcatccag

SEQ ID NO: 15414 - DNA, 25 bp, Mus musculus
aaaggactcccaggctagcatccag

SEQ ID NO: 15415 - DNA, 25 bp, Mus musculus
aaaggactcctgagatggtgattct

SEQ ID NO: 15416 - DNA, 25 bp, Mus musculus
aaaggactcctgtgatggtgattct

SEQ ID NO: 15417 - DNA, 25 bp, Mus musculus
aaaggactcgatatgctctcagtag

SEQ ID NO: 15418 - DNA, 25 bp, Mus musculus
aaaggactcgatttgctctcagtag

SEQ ID NO: 15419 - DNA, 25 bp, Mus musculus
aaaggactcgggatgtctgacatcg

SEQ ID NO: 15420 - DNA, 25 bp, Mus musculus
aaaggactcgggttgtctgacatcg

SEQ ID NO: 15421 - DNA, 25 bp, Mus musculus
aaaggactcgtcagaatctgccact

SEQ ID NO: 15422 - DNA, 25 bp, Mus musculus
aaaggactcgtctgaatctgccact

SEQ ID NO: 15423 - DNA, 25 bp, Mus musculus
aaaggactctggactaagttagcta

SEQ ID NO: 15424 - DNA, 25 bp, Mus musculus
aaaggactctggtctaagttagcta

SEQ ID NO: 15425 - DNA, 25 bp, Mus musculus
aaaggactctgtagaagttgttcac

SEQ ID NO: 15426 - DNA, 25 bp, Mus musculus
aaaggactctgtagcatacctccat

SEQ ID NO: 15427 - DNA, 25 bp, Mus musculus
aaaggactctgttgaagttgttcac

SEQ ID NO: 15428 - DNA, 25 bp, Mus musculus
aaaggactctgttgcatacctccat

SEQ ID NO: 15429 - DNA, 25 bp, Mus musculus
aaaggactcttactaggcctggaag

SEQ ID NO: 15430 - DNA, 25 bp, Mus musculus
aaaggactcttagtaggcctggaag

SEQ ID NO: 15431 - DNA, 25 bp, Mus musculus
aaaggactcttgatcaggcactggt

SEQ ID NO: 15432 - DNA, 25 bp, Mus musculus
aaaggactcttgttcaggcactggt

SEQ ID NO: 15433 - DNA, 25 bp, Mus musculus
aaaggactctttatagctgcttcct

SEQ ID NO: 15434 - DNA, 25 bp, Mus musculus
aaaggactctttttagctgcttcct

SEQ ID NO: 15435 - DNA, 25 bp, Mus musculus
aaaggactgactaggaagccctctt

SEQ ID NO: 15436 - DNA, 25 bp, Mus musculus
aaaggactgacttggaagccctctt

SEQ ID NO: 15437 - DNA, 25 bp, Mus musculus
aaaggactgagccatcatgtgagaa

SEQ ID NO: 15438 - DNA, 25 bp, Mus musculus
aaaggactgagcgatcatgtgagaa

SEQ ID NO: 15439 - DNA, 25 bp, Mus musculus
aaaggactgaggagaggccccacgc

SEQ ID NO: 15440 - DNA, 25 bp, Mus musculus
aaaggactgaggtgaggccccacgc

SEQ ID NO: 15441 - DNA, 25 bp, Mus musculus
aaaggactgatactcgacacagtgt

SEQ ID NO: 15442 - DNA, 25 bp, Mus musculus
aaaggactgatagtcgacacagtgt

SEQ ID NO: 15443 - DNA, 25 bp, Mus musculus
aaaggactgattcacttgctggccc

SEQ ID NO: 15444 - DNA, 25 bp, Mus musculus
aaaggactgattgacttgctggccc

SEQ ID NO: 15445 - DNA, 25 bp, Mus musculus
aaaggactgcatagggtgaggacct

SEQ ID NO: 15446 - DNA, 25 bp, Mus musculus
aaaggactgcatccaccactaatct

SEQ ID NO: 15447 - DNA, 25 bp, Mus musculus
aaaggactgcatgcaccactaatct

SEQ ID NO: 15448 - DNA, 25 bp, Mus musculus
aaaggactgcattgggtgaggacct

SEQ ID NO: 15449 - DNA, 25 bp, Mus musculus
aaaggactgcccagccacatgaagc

SEQ ID NO: 15450 - DNA, 25 bp, Mus musculus
aaaggactgccctgccacatgaagc

SEQ ID NO: 15451 - DNA, 25 bp, Mus musculus
aaaggactgcttcattcctcttggg

SEQ ID NO: 15452 - DNA, 25 bp, Mus musculus
aaaggactgcttgattcctcttggg

SEQ ID NO: 15453 - DNA, 25 bp, Mus musculus
aaaggactggagacgtgcctgagaa

SEQ ID NO: 15454 - DNA, 25 bp, Mus musculus
aaaggactggagtcgtgcctgagaa

SEQ ID NO: 15455 - DNA, 25 bp, Mus musculus
aaaggactgtacatagggtagcctg

SEQ ID NO: 15456 - DNA, 25 bp, Mus musculus
aaaggactgtacttagggtagcctg

SEQ ID NO: 15457 - DNA, 25 bp, Mus musculus
aaaggactgtatcgaggactcccag

SEQ ID NO: 15458 - DNA, 25 bp, Mus musculus
aaaggactgtatggaggactcccag

SEQ ID NO: 15459 - DNA, 25 bp, Mus musculus
aaaggactgtggcttagttcccgct

SEQ ID NO: 15460 - DNA, 25 bp, Mus musculus
aaaggactgtgggttagttcccgct

SEQ ID NO: 15461 - DNA, 25 bp, Mus musculus
aaaggactgttcagtgtcatcatga

SEQ ID NO: 15462 - DNA, 25 bp, Mus musculus
aaaggactgttctgtgtcatcatga

SEQ ID NO: 15463 - DNA, 25 bp, Mus musculus
aaaggactgttgctgctgaatatgt

SEQ ID NO: 15464 - DNA, 25 bp, Mus musculus
aaaggactgttggtgctgaatatgt

SEQ ID NO: 15465 - DNA, 25 bp, Mus musculus
aaaggacttaaaccctcgctgtcgc

SEQ ID NO: 15466 - DNA, 25 bp, Mus musculus
aaaggacttaaagcctcgctgtcgc

SEQ ID NO: 15467 - DNA, 25 bp, Mus musculus
aaaggacttatcctcgtcctggaag

SEQ ID NO: 15468 - DNA, 25 bp, Mus musculus
aaaggacttatcgtcgtcctggaag

SEQ ID NO: 15469 - DNA, 25 bp, Mus musculus
aaaggacttcacagctcctgggcca

SEQ ID NO: 15470 - DNA, 25 bp, Mus musculus
aaaggacttcactgctcctgggcca

SEQ ID NO: 15471 - DNA, 25 bp, Mus musculus
aaaggacttcatcgcaacccgattt

SEQ ID NO: 15472 - DNA, 25 bp, Mus musculus
aaaggacttcatggcaacccgattt

SEQ ID NO: 15473 - DNA, 25 bp, Mus musculus
aaaggacttccactctcaggcaata

SEQ ID NO: 15474 - DNA, 25 bp, Mus musculus
aaaggacttccagtctcaggcaata

SEQ ID NO: 15475 - DNA, 25 bp, Mus musculus
aaaggacttgctatggacacatggc

SEQ ID NO: 15476 - DNA, 25 bp, Mus musculus
aaaggacttgctttggacacatggc

SEQ ID NO: 15477 - DNA, 25 bp, Mus musculus
aaaggacttggaaggcgctcttggc

SEQ ID NO: 15478 - DNA, 25 bp, Mus musculus
aaaggacttggatggcgctcttggc

SEQ ID NO: 15479 - DNA, 25 bp, Mus musculus
aaaggacttggcagattgtgtcatt

SEQ ID NO: 15480 - DNA, 25 bp, Mus musculus
aaaggacttggctgattgtgtcatt

SEQ ID NO: 15481 - DNA, 25 bp, Mus musculus
aaaggactttacagtctgtcttctc

SEQ ID NO: 15482 - DNA, 25 bp, Mus musculus
aaaggactttactgtctgtcttctc

SEQ ID NO: 15483 - DNA, 25 bp, Mus musculus
aaaggagaaataccacttgcagcaa

SEQ ID NO: 15484 - DNA, 25 bp, Mus musculus
aaaggagaaatagcacttgcagcaa

SEQ ID NO: 15485 - DNA, 25 bp, Mus musculus
aaaggagaacctcacagactctgca

SEQ ID NO: 15486 - DNA, 25 bp, Mus musculus
aaaggagaacctgacagactctgca

SEQ ID NO: 15487 - DNA, 25 bp, Mus musculus
aaaggagaaggtcctcctgcaccat

SEQ ID NO: 15488 - DNA, 25 bp, Mus musculus
aaaggagaaggtgctcctgcaccat

SEQ ID NO: 15489 - DNA, 25 bp, Mus musculus
aaaggagaagttagcccctgcaagc

SEQ ID NO: 15490 - DNA, 25 bp, Mus musculus
aaaggagaagtttgcccctgcaagc

SEQ ID NO: 15491 - DNA, 25 bp, Mus musculus
aaaggagacacacctgtcctgcgca

SEQ ID NO: 15492 - DNA, 25 bp, Mus musculus
aaaggagacacagctgtcctgcgca

SEQ ID NO: 15493 - DNA, 25 bp, Mus musculus
aaaggagaccagatcagcagccatc

SEQ ID NO: 15494 - DNA, 25 bp, Mus musculus
aaaggagaccagttcagcagccatc

SEQ ID NO: 15495 - DNA, 25 bp, Mus musculus
aaaggagacctacgcccagcagagc

SEQ ID NO: 15496 - DNA, 25 bp, Mus musculus
aaaggagacctaggcccagcagagc

SEQ ID NO: 15497 - DNA, 25 bp, Mus musculus
aaaggagacctgaagcagtcagaga

SEQ ID NO: 15498 - DNA, 25 bp, Mus musculus
aaaggagacctgtagcagtcagaga

SEQ ID NO: 15499 - DNA, 25 bp, Mus musculus
aaaggagaccttatgcatgcccggc

SEQ ID NO: 15500 - DNA, 25 bp, Mus musculus
aaaggagaccttttgcatgcccggc

SEQ ID NO: 15501 - DNA, 25 bp, Mus musculus
aaaggagacgctaccagctagtggc

SEQ ID NO: 15502 - DNA, 25 bp, Mus musculus
aaaggagacgcttccagctagtggc

SEQ ID NO: 15503 - DNA, 25 bp, Mus musculus
aaaggagactccaggctggatctat

SEQ ID NO: 15504 - DNA, 25 bp, Mus musculus
aaaggagactcctggctggatctat

SEQ ID NO: 15505 - DNA, 25 bp, Mus musculus
aaaggagacttcagtccacagtcct

SEQ ID NO: 15506 - DNA, 25 bp, Mus musculus
aaaggagacttctgtccacagtcct

SEQ ID NO: 15507 - DNA, 25 bp, Mus musculus
aaaggagactttcaggccattctaa

SEQ ID NO: 15508 - DNA, 25 bp, Mus musculus
aaaggagactttgaggccattctaa

SEQ ID NO: 15509 - DNA, 25 bp, Mus musculus
aaaggagaggtcactaaaggcacat

SEQ ID NO: 15510 - DNA, 25 bp, Mus musculus
aaaggagaggtctctaaaggcacat

SEQ ID NO: 15511 - DNA, 25 bp, Mus musculus
aaaggagatctgagtgcataaggtt

SEQ ID NO: 15512 - DNA, 25 bp, Mus musculus
aaaggagatctgtgtgcataaggtt

SEQ ID NO: 15513 - DNA, 25 bp, Mus musculus
aaaggagattgcagccccagaactg

SEQ ID NO: 15514 - DNA, 25 bp, Mus musculus
aaaggagattgctgccccagaactg

SEQ ID NO: 15515 - DNA, 25 bp, Mus musculus
aaaggagcaccaacacaacagccac

SEQ ID NO: 15516 - DNA, 25 bp, Mus musculus
aaaggagcaccatcacaacagccac

SEQ ID NO: 15517 - DNA, 25 bp, Mus musculus
aaaggagcacttcgctctgggaaaa

SEQ ID NO: 15518 - DNA, 25 bp, Mus musculus
aaaggagcacttggctctgggaaaa

SEQ ID NO: 15519 - DNA, 25 bp, Mus musculus
aaaggagcagagctgtccagttcag

SEQ ID NO: 15520 - DNA, 25 bp, Mus musculus
aaaggagcagaggtgtccagttcag

SEQ ID NO: 15521 - DNA, 25 bp, Mus musculus
aaaggagcagatacaggcctggatg

SEQ ID NO: 15522 - DNA, 25 bp, Mus musculus
aaaggagcagattcaggcctggatg

SEQ ID NO: 15523 - DNA, 25 bp, Mus musculus
aaaggagcagcacccctagaagcgc

SEQ ID NO: 15524 - DNA, 25 bp, Mus musculus
aaaggagcagcacgtcttgggatct

SEQ ID NO: 15525 - DNA, 25 bp, Mus musculus
aaaggagcagcagccctagaagcgc

SEQ ID NO: 15526 - DNA, 25 bp, Mus musculus
aaaggagcagcaggtcttgggatct

SEQ ID NO: 15527 - DNA, 25 bp, Mus musculus
aaaggagcatcccacgcaacagtaa

SEQ ID NO: 15528 - DNA, 25 bp, Mus musculus
aaaggagcatccgacgcaacagtaa

SEQ ID NO: 15529 - DNA, 25 bp, Mus musculus
aaaggagcatctccctgggagtccg

SEQ ID NO: 15530 - DNA, 25 bp, Mus musculus
aaaggagcatctgcctgggagtccg

SEQ ID NO: 15531 - DNA, 25 bp, Mus musculus
aaaggagccagacctgtgctcttgg

SEQ ID NO: 15532 - DNA, 25 bp, Mus musculus
aaaggagccagagctgtgctcttgg

SEQ ID NO: 15533 - DNA, 25 bp, Mus musculus
aaaggagccagccatgcttggaaag

SEQ ID NO: 15534 - DNA, 25 bp, Mus musculus
aaaggagccagcgatgcttggaaag

SEQ ID NO: 15535 - DNA, 25 bp, Mus musculus
aaaggagcccacctagttgcctgga

SEQ ID NO: 15536 - DNA, 25 bp, Mus musculus
aaaggagcccacgtagttgcctgga

SEQ ID NO: 15537 - DNA, 25 bp, Mus musculus
aaaggagcccatcccagagtcagca

SEQ ID NO: 15538 - DNA, 25 bp, Mus musculus
aaaggagcccatgccagagtcagca

SEQ ID NO: 15539 - DNA, 25 bp, Mus musculus
aaaggagccccaatatataggccct

SEQ ID NO: 15540 - DNA, 25 bp, Mus musculus
aaaggagccccactcatgaagaggt

SEQ ID NO: 15541 - DNA, 25 bp, Mus musculus
aaaggagccccagtcatgaagaggt

SEQ ID NO: 15542 - DNA, 25 bp, Mus musculus
aaaggagccccattatataggccct

SEQ ID NO: 15543 - DNA, 25 bp, Mus musculus
aaaggagccctaattgcatctagta

SEQ ID NO: 15544 - DNA, 25 bp, Mus musculus
aaaggagccctatttgcatctagta

SEQ ID NO: 15545 - DNA, 25 bp, Mus musculus
aaaggagccgggactccagtacgca

SEQ ID NO: 15546 - DNA, 25 bp, Mus musculus
aaaggagccgggtctccagtacgca

SEQ ID NO: 15547 - DNA, 25 bp, Mus musculus
aaaggagcctcactttttgacttga

SEQ ID NO: 15548 - DNA, 25 bp, Mus musculus
aaaggagcctcagtttttgacttga

SEQ ID NO: 15549 - DNA, 25 bp, Mus musculus
aaaggagcctccagtggacatctgt

SEQ ID NO: 15550 - DNA, 25 bp, Mus musculus
aaaggagcctccagtttctggcttc

SEQ ID NO: 15551 - DNA, 25 bp, Mus musculus
aaaggagcctcctgtggacatctgt

SEQ ID NO: 15552 - DNA, 25 bp, Mus musculus
aaaggagcctcctgtttctggcttc

SEQ ID NO: 15553 - DNA, 25 bp, Mus musculus
aaaggagcctgtagcggtactgtaa

SEQ ID NO: 15554 - DNA, 25 bp, Mus musculus
aaaggagcctgttgcggtactgtaa

SEQ ID NO: 15555 - DNA, 25 bp, Mus musculus
aaaggagcgctcatgttcagttgtt

SEQ ID NO: 15556 - DNA, 25 bp, Mus musculus
aaaggagcgctccattatccctgga

SEQ ID NO: 15557 - DNA, 25 bp, Mus musculus
aaaggagcgctcgattatccctgga

SEQ ID NO: 15558 - DNA, 25 bp, Mus musculus
aaaggagcgctcttgttcagttgtt

SEQ ID NO: 15559 - DNA, 25 bp, Mus musculus
aaaggagcggcactcatacatgaac

SEQ ID NO: 15560 - DNA, 25 bp, Mus musculus
aaaggagcggcagtcatacatgaac

SEQ ID NO: 15561 - DNA, 25 bp, Mus musculus
aaaggagctcacagtgtccagcaat

SEQ ID NO: 15562 - DNA, 25 bp, Mus musculus
aaaggagctcactgtgtccagcaat

SEQ ID NO: 15563 - DNA, 25 bp, Mus musculus
aaaggagctccgcaaggccattgaa

SEQ ID NO: 15564 - DNA, 25 bp, Mus musculus
aaaggagctccggaaggccattgaa

SEQ ID NO: 15565 - DNA, 25 bp, Mus musculus
aaaggagctcctaccaagaaaagca

SEQ ID NO: 15566 - DNA, 25 bp, Mus musculus
aaaggagctcctataacatcactca

SEQ ID NO: 15567 - DNA, 25 bp, Mus musculus
aaaggagctccttccaagaaaagca

SEQ ID NO: 15568 - DNA, 25 bp, Mus musculus
aaaggagctcctttaacatcactca

SEQ ID NO: 15569 - DNA, 25 bp, Mus musculus
aaaggagctcgcaattggtgtccct

SEQ ID NO: 15570 - DNA, 25 bp, Mus musculus
aaaggagctcgctattggtgtccct

SEQ ID NO: 15571 - DNA, 25 bp, Mus musculus
aaaggagctgacagacttcctgcag

SEQ ID NO: 15572 - DNA, 25 bp, Mus musculus
aaaggagctgacctatttccagagc

SEQ ID NO: 15573 - DNA, 25 bp, Mus musculus
aaaggagctgacgtatttccagagc

SEQ ID NO: 15574 - DNA, 25 bp, Mus musculus
aaaggagctgactgacttcctgcag

SEQ ID NO: 15575 - DNA, 25 bp, Mus musculus
aaaggagctgagcttttctgtggcc

SEQ ID NO: 15576 - DNA, 25 bp, Mus musculus
aaaggagctgaggttttctgtggcc

SEQ ID NO: 15577 - DNA, 25 bp, Mus musculus
aaaggagctgcgagatgcctaccgc

SEQ ID NO: 15578 - DNA, 25 bp, Mus musculus
aaaggagctgcgattcttgccatca

SEQ ID NO: 15579 - DNA, 25 bp, Mus musculus
aaaggagctgcgtgatgcctaccgc

SEQ ID NO: 15580 - DNA, 25 bp, Mus musculus
aaaggagctgcgtttcttgccatca

SEQ ID NO: 15581 - DNA, 25 bp, Mus musculus
aaaggagctgctattcgtggtggta

SEQ ID NO: 15582 - DNA, 25 bp, Mus musculus
aaaggagctgcttttcgtggtggta

SEQ ID NO: 15583 - DNA, 25 bp, Mus musculus
aaaggagctggcaggtgccatgctc

SEQ ID NO: 15584 - DNA, 25 bp, Mus musculus
aaaggagctggctggtgccatgctc

SEQ ID NO: 15585 - DNA, 25 bp, Mus musculus
aaaggagctggtcgtcttcagccct

SEQ ID NO: 15586 - DNA, 25 bp, Mus musculus
aaaggagctggtggtcttcagccct

SEQ ID NO: 15587 - DNA, 25 bp, Mus musculus
aaaggagctgtaagaccatgccgaa

SEQ ID NO: 15588 - DNA, 25 bp, Mus musculus
aaaggagctgtatgaccatgccgaa

SEQ ID NO: 15589 - DNA, 25 bp, Mus musculus
aaaggagctttaatttcccatggag

SEQ ID NO: 15590 - DNA, 25 bp, Mus musculus
aaaggagctttattttcccatggag

SEQ ID NO: 15591 - DNA, 25 bp, Mus musculus
aaaggagctttccactctgcatggc

SEQ ID NO: 15592 - DNA, 25 bp, Mus musculus
aaaggagctttcgactctgcatggc

SEQ ID NO: 15593 - DNA, 25 bp, Mus musculus
aaaggagctttgattctgctgtttc

SEQ ID NO: 15594 - DNA, 25 bp, Mus musculus
aaaggagctttgtttctgctgtttc

SEQ ID NO: 15595 - DNA, 25 bp, Mus musculus
aaaggaggacggagctcacccagct

SEQ ID NO: 15596 - DNA, 25 bp, Mus musculus
aaaggaggacggtgctcacccagct

SEQ ID NO: 15597 - DNA, 25 bp, Mus musculus
aaaggaggaggacctccaagcccag

SEQ ID NO: 15598 - DNA, 25 bp, Mus musculus
aaaggaggaggagctccaagcccag

SEQ ID NO: 15599 - DNA, 25 bp, Mus musculus
aaaggaggatgaatgtggctgcccc

SEQ ID NO: 15600 - DNA, 25 bp, Mus musculus
aaaggaggatgattgtggctgcccc

SEQ ID NO: 15601 - DNA, 25 bp, Mus musculus
aaaggaggcacaactcattttgtat

SEQ ID NO: 15602 - DNA, 25 bp, Mus musculus
aaaggaggcacatctcattttgtat

SEQ ID NO: 15603 - DNA, 25 bp, Mus musculus
aaaggaggcaccaactacccagtga

SEQ ID NO: 15604 - DNA, 25 bp, Mus musculus
aaaggaggcacctactacccagtga

SEQ ID NO: 15605 - DNA, 25 bp, Mus musculus
aaaggaggcagcactcctcttccag

SEQ ID NO: 15606 - DNA, 25 bp, Mus musculus
aaaggaggcagccttcctaaccatc

SEQ ID NO: 15607 - DNA, 25 bp, Mus musculus
aaaggaggcagcgttcctaaccatc

SEQ ID NO: 15608 - DNA, 25 bp, Mus musculus
aaaggaggcagctctcctcttccag

SEQ ID NO: 15609 - DNA, 25 bp, Mus musculus
aaaggaggcagtctcgctctccaaa

SEQ ID NO: 15610 - DNA, 25 bp, Mus musculus
aaaggaggcagtgtcgctctccaaa

SEQ ID NO: 15611 - DNA, 25 bp, Mus musculus
aaaggaggccaacattcggtccact

SEQ ID NO: 15612 - DNA, 25 bp, Mus musculus
aaaggaggccaagattcggtccact

SEQ ID NO: 15613 - DNA, 25 bp, Mus musculus
aaaggaggcctcagctcatctagga

SEQ ID NO: 15614 - DNA, 25 bp, Mus musculus
aaaggaggcctctgctcatctagga

SEQ ID NO: 15615 - DNA, 25 bp, Mus musculus
aaaggaggcgctactaggccacctg

SEQ ID NO: 15616 - DNA, 25 bp, Mus musculus
aaaggaggcgcttctaggccacctg

SEQ ID NO: 15617 - DNA, 25 bp, Mus musculus
aaaggaggctctcgcactctagggt

SEQ ID NO: 15618 - DNA, 25 bp, Mus musculus
aaaggaggctctggcactctagggt

SEQ ID NO: 15619 - DNA, 25 bp, Mus musculus
aaaggagggagccatctcgatctag

SEQ ID NO: 15620 - DNA, 25 bp, Mus musculus
aaaggagggagcgatctcgatctag

SEQ ID NO: 15621 - DNA, 25 bp, Mus musculus
aaaggagggcagaaggccatacctt

SEQ ID NO: 15622 - DNA, 25 bp, Mus musculus
aaaggagggcagtaggccatacctt

SEQ ID NO: 15623 - DNA, 25 bp, Mus musculus
aaaggagggccgctctcagttccct

SEQ ID NO: 15624 - DNA, 25 bp, Mus musculus
aaaggagggccggtctcagttccct

SEQ ID NO: 15625 - DNA, 25 bp, Mus musculus
aaaggagggcctagactatatgtag

SEQ ID NO: 15626 - DNA, 25 bp, Mus musculus
aaaggagggccttgactatatgtag

SEQ ID NO: 15627 - DNA, 25 bp, Mus musculus
aaaggagggctaatcccacttcaca

SEQ ID NO: 15628 - DNA, 25 bp, Mus musculus
aaaggagggctattcccacttcaca

SEQ ID NO: 15629 - DNA, 25 bp, Mus musculus
aaaggagggcttcacaccactttca

SEQ ID NO: 15630 - DNA, 25 bp, Mus musculus
aaaggagggcttgacaccactttca

SEQ ID NO: 15631 - DNA, 25 bp, Mus musculus
aaaggaggtaccacgggccatggct

SEQ ID NO: 15632 - DNA, 25 bp, Mus musculus
aaaggaggtacctcgggccatggct

SEQ ID NO: 15633 - DNA, 25 bp, Mus musculus
aaaggaggtcagcagatcctagaac

SEQ ID NO: 15634 - DNA, 25 bp, Mus musculus
aaaggaggtcaggagatcctagaac

SEQ ID NO: 15635 - DNA, 25 bp, Mus musculus
aaaggaggtccaagtcctgcttgct

SEQ ID NO: 15636 - DNA, 25 bp, Mus musculus
aaaggaggtccatgtcctgcttgct

SEQ ID NO: 15637 - DNA, 25 bp, Mus musculus
aaaggaggtcccaggttactgcaga

SEQ ID NO: 15638 - DNA, 25 bp, Mus musculus
aaaggaggtccctggttactgcaga

SEQ ID NO: 15639 - DNA, 25 bp, Mus musculus
aaaggaggtgccagtgctgcagctg

SEQ ID NO: 15640 - DNA, 25 bp, Mus musculus
aaaggaggtgcctgtgctgcagctg

SEQ ID NO: 15641 - DNA, 25 bp, Mus musculus
aaaggagtacgccatgctgcacaac

SEQ ID NO: 15642 - DNA, 25 bp, Mus musculus
aaaggagtacgcgatgctgcacaac

SEQ ID NO: 15643 - DNA, 25 bp, Mus musculus
aaaggagtcaagctctgctgctcat

SEQ ID NO: 15644 - DNA, 25 bp, Mus musculus
aaaggagtcaaggtctgctgctcat

SEQ ID NO: 15645 - DNA, 25 bp, Mus musculus
aaaggagtcacccagtccacgggag

SEQ ID NO: 15646 - DNA, 25 bp, Mus musculus
aaaggagtcaccgagtccacgggag

SEQ ID NO: 15647 - DNA, 25 bp, Mus musculus
aaaggagtcatcattttgcttcaag

SEQ ID NO: 15648 - DNA, 25 bp, Mus musculus
aaaggagtcatctttttgcttcaag

SEQ ID NO: 15649 - DNA, 25 bp, Mus musculus
aaaggagtccaaattcaacccacag

SEQ ID NO: 15650 - DNA, 25 bp, Mus musculus
aaaggagtccaatttcaacccacag

SEQ ID NO: 15651 - DNA, 25 bp, Mus musculus
aaaggagtccatcaagtcactcaaa

SEQ ID NO: 15652 - DNA, 25 bp, Mus musculus
aaaggagtccatcaggcttacccca

SEQ ID NO: 15653 - DNA, 25 bp, Mus musculus
aaaggagtccatgaagtcactcaaa

SEQ ID NO: 15654 - DNA, 25 bp, Mus musculus
aaaggagtccatgaggcttacccca

SEQ ID NO: 15655 - DNA, 25 bp, Mus musculus
aaaggagtcccgcagctctcacaaa

SEQ ID NO: 15656 - DNA, 25 bp, Mus musculus
aaaggagtcccggagctctcacaaa

SEQ ID NO: 15657 - DNA, 25 bp, Mus musculus
aaaggagtccctcggtgccatgccc

SEQ ID NO: 15658 - DNA, 25 bp, Mus musculus
aaaggagtccctgggtgccatgccc

SEQ ID NO: 15659 - DNA, 25 bp, Mus musculus
aaaggagtcgccaggctgcctatgt

SEQ ID NO: 15660 - DNA, 25 bp, Mus musculus
aaaggagtcgcctggctgcctatgt

SEQ ID NO: 15661 - DNA, 25 bp, Mus musculus
aaaggagtcggcacggtccattgca

SEQ ID NO: 15662 - DNA, 25 bp, Mus musculus
aaaggagtcggctcggtccattgca

SEQ ID NO: 15663 - DNA, 25 bp, Mus musculus
aaaggagtctccctaggcgacctgg

SEQ ID NO: 15664 - DNA, 25 bp, Mus musculus
aaaggagtctccgtaggcgacctgg

SEQ ID NO: 15665 - DNA, 25 bp, Mus musculus
aaaggagtgaatagcccatccgtcc

SEQ ID NO: 15666 - DNA, 25 bp, Mus musculus
aaaggagtgaattgcccatccgtcc

SEQ ID NO: 15667 - DNA, 25 bp, Mus musculus
aaaggagtgcacagtggctcctcaa

SEQ ID NO: 15668 - DNA, 25 bp, Mus musculus
aaaggagtgcactgtggctcctcaa

SEQ ID NO: 15669 - DNA, 25 bp, Mus musculus
aaaggagtgctaccagctgagcttg

SEQ ID NO: 15670 - DNA, 25 bp, Mus musculus
aaaggagtgctagcagctgagcttg

SEQ ID NO: 15671 - DNA, 25 bp, Mus musculus
aaaggagtggatcactgcccctagc

SEQ ID NO: 15672 - DNA, 25 bp, Mus musculus
aaaggagtggatgactgcccctagc

SEQ ID NO: 15673 - DNA, 25 bp, Mus musculus
aaaggagtgggaaacaatcagaagt

SEQ ID NO: 15674 - DNA, 25 bp, Mus musculus
aaaggagtgggatacaatcagaagt

SEQ ID NO: 15675 - DNA, 25 bp, Mus musculus
aaaggagtgtgacgtcctctctgag

SEQ ID NO: 15676 - DNA, 25 bp, Mus musculus
aaaggagtgtgaggtcctctctgag

SEQ ID NO: 15677 - DNA, 25 bp, Mus musculus
aaaggagttcagattgctgcccctt

SEQ ID NO: 15678 - DNA, 25 bp, Mus musculus
aaaggagttcagtttgctgcccctt

SEQ ID NO: 15679 - DNA, 25 bp, Mus musculus
aaaggagttcctatgatcaaataaa

SEQ ID NO: 15680 - DNA, 25 bp, Mus musculus
aaaggagttcctttgatcaaataaa

SEQ ID NO: 15681 - DNA, 25 bp, Mus musculus
aaaggatacagcatctaccagctcc

SEQ ID NO: 15682 - DNA, 25 bp, Mus musculus
aaaggatacagcttctaccagctcc

SEQ ID NO: 15683 - DNA, 25 bp, Mus musculus
aaaggatacaggctctcacggaaga

SEQ ID NO: 15684 - DNA, 25 bp, Mus musculus
aaaggatacagggtctcacggaaga

SEQ ID NO: 15685 - DNA, 25 bp, Mus musculus
aaaggatatactctgttctctcgct

SEQ ID NO: 15686 - DNA, 25 bp, Mus musculus
aaaggatatactgtgttctctcgct

SEQ ID NO: 15687 - DNA, 25 bp, Mus musculus
aaaggatatgctctcttggctcgga

SEQ ID NO: 15688 - DNA, 25 bp, Mus musculus
aaaggatatgctgtcttggctcgga

SEQ ID NO: 15689 - DNA, 25 bp, Mus musculus
aaaggatatggtcggcccctgtgct

SEQ ID NO: 15690 - DNA, 25 bp, Mus musculus
aaaggatatggtgggcccctgtgct

SEQ ID NO: 15691 - DNA, 25 bp, Mus musculus
aaaggatcaccgctttccgactgag

SEQ ID NO: 15692 - DNA, 25 bp, Mus musculus
aaaggatcaccggtttccgactgag

SEQ ID NO: 15693 - DNA, 25 bp, Mus musculus
aaaggatcatccattgtagcccagc

SEQ ID NO: 15694 - DNA, 25 bp, Mus musculus
aaaggatcatcctttgtagcccagc

SEQ ID NO: 15695 - DNA, 25 bp, Mus musculus
aaaggatccaggagctgcagcagca

SEQ ID NO: 15696 - DNA, 25 bp, Mus musculus
aaaggatccaggtgctgcagcagca

SEQ ID NO: 15697 - DNA, 25 bp, Mus musculus
aaaggatcccctcagaagctgtatt

SEQ ID NO: 15698 - DNA, 25 bp, Mus musculus
aaaggatcccctgagaagctgtatt

SEQ ID NO: 15699 - DNA, 25 bp, Mus musculus
aaaggatcctgtactgtttgtgtcg

SEQ ID NO: 15700 - DNA, 25 bp, Mus musculus
aaaggatcctgtcctgtctatggct

SEQ ID NO: 15701 - DNA, 25 bp, Mus musculus
aaaggatcctgtgctgtctatggct

SEQ ID NO: 15702 - DNA, 25 bp, Mus musculus
aaaggatcctgttctgtttgtgtcg

SEQ ID NO: 15703 - DNA, 25 bp, Mus musculus
aaaggatcgtccctgagaggttcct

SEQ ID NO: 15704 - DNA, 25 bp, Mus musculus
aaaggatcgtccgtgagaggttcct

SEQ ID NO: 15705 - DNA, 25 bp, Mus musculus
aaaggatctcacatggtagccaggg

SEQ ID NO: 15706 - DNA, 25 bp, Mus musculus
aaaggatctcaccaatgcccacagg

SEQ ID NO: 15707 - DNA, 25 bp, Mus musculus
aaaggatctcacgaatgcccacagg

SEQ ID NO: 15708 - DNA, 25 bp, Mus musculus
aaaggatctcacttggtagccaggg

SEQ ID NO: 15709 - DNA, 25 bp, Mus musculus
aaaggatctgatacaggacttgaca

SEQ ID NO: 15710 - DNA, 25 bp, Mus musculus
aaaggatctgattcaggacttgaca

SEQ ID NO: 15711 - DNA, 25 bp, Mus musculus
aaaggatctgcgagtgtctggtcat

SEQ ID NO: 15712 - DNA, 25 bp, Mus musculus
aaaggatctgcgtgtgtctggtcat

SEQ ID NO: 15713 - DNA, 25 bp, Mus musculus
aaaggatctgtgcttcccaattcag

SEQ ID NO: 15714 - DNA, 25 bp, Mus musculus
aaaggatctgtggttcccaattcag

SEQ ID NO: 15715 - DNA, 25 bp, Mus musculus
aaaggatcttgaagccgccggtgca

SEQ ID NO: 15716 - DNA, 25 bp, Mus musculus
aaaggatcttgatgccgccggtgca

SEQ ID NO: 15717 - DNA, 25 bp, Mus musculus
aaaggatcttggctagctcacttcc

SEQ ID NO: 15718 - DNA, 25 bp, Mus musculus
aaaggatcttgggtagctcacttcc

SEQ ID NO: 15719 - DNA, 25 bp, Mus musculus
aaaggatgacccctcacaagtatgc

SEQ ID NO: 15720 - DNA, 25 bp, Mus musculus
aaaggatgacccgtcacaagtatgc

SEQ ID NO: 15721 - DNA, 25 bp, Mus musculus
aaaggatgagcacgtccccttctct

SEQ ID NO: 15722 - DNA, 25 bp, Mus musculus
aaaggatgagcaggtccccttctct

SEQ ID NO: 15723 - DNA, 25 bp, Mus musculus
aaaggatgcagactggctgtttctt

SEQ ID NO: 15724 - DNA, 25 bp, Mus musculus
aaaggatgcagagtggctgtttctt

SEQ ID NO: 15725 - DNA, 25 bp, Mus musculus
aaaggatgcagcatttcccactgcg

SEQ ID NO: 15726 - DNA, 25 bp, Mus musculus
aaaggatgcagcttttcccactgcg

SEQ ID NO: 15727 - DNA, 25 bp, Mus musculus
aaaggatgcatacgagtctagctat

SEQ ID NO: 15728 - DNA, 25 bp, Mus musculus
aaaggatgcataggagtctagctat

SEQ ID NO: 15729 - DNA, 25 bp, Mus musculus
aaaggatgcatcaggtctaccccag

SEQ ID NO: 15730 - DNA, 25 bp, Mus musculus
aaaggatgcatctggtctaccccag

SEQ ID NO: 15731 - DNA, 25 bp, Mus musculus
aaaggatgccaacagcctgacgcta

SEQ ID NO: 15732 - DNA, 25 bp, Mus musculus
aaaggatgccaagagcctgacgcta

SEQ ID NO: 15733 - DNA, 25 bp, Mus musculus
aaaggatgcctccatggtgtaccga

SEQ ID NO: 15734 - DNA, 25 bp, Mus musculus
aaaggatgcctcgatggtgtaccga

SEQ ID NO: 15735 - DNA, 25 bp, Mus musculus
aaaggatgcgcacgagagacccaga

SEQ ID NO: 15736 - DNA, 25 bp, Mus musculus
aaaggatgcgcaggagagacccaga

SEQ ID NO: 15737 - DNA, 25 bp, Mus musculus
aaaggatgctatcctcatgttctag

SEQ ID NO: 15738 - DNA, 25 bp, Mus musculus
aaaggatgctatgctcatgttctag

SEQ ID NO: 15739 - DNA, 25 bp, Mus musculus
aaaggatgctgtcttcaccagaggg

SEQ ID NO: 15740 - DNA, 25 bp, Mus musculus
aaaggatgctgtgttcaccagaggg

SEQ ID NO: 15741 - DNA, 25 bp, Mus musculus
aaaggatgcttaacactctgtcacc

SEQ ID NO: 15742 - DNA, 25 bp, Mus musculus
aaaggatgcttatcactctgtcacc

SEQ ID NO: 15743 - DNA, 25 bp, Mus musculus
aaaggatgcttcagtacatgtccct

SEQ ID NO: 15744 - DNA, 25 bp, Mus musculus
aaaggatgcttctgtacatgtccct

SEQ ID NO: 15745 - DNA, 25 bp, Mus musculus
aaaggatggcatattccctacctct

SEQ ID NO: 15746 - DNA, 25 bp, Mus musculus
aaaggatggcattttccctacctct

SEQ ID NO: 15747 - DNA, 25 bp, Mus musculus
aaaggatggccgaatctccgtggca

SEQ ID NO: 15748 - DNA, 25 bp, Mus musculus
aaaggatggccgtatctccgtggca

SEQ ID NO: 15749 - DNA, 25 bp, Mus musculus
aaaggatggcttactcgcgcgggca

SEQ ID NO: 15750 - DNA, 25 bp, Mus musculus
aaaggatggctttctcgcgcgggca

SEQ ID NO: 15751 - DNA, 25 bp, Mus musculus
aaaggatggtgtctacccagctcaa

SEQ ID NO: 15752 - DNA, 25 bp, Mus musculus
aaaggatggtgtgtacccagctcaa

SEQ ID NO: 15753 - DNA, 25 bp, Mus musculus
aaaggatgtgccctggcagatcacc

SEQ ID NO: 15754 - DNA, 25 bp, Mus musculus
aaaggatgtgccgtggcagatcacc

SEQ ID NO: 15755 - DNA, 25 bp, Mus musculus
aaaggatgttacagccctcatttgc

SEQ ID NO: 15756 - DNA, 25 bp, Mus musculus
aaaggatgttactgccctcatttgc

SEQ ID NO: 15757 - DNA, 25 bp, Mus musculus
aaaggattaagtcctcttgggttga

SEQ ID NO: 15758 - DNA, 25 bp, Mus musculus
aaaggattaagtgctcttgggttga

SEQ ID NO: 15759 - DNA, 25 bp, Mus musculus
aaaggattagccacgcgctacgtca

SEQ ID NO: 15760 - DNA, 25 bp, Mus musculus
aaaggattagccactgcagtcctcc

SEQ ID NO: 15761 - DNA, 25 bp, Mus musculus
aaaggattagcctcgcgctacgtca

SEQ ID NO: 15762 - DNA, 25 bp, Mus musculus
aaaggattagcctctgcagtcctcc

SEQ ID NO: 15763 - DNA, 25 bp, Mus musculus
aaaggattcagcatgctttggattg

SEQ ID NO: 15764 - DNA, 25 bp, Mus musculus
aaaggattcagcttgctttggattg

SEQ ID NO: 15765 - DNA, 25 bp, Mus musculus
aaaggattcaggatcaacattatgc

SEQ ID NO: 15766 - DNA, 25 bp, Mus musculus
aaaggattcaggttcaacattatgc

SEQ ID NO: 15767 - DNA, 25 bp, Mus musculus
aaaggattccgtcattctcagtgct

SEQ ID NO: 15768 - DNA, 25 bp, Mus musculus
aaaggattccgtgattctcagtgct

SEQ ID NO: 15769 - DNA, 25 bp, Mus musculus
aaaggattcgatactggtcgacagt

SEQ ID NO: 15770 - DNA, 25 bp, Mus musculus
aaaggattcgattctggtcgacagt

SEQ ID NO: 15771 - DNA, 25 bp, Mus musculus
aaaggattcggcatctggcttctga

SEQ ID NO: 15772 - DNA, 25 bp, Mus musculus
aaaggattcggcttctggcttctga

SEQ ID NO: 15773 - DNA, 25 bp, Mus musculus
aaaggattgcacatgttcgttctgt

SEQ ID NO: 15774 - DNA, 25 bp, Mus musculus
aaaggattgcacttgttcgttctgt

SEQ ID NO: 15775 - DNA, 25 bp, Mus musculus
aaaggattgcttctttccagtcaaa

SEQ ID NO: 15776 - DNA, 25 bp, Mus musculus
aaaggattgcttgtttccagtcaaa

SEQ ID NO: 15777 - DNA, 25 bp, Mus musculus
aaaggattgggcatcctgaggcttc

SEQ ID NO: 15778 - DNA, 25 bp, Mus musculus
aaaggattgggcttcctgaggcttc

SEQ ID NO: 15779 - DNA, 25 bp, Mus musculus
aaaggattgtgtctgccattgtggc

SEQ ID NO: 15780 - DNA, 25 bp, Mus musculus
aaaggattgtgtgtgccattgtggc

SEQ ID NO: 15781 - DNA, 25 bp, Mus musculus
aaaggattgttcatcagtggtgaca

SEQ ID NO: 15782 - DNA, 25 bp, Mus musculus
aaaggattgttcttcagtggtgaca

SEQ ID NO: 15783 - DNA, 25 bp, Mus musculus
aaaggatttatcactgtgggactca

SEQ ID NO: 15784 - DNA, 25 bp, Mus musculus
aaaggatttatctctgtgggactca

SEQ ID NO: 15785 - DNA, 25 bp, Mus musculus
aaaggatttgcaactggcttgcgtt

SEQ ID NO: 15786 - DNA, 25 bp, Mus musculus
aaaggatttgcatctggcttgcgtt

SEQ ID NO: 15787 - DNA, 25 bp, Mus musculus
aaaggattttggctactcctggaca

SEQ ID NO: 15788 - DNA, 25 bp, Mus musculus
aaaggattttgggtactcctggaca

SEQ ID NO: 15789 - DNA, 25 bp, Mus musculus
aaaggcaaacatatagcacagtagt

SEQ ID NO: 15790 - DNA, 25 bp, Mus musculus
aaaggcaaacatttagcacagtagt

SEQ ID NO: 15791 - DNA, 25 bp, Mus musculus
aaaggcaaaggtcccgctgacggca

SEQ ID NO: 15792 - DNA, 25 bp, Mus musculus
aaaggcaaaggtgccgctgacggca

SEQ ID NO: 15793 - DNA, 25 bp, Mus musculus
aaaggcaaatagcttgccttgcctt

SEQ ID NO: 15794 - DNA, 25 bp, Mus musculus
aaaggcaaataggttgccttgcctt

SEQ ID NO: 15795 - DNA, 25 bp, Mus musculus
aaaggcaaatgaccctcatgtgtag

SEQ ID NO: 15796 - DNA, 25 bp, Mus musculus
aaaggcaaatgagcctcatgtgtag

SEQ ID NO: 15797 - DNA, 25 bp, Mus musculus
aaaggcaacactcctaccttcctgt

SEQ ID NO: 15798 - DNA, 25 bp, Mus musculus
aaaggcaacactgctaccttcctgt

SEQ ID NO: 15799 - DNA, 25 bp, Mus musculus
aaaggcaacgttcgccagtctgcat

SEQ ID NO: 15800 - DNA, 25 bp, Mus musculus
aaaggcaacgttggccagtctgcat

SEQ ID NO: 15801 - DNA, 25 bp, Mus musculus
aaaggcaactaacgctaagaaggcg

SEQ ID NO: 15802 - DNA, 25 bp, Mus musculus
aaaggcaactaaggctaagaaggcg

SEQ ID NO: 15803 - DNA, 25 bp, Mus musculus
aaaggcaactgcagggcacggagtc

SEQ ID NO: 15804 - DNA, 25 bp, Mus musculus
aaaggcaactgctgggcacggagtc

SEQ ID NO: 15805 - DNA, 25 bp, Mus musculus
aaaggcaactgtaacagccgcaaca

SEQ ID NO: 15806 - DNA, 25 bp, Mus musculus
aaaggcaactgttacagccgcaaca

SEQ ID NO: 15807 - DNA, 25 bp, Mus musculus
aaaggcaagaaccaccaggcaactg

SEQ ID NO: 15808 - DNA, 25 bp, Mus musculus
aaaggcaagaacgaccaggcaactg

SEQ ID NO: 15809 - DNA, 25 bp, Mus musculus
aaaggcaagcccagacttttgacct

SEQ ID NO: 15810 - DNA, 25 bp, Mus musculus
aaaggcaagccctgacttttgacct

SEQ ID NO: 15811 - DNA, 25 bp, Mus musculus
aaaggcaagctcactgtactggcta

SEQ ID NO: 15812 - DNA, 25 bp, Mus musculus
aaaggcaagctctctgtactggcta

SEQ ID NO: 15813 - DNA, 25 bp, Mus musculus
aaaggcaagctgagtgttcataatg

SEQ ID NO: 15814 - DNA, 25 bp, Mus musculus
aaaggcaagctgtgtgttcataatg

SEQ ID NO: 15815 - DNA, 25 bp, Mus musculus
aaaggcaagggacccaccatctgcc

SEQ ID NO: 15816 - DNA, 25 bp, Mus musculus
aaaggcaagggagccaccatctgcc

SEQ ID NO: 15817 - DNA, 25 bp, Mus musculus
aaaggcaagggtagatccccgcagc

SEQ ID NO: 15818 - DNA, 25 bp, Mus musculus
aaaggcaagggttgatccccgcagc

SEQ ID NO: 15819 - DNA, 25 bp, Mus musculus
aaaggcaaggtcactctacatggtc

SEQ ID NO: 15820 - DNA, 25 bp, Mus musculus
aaaggcaaggtctctctacatggtc

SEQ ID NO: 15821 - DNA, 25 bp, Mus musculus
aaaggcaagtatacattcccagatg

SEQ ID NO: 15822 - DNA, 25 bp, Mus musculus
aaaggcaagtattcattcccagatg

SEQ ID NO: 15823 - DNA, 25 bp, Mus musculus
aaaggcaagtctctttccatctcgt

SEQ ID NO: 15824 - DNA, 25 bp, Mus musculus
aaaggcaagtctgtttccatctcgt

SEQ ID NO: 15825 - DNA, 25 bp, Mus musculus
aaaggcacaaatctaagtatctatg

SEQ ID NO: 15826 - DNA, 25 bp, Mus musculus
aaaggcacaaatgtaagtatctatg

SEQ ID NO: 15827 - DNA, 25 bp, Mus musculus
aaaggcacaagtccctgtttcagtg

SEQ ID NO: 15828 - DNA, 25 bp, Mus musculus
aaaggcacaagtgcctgtttcagtg

SEQ ID NO: 15829 - DNA, 25 bp, Mus musculus
aaaggcacacaaacagacctcgggc

SEQ ID NO: 15830 - DNA, 25 bp, Mus musculus
aaaggcacacaatcagacctcgggc

SEQ ID NO: 15831 - DNA, 25 bp, Mus musculus
aaaggcacagatagacgaacgggaa

SEQ ID NO: 15832 - DNA, 25 bp, Mus musculus
aaaggcacagattgacgaacgggaa

SEQ ID NO: 15833 - DNA, 25 bp, Mus musculus
aaaggcacagcacgcaaaggcgctt

SEQ ID NO: 15834 - DNA, 25 bp, Mus musculus
aaaggcacagcaggcaaaggcgctt

SEQ ID NO: 15835 - DNA, 25 bp, Mus musculus
aaaggcacatcaaaccgaaatgtat

SEQ ID NO: 15836 - DNA, 25 bp, Mus musculus
aaaggcacatcataccgaaatgtat

SEQ ID NO: 15837 - DNA, 25 bp, Mus musculus
aaaggcaccacacctgggcagagaa

SEQ ID NO: 15838 - DNA, 25 bp, Mus musculus
aaaggcaccacagctgggcagagaa

SEQ ID NO: 15839 - DNA, 25 bp, Mus musculus
aaaggcaccggcagagccacacgtg

SEQ ID NO: 15840 - DNA, 25 bp, Mus musculus
aaaggcaccggctgagccacacgtg

SEQ ID NO: 15841 - DNA, 25 bp, Mus musculus
aaaggcacctatcctcatgtacata

SEQ ID NO: 15842 - DNA, 25 bp, Mus musculus
aaaggcacctatgctcatgtacata

SEQ ID NO: 15843 - DNA, 25 bp, Mus musculus
aaaggcacctccctggaaggagcac

SEQ ID NO: 15844 - DNA, 25 bp, Mus musculus
aaaggcacctccgtggaaggagcac

SEQ ID NO: 15845 - DNA, 25 bp, Mus musculus
aaaggcaccttcagaaccctcactg

SEQ ID NO: 15846 - DNA, 25 bp, Mus musculus
aaaggcaccttctgaaccctcactg

SEQ ID NO: 15847 - DNA, 25 bp, Mus musculus
aaaggcacgagcatcatctgatggc

SEQ ID NO: 15848 - DNA, 25 bp, Mus musculus
aaaggcacgagcttcatctgatggc

SEQ ID NO: 15849 - DNA, 25 bp, Mus musculus
aaaggcacgatgagctctcctactt

SEQ ID NO: 15850 - DNA, 25 bp, Mus musculus
aaaggcacgatgtgctctcctactt

SEQ ID NO: 15851 - DNA, 25 bp, Mus musculus
aaaggcacgcttcgcatgcaacaga

SEQ ID NO: 15852 - DNA, 25 bp, Mus musculus
aaaggcacgcttggcatgcaacaga

SEQ ID NO: 15853 - DNA, 25 bp, Mus musculus
aaaggcactgcaaaggtggctctgg

SEQ ID NO: 15854 - DNA, 25 bp, Mus musculus
aaaggcactgcataggtggctctgg

SEQ ID NO: 15855 - DNA, 25 bp, Mus musculus
aaaggcacttaaatgaccgggcagt

SEQ ID NO: 15856 - DNA, 25 bp, Mus musculus
aaaggcacttaattgaccgggcagt

SEQ ID NO: 15857 - DNA, 25 bp, Mus musculus
aaaggcacttagaactgatagacag

SEQ ID NO: 15858 - DNA, 25 bp, Mus musculus
aaaggcacttagtactgatagacag

SEQ ID NO: 15859 - DNA, 25 bp, Mus musculus
aaaggcacttatcgcacttattgta

SEQ ID NO: 15860 - DNA, 25 bp, Mus musculus
aaaggcacttatctccaaggttggt

SEQ ID NO: 15861 - DNA, 25 bp, Mus musculus
aaaggcacttatggcacttattgta

SEQ ID NO: 15862 - DNA, 25 bp, Mus musculus
aaaggcacttatgtccaaggttggt

SEQ ID NO: 15863 - DNA, 25 bp, Mus musculus
aaaggcacttctaaactgttgtggt

SEQ ID NO: 15864 - DNA, 25 bp, Mus musculus
aaaggcacttcttaactgttgtggt

SEQ ID NO: 15865 - DNA, 25 bp, Mus musculus
aaaggcacttgtcacacgaggctga

SEQ ID NO: 15866 - DNA, 25 bp, Mus musculus
aaaggcacttgtctctgtgtcggga

SEQ ID NO: 15867 - DNA, 25 bp, Mus musculus
aaaggcacttgtgacacgaggctga

SEQ ID NO: 15868 - DNA, 25 bp, Mus musculus
aaaggcacttgtgtctgtgtcggga

SEQ ID NO: 15869 - DNA, 25 bp, Mus musculus
aaaggcagactccataaggaatgaa

SEQ ID NO: 15870 - DNA, 25 bp, Mus musculus
aaaggcagactcgataaggaatgaa

SEQ ID NO: 15871 - DNA, 25 bp, Mus musculus
aaaggcagaggcattccggtcgctt

SEQ ID NO: 15872 - DNA, 25 bp, Mus musculus
aaaggcagaggctttccggtcgctt

SEQ ID NO: 15873 - DNA, 25 bp, Mus musculus
aaaggcagatctctatcgctcgctg

SEQ ID NO: 15874 - DNA, 25 bp, Mus musculus
aaaggcagatctgtatcgctcgctg

SEQ ID NO: 15875 - DNA, 25 bp, Mus musculus
aaaggcagatggacacaacaggatt

SEQ ID NO: 15876 - DNA, 25 bp, Mus musculus
aaaggcagatggtcacaacaggatt

SEQ ID NO: 15877 - DNA, 25 bp, Mus musculus
aaaggcagatgtattcctctccgag

SEQ ID NO: 15878 - DNA, 25 bp, Mus musculus
aaaggcagatgttttcctctccgag

SEQ ID NO: 15879 - DNA, 25 bp, Mus musculus
aaaggcagatttctctacataatga

SEQ ID NO: 15880 - DNA, 25 bp, Mus musculus
aaaggcagatttgtctacataatga

SEQ ID NO: 15881 - DNA, 25 bp, Mus musculus
aaaggcagcagcattctcttgggca

SEQ ID NO: 15882 - DNA, 25 bp, Mus musculus
aaaggcagcagctttctcttgggca

SEQ ID NO: 15883 - DNA, 25 bp, Mus musculus
aaaggcagcatcaccacatggagcc

SEQ ID NO: 15884 - DNA, 25 bp, Mus musculus
aaaggcagcatctccacatggagcc

SEQ ID NO: 15885 - DNA, 25 bp, Mus musculus
aaaggcagcccactgtttgtgtaca

SEQ ID NO: 15886 - DNA, 25 bp, Mus musculus
aaaggcagcccagtgtttgtgtaca

SEQ ID NO: 15887 - DNA, 25 bp, Mus musculus
aaaggcagccccagcttttgtgagg

SEQ ID NO: 15888 - DNA, 25 bp, Mus musculus
aaaggcagcccctgcttttgtgagg

SEQ ID NO: 15889 - DNA, 25 bp, Mus musculus
aaaggcagccgacctaattctgaag

SEQ ID NO: 15890 - DNA, 25 bp, Mus musculus
aaaggcagccgagctaattctgaag

SEQ ID NO: 15891 - DNA, 25 bp, Mus musculus
aaaggcagcctacagcccagcctgg

SEQ ID NO: 15892 - DNA, 25 bp, Mus musculus
aaaggcagcctagagcccagcctgg

SEQ ID NO: 15893 - DNA, 25 bp, Mus musculus
aaaggcagcctcactaagctagatc

SEQ ID NO: 15894 - DNA, 25 bp, Mus musculus
aaaggcagcctctctaagctagatc

SEQ ID NO: 15895 - DNA, 25 bp, Mus musculus
aaaggcagccttagtaacgagctaa

SEQ ID NO: 15896 - DNA, 25 bp, Mus musculus
aaaggcagcctttgtaacgagctaa

SEQ ID NO: 15897 - DNA, 25 bp, Mus musculus
aaaggcagcgagagggtccagatct

SEQ ID NO: 15898 - DNA, 25 bp, Mus musculus
aaaggcagcgagtgggtccagatct

SEQ ID NO: 15899 - DNA, 25 bp, Mus musculus
aaaggcagctctaaccatgttctca

SEQ ID NO: 15900 - DNA, 25 bp, Mus musculus
aaaggcagctctcgatcctaggcca

SEQ ID NO: 15901 - DNA, 25 bp, Mus musculus
aaaggcagctctggatcctaggcca

SEQ ID NO: 15902 - DNA, 25 bp, Mus musculus
aaaggcagctcttaccatgttctca

SEQ ID NO: 15903 - DNA, 25 bp, Mus musculus
aaaggcagctttctcattcagatcc

SEQ ID NO: 15904 - DNA, 25 bp, Mus musculus
aaaggcagctttgtcattcagatcc

SEQ ID NO: 15905 - DNA, 25 bp, Mus musculus
aaaggcaggcacattaccacttccc

SEQ ID NO: 15906 - DNA, 25 bp, Mus musculus
aaaggcaggcactttaccacttccc

SEQ ID NO: 15907 - DNA, 25 bp, Mus musculus
aaaggcaggcgcagtgggatctcat

SEQ ID NO: 15908 - DNA, 25 bp, Mus musculus
aaaggcaggcgctgtgggatctcat

SEQ ID NO: 15909 - DNA, 25 bp, Mus musculus
aaaggcaggctacccttacccaaat

SEQ ID NO: 15910 - DNA, 25 bp, Mus musculus
aaaggcaggctagccttacccaaat

SEQ ID NO: 15911 - DNA, 25 bp, Mus musculus
aaaggcaggctcaggtttcccaaag

SEQ ID NO: 15912 - DNA, 25 bp, Mus musculus
aaaggcaggctctggtttcccaaag

SEQ ID NO: 15913 - DNA, 25 bp, Mus musculus
aaaggcaggctgaatagtgtgaacg

SEQ ID NO: 15914 - DNA, 25 bp, Mus musculus
aaaggcaggctgtatagtgtgaacg

SEQ ID NO: 15915 - DNA, 25 bp, Mus musculus
aaaggcaggcttagtttgatatcag

SEQ ID NO: 15916 - DNA, 25 bp, Mus musculus
aaaggcaggcttcctgtgtgcacag

SEQ ID NO: 15917 - DNA, 25 bp, Mus musculus
aaaggcaggcttgctgtgtgcacag

SEQ ID NO: 15918 - DNA, 25 bp, Mus musculus
aaaggcaggctttgtttgatatcag

SEQ ID NO: 15919 - DNA, 25 bp, Mus musculus
aaaggcaggtttcatttaagcagcg

SEQ ID NO: 15920 - DNA, 25 bp, Mus musculus
aaaggcaggtttgatttaagcagcg

SEQ ID NO: 15921 - DNA, 25 bp, Mus musculus
aaaggcagtcatcgcttgccacact

SEQ ID NO: 15922 - DNA, 25 bp, Mus musculus
aaaggcagtcatctcaggattcaga

SEQ ID NO: 15923 - DNA, 25 bp, Mus musculus
aaaggcagtcatggcttgccacact

SEQ ID NO: 15924 - DNA, 25 bp, Mus musculus
aaaggcagtcatgtcaggattcaga

SEQ ID NO: 15925 - DNA, 25 bp, Mus musculus
aaaggcagtctcagtgtctggagct

SEQ ID NO: 15926 - DNA, 25 bp, Mus musculus
aaaggcagtctccactttgaacact

SEQ ID NO: 15927 - DNA, 25 bp, Mus musculus
aaaggcagtctcgactttgaacact

SEQ ID NO: 15928 - DNA, 25 bp, Mus musculus
aaaggcagtctctgtgtctggagct

SEQ ID NO: 15929 - DNA, 25 bp, Mus musculus
aaaggcagtgaccaatccacaatag

SEQ ID NO: 15930 - DNA, 25 bp, Mus musculus
aaaggcagtgacgaatccacaatag

SEQ ID NO: 15931 - DNA, 25 bp, Mus musculus
aaaggcagtgagagccctgtctctg

SEQ ID NO: 15932 - DNA, 25 bp, Mus musculus
aaaggcagtgagagcgcgcgcagag

SEQ ID NO: 15933 - DNA, 25 bp, Mus musculus
aaaggcagtgagtgccctgtctctg

SEQ ID NO: 15934 - DNA, 25 bp, Mus musculus
aaaggcagtgagtgcgcgcgcagag

SEQ ID NO: 15935 - DNA, 25 bp, Mus musculus
aaaggcagtggcagcactaactgat

SEQ ID NO: 15936 - DNA, 25 bp, Mus musculus
aaaggcagtggctgcactaactgat

SEQ ID NO: 15937 - DNA, 25 bp, Mus musculus
aaaggcagttcgaggagacgcagat

SEQ ID NO: 15938 - DNA, 25 bp, Mus musculus
aaaggcagttcgtggagacgcagat

SEQ ID NO: 15939 - DNA, 25 bp, Mus musculus
aaaggcagttggaagtcctggccag

SEQ ID NO: 15940 - DNA, 25 bp, Mus musculus
aaaggcagttggagccttctctgta

SEQ ID NO: 15941 - DNA, 25 bp, Mus musculus
aaaggcagttggtagtcctggccag

SEQ ID NO: 15942 - DNA, 25 bp, Mus musculus
aaaggcagttggtgccttctctgta

SEQ ID NO: 15943 - DNA, 25 bp, Mus musculus
aaaggcatacatcccctcacatgta

SEQ ID NO: 15944 - DNA, 25 bp, Mus musculus
aaaggcatacatgccctcacatgta

SEQ ID NO: 15945 - DNA, 25 bp, Mus musculus
aaaggcatacctcgtctgtacttcc

SEQ ID NO: 15946 - DNA, 25 bp, Mus musculus
aaaggcatacctggtctgtacttcc

SEQ ID NO: 15947 - DNA, 25 bp, Mus musculus
aaaggcatacgtcgcttgtctttcc

SEQ ID NO: 15948 - DNA, 25 bp, Mus musculus
aaaggcatacgtggcttgtctttcc

SEQ ID NO: 15949 - DNA, 25 bp, Mus musculus
aaaggcatatccagtacaccgacat

SEQ ID NO: 15950 - DNA, 25 bp, Mus musculus
aaaggcatatcctgtacaccgacat

SEQ ID NO: 15951 - DNA, 25 bp, Mus musculus
aaaggcatatctcaagacccctatg

SEQ ID NO: 15952 - DNA, 25 bp, Mus musculus
aaaggcatatctgaagacccctatg

SEQ ID NO: 15953 - DNA, 25 bp, Mus musculus
aaaggcatcaaacgctaagcaggga

SEQ ID NO: 15954 - DNA, 25 bp, Mus musculus
aaaggcatcaaaggctaagcaggga

SEQ ID NO: 15955 - DNA, 25 bp, Mus musculus
aaaggcatcagtaagtgcacaacct

SEQ ID NO: 15956 - DNA, 25 bp, Mus musculus
aaaggcatcagttagtgcacaacct

SEQ ID NO: 15957 - DNA, 25 bp, Mus musculus
aaaggcatcgtcaccaaactgttct

SEQ ID NO: 15958 - DNA, 25 bp, Mus musculus
aaaggcatcgtctccaaactgttct

SEQ ID NO: 15959 - DNA, 25 bp, Mus musculus
aaaggcatctccagaacgaagggct

SEQ ID NO: 15960 - DNA, 25 bp, Mus musculus
aaaggcatctcctgaacgaagggct

SEQ ID NO: 15961 - DNA, 25 bp, Mus musculus
aaaggcatgagtatctgtcactgaa

SEQ ID NO: 15962 - DNA, 25 bp, Mus musculus
aaaggcatgagtctccaccacatcc

SEQ ID NO: 15963 - DNA, 25 bp, Mus musculus
aaaggcatgagtgtccaccacatcc

SEQ ID NO: 15964 - DNA, 25 bp, Mus musculus
aaaggcatgagtttctgtcactgaa

SEQ ID NO: 15965 - DNA, 25 bp, Mus musculus
aaaggcatgcctaccgttgctacat

SEQ ID NO: 15966 - DNA, 25 bp, Mus musculus
aaaggcatgccttccgttgctacat

SEQ ID NO: 15967 - DNA, 25 bp, Mus musculus
aaaggcatgcgcagtgatgcgtgtt

SEQ ID NO: 15968 - DNA, 25 bp, Mus musculus
aaaggcatgcgctgtgatgcgtgtt

SEQ ID NO: 15969 - DNA, 25 bp, Mus musculus
aaaggcatgctgcttagacgccccg

SEQ ID NO: 15970 - DNA, 25 bp, Mus musculus
aaaggcatgctggttagacgccccg

SEQ ID NO: 15971 - DNA, 25 bp, Mus musculus
aaaggcatggaaacagactactgta

SEQ ID NO: 15972 - DNA, 25 bp, Mus musculus
aaaggcatggaatcagactactgta

SEQ ID NO: 15973 - DNA, 25 bp, Mus musculus
aaaggcatggagaatcgacgttaga

SEQ ID NO: 15974 - DNA, 25 bp, Mus musculus
aaaggcatggagtatcgacgttaga

SEQ ID NO: 15975 - DNA, 25 bp, Mus musculus
aaaggcatggccctttgacttttct

SEQ ID NO: 15976 - DNA, 25 bp, Mus musculus
aaaggcatggccgtttgacttttct

SEQ ID NO: 15977 - DNA, 25 bp, Mus musculus
aaaggcattagcaacctggacagat

SEQ ID NO: 15978 - DNA, 25 bp, Mus musculus
aaaggcattagctacctggacagat

SEQ ID NO: 15979 - DNA, 25 bp, Mus musculus
aaaggcattatcagaccctgggaga

SEQ ID NO: 15980 - DNA, 25 bp, Mus musculus
aaaggcattatctgaccctgggaga

SEQ ID NO: 15981 - DNA, 25 bp, Mus musculus
aaaggcattcccaaactggatgatg

SEQ ID NO: 15982 - DNA, 25 bp, Mus musculus
aaaggcattccctaactggatgatg

SEQ ID NO: 15983 - DNA, 25 bp, Mus musculus
aaaggcattcttaagctgttctttc

SEQ ID NO: 15984 - DNA, 25 bp, Mus musculus
aaaggcattctttagctgttctttc

SEQ ID NO: 15985 - DNA, 25 bp, Mus musculus
aaaggcattgctctgcacccggaat

SEQ ID NO: 15986 - DNA, 25 bp, Mus musculus
aaaggcattgctgtgcacccggaat

SEQ ID NO: 15987 - DNA, 25 bp, Mus musculus
aaaggcatttgaactggtcggacag

SEQ ID NO: 15988 - DNA, 25 bp, Mus musculus
aaaggcatttgatctggtcggacag

SEQ ID NO: 15989 - DNA, 25 bp, Mus musculus
aaaggcatttgcagtctctagctct

SEQ ID NO: 15990 - DNA, 25 bp, Mus musculus
aaaggcatttgctgtctctagctct

SEQ ID NO: 15991 - DNA, 25 bp, Mus musculus
aaaggccaacgcctggaatgccaat

SEQ ID NO: 15992 - DNA, 25 bp, Mus musculus
aaaggccaacgcgtggaatgccaat

SEQ ID NO: 15993 - DNA, 25 bp, Mus musculus
aaaggccaactgaagcaattgtgaa

SEQ ID NO: 15994 - DNA, 25 bp, Mus musculus
aaaggccaactgtagcaattgtgaa

SEQ ID NO: 15995 - DNA, 25 bp, Mus musculus
aaaggccaagcaagcactgcagtga

SEQ ID NO: 15996 - DNA, 25 bp, Mus musculus
aaaggccaagcatgcactgcagtga

SEQ ID NO: 15997 - DNA, 25 bp, Mus musculus
aaaggccaagttccctgcatttgaa

SEQ ID NO: 15998 - DNA, 25 bp, Mus musculus
aaaggccaagttgcctgcatttgaa

SEQ ID NO: 15999 - DNA, 25 bp, Mus musculus
aaaggccacaacagcttccagatct

SEQ ID NO: 16000 - DNA, 25 bp, Mus musculus
aaaggccacaactgcttccagatct

SEQ ID NO: 16001 - DNA, 25 bp, Mus musculus
aaaggccacactactcggagttgca

SEQ ID NO: 16002 - DNA, 25 bp, Mus musculus
aaaggccacacttctcggagttgca

SEQ ID NO: 16003 - DNA, 25 bp, Mus musculus
aaaggccacagtacacttcaggtaa

SEQ ID NO: 16004 - DNA, 25 bp, Mus musculus
aaaggccacagttcacttcaggtaa

SEQ ID NO: 16005 - DNA, 25 bp, Mus musculus
aaaggccacatgagggactcaggat

SEQ ID NO: 16006 - DNA, 25 bp, Mus musculus
aaaggccacatgtgggactcaggat

SEQ ID NO: 16007 - DNA, 25 bp, Mus musculus
aaaggccacattcctcgtttgtttg

SEQ ID NO: 16008 - DNA, 25 bp, Mus musculus
aaaggccacattgctcgtttgtttg

SEQ ID NO: 16009 - DNA, 25 bp, Mus musculus
aaaggccacctaccatcatgaagtt

SEQ ID NO: 16010 - DNA, 25 bp, Mus musculus
aaaggccacctagcatcatgaagtt

SEQ ID NO: 16011 - DNA, 25 bp, Mus musculus
aaaggccacctgagcaatagtaggt

SEQ ID NO: 16012 - DNA, 25 bp, Mus musculus
aaaggccacctgtgcaatagtaggt

SEQ ID NO: 16013 - DNA, 25 bp, Mus musculus
aaaggccacgagcagaggaaacagt

SEQ ID NO: 16014 - DNA, 25 bp, Mus musculus
aaaggccacgaggagaggaaacagt

SEQ ID NO: 16015 - DNA, 25 bp, Mus musculus
aaaggccacggcaggtcaggagctc

SEQ ID NO: 16016 - DNA, 25 bp, Mus musculus
aaaggccacggctggtcaggagctc

SEQ ID NO: 16017 - DNA, 25 bp, Mus musculus
aaaggccacggtccaggctgccatt

SEQ ID NO: 16018 - DNA, 25 bp, Mus musculus
aaaggccacggtgcaggctgccatt

SEQ ID NO: 16019 - DNA, 25 bp, Mus musculus
aaaggccactcacgttgcttttgat

SEQ ID NO: 16020 - DNA, 25 bp, Mus musculus
aaaggccactcaggttgcttttgat

SEQ ID NO: 16021 - DNA, 25 bp, Mus musculus
aaaggccactttactgaggctctat

SEQ ID NO: 16022 - DNA, 25 bp, Mus musculus
aaaggccacttttctgaggctctat

SEQ ID NO: 16023 - DNA, 25 bp, Mus musculus
aaaggccagacaccgacagcgacag

SEQ ID NO: 16024 - DNA, 25 bp, Mus musculus
aaaggccagacagcgacagcgacag

SEQ ID NO: 16025 - DNA, 25 bp, Mus musculus
aaaggccagagaaaggtgctccgaa

SEQ ID NO: 16026 - DNA, 25 bp, Mus musculus
aaaggccagagataggtgctccgaa

SEQ ID NO: 16027 - DNA, 25 bp, Mus musculus
aaaggccagcgtaactcttgactga

SEQ ID NO: 16028 - DNA, 25 bp, Mus musculus
aaaggccagcgttactcttgactga

SEQ ID NO: 16029 - DNA, 25 bp, Mus musculus
aaaggccagctgcatgtcagtttct

SEQ ID NO: 16030 - DNA, 25 bp, Mus musculus
aaaggccagctggatgtcagtttct

SEQ ID NO: 16031 - DNA, 25 bp, Mus musculus
aaaggccagcttccacatctgttta

SEQ ID NO: 16032 - DNA, 25 bp, Mus musculus
aaaggccagcttgcacatctgttta

SEQ ID NO: 16033 - DNA, 25 bp, Mus musculus
aaaggccaggatctagtgtctcctg

SEQ ID NO: 16034 - DNA, 25 bp, Mus musculus
aaaggccaggatgtagtgtctcctg

SEQ ID NO: 16035 - DNA, 25 bp, Mus musculus
aaaggccagggcagtcttgcgcaaa

SEQ ID NO: 16036 - DNA, 25 bp, Mus musculus
aaaggccagggctgtcttgcgcaaa

SEQ ID NO: 16037 - DNA, 25 bp, Mus musculus
aaaggccagtatacattgttcttga

SEQ ID NO: 16038 - DNA, 25 bp, Mus musculus
aaaggccagtattcattgttcttga

SEQ ID NO: 16039 - DNA, 25 bp, Mus musculus
aaaggccatattcctaacctcacca

SEQ ID NO: 16040 - DNA, 25 bp, Mus musculus
aaaggccatattgctaacctcacca

SEQ ID NO: 16041 - DNA, 25 bp, Mus musculus
aaaggccatctcctgagggaccaag

SEQ ID NO: 16042 - DNA, 25 bp, Mus musculus
aaaggccatctcgtgagggaccaag

SEQ ID NO: 16043 - DNA, 25 bp, Mus musculus
aaaggccatgctagacgttcataag

SEQ ID NO: 16044 - DNA, 25 bp, Mus musculus
aaaggccatgcttgacgttcataag

SEQ ID NO: 16045 - DNA, 25 bp, Mus musculus
aaaggccatttgcaggagcctctgg

SEQ ID NO: 16046 - DNA, 25 bp, Mus musculus
aaaggccatttggaggagcctctgg

SEQ ID NO: 16047 - DNA, 25 bp, Mus musculus
aaaggcccaaggactattagcttct

SEQ ID NO: 16048 - DNA, 25 bp, Mus musculus
aaaggcccaaggtctattagcttct

SEQ ID NO: 16049 - DNA, 25 bp, Mus musculus
aaaggcccagagacaccgctcttaa

SEQ ID NO: 16050 - DNA, 25 bp, Mus musculus
aaaggcccagagtcaccgctcttaa

SEQ ID NO: 16051 - DNA, 25 bp, Mus musculus
aaaggcccagcactcggtgtgttgt

SEQ ID NO: 16052 - DNA, 25 bp, Mus musculus
aaaggcccagcagtcggtgtgttgt

SEQ ID NO: 16053 - DNA, 25 bp, Mus musculus
aaaggcccagctaggttattgcttt

SEQ ID NO: 16054 - DNA, 25 bp, Mus musculus
aaaggcccagcttggttattgcttt

SEQ ID NO: 16055 - DNA, 25 bp, Mus musculus
aaaggcccaggcacagtggtgtaca

SEQ ID NO: 16056 - DNA, 25 bp, Mus musculus
aaaggcccaggctcagtggtgtaca

SEQ ID NO: 16057 - DNA, 25 bp, Mus musculus
aaaggcccagttcagcagggattta

SEQ ID NO: 16058 - DNA, 25 bp, Mus musculus
aaaggcccagttgagcagggattta

SEQ ID NO: 16059 - DNA, 25 bp, Mus musculus
aaaggccccaaactcaagcggctgg

SEQ ID NO: 16060 - DNA, 25 bp, Mus musculus
aaaggccccaaagtcaagcggctgg

SEQ ID NO: 16061 - DNA, 25 bp, Mus musculus
aaaggccccacgcctggctatgatg

SEQ ID NO: 16062 - DNA, 25 bp, Mus musculus
aaaggccccacggctggctatgatg

SEQ ID NO: 16063 - DNA, 25 bp, Mus musculus
aaaggccccatgaagtctgtgataa

SEQ ID NO: 16064 - DNA, 25 bp, Mus musculus
aaaggccccatgtagtctgtgataa

SEQ ID NO: 16065 - DNA, 25 bp, Mus musculus
aaaggccccattctctatgctaaac

SEQ ID NO: 16066 - DNA, 25 bp, Mus musculus
aaaggccccattgtctatgctaaac

SEQ ID NO: 16067 - DNA, 25 bp, Mus musculus
aaaggcccgctcaacttgaacatgg

SEQ ID NO: 16068 - DNA, 25 bp, Mus musculus
aaaggcccgctctacttgaacatgg

SEQ ID NO: 16069 - DNA, 25 bp, Mus musculus
aaaggccctatgattttatagtctt

SEQ ID NO: 16070 - DNA, 25 bp, Mus musculus
aaaggccctatgtttttatagtctt

SEQ ID NO: 16071 - DNA, 25 bp, Mus musculus
aaaggccctcttagaggccgggcag

SEQ ID NO: 16072 - DNA, 25 bp, Mus musculus
aaaggccctctttgaggccgggcag

SEQ ID NO: 16073 - DNA, 25 bp, Mus musculus
aaaggccctgctctaagcaaatcat

SEQ ID NO: 16074 - DNA, 25 bp, Mus musculus
aaaggccctgctgtaagcaaatcat

SEQ ID NO: 16075 - DNA, 25 bp, Mus musculus
aaaggccctgggagtactgtccaat

SEQ ID NO: 16076 - DNA, 25 bp, Mus musculus
aaaggccctgggtgtactgtccaat

SEQ ID NO: 16077 - DNA, 25 bp, Mus musculus
aaaggccctggtctcaggcaaggcc

SEQ ID NO: 16078 - DNA, 25 bp, Mus musculus
aaaggccctggtgtcaggcaaggcc

SEQ ID NO: 16079 - DNA, 25 bp, Mus musculus
aaaggccctgtgaggaggactgcaa

SEQ ID NO: 16080 - DNA, 25 bp, Mus musculus
aaaggccctgtgtggaggactgcaa

SEQ ID NO: 16081 - DNA, 25 bp, Mus musculus
aaaggcccttgtctgggtgactcag

SEQ ID NO: 16082 - DNA, 25 bp, Mus musculus
aaaggcccttgtgtgggtgactcag

SEQ ID NO: 16083 - DNA, 25 bp, Mus musculus
aaaggccctttaaggtcagcgctgg

SEQ ID NO: 16084 - DNA, 25 bp, Mus musculus
aaaggccctttatggtcagcgctgg

SEQ ID NO: 16085 - DNA, 25 bp, Mus musculus
aaaggccgactacaaggcttccaag

SEQ ID NO: 16086 - DNA, 25 bp, Mus musculus
aaaggccgactagaaggcttccaag

SEQ ID NO: 16087 - DNA, 25 bp, Mus musculus
aaaggccgagcgactgatggcttcc

SEQ ID NO: 16088 - DNA, 25 bp, Mus musculus
aaaggccgagcgtctgatggcttcc

SEQ ID NO: 16089 - DNA, 25 bp, Mus musculus
aaaggccgcactcttgccttgggct

SEQ ID NO: 16090 - DNA, 25 bp, Mus musculus
aaaggccgcactgttgccttgggct

SEQ ID NO: 16091 - DNA, 25 bp, Mus musculus
aaaggccgcctgatccagatgagaa

SEQ ID NO: 16092 - DNA, 25 bp, Mus musculus
aaaggccgcctgttccagatgagaa

SEQ ID NO: 16093 - DNA, 25 bp, Mus musculus
aaaggccggattcctacttcaacag

SEQ ID NO: 16094 - DNA, 25 bp, Mus musculus
aaaggccggattgctacttcaacag

SEQ ID NO: 16095 - DNA, 25 bp, Mus musculus
aaaggccggctcagcggagacagaa

SEQ ID NO: 16096 - DNA, 25 bp, Mus musculus
aaaggccggctctgcggagacagaa

SEQ ID NO: 16097 - DNA, 25 bp, Mus musculus
aaaggccgtacaaacttcaggagtc

SEQ ID NO: 16098 - DNA, 25 bp, Mus musculus
aaaggccgtacatacttcaggagtc

SEQ ID NO: 16099 - DNA, 25 bp, Mus musculus
aaaggccgtatccaactgcaacagt

SEQ ID NO: 16100 - DNA, 25 bp, Mus musculus
aaaggccgtatcgaactgcaacagt

SEQ ID NO: 16101 - DNA, 25 bp, Mus musculus
aaaggccgtgccagctgtagctcag

SEQ ID NO: 16102 - DNA, 25 bp, Mus musculus
aaaggccgtgcctgctgtagctcag

SEQ ID NO: 16103 - DNA, 25 bp, Mus musculus
aaaggccgtggcaactcctaagcag

SEQ ID NO: 16104 - DNA, 25 bp, Mus musculus
aaaggccgtggctactcctaagcag

SEQ ID NO: 16105 - DNA, 25 bp, Mus musculus
aaaggccgttgcatacagtaatcac

SEQ ID NO: 16106 - DNA, 25 bp, Mus musculus
aaaggccgttgcttacagtaatcac

SEQ ID NO: 16107 - DNA, 25 bp, Mus musculus
aaaggcctagagaactgacagcaac

SEQ ID NO: 16108 - DNA, 25 bp, Mus musculus
aaaggcctagagtactgacagcaac

SEQ ID NO: 16109 - DNA, 25 bp, Mus musculus
aaaggcctagcacagctttggcacc

SEQ ID NO: 16110 - DNA, 25 bp, Mus musculus
aaaggcctagcagagctttggcacc

SEQ ID NO: 16111 - DNA, 25 bp, Mus musculus
aaaggcctagtcctaagtctgtctc

SEQ ID NO: 16112 - DNA, 25 bp, Mus musculus
aaaggcctagtcgtaagtctgtctc

SEQ ID NO: 16113 - DNA, 25 bp, Mus musculus
aaaggcctatcgataatatctgaat

SEQ ID NO: 16114 - DNA, 25 bp, Mus musculus
aaaggcctatcgttaatatctgaat

SEQ ID NO: 16115 - DNA, 25 bp, Mus musculus
aaaggcctatctatggtgccaactc

SEQ ID NO: 16116 - DNA, 25 bp, Mus musculus
aaaggcctatctttggtgccaactc

SEQ ID NO: 16117 - DNA, 25 bp, Mus musculus
aaaggcctcaccaagtgtagataag

SEQ ID NO: 16118 - DNA, 25 bp, Mus musculus
aaaggcctcacctagtgtagataag

SEQ ID NO: 16119 - DNA, 25 bp, Mus musculus
aaaggcctcatgctgtgctggttaa

SEQ ID NO: 16120 - DNA, 25 bp, Mus musculus
aaaggcctcatggtgtgctggttaa

SEQ ID NO: 16121 - DNA, 25 bp, Mus musculus
aaaggcctccttcagagtgtacatg

SEQ ID NO: 16122 - DNA, 25 bp, Mus musculus
aaaggcctccttgagagtgtacatg

SEQ ID NO: 16123 - DNA, 25 bp, Mus musculus
aaaggcctctaacgatcaagtggat

SEQ ID NO: 16124 - DNA, 25 bp, Mus musculus
aaaggcctctaactttgtgaactga

SEQ ID NO: 16125 - DNA, 25 bp, Mus musculus
aaaggcctctaaggatcaagtggat

SEQ ID NO: 16126 - DNA, 25 bp, Mus musculus
aaaggcctctaagtttgtgaactga

SEQ ID NO: 16127 - DNA, 25 bp, Mus musculus
aaaggcctctgtcctggtgcagttt

SEQ ID NO: 16128 - DNA, 25 bp, Mus musculus
aaaggcctctgtgctggtgcagttt

SEQ ID NO: 16129 - DNA, 25 bp, Mus musculus
aaaggcctctttccacacatgggct

SEQ ID NO: 16130 - DNA, 25 bp, Mus musculus
aaaggcctctttgcacacatgggct

SEQ ID NO: 16131 - DNA, 25 bp, Mus musculus
aaaggcctgatgacctggtgtgatc

SEQ ID NO: 16132 - DNA, 25 bp, Mus musculus
aaaggcctgatgtcctggtgtgatc

SEQ ID NO: 16133 - DNA, 25 bp, Mus musculus
aaaggcctgccaccttaaggaccag

SEQ ID NO: 16134 - DNA, 25 bp, Mus musculus
aaaggcctgccagcttaaggaccag

SEQ ID NO: 16135 - DNA, 25 bp, Mus musculus
aaaggcctgcctcctgacaaaagac

SEQ ID NO: 16136 - DNA, 25 bp, Mus musculus
aaaggcctgcctgctgacaaaagac

SEQ ID NO: 16137 - DNA, 25 bp, Mus musculus
aaaggcctgcggactacattgacga

SEQ ID NO: 16138 - DNA, 25 bp, Mus musculus
aaaggcctgcggtctacattgacga

SEQ ID NO: 16139 - DNA, 25 bp, Mus musculus
aaaggcctggctcggcaacacagac

SEQ ID NO: 16140 - DNA, 25 bp, Mus musculus
aaaggcctggctgggcaacacagac

SEQ ID NO: 16141 - DNA, 25 bp, Mus musculus
aaaggcctgtgcctgaagcacttgg

SEQ ID NO: 16142 - DNA, 25 bp, Mus musculus
aaaggcctgtgcgtgaagcacttgg

SEQ ID NO: 16143 - DNA, 25 bp, Mus musculus
aaaggccttcaacttcagcctccaa

SEQ ID NO: 16144 - DNA, 25 bp, Mus musculus
aaaggccttcaagttcagcctccaa

SEQ ID NO: 16145 - DNA, 25 bp, Mus musculus
aaaggccttcctcgcatggcgctgt

SEQ ID NO: 16146 - DNA, 25 bp, Mus musculus
aaaggccttcctctgaatctatggg

SEQ ID NO: 16147 - DNA, 25 bp, Mus musculus
aaaggccttcctcttcgtgacatgg

SEQ ID NO: 16148 - DNA, 25 bp, Mus musculus
aaaggccttcctggcatggcgctgt

SEQ ID NO: 16149 - DNA, 25 bp, Mus musculus
aaaggccttcctgtgaatctatggg

SEQ ID NO: 16150 - DNA, 25 bp, Mus musculus
aaaggccttcctgttcgtgacatgg

SEQ ID NO: 16151 - DNA, 25 bp, Mus musculus
aaaggccttgagagtgaattccaac

SEQ ID NO: 16152 - DNA, 25 bp, Mus musculus
aaaggccttgagtgtgaattccaac

SEQ ID NO: 16153 - DNA, 25 bp, Mus musculus
aaaggccttgcaattctgatgcgct

SEQ ID NO: 16154 - DNA, 25 bp, Mus musculus
aaaggccttgcatttctgatgcgct

SEQ ID NO: 16155 - DNA, 25 bp, Mus musculus
aaaggccttgttaattcggtgcctg

SEQ ID NO: 16156 - DNA, 25 bp, Mus musculus
aaaggccttgtttattcggtgcctg

SEQ ID NO: 16157 - DNA, 25 bp, Mus musculus
aaaggcctttttactgctggtatga

SEQ ID NO: 16158 - DNA, 25 bp, Mus musculus
aaaggccttttttctgctggtatga

SEQ ID NO: 16159 - DNA, 25 bp, Mus musculus
aaaggcgaatgtctgaagaggctcc

SEQ ID NO: 16160 - DNA, 25 bp, Mus musculus
aaaggcgaatgtgtgaagaggctcc

SEQ ID NO: 16161 - DNA, 25 bp, Mus musculus
aaaggcgactccacattgtatctac

SEQ ID NO: 16162 - DNA, 25 bp, Mus musculus
aaaggcgactcctcattgtatctac

SEQ ID NO: 16163 - DNA, 25 bp, Mus musculus
aaaggcgagcatcctggcttatcca

SEQ ID NO: 16164 - DNA, 25 bp, Mus musculus
aaaggcgagcatgctggcttatcca

SEQ ID NO: 16165 - DNA, 25 bp, Mus musculus
aaaggcgaggccctgcaagcatttg

SEQ ID NO: 16166 - DNA, 25 bp, Mus musculus
aaaggcgaggccgtgcaagcatttg

SEQ ID NO: 16167 - DNA, 25 bp, Mus musculus
aaaggcgagggcaaccagtagaagc

SEQ ID NO: 16168 - DNA, 25 bp, Mus musculus
aaaggcgagggctaccagtagaagc

SEQ ID NO: 16169 - DNA, 25 bp, Mus musculus
aaaggcgagtgcctagtccagcctg

SEQ ID NO: 16170 - DNA, 25 bp, Mus musculus
aaaggcgagtgcgtagtccagcctg

SEQ ID NO: 16171 - DNA, 25 bp, Mus musculus
aaaggcgatcttaaggggctgtcca

SEQ ID NO: 16172 - DNA, 25 bp, Mus musculus
aaaggcgatctttaggggctgtcca

SEQ ID NO: 16173 - DNA, 25 bp, Mus musculus
aaaggcgatgcgaccgtcatttaaa

SEQ ID NO: 16174 - DNA, 25 bp, Mus musculus
aaaggcgatgcgtccgtcatttaaa

SEQ ID NO: 16175 - DNA, 25 bp, Mus musculus
aaaggcgcattaccagagactggag

SEQ ID NO: 16176 - DNA, 25 bp, Mus musculus
aaaggcgcattagcagagactggag

SEQ ID NO: 16177 - DNA, 25 bp, Mus musculus
aaaggcgccgcgcacaagtgcacgt

SEQ ID NO: 16178 - DNA, 25 bp, Mus musculus
aaaggcgccgcggacaagtgcacgt

SEQ ID NO: 16179 - DNA, 25 bp, Mus musculus
aaaggcgcctagatacgggtcatgt

SEQ ID NO: 16180 - DNA, 25 bp, Mus musculus
aaaggcgcctagttacgggtcatgt

SEQ ID NO: 16181 - DNA, 25 bp, Mus musculus
aaaggcgctgaccactcagttgaca

SEQ ID NO: 16182 - DNA, 25 bp, Mus musculus
aaaggcgctgacgactcagttgaca

SEQ ID NO: 16183 - DNA, 25 bp, Mus musculus
aaaggcgctggtaactgaagccgga

SEQ ID NO: 16184 - DNA, 25 bp, Mus musculus
aaaggcgctggttactgaagccgga

SEQ ID NO: 16185 - DNA, 25 bp, Mus musculus
aaaggcgcttaaacggcctccaacg

SEQ ID NO: 16186 - DNA, 25 bp, Mus musculus
aaaggcgcttaatcggcctccaacg

SEQ ID NO: 16187 - DNA, 25 bp, Mus musculus
aaaggcggaattaactcctccagca

SEQ ID NO: 16188 - DNA, 25 bp, Mus musculus
aaaggcggaatttactcctccagca

SEQ ID NO: 16189 - DNA, 25 bp, Mus musculus
aaaggcggacacctactgtgcatag

SEQ ID NO: 16190 - DNA, 25 bp, Mus musculus
aaaggcggacacgtactgtgcatag

SEQ ID NO: 16191 - DNA, 25 bp, Mus musculus
aaaggcggcacacacaacaacagct

SEQ ID NO: 16192 - DNA, 25 bp, Mus musculus
aaaggcggcacagacaacaacagct

SEQ ID NO: 16193 - DNA, 25 bp, Mus musculus
aaaggcggcctcattcaagctgcag

SEQ ID NO: 16194 - DNA, 25 bp, Mus musculus
aaaggcggcctctttcaagctgcag

SEQ ID NO: 16195 - DNA, 25 bp, Mus musculus
aaaggcggcttaatctctactccag

SEQ ID NO: 16196 - DNA, 25 bp, Mus musculus
aaaggcggcttattctctactccag

SEQ ID NO: 16197 - DNA, 25 bp, Mus musculus
aaaggcggcttgagtggtatacatc

SEQ ID NO: 16198 - DNA, 25 bp, Mus musculus
aaaggcggcttgtgtggtatacatc

SEQ ID NO: 16199 - DNA, 25 bp, Mus musculus
aaaggcgggaacctcagggcttcat

SEQ ID NO: 16200 - DNA, 25 bp, Mus musculus
aaaggcgggaacgtcagggcttcat

SEQ ID NO: 16201 - DNA, 25 bp, Mus musculus
aaaggcgggcatataacagtgtaga

SEQ ID NO: 16202 - DNA, 25 bp, Mus musculus
aaaggcgggcatttaacagtgtaga

SEQ ID NO: 16203 - DNA, 25 bp, Mus musculus
aaaggcggtatacttcactgatgct

SEQ ID NO: 16204 - DNA, 25 bp, Mus musculus
aaaggcggtatagttcactgatgct

SEQ ID NO: 16205 - DNA, 25 bp, Mus musculus
aaaggcggtgctatcaaatgagact

SEQ ID NO: 16206 - DNA, 25 bp, Mus musculus
aaaggcggtgctttcaaatgagact

SEQ ID NO: 16207 - DNA, 25 bp, Mus musculus
aaaggcggtggaactcctgaaggct

SEQ ID NO: 16208 - DNA, 25 bp, Mus musculus
aaaggcggtggatctcctgaaggct

SEQ ID NO: 16209 - DNA, 25 bp, Mus musculus
aaaggcgtcgacctctatgtcctgg

SEQ ID NO: 16210 - DNA, 25 bp, Mus musculus
aaaggcgtcgacgtctatgtcctgg

SEQ ID NO: 16211 - DNA, 25 bp, Mus musculus
aaaggcgtctgcacacaagcaagca

SEQ ID NO: 16212 - DNA, 25 bp, Mus musculus
aaaggcgtctgctcacaagcaagca

SEQ ID NO: 16213 - DNA, 25 bp, Mus musculus
aaaggcgtgacgaagctcagcatat

SEQ ID NO: 16214 - DNA, 25 bp, Mus musculus
aaaggcgtgacgtagctcagcatat

SEQ ID NO: 16215 - DNA, 25 bp, Mus musculus
aaaggcgtgagactgggctacttcc

SEQ ID NO: 16216 - DNA, 25 bp, Mus musculus
aaaggcgtgagagtgggctacttcc

SEQ ID NO: 16217 - DNA, 25 bp, Mus musculus
aaaggcgtgctcatgttcccgtctg

SEQ ID NO: 16218 - DNA, 25 bp, Mus musculus
aaaggcgtgctcttgttcccgtctg

SEQ ID NO: 16219 - DNA, 25 bp, Mus musculus
aaaggcgtgcttactaccaaggctg

SEQ ID NO: 16220 - DNA, 25 bp, Mus musculus
aaaggcgtgctttctaccaaggctg

SEQ ID NO: 16221 - DNA, 25 bp, Mus musculus
aaaggcgtggacagcgctgctctca

SEQ ID NO: 16222 - DNA, 25 bp, Mus musculus
aaaggcgtggactgcgctgctctca

SEQ ID NO: 16223 - DNA, 25 bp, Mus musculus
aaaggcgtgtacaatcgctcctaat

SEQ ID NO: 16224 - DNA, 25 bp, Mus musculus
aaaggcgtgtactatcgctcctaat

SEQ ID NO: 16225 - DNA, 25 bp, Mus musculus
aaaggcgttatgcattgatcagctt

SEQ ID NO: 16226 - DNA, 25 bp, Mus musculus
aaaggcgttatggattgatcagctt

SEQ ID NO: 16227 - DNA, 25 bp, Mus musculus
aaaggcgttcaactgagctgtaaaa

SEQ ID NO: 16228 - DNA, 25 bp, Mus musculus
aaaggcgttcaagtgagctgtaaaa

SEQ ID NO: 16229 - DNA, 25 bp, Mus musculus
aaaggcgttcgtactgacactgtgc

SEQ ID NO: 16230 - DNA, 25 bp, Mus musculus
aaaggcgttcgttctgacactgtgc

SEQ ID NO: 16231 - DNA, 25 bp, Mus musculus
aaaggctaacccaattgacacacct

SEQ ID NO: 16232 - DNA, 25 bp, Mus musculus
aaaggctaaccctattgacacacct

SEQ ID NO: 16233 - DNA, 25 bp, Mus musculus
aaaggctaagagagtcatcagataa

SEQ ID NO: 16234 - DNA, 25 bp, Mus musculus
aaaggctaagagtgtcatcagataa

SEQ ID NO: 16235 - DNA, 25 bp, Mus musculus
aaaggctaagcgaggtccttggatt

SEQ ID NO: 16236 - DNA, 25 bp, Mus musculus
aaaggctaagcgtggtccttggatt

SEQ ID NO: 16237 - DNA, 25 bp, Mus musculus
aaaggctaatggctcgcagcctact

SEQ ID NO: 16238 - DNA, 25 bp, Mus musculus
aaaggctaatgggtcgcagcctact

SEQ ID NO: 16239 - DNA, 25 bp, Mus musculus
aaaggctaattcagcgtccaggatt

SEQ ID NO: 16240 - DNA, 25 bp, Mus musculus
aaaggctaattcaggcttacgatct

SEQ ID NO: 16241 - DNA, 25 bp, Mus musculus
aaaggctaattctgcgtccaggatt

SEQ ID NO: 16242 - DNA, 25 bp, Mus musculus
aaaggctaattctggcttacgatct

SEQ ID NO: 16243 - DNA, 25 bp, Mus musculus
aaaggctacaggacttcatccacat

SEQ ID NO: 16244 - DNA, 25 bp, Mus musculus
aaaggctacaggtcttcatccacat

SEQ ID NO: 16245 - DNA, 25 bp, Mus musculus
aaaggctacagtatgccggccatcc

SEQ ID NO: 16246 - DNA, 25 bp, Mus musculus
aaaggctacagtcttgccaacagtc

SEQ ID NO: 16247 - DNA, 25 bp, Mus musculus
aaaggctacagtgttgccaacagtc

SEQ ID NO: 16248 - DNA, 25 bp, Mus musculus
aaaggctacagtttgccggccatcc

SEQ ID NO: 16249 - DNA, 25 bp, Mus musculus
aaaggctaccggagcccttggcagg

SEQ ID NO: 16250 - DNA, 25 bp, Mus musculus
aaaggctaccggtgcccttggcagg

SEQ ID NO: 16251 - DNA, 25 bp, Mus musculus
aaaggctacctcagctgaacggtct

SEQ ID NO: 16252 - DNA, 25 bp, Mus musculus
aaaggctacctctgctgaacggtct

SEQ ID NO: 16253 - DNA, 25 bp, Mus musculus
aaaggctactccaaggaacttgcca

SEQ ID NO: 16254 - DNA, 25 bp, Mus musculus
aaaggctactcctaggaacttgcca

SEQ ID NO: 16255 - DNA, 25 bp, Mus musculus
aaaggctagagcagaccctgttctg

SEQ ID NO: 16256 - DNA, 25 bp, Mus musculus
aaaggctagagctgaccctgttctg

SEQ ID NO: 16257 - DNA, 25 bp, Mus musculus
aaaggctagcagaaactgttcgagc

SEQ ID NO: 16258 - DNA, 25 bp, Mus musculus
aaaggctagcagtaactgttcgagc

SEQ ID NO: 16259 - DNA, 25 bp, Mus musculus
aaaggctagcccagggtgtctggct

SEQ ID NO: 16260 - DNA, 25 bp, Mus musculus
aaaggctagccctgggtgtctggct

SEQ ID NO: 16261 - DNA, 25 bp, Mus musculus
aaaggctagcgcattgttgacccaa

SEQ ID NO: 16262 - DNA, 25 bp, Mus musculus
aaaggctagcgctttgttgacccaa

SEQ ID NO: 16263 - DNA, 25 bp, Mus musculus
aaaggctaggacactttcagctcat

SEQ ID NO: 16264 - DNA, 25 bp, Mus musculus
aaaggctaggactctttcagctcat

SEQ ID NO: 16265 - DNA, 25 bp, Mus musculus
aaaggctagtacacagtgttcttac

SEQ ID NO: 16266 - DNA, 25 bp, Mus musculus
aaaggctagtactcagtgttcttac

SEQ ID NO: 16267 - DNA, 25 bp, Mus musculus
aaaggctagtccaaagtccttcctg

SEQ ID NO: 16268 - DNA, 25 bp, Mus musculus
aaaggctagtcctaagtccttcctg

SEQ ID NO: 16269 - DNA, 25 bp, Mus musculus
aaaggctagttactgtgtcctacat

SEQ ID NO: 16270 - DNA, 25 bp, Mus musculus
aaaggctagttagtgtgtcctacat

SEQ ID NO: 16271 - DNA, 25 bp, Mus musculus
aaaggctatagaagtagtgatactc

SEQ ID NO: 16272 - DNA, 25 bp, Mus musculus
aaaggctatagatgtagtgatactc

SEQ ID NO: 16273 - DNA, 25 bp, Mus musculus
aaaggctatgccaggatgggcctgt

SEQ ID NO: 16274 - DNA, 25 bp, Mus musculus
aaaggctatgcctggatgggcctgt

SEQ ID NO: 16275 - DNA, 25 bp, Mus musculus
aaaggctatgctcaatgctgtcctc

SEQ ID NO: 16276 - DNA, 25 bp, Mus musculus
aaaggctatgctgaatgctgtcctc

SEQ ID NO: 16277 - DNA, 25 bp, Mus musculus
aaaggctatgttaggcgctcagctg

SEQ ID NO: 16278 - DNA, 25 bp, Mus musculus
aaaggctatgtttggcgctcagctg

SEQ ID NO: 16279 - DNA, 25 bp, Mus musculus
aaaggctatttaccagactcagtga

SEQ ID NO: 16280 - DNA, 25 bp, Mus musculus
aaaggctatttagcagactcagtga

SEQ ID NO: 16281 - DNA, 25 bp, Mus musculus
aaaggctcaaaacttgcccttcagc

SEQ ID NO: 16282 - DNA, 25 bp, Mus musculus
aaaggctcaaaagttgcccttcagc

SEQ ID NO: 16283 - DNA, 25 bp, Mus musculus
aaaggctcaaacatgcacctgaaga

SEQ ID NO: 16284 - DNA, 25 bp, Mus musculus
aaaggctcaaacttgcacctgaaga

SEQ ID NO: 16285 - DNA, 25 bp, Mus musculus
aaaggctcaagcactacgacgacca

SEQ ID NO: 16286 - DNA, 25 bp, Mus musculus
aaaggctcaagctctacgacgacca

SEQ ID NO: 16287 - DNA, 25 bp, Mus musculus
aaaggctcacacacctgttaatgga

SEQ ID NO: 16288 - DNA, 25 bp, Mus musculus
aaaggctcacactcctgttaatgga

SEQ ID NO: 16289 - DNA, 25 bp, Mus musculus
aaaggctcacatactgcatcttgtt

SEQ ID NO: 16290 - DNA, 25 bp, Mus musculus
aaaggctcacattctgcatcttgtt

SEQ ID NO: 16291 - DNA, 25 bp, Mus musculus
aaaggctcaccactttgtggctgtt

SEQ ID NO: 16292 - DNA, 25 bp, Mus musculus
aaaggctcaccagtttgtggctgtt

SEQ ID NO: 16293 - DNA, 25 bp, Mus musculus
aaaggctcaggcaggtgttcttcct

SEQ ID NO: 16294 - DNA, 25 bp, Mus musculus
aaaggctcaggctggtgttcttcct

SEQ ID NO: 16295 - DNA, 25 bp, Mus musculus
aaaggctcagggatctacagacaag

SEQ ID NO: 16296 - DNA, 25 bp, Mus musculus
aaaggctcagggttctacagacaag

SEQ ID NO: 16297 - DNA, 25 bp, Mus musculus
aaaggctcaggtagaacttcagtgt

SEQ ID NO: 16298 - DNA, 25 bp, Mus musculus
aaaggctcaggttgaacttcagtgt

SEQ ID NO: 16299 - DNA, 25 bp, Mus musculus
aaaggctcatccaggtgacaactcc

SEQ ID NO: 16300 - DNA, 25 bp, Mus musculus
aaaggctcatcctggtgacaactcc

SEQ ID NO: 16301 - DNA, 25 bp, Mus musculus
aaaggctcattaaacagtcgcactg

SEQ ID NO: 16302 - DNA, 25 bp, Mus musculus
aaaggctcattatacagtcgcactg

SEQ ID NO: 16303 - DNA, 25 bp, Mus musculus
aaaggctccacaataaaattctctg

SEQ ID NO: 16304 - DNA, 25 bp, Mus musculus
aaaggctccacattaaaattctctg

SEQ ID NO: 16305 - DNA, 25 bp, Mus musculus
aaaggctccagtcatcctgttgcag

SEQ ID NO: 16306 - DNA, 25 bp, Mus musculus
aaaggctccagtgatcctgttgcag

SEQ ID NO: 16307 - DNA, 25 bp, Mus musculus
aaaggctccataatcccatctttgc

SEQ ID NO: 16308 - DNA, 25 bp, Mus musculus
aaaggctccatattcccatctttgc

SEQ ID NO: 16309 - DNA, 25 bp, Mus musculus
aaaggctccctgaggattgggccct

SEQ ID NO: 16310 - DNA, 25 bp, Mus musculus
aaaggctccctgtggattgggccct

SEQ ID NO: 16311 - DNA, 25 bp, Mus musculus
aaaggctcctatcccaagtacagct

SEQ ID NO: 16312 - DNA, 25 bp, Mus musculus
aaaggctcctatgccaagtacagct

SEQ ID NO: 16313 - DNA, 25 bp, Mus musculus
aaaggctcctcaccattatgtcctg

SEQ ID NO: 16314 - DNA, 25 bp, Mus musculus
aaaggctcctcagcattatgtcctg

SEQ ID NO: 16315 - DNA, 25 bp, Mus musculus
aaaggctcctggctacgaactatac

SEQ ID NO: 16316 - DNA, 25 bp, Mus musculus
aaaggctcctgggtacgaactatac

SEQ ID NO: 16317 - DNA, 25 bp, Mus musculus
aaaggctccttgatcccggatgtgg

SEQ ID NO: 16318 - DNA, 25 bp, Mus musculus
aaaggctccttgctggtctatgtga

SEQ ID NO: 16319 - DNA, 25 bp, Mus musculus
aaaggctccttggtggtctatgtga

SEQ ID NO: 16320 - DNA, 25 bp, Mus musculus
aaaggctccttgttcccggatgtgg

SEQ ID NO: 16321 - DNA, 25 bp, Mus musculus
aaaggctcgactcgagatcgaacca

SEQ ID NO: 16322 - DNA, 25 bp, Mus musculus
aaaggctcgactggagatcgaacca

SEQ ID NO: 16323 - DNA, 25 bp, Mus musculus
aaaggctctacactacttcttgcca

SEQ ID NO: 16324 - DNA, 25 bp, Mus musculus
aaaggctctacagtacttcttgcca

SEQ ID NO: 16325 - DNA, 25 bp, Mus musculus
aaaggctctatcaaccacctgtgtg

SEQ ID NO: 16326 - DNA, 25 bp, Mus musculus
aaaggctctatctaccacctgtgtg

SEQ ID NO: 16327 - DNA, 25 bp, Mus musculus
aaaggctctcccagggtggcagtct

SEQ ID NO: 16328 - DNA, 25 bp, Mus musculus
aaaggctctccctgggtggcagtct

SEQ ID NO: 16329 - DNA, 25 bp, Mus musculus
aaaggctctgacagttgtttctcta

SEQ ID NO: 16330 - DNA, 25 bp, Mus musculus
aaaggctctgactgttgtttctcta

SEQ ID NO: 16331 - DNA, 25 bp, Mus musculus
aaaggctctgagcagaagcagacat

SEQ ID NO: 16332 - DNA, 25 bp, Mus musculus
aaaggctctgaggagaagcagacat

SEQ ID NO: 16333 - DNA, 25 bp, Mus musculus
aaaggctctgccattgcactggtct

SEQ ID NO: 16334 - DNA, 25 bp, Mus musculus
aaaggctctgcctttgcactggtct

SEQ ID NO: 16335 - DNA, 25 bp, Mus musculus
aaaggctctgggatgttggtacagt

SEQ ID NO: 16336 - DNA, 25 bp, Mus musculus
aaaggctctgggttgttggtacagt

SEQ ID NO: 16337 - DNA, 25 bp, Mus musculus
aaaggctctggtattgtaaaagcag

SEQ ID NO: 16338 - DNA, 25 bp, Mus musculus
aaaggctctggttttgtaaaagcag

SEQ ID NO: 16339 - DNA, 25 bp, Mus musculus
aaaggctgaaggcactgggcttccc

SEQ ID NO: 16340 - DNA, 25 bp, Mus musculus
aaaggctgaagggactgggcttccc

SEQ ID NO: 16341 - DNA, 25 bp, Mus musculus
aaaggctgacaacgctcgttatgaa

SEQ ID NO: 16342 - DNA, 25 bp, Mus musculus
aaaggctgacaaggctcgttatgaa

SEQ ID NO: 16343 - DNA, 25 bp, Mus musculus
aaaggctgacagatgctatgcaaca

SEQ ID NO: 16344 - DNA, 25 bp, Mus musculus
aaaggctgacagttgctatgcaaca

SEQ ID NO: 16345 - DNA, 25 bp, Mus musculus
aaaggctgacttattattcacctca

SEQ ID NO: 16346 - DNA, 25 bp, Mus musculus
aaaggctgactttttattcacctca

SEQ ID NO: 16347 - DNA, 25 bp, Mus musculus
aaaggctgaggtcttccctagcctg

SEQ ID NO: 16348 - DNA, 25 bp, Mus musculus
aaaggctgaggtgttccctagcctg

SEQ ID NO: 16349 - DNA, 25 bp, Mus musculus
aaaggctgatggctggcccagttat

SEQ ID NO: 16350 - DNA, 25 bp, Mus musculus
aaaggctgatgggtggcccagttat

SEQ ID NO: 16351 - DNA, 25 bp, Mus musculus
aaaggctgcaaacactaggagtata

SEQ ID NO: 16352 - DNA, 25 bp, Mus musculus
aaaggctgcaaagactaggagtata

SEQ ID NO: 16353 - DNA, 25 bp, Mus musculus
aaaggctgcaagcacgccctgaagt

SEQ ID NO: 16354 - DNA, 25 bp, Mus musculus
aaaggctgcaaggacgccctgaagt

SEQ ID NO: 16355 - DNA, 25 bp, Mus musculus
aaaggctgcatgacaatccttccaa

SEQ ID NO: 16356 - DNA, 25 bp, Mus musculus
aaaggctgcatgcacctctacaggc

SEQ ID NO: 16357 - DNA, 25 bp, Mus musculus
aaaggctgcatggacctctacaggc

SEQ ID NO: 16358 - DNA, 25 bp, Mus musculus
aaaggctgcatgtcaatccttccaa

SEQ ID NO: 16359 - DNA, 25 bp, Mus musculus
aaaggctgcgccaagaggcaaagga

SEQ ID NO: 16360 - DNA, 25 bp, Mus musculus
aaaggctgcgcctagaggcaaagga

SEQ ID NO: 16361 - DNA, 25 bp, Mus musculus
aaaggctgcgttcagttcccagatc

SEQ ID NO: 16362 - DNA, 25 bp, Mus musculus
aaaggctgcgttgagttcccagatc

SEQ ID NO: 16363 - DNA, 25 bp, Mus musculus
aaaggctgctctatggcgtgagaag

SEQ ID NO: 16364 - DNA, 25 bp, Mus musculus
aaaggctgctctttggcgtgagaag

SEQ ID NO: 16365 - DNA, 25 bp, Mus musculus
aaaggctgctgcagggggtattcct

SEQ ID NO: 16366 - DNA, 25 bp, Mus musculus
aaaggctgctgctgggggtattcct

SEQ ID NO: 16367 - DNA, 25 bp, Mus musculus
aaaggctgcttactcatttcccaga

SEQ ID NO: 16368 - DNA, 25 bp, Mus musculus
aaaggctgcttagtcatttcccaga

SEQ ID NO: 16369 - DNA, 25 bp, Mus musculus
aaaggctgcttcacatgcccgaggc

SEQ ID NO: 16370 - DNA, 25 bp, Mus musculus
aaaggctgcttcagagccagaggcc

SEQ ID NO: 16371 - DNA, 25 bp, Mus musculus
aaaggctgcttctcatgcccgaggc

SEQ ID NO: 16372 - DNA, 25 bp, Mus musculus
aaaggctgcttctgagccagaggcc

SEQ ID NO: 16373 - DNA, 25 bp, Mus musculus
aaaggctgcttgacctggcttcaga

SEQ ID NO: 16374 - DNA, 25 bp, Mus musculus
aaaggctgcttgtcctggcttcaga

SEQ ID NO: 16375 - DNA, 25 bp, Mus musculus
aaaggctggagcatcatgcatcctg

SEQ ID NO: 16376 - DNA, 25 bp, Mus musculus
aaaggctggagcttcatgcatcctg

SEQ ID NO: 16377 - DNA, 25 bp, Mus musculus
aaaggctggaggctctctttatgtc

SEQ ID NO: 16378 - DNA, 25 bp, Mus musculus
aaaggctggagggtctctttatgtc

SEQ ID NO: 16379 - DNA, 25 bp, Mus musculus
aaaggctggcagacagggatctcat

SEQ ID NO: 16380 - DNA, 25 bp, Mus musculus
aaaggctggcagtcagggatctcat

SEQ ID NO: 16381 - DNA, 25 bp, Mus musculus
aaaggctggctgagcataattgaat

SEQ ID NO: 16382 - DNA, 25 bp, Mus musculus
aaaggctggctgtgcataattgaat

SEQ ID NO: 16383 - DNA, 25 bp, Mus musculus
aaaggctgggacaggtcctcaggca

SEQ ID NO: 16384 - DNA, 25 bp, Mus musculus
aaaggctgggactggtcctcaggca

SEQ ID NO: 16385 - DNA, 25 bp, Mus musculus
aaaggctgggcacacatggcagtct

SEQ ID NO: 16386 - DNA, 25 bp, Mus musculus
aaaggctgggcagacatggcagtct

SEQ ID NO: 16387 - DNA, 25 bp, Mus musculus
aaaggctgggctcttcttcctaagc

SEQ ID NO: 16388 - DNA, 25 bp, Mus musculus
aaaggctgggctgttcttcctaagc

SEQ ID NO: 16389 - DNA, 25 bp, Mus musculus
aaaggctggtgactctccatgggaa

SEQ ID NO: 16390 - DNA, 25 bp, Mus musculus
aaaggctggtgagtctccatgggaa

SEQ ID NO: 16391 - DNA, 25 bp, Mus musculus
aaaggctgtatccttcaacactctc

SEQ ID NO: 16392 - DNA, 25 bp, Mus musculus
aaaggctgtatcgttcaacactctc

SEQ ID NO: 16393 - DNA, 25 bp, Mus musculus
aaaggctgtccccatatactttgac

SEQ ID NO: 16394 - DNA, 25 bp, Mus musculus
aaaggctgtcccgatatactttgac

SEQ ID NO: 16395 - DNA, 25 bp, Mus musculus
aaaggctgtgaaatgctggagatgc

SEQ ID NO: 16396 - DNA, 25 bp, Mus musculus
aaaggctgtgaattgctggagatgc

SEQ ID NO: 16397 - DNA, 25 bp, Mus musculus
aaaggctgtgagattgaccccaatc

SEQ ID NO: 16398 - DNA, 25 bp, Mus musculus
aaaggctgtgagcaaccttccttcc

SEQ ID NO: 16399 - DNA, 25 bp, Mus musculus
aaaggctgtgaggaaccttccttcc

SEQ ID NO: 16400 - DNA, 25 bp, Mus musculus
aaaggctgtgagtttgaccccaatc

SEQ ID NO: 16401 - DNA, 25 bp, Mus musculus
aaaggctgtggtacctgaccttgtt

SEQ ID NO: 16402 - DNA, 25 bp, Mus musculus
aaaggctgtggttcctgaccttgtt

SEQ ID NO: 16403 - DNA, 25 bp, Mus musculus
aaaggctgtgtgcatctcagctcct

SEQ ID NO: 16404 - DNA, 25 bp, Mus musculus
aaaggctgtgtggatctcagctcct

SEQ ID NO: 16405 - DNA, 25 bp, Mus musculus
aaaggctgttgaaatggcatcggaa

SEQ ID NO: 16406 - DNA, 25 bp, Mus musculus
aaaggctgttgatatggcatcggaa

SEQ ID NO: 16407 - DNA, 25 bp, Mus musculus
aaaggctgttttcttcatgcatgca

SEQ ID NO: 16408 - DNA, 25 bp, Mus musculus
aaaggctgttttgttcatgcatgca

SEQ ID NO: 16409 - DNA, 25 bp, Mus musculus
aaaggcttcacaatcttacgactga

SEQ ID NO: 16410 - DNA, 25 bp, Mus musculus
aaaggcttcacattcttacgactga

SEQ ID NO: 16411 - DNA, 25 bp, Mus musculus
aaaggcttcagaaatatcctgtaaa

SEQ ID NO: 16412 - DNA, 25 bp, Mus musculus
aaaggcttcagatatatcctgtaaa

SEQ ID NO: 16413 - DNA, 25 bp, Mus musculus
aaaggcttcatgaggctggatgcca

SEQ ID NO: 16414 - DNA, 25 bp, Mus musculus
aaaggcttcatgtggctggatgcca

SEQ ID NO: 16415 - DNA, 25 bp, Mus musculus
aaaggcttcattaccattgttgatg

SEQ ID NO: 16416 - DNA, 25 bp, Mus musculus
aaaggcttcatttccattgttgatg

SEQ ID NO: 16417 - DNA, 25 bp, Mus musculus
aaaggcttccagaaaggtggcaata

SEQ ID NO: 16418 - DNA, 25 bp, Mus musculus
aaaggcttccagtaaggtggcaata

SEQ ID NO: 16419 - DNA, 25 bp, Mus musculus
aaaggcttccgacggtgaccacagt

SEQ ID NO: 16420 - DNA, 25 bp, Mus musculus
aaaggcttccgagggtgaccacagt

SEQ ID NO: 16421 - DNA, 25 bp, Mus musculus
aaaggcttccttcctttctgatgtc

SEQ ID NO: 16422 - DNA, 25 bp, Mus musculus
aaaggcttccttgctttctgatgtc

SEQ ID NO: 16423 - DNA, 25 bp, Mus musculus
aaaggcttcgcgctgctgttctctg

SEQ ID NO: 16424 - DNA, 25 bp, Mus musculus
aaaggcttcgcggtgctgttctctg

SEQ ID NO: 16425 - DNA, 25 bp, Mus musculus
aaaggcttcgtacctaccgatgcac

SEQ ID NO: 16426 - DNA, 25 bp, Mus musculus
aaaggcttcgtagctaccgatgcac

SEQ ID NO: 16427 - DNA, 25 bp, Mus musculus
aaaggcttctcaagactgtctgtct

SEQ ID NO: 16428 - DNA, 25 bp, Mus musculus
aaaggcttctcatgactgtctgtct

SEQ ID NO: 16429 - DNA, 25 bp, Mus musculus
aaaggcttctccaactttggtgaag

SEQ ID NO: 16430 - DNA, 25 bp, Mus musculus
aaaggcttctcctactttggtgaag

SEQ ID NO: 16431 - DNA, 25 bp, Mus musculus
aaaggcttctgacgcctgatggtca

SEQ ID NO: 16432 - DNA, 25 bp, Mus musculus
aaaggcttctgaggcctgatggtca

SEQ ID NO: 16433 - DNA, 25 bp, Mus musculus
aaaggcttctgcattcatccttaca

SEQ ID NO: 16434 - DNA, 25 bp, Mus musculus
aaaggcttctgctttcatccttaca

SEQ ID NO: 16435 - DNA, 25 bp, Mus musculus
aaaggcttgaaacagtgcggttcca

SEQ ID NO: 16436 - DNA, 25 bp, Mus musculus
aaaggcttgaaagagtgcggttcca

SEQ ID NO: 16437 - DNA, 25 bp, Mus musculus
aaaggcttgaagacggtccacgcca

SEQ ID NO: 16438 - DNA, 25 bp, Mus musculus
aaaggcttgaagtcggtccacgcca

SEQ ID NO: 16439 - DNA, 25 bp, Mus musculus
aaaggcttgccacaatgtgaagaat

SEQ ID NO: 16440 - DNA, 25 bp, Mus musculus
aaaggcttgccagaatgtgaagaat

SEQ ID NO: 16441 - DNA, 25 bp, Mus musculus
aaaggcttgctccagtgttctttgc

SEQ ID NO: 16442 - DNA, 25 bp, Mus musculus
aaaggcttgctcgagtgttctttgc

SEQ ID NO: 16443 - DNA, 25 bp, Mus musculus
aaaggcttgcttagagctatgtttg

SEQ ID NO: 16444 - DNA, 25 bp, Mus musculus
aaaggcttgctttgagctatgtttg

SEQ ID NO: 16445 - DNA, 25 bp, Mus musculus
aaaggcttggttaccatacggcaga

SEQ ID NO: 16446 - DNA, 25 bp, Mus musculus
aaaggcttggtttccatacggcaga

SEQ ID NO: 16447 - DNA, 25 bp, Mus musculus
aaaggcttgtctcgcagccacgggc

SEQ ID NO: 16448 - DNA, 25 bp, Mus musculus
aaaggcttgtctggcagccacgggc

SEQ ID NO: 16449 - DNA, 25 bp, Mus musculus
aaaggcttgtgcacactgcttccca

SEQ ID NO: 16450 - DNA, 25 bp, Mus musculus
aaaggcttgtgctcactgcttccca

SEQ ID NO: 16451 - DNA, 25 bp, Mus musculus
aaaggctttaggctatcacgagaca

SEQ ID NO: 16452 - DNA, 25 bp, Mus musculus
aaaggctttagggtatcacgagaca

SEQ ID NO: 16453 - DNA, 25 bp, Mus musculus
aaaggctttatgcagcctgcaaata

SEQ ID NO: 16454 - DNA, 25 bp, Mus musculus
aaaggctttatggagcctgcaaata

SEQ ID NO: 16455 - DNA, 25 bp, Mus musculus
aaaggctttattattaacagaccag

SEQ ID NO: 16456 - DNA, 25 bp, Mus musculus
aaaggctttatttttaacagaccag

SEQ ID NO: 16457 - DNA, 25 bp, Mus musculus
aaaggctttcctactacagagagaa

SEQ ID NO: 16458 - DNA, 25 bp, Mus musculus
aaaggctttccttctacagagagaa

SEQ ID NO: 16459 - DNA, 25 bp, Mus musculus
aaaggctttctacgaggccaaatgt

SEQ ID NO: 16460 - DNA, 25 bp, Mus musculus
aaaggctttctaggaggccaaatgt

SEQ ID NO: 16461 - DNA, 25 bp, Mus musculus
aaaggctttcttacattcaaattgg

SEQ ID NO: 16462 - DNA, 25 bp, Mus musculus
aaaggctttctttcattcaaattgg

SEQ ID NO: 16463 - DNA, 25 bp, Mus musculus
aaaggctttggaatccagtggcttt

SEQ ID NO: 16464 - DNA, 25 bp, Mus musculus
aaaggctttggattccagtggcttt

SEQ ID NO: 16465 - DNA, 25 bp, Mus musculus
aaaggctttggtagagaacttggca

SEQ ID NO: 16466 - DNA, 25 bp, Mus musculus
aaaggctttggttgagaacttggca

SEQ ID NO: 16467 - DNA, 25 bp, Mus musculus
aaaggctttgtgaagctggccctgc

SEQ ID NO: 16468 - DNA, 25 bp, Mus musculus
aaaggctttgtgtagctggccctgc

SEQ ID NO: 16469 - DNA, 25 bp, Mus musculus
aaaggcttttaacagcatgtcagat

SEQ ID NO: 16470 - DNA, 25 bp, Mus musculus
aaaggcttttaagagcatgtcagat

SEQ ID NO: 16471 - DNA, 25 bp, Mus musculus
aaaggcttttacacgtttatctgat

SEQ ID NO: 16472 - DNA, 25 bp, Mus musculus
aaaggcttttactcgtttatctgat

SEQ ID NO: 16473 - DNA, 25 bp, Mus musculus
aaaggcttttcacatctgtgcccca

SEQ ID NO: 16474 - DNA, 25 bp, Mus musculus
aaaggcttttcagatctgtgcccca

SEQ ID NO: 16475 - DNA, 25 bp, Mus musculus
aaaggcttttgaccgatacacaaca

SEQ ID NO: 16476 - DNA, 25 bp, Mus musculus
aaaggcttttgagcgatacacaaca

SEQ ID NO: 16477 - DNA, 25 bp, Mus musculus
aaagggaaactcactctgccttcat

SEQ ID NO: 16478 - DNA, 25 bp, Mus musculus
aaagggaaactctctctgccttcat

SEQ ID NO: 16479 - DNA, 25 bp, Mus musculus
aaagggaaccagatagcagcattaa

SEQ ID NO: 16480 - DNA, 25 bp, Mus musculus
aaagggaaccagttagcagcattaa

SEQ ID NO: 16481 - DNA, 25 bp, Mus musculus
aaagggaacctgcaataatcttggg

SEQ ID NO: 16482 - DNA, 25 bp, Mus musculus
aaagggaacctggaataatcttggg

SEQ ID NO: 16483 - DNA, 25 bp, Mus musculus
aaagggaagagaccagcctcgcacc

SEQ ID NO: 16484 - DNA, 25 bp, Mus musculus
aaagggaagagagcagcctcgcacc

SEQ ID NO: 16485 - DNA, 25 bp, Mus musculus
aaagggaagagcaggcacaaagccc

SEQ ID NO: 16486 - DNA, 25 bp, Mus musculus
aaagggaagagctggcacaaagccc

SEQ ID NO: 16487 - DNA, 25 bp, Mus musculus
aaagggaatagtcccaggacttctg

SEQ ID NO: 16488 - DNA, 25 bp, Mus musculus
aaagggaatagtgccaggacttctg

SEQ ID NO: 16489 - DNA, 25 bp, Mus musculus
aaagggaattccagggcgcaccaag

SEQ ID NO: 16490 - DNA, 25 bp, Mus musculus
aaagggaattcctgggcgcaccaag

SEQ ID NO: 16491 - DNA, 25 bp, Mus musculus
aaagggacactgcagctgaatgaga

SEQ ID NO: 16492 - DNA, 25 bp, Mus musculus
aaagggacactggagctgaatgaga

SEQ ID NO: 16493 - DNA, 25 bp, Mus musculus
aaagggacacttcgactttatatga

SEQ ID NO: 16494 - DNA, 25 bp, Mus musculus
aaagggacacttcgctattctttct

SEQ ID NO: 16495 - DNA, 25 bp, Mus musculus
aaagggacacttggactttatatga

SEQ ID NO: 16496 - DNA, 25 bp, Mus musculus
aaagggacacttggctattctttct

SEQ ID NO: 16497 - DNA, 25 bp, Mus musculus
aaagggacagctcgtgccatcctga

SEQ ID NO: 16498 - DNA, 25 bp, Mus musculus
aaagggacagctctcttcaagcttt

SEQ ID NO: 16499 - DNA, 25 bp, Mus musculus
aaagggacagctggtgccatcctga

SEQ ID NO: 16500 - DNA, 25 bp, Mus musculus
aaagggacagctgtcttcaagcttt

SEQ ID NO: 16501 - DNA, 25 bp, Mus musculus
aaagggacagttctgggccccatga

SEQ ID NO: 16502 - DNA, 25 bp, Mus musculus
aaagggacagttgtgggccccatga

SEQ ID NO: 16503 - DNA, 25 bp, Mus musculus
aaagggaccaagcagctcactacac

SEQ ID NO: 16504 - DNA, 25 bp, Mus musculus
aaagggaccaaggagctcactacac

SEQ ID NO: 16505 - DNA, 25 bp, Mus musculus
aaagggaccatcacaggttccaagt

SEQ ID NO: 16506 - DNA, 25 bp, Mus musculus
aaagggaccatctcaggttccaagt

SEQ ID NO: 16507 - DNA, 25 bp, Mus musculus
aaagggacccagcacaatgactctc

SEQ ID NO: 16508 - DNA, 25 bp, Mus musculus
aaagggacccaggacaatgactctc

SEQ ID NO: 16509 - DNA, 25 bp, Mus musculus
aaagggacctagcactggaaccagt

SEQ ID NO: 16510 - DNA, 25 bp, Mus musculus
aaagggacctaggactggaaccagt

SEQ ID NO: 16511 - DNA, 25 bp, Mus musculus
aaagggacctcgcttcagcactgaa

SEQ ID NO: 16512 - DNA, 25 bp, Mus musculus
aaagggacctcggttcagcactgaa

SEQ ID NO: 16513 - DNA, 25 bp, Mus musculus
aaagggacgaggctctccttgatca

SEQ ID NO: 16514 - DNA, 25 bp, Mus musculus
aaagggacgagggtctccttgatca

SEQ ID NO: 16515 - DNA, 25 bp, Mus musculus
aaagggacgcctagtgtgtgccaca

SEQ ID NO: 16516 - DNA, 25 bp, Mus musculus
aaagggacgccttgtgtgtgccaca

SEQ ID NO: 16517 - DNA, 25 bp, Mus musculus
aaagggacgctacacctcccagaag

SEQ ID NO: 16518 - DNA, 25 bp, Mus musculus
aaagggacgctagacctcccagaag

SEQ ID NO: 16519 - DNA, 25 bp, Mus musculus
aaagggacgctgagtccctacccat

SEQ ID NO: 16520 - DNA, 25 bp, Mus musculus
aaagggacgctgtgtccctacccat

SEQ ID NO: 16521 - DNA, 25 bp, Mus musculus
aaagggactccaacagattatctgt

SEQ ID NO: 16522 - DNA, 25 bp, Mus musculus
aaagggactccatcagattatctgt

SEQ ID NO: 16523 - DNA, 25 bp, Mus musculus
aaagggactcgtcatgcttcccata

SEQ ID NO: 16524 - DNA, 25 bp, Mus musculus
aaagggactcgtgatgcttcccata

SEQ ID NO: 16525 - DNA, 25 bp, Mus musculus
aaagggactgcacacacacttgaca

SEQ ID NO: 16526 - DNA, 25 bp, Mus musculus
aaagggactgcagacacacttgaca

SEQ ID NO: 16527 - DNA, 25 bp, Mus musculus
aaagggactggaaccatctactgaa

SEQ ID NO: 16528 - DNA, 25 bp, Mus musculus
aaagggactggatccatctactgaa

SEQ ID NO: 16529 - DNA, 25 bp, Mus musculus
aaagggacttgcaccaacctgacaa

SEQ ID NO: 16530 - DNA, 25 bp, Mus musculus
aaagggacttgcctttcattctgcc

SEQ ID NO: 16531 - DNA, 25 bp, Mus musculus
aaagggacttgcgtttcattctgcc

SEQ ID NO: 16532 - DNA, 25 bp, Mus musculus
aaagggacttgctccaacctgacaa

SEQ ID NO: 16533 - DNA, 25 bp, Mus musculus
aaagggagactccaggtctctgcct

SEQ ID NO: 16534 - DNA, 25 bp, Mus musculus
aaagggagactcgaggtctctgcct

SEQ ID NO: 16535 - DNA, 25 bp, Mus musculus
aaagggagagcccagcatcttgtgc

SEQ ID NO: 16536 - DNA, 25 bp, Mus musculus
aaagggagagccgagcatcttgtgc

SEQ ID NO: 16537 - DNA, 25 bp, Mus musculus
aaagggagagctattccaacagaga

SEQ ID NO: 16538 - DNA, 25 bp, Mus musculus
aaagggagagcttttccaacagaga

SEQ ID NO: 16539 - DNA, 25 bp, Mus musculus
aaagggagaggcagcaggctcaaca

SEQ ID NO: 16540 - DNA, 25 bp, Mus musculus
aaagggagaggctgcaggctcaaca

SEQ ID NO: 16541 - DNA, 25 bp, Mus musculus
aaagggagcaaactcctgcactgtt

SEQ ID NO: 16542 - DNA, 25 bp, Mus musculus
aaagggagcaaagtcctgcactgtt

SEQ ID NO: 16543 - DNA, 25 bp, Mus musculus
aaagggagccaactcgatgcaagga

SEQ ID NO: 16544 - DNA, 25 bp, Mus musculus
aaagggagccaagtcgatgcaagga

SEQ ID NO: 16545 - DNA, 25 bp, Mus musculus
aaagggagccttattcacagtgaga

SEQ ID NO: 16546 - DNA, 25 bp, Mus musculus
aaagggagcctttttcacagtgaga

SEQ ID NO: 16547 - DNA, 25 bp, Mus musculus
aaagggagctccatactgcccagtt

SEQ ID NO: 16548 - DNA, 25 bp, Mus musculus
aaagggagctccttactgcccagtt

SEQ ID NO: 16549 - DNA, 25 bp, Mus musculus
aaagggaggccaagactgggaacac

SEQ ID NO: 16550 - DNA, 25 bp, Mus musculus
aaagggaggccatgactgggaacac

SEQ ID NO: 16551 - DNA, 25 bp, Mus musculus
aaagggagggatctctaaacatgac

SEQ ID NO: 16552 - DNA, 25 bp, Mus musculus
aaagggagggatgtctaaacatgac

SEQ ID NO: 16553 - DNA, 25 bp, Mus musculus
aaagggagtagacctctcacctgtg

SEQ ID NO: 16554 - DNA, 25 bp, Mus musculus
aaagggagtagagctctcacctgtg

SEQ ID NO: 16555 - DNA, 25 bp, Mus musculus
aaagggagtatccactccgcggcag

SEQ ID NO: 16556 - DNA, 25 bp, Mus musculus
aaagggagtatcgactccgcggcag

SEQ ID NO: 16557 - DNA, 25 bp, Mus musculus
aaagggagttctcgctacctagtct

SEQ ID NO: 16558 - DNA, 25 bp, Mus musculus
aaagggagttctggctacctagtct

SEQ ID NO: 16559 - DNA, 25 bp, Mus musculus
aaagggagttgcctcagcagcccga

SEQ ID NO: 16560 - DNA, 25 bp, Mus musculus
aaagggagttgcgtcagcagcccga

SEQ ID NO: 16561 - DNA, 25 bp, Mus musculus
aaagggataagacccaagtctgtgt

SEQ ID NO: 16562 - DNA, 25 bp, Mus musculus
aaagggataagagccaagtctgtgt

SEQ ID NO: 16563 - DNA, 25 bp, Mus musculus
aaagggatacagattggaacaaatg

SEQ ID NO: 16564 - DNA, 25 bp, Mus musculus
aaagggatacagtttggaacaaatg

SEQ ID NO: 16565 - DNA, 25 bp, Mus musculus
aaagggatccctctacaaactatgg

SEQ ID NO: 16566 - DNA, 25 bp, Mus musculus
aaagggatccctgtacaaactatgg

SEQ ID NO: 16567 - DNA, 25 bp, Mus musculus
aaagggatccgaatgtggccctgcc

SEQ ID NO: 16568 - DNA, 25 bp, Mus musculus
aaagggatccgattgtggccctgcc

SEQ ID NO: 16569 - DNA, 25 bp, Mus musculus
aaagggatgattcacaagtcgcccc

SEQ ID NO: 16570 - DNA, 25 bp, Mus musculus
aaagggatgattgacaagtcgcccc

SEQ ID NO: 16571 - DNA, 25 bp, Mus musculus
aaagggatggatccgagtcctcccg

SEQ ID NO: 16572 - DNA, 25 bp, Mus musculus
aaagggatggatctttacaggtgac

SEQ ID NO: 16573 - DNA, 25 bp, Mus musculus
aaagggatggatgcgagtcctcccg

SEQ ID NO: 16574 - DNA, 25 bp, Mus musculus
aaagggatggatgtttacaggtgac

SEQ ID NO: 16575 - DNA, 25 bp, Mus musculus
aaagggatggcccttccgctgcttc

SEQ ID NO: 16576 - DNA, 25 bp, Mus musculus
aaagggatggccgttccgctgcttc

SEQ ID NO: 16577 - DNA, 25 bp, Mus musculus
aaagggattcaaatcctgtggcctt

SEQ ID NO: 16578 - DNA, 25 bp, Mus musculus
aaagggattcaattcctgtggcctt

SEQ ID NO: 16579 - DNA, 25 bp, Mus musculus
aaagggattctgctcctgaacagcc

SEQ ID NO: 16580 - DNA, 25 bp, Mus musculus
aaagggattctggtcctgaacagcc

SEQ ID NO: 16581 - DNA, 25 bp, Mus musculus
aaagggcaaattcgcaacctctgtg

SEQ ID NO: 16582 - DNA, 25 bp, Mus musculus
aaagggcaaattggcaacctctgtg

SEQ ID NO: 16583 - DNA, 25 bp, Mus musculus
aaagggcaacgccatctggctcaca

SEQ ID NO: 16584 - DNA, 25 bp, Mus musculus
aaagggcaacgcgatctggctcaca

SEQ ID NO: 16585 - DNA, 25 bp, Mus musculus
aaagggcaacttagtcatgacttct

SEQ ID NO: 16586 - DNA, 25 bp, Mus musculus
aaagggcaactttgtcatgacttct

SEQ ID NO: 16587 - DNA, 25 bp, Mus musculus
aaagggcacacactccttggtggcc

SEQ ID NO: 16588 - DNA, 25 bp, Mus musculus
aaagggcacacagtccttggtggcc

SEQ ID NO: 16589 - DNA, 25 bp, Mus musculus
aaagggcacaggacaactaccattc

SEQ ID NO: 16590 - DNA, 25 bp, Mus musculus
aaagggcacaggtcaactaccattc

SEQ ID NO: 16591 - DNA, 25 bp, Mus musculus
aaagggcactgtcagcctattctgc

SEQ ID NO: 16592 - DNA, 25 bp, Mus musculus
aaagggcactgtgagcctattctgc

SEQ ID NO: 16593 - DNA, 25 bp, Mus musculus
aaagggcagcacactcctattttcc

SEQ ID NO: 16594 - DNA, 25 bp, Mus musculus
aaagggcagcactctcctattttcc

SEQ ID NO: 16595 - DNA, 25 bp, Mus musculus
aaagggcagcagcatgtattgtata

SEQ ID NO: 16596 - DNA, 25 bp, Mus musculus
aaagggcagcaggatgtattgtata

SEQ ID NO: 16597 - DNA, 25 bp, Mus musculus
aaagggcagcccacatggtgggcat

SEQ ID NO: 16598 - DNA, 25 bp, Mus musculus
aaagggcagccctcatggtgggcat

SEQ ID NO: 16599 - DNA, 25 bp, Mus musculus
aaagggcagcgtaatttaacacagc

SEQ ID NO: 16600 - DNA, 25 bp, Mus musculus
aaagggcagcgttatttaacacagc

SEQ ID NO: 16601 - DNA, 25 bp, Mus musculus
aaagggcagctgcagtctgcaccat

SEQ ID NO: 16602 - DNA, 25 bp, Mus musculus
aaagggcagctggagtctgcaccat

SEQ ID NO: 16603 - DNA, 25 bp, Mus musculus
aaagggcaggttcaggccttgccct

SEQ ID NO: 16604 - DNA, 25 bp, Mus musculus
aaagggcaggttgaggccttgccct

SEQ ID NO: 16605 - DNA, 25 bp, Mus musculus
aaagggcatagcaggacactcctgc

SEQ ID NO: 16606 - DNA, 25 bp, Mus musculus
aaagggcatagctggacactcctgc

SEQ ID NO: 16607 - DNA, 25 bp, Mus musculus
aaagggcattgcctctaccagcatt

SEQ ID NO: 16608 - DNA, 25 bp, Mus musculus
aaagggcattgcgtctaccagcatt

SEQ ID NO: 16609 - DNA, 25 bp, Mus musculus
aaagggcatttaaggccctctgtcc

SEQ ID NO: 16610 - DNA, 25 bp, Mus musculus
aaagggcatttatggccctctgtcc

SEQ ID NO: 16611 - DNA, 25 bp, Mus musculus
aaagggcatttgcttcatccggacc

SEQ ID NO: 16612 - DNA, 25 bp, Mus musculus
aaagggcatttggttcatccggacc

SEQ ID NO: 16613 - DNA, 25 bp, Mus musculus
aaagggccaacaacagacacttgct

SEQ ID NO: 16614 - DNA, 25 bp, Mus musculus
aaagggccaacatcagacacttgct

SEQ ID NO: 16615 - DNA, 25 bp, Mus musculus
aaagggccagcacctcaccagggag

SEQ ID NO: 16616 - DNA, 25 bp, Mus musculus
aaagggccagcagctcaccagggag

SEQ ID NO: 16617 - DNA, 25 bp, Mus musculus
aaagggccagtccatcgacgacatg

SEQ ID NO: 16618 - DNA, 25 bp, Mus musculus
aaagggccagtcgatcgacgacatg

SEQ ID NO: 16619 - DNA, 25 bp, Mus musculus
aaagggcccattcatcctttatgcc

SEQ ID NO: 16620 - DNA, 25 bp, Mus musculus
aaagggcccattgatcctttatgcc

SEQ ID NO: 16621 - DNA, 25 bp, Mus musculus
aaagggccctgcaaaaacaatagat

SEQ ID NO: 16622 - DNA, 25 bp, Mus musculus
aaagggccctgctaaaacaatagat

SEQ ID NO: 16623 - DNA, 25 bp, Mus musculus
aaagggccggcaagctcagtggact

SEQ ID NO: 16624 - DNA, 25 bp, Mus musculus
aaagggccggcatgctcagtggact

SEQ ID NO: 16625 - DNA, 25 bp, Mus musculus
aaagggccggccagtgtgcagtgga

SEQ ID NO: 16626 - DNA, 25 bp, Mus musculus
aaagggccggcctgtgtgcagtgga

SEQ ID NO: 16627 - DNA, 25 bp, Mus musculus
aaagggcctccgagagcgcatacgg

SEQ ID NO: 16628 - DNA, 25 bp, Mus musculus
aaagggcctccgtgagcgcatacgg

SEQ ID NO: 16629 - DNA, 25 bp, Mus musculus
aaagggcctcctacctagatcttat

SEQ ID NO: 16630 - DNA, 25 bp, Mus musculus
aaagggcctccttcctagatcttat

SEQ ID NO: 16631 - DNA, 25 bp, Mus musculus
aaagggcctgccaatttgtccacgg

SEQ ID NO: 16632 - DNA, 25 bp, Mus musculus
aaagggcctgcctatttgtccacgg

SEQ ID NO: 16633 - DNA, 25 bp, Mus musculus
aaagggcctggacacgtctagccgc

SEQ ID NO: 16634 - DNA, 25 bp, Mus musculus
aaagggcctggagacgtctagccgc

SEQ ID NO: 16635 - DNA, 25 bp, Mus musculus
aaagggcctgttatctttcatgagt

SEQ ID NO: 16636 - DNA, 25 bp, Mus musculus
aaagggcctgttttctttcatgagt

SEQ ID NO: 16637 - DNA, 25 bp, Mus musculus
aaagggccttggagtggcgctgagc

SEQ ID NO: 16638 - DNA, 25 bp, Mus musculus
aaagggccttggtgtggcgctgagc

SEQ ID NO: 16639 - DNA, 25 bp, Mus musculus
aaagggccttgtagtgtccagactc

SEQ ID NO: 16640 - DNA, 25 bp, Mus musculus
aaagggccttgtccacgttgggcaa

SEQ ID NO: 16641 - DNA, 25 bp, Mus musculus
aaagggccttgtgcacgttgggcaa

SEQ ID NO: 16642 - DNA, 25 bp, Mus musculus
aaagggccttgttgtgtccagactc

SEQ ID NO: 16643 - DNA, 25 bp, Mus musculus
aaagggcgacaactgactcacgaga

SEQ ID NO: 16644 - DNA, 25 bp, Mus musculus
aaagggcgacaagtgactcacgaga

SEQ ID NO: 16645 - DNA, 25 bp, Mus musculus
aaagggcgagcccttacagccaaat

SEQ ID NO: 16646 - DNA, 25 bp, Mus musculus
aaagggcgagccgttacagccaaat

SEQ ID NO: 16647 - DNA, 25 bp, Mus musculus
aaagggcgccgacttccagtggtct

SEQ ID NO: 16648 - DNA, 25 bp, Mus musculus
aaagggcgccgagttccagtggtct

SEQ ID NO: 16649 - DNA, 25 bp, Mus musculus
aaagggcgggtgattgccaatgctc

SEQ ID NO: 16650 - DNA, 25 bp, Mus musculus
aaagggcgggtgtttgccaatgctc

SEQ ID NO: 16651 - DNA, 25 bp, Mus musculus
aaagggctcaagatcaccctgcagg

SEQ ID NO: 16652 - DNA, 25 bp, Mus musculus
aaagggctcaagttcaccctgcagg

SEQ ID NO: 16653 - DNA, 25 bp, Mus musculus
aaagggctcagtacaggcacccctg

SEQ ID NO: 16654 - DNA, 25 bp, Mus musculus
aaagggctcagtctcttggcacagc

SEQ ID NO: 16655 - DNA, 25 bp, Mus musculus
aaagggctcagtgtcttggcacagc

SEQ ID NO: 16656 - DNA, 25 bp, Mus musculus
aaagggctcagttcaggcacccctg

SEQ ID NO: 16657 - DNA, 25 bp, Mus musculus
aaagggctcatccttagtgacccag

SEQ ID NO: 16658 - DNA, 25 bp, Mus musculus
aaagggctcatcgttagtgacccag

SEQ ID NO: 16659 - DNA, 25 bp, Mus musculus
aaagggctccaaagacagtcagacc

SEQ ID NO: 16660 - DNA, 25 bp, Mus musculus
aaagggctccaatgacagtcagacc

SEQ ID NO: 16661 - DNA, 25 bp, Mus musculus
aaagggctcccacaacacttgatgt

SEQ ID NO: 16662 - DNA, 25 bp, Mus musculus
aaagggctcccagaacacttgatgt

SEQ ID NO: 16663 - DNA, 25 bp, Mus musculus
aaagggctccctccatggtgacaag

SEQ ID NO: 16664 - DNA, 25 bp, Mus musculus
aaagggctccctgcatggtgacaag

SEQ ID NO: 16665 - DNA, 25 bp, Mus musculus
aaagggctctgcagatgtgaccatc

SEQ ID NO: 16666 - DNA, 25 bp, Mus musculus
aaagggctctgctgatgtgaccatc

SEQ ID NO: 16667 - DNA, 25 bp, Mus musculus
aaagggctcttgaagcccgcgtggc

SEQ ID NO: 16668 - DNA, 25 bp, Mus musculus
aaagggctcttgtagcccgcgtggc

SEQ ID NO: 16669 - DNA, 25 bp, Mus musculus
aaagggctgcctacaaatccagttt

SEQ ID NO: 16670 - DNA, 25 bp, Mus musculus
aaagggctgccttcaaatccagttt

SEQ ID NO: 16671 - DNA, 25 bp, Mus musculus
aaagggctgctcaattccatatgaa

SEQ ID NO: 16672 - DNA, 25 bp, Mus musculus
aaagggctgctctattccatatgaa

SEQ ID NO: 16673 - DNA, 25 bp, Mus musculus
aaagggctgctgaagcacttttctt

SEQ ID NO: 16674 - DNA, 25 bp, Mus musculus
aaagggctgctgtagcacttttctt

SEQ ID NO: 16675 - DNA, 25 bp, Mus musculus
aaagggctggaacatttagctttag

SEQ ID NO: 16676 - DNA, 25 bp, Mus musculus
aaagggctggaagatttagctttag

SEQ ID NO: 16677 - DNA, 25 bp, Mus musculus
aaagggctggatccccataggccct

SEQ ID NO: 16678 - DNA, 25 bp, Mus musculus
aaagggctggatgcccataggccct

SEQ ID NO: 16679 - DNA, 25 bp, Mus musculus
aaagggctggccatggacagtaccc

SEQ ID NO: 16680 - DNA, 25 bp, Mus musculus
aaagggctggccttggacagtaccc

SEQ ID NO: 16681 - DNA, 25 bp, Mus musculus
aaagggctgtcaagggcactcaatt

SEQ ID NO: 16682 - DNA, 25 bp, Mus musculus
aaagggctgtcatgggcactcaatt

SEQ ID NO: 16683 - DNA, 25 bp, Mus musculus
aaagggctgtgcctcgatggtccac

SEQ ID NO: 16684 - DNA, 25 bp, Mus musculus
aaagggctgtgcgtcgatggtccac

SEQ ID NO: 16685 - DNA, 25 bp, Mus musculus
aaagggcttaggattttgcactgca

SEQ ID NO: 16686 - DNA, 25 bp, Mus musculus
aaagggcttaggtttttgcactgca

SEQ ID NO: 16687 - DNA, 25 bp, Mus musculus
aaagggcttcacaagactgtactga

SEQ ID NO: 16688 - DNA, 25 bp, Mus musculus
aaagggcttcactagactgtactga

SEQ ID NO: 16689 - DNA, 25 bp, Mus musculus
aaagggcttcggatcccgtgaactg

SEQ ID NO: 16690 - DNA, 25 bp, Mus musculus
aaagggcttcggttcccgtgaactg

SEQ ID NO: 16691 - DNA, 25 bp, Mus musculus
aaagggcttctacccacactggaga

SEQ ID NO: 16692 - DNA, 25 bp, Mus musculus
aaagggcttctagccacactggaga

SEQ ID NO: 16693 - DNA, 25 bp, Mus musculus
aaagggctttaacaactcagtactg

SEQ ID NO: 16694 - DNA, 25 bp, Mus musculus
aaagggctttaagaactcagtactg

SEQ ID NO: 16695 - DNA, 25 bp, Mus musculus
aaagggctttacatattgcaggtag

SEQ ID NO: 16696 - DNA, 25 bp, Mus musculus
aaagggctttacttattgcaggtag

SEQ ID NO: 16697 - DNA, 25 bp, Mus musculus
aaagggtagtagcatttggccaact

SEQ ID NO: 16698 - DNA, 25 bp, Mus musculus
aaagggtagtaggatttggccaact

SEQ ID NO: 16699 - DNA, 25 bp, Mus musculus
aaagggtagtcaaactgtggaatat

SEQ ID NO: 16700 - DNA, 25 bp, Mus musculus
aaagggtagtcatactgtggaatat

SEQ ID NO: 16701 - DNA, 25 bp, Mus musculus
aaagggtatttgctctcttgtcata

SEQ ID NO: 16702 - DNA, 25 bp, Mus musculus
aaagggtatttggtctcttgtcata

SEQ ID NO: 16703 - DNA, 25 bp, Mus musculus
aaagggtcaccaattgaggtcctgc

SEQ ID NO: 16704 - DNA, 25 bp, Mus musculus
aaagggtcaccatttgaggtcctgc

SEQ ID NO: 16705 - DNA, 25 bp, Mus musculus
aaagggtcacctatcaagctgcatc

SEQ ID NO: 16706 - DNA, 25 bp, Mus musculus
aaagggtcacctttcaagctgcatc

SEQ ID NO: 16707 - DNA, 25 bp, Mus musculus
aaagggtcattccttgatgcccagg

SEQ ID NO: 16708 - DNA, 25 bp, Mus musculus
aaagggtcattcgttgatgcccagg

SEQ ID NO: 16709 - DNA, 25 bp, Mus musculus
aaagggtccaccaaaaccatgctgt

SEQ ID NO: 16710 - DNA, 25 bp, Mus musculus
aaagggtccacctaaaccatgctgt

SEQ ID NO: 16711 - DNA, 25 bp, Mus musculus
aaagggtccactcggtgctctgatg

SEQ ID NO: 16712 - DNA, 25 bp, Mus musculus
aaagggtccactgggtgctctgatg

SEQ ID NO: 16713 - DNA, 25 bp, Mus musculus
aaagggtcccatagtctggatggat

SEQ ID NO: 16714 - DNA, 25 bp, Mus musculus
aaagggtcccattgtctggatggat

SEQ ID NO: 16715 - DNA, 25 bp, Mus musculus
aaagggtccccgctgtctgagattg

SEQ ID NO: 16716 - DNA, 25 bp, Mus musculus
aaagggtccccggtgtctgagattg

SEQ ID NO: 16717 - DNA, 25 bp, Mus musculus
aaagggtcccctcagcaaacgagag

SEQ ID NO: 16718 - DNA, 25 bp, Mus musculus
aaagggtcccctgagcaaacgagag

SEQ ID NO: 16719 - DNA, 25 bp, Mus musculus
aaagggtccgagcacaagcgaagaa

SEQ ID NO: 16720 - DNA, 25 bp, Mus musculus
aaagggtccgaggacaagcgaagaa

SEQ ID NO: 16721 - DNA, 25 bp, Mus musculus
aaagggtctatcacctcacattttg

SEQ ID NO: 16722 - DNA, 25 bp, Mus musculus
aaagggtctatctcctcacattttg

SEQ ID NO: 16723 - DNA, 25 bp, Mus musculus
aaagggtctcttccctggtggtgca

SEQ ID NO: 16724 - DNA, 25 bp, Mus musculus
aaagggtctcttgcctggtggtgca

SEQ ID NO: 16725 - DNA, 25 bp, Mus musculus
aaagggtcttttacagcccgagcag

SEQ ID NO: 16726 - DNA, 25 bp, Mus musculus
aaagggtctttttcagcccgagcag

SEQ ID NO: 16727 - DNA, 25 bp, Mus musculus
aaagggtgaattcctcacattccag

SEQ ID NO: 16728 - DNA, 25 bp, Mus musculus
aaagggtgaattgctcacattccag

SEQ ID NO: 16729 - DNA, 25 bp, Mus musculus
aaagggtgatccagctatttgcagt

SEQ ID NO: 16730 - DNA, 25 bp, Mus musculus
aaagggtgatcctgctatttgcagt

SEQ ID NO: 16731 - DNA, 25 bp, Mus musculus
aaagggtgccacaccaaaaacatga

SEQ ID NO: 16732 - DNA, 25 bp, Mus musculus
aaagggtgccactccaaaaacatga

SEQ ID NO: 16733 - DNA, 25 bp, Mus musculus
aaagggtgcctaagggtctcgctct

SEQ ID NO: 16734 - DNA, 25 bp, Mus musculus
aaagggtgcctatgggtctcgctct

SEQ ID NO: 16735 - DNA, 25 bp, Mus musculus
aaagggtgcgaaccctgccatgtcc

SEQ ID NO: 16736 - DNA, 25 bp, Mus musculus
aaagggtgcgaagcctgccatgtcc

SEQ ID NO: 16737 - DNA, 25 bp, Mus musculus
aaagggtgctgcagcgcctgcgcca

SEQ ID NO: 16738 - DNA, 25 bp, Mus musculus
aaagggtgctgctgcgcctgcgcca

SEQ ID NO: 16739 - DNA, 25 bp, Mus musculus
aaagggtgcttcatgggactccagt

SEQ ID NO: 16740 - DNA, 25 bp, Mus musculus
aaagggtgcttcttgggactccagt

SEQ ID NO: 16741 - DNA, 25 bp, Mus musculus
aaagggtggcacaacttgagtcctt

SEQ ID NO: 16742 - DNA, 25 bp, Mus musculus
aaagggtggcactacttgagtcctt

SEQ ID NO: 16743 - DNA, 25 bp, Mus musculus
aaagggtgggataacagtgtttcat

SEQ ID NO: 16744 - DNA, 25 bp, Mus musculus
aaagggtgggattacagtgtttcat

SEQ ID NO: 16745 - DNA, 25 bp, Mus musculus
aaagggtgtatgactcgtgcatccg

SEQ ID NO: 16746 - DNA, 25 bp, Mus musculus
aaagggtgtatgtctcgtgcatccg

SEQ ID NO: 16747 - DNA, 25 bp, Mus musculus
aaagggtgtcatctgttcttcctgc

SEQ ID NO: 16748 - DNA, 25 bp, Mus musculus
aaagggtgtcatgtgttcttcctgc

SEQ ID NO: 16749 - DNA, 25 bp, Mus musculus
aaagggtgtccacaatggctccagc

SEQ ID NO: 16750 - DNA, 25 bp, Mus musculus
aaagggtgtccagaatggctccagc

SEQ ID NO: 16751 - DNA, 25 bp, Mus musculus
aaagggtgtcttaatttgctgtttg

SEQ ID NO: 16752 - DNA, 25 bp, Mus musculus
aaagggtgtctttatttgctgtttg

SEQ ID NO: 16753 - DNA, 25 bp, Mus musculus
aaagggttaccccagtgggcatgct

SEQ ID NO: 16754 - DNA, 25 bp, Mus musculus
aaagggttacccgagtgggcatgct

SEQ ID NO: 16755 - DNA, 25 bp, Mus musculus
aaagggttaggaacccaggctcagg

SEQ ID NO: 16756 - DNA, 25 bp, Mus musculus
aaagggttaggatcccaggctcagg

SEQ ID NO: 16757 - DNA, 25 bp, Mus musculus
aaagggttagtgctgcagtttgctt

SEQ ID NO: 16758 - DNA, 25 bp, Mus musculus
aaagggttagtggtgcagtttgctt

SEQ ID NO: 16759 - DNA, 25 bp, Mus musculus
aaagggttcaggacatggtcacact

SEQ ID NO: 16760 - DNA, 25 bp, Mus musculus
aaagggttcaggtcatggtcacact

SEQ ID NO: 16761 - DNA, 25 bp, Mus musculus
aaagggttcatgacgcttacacttc

SEQ ID NO: 16762 - DNA, 25 bp, Mus musculus
aaagggttcatgtcgcttacacttc

SEQ ID NO: 16763 - DNA, 25 bp, Mus musculus
aaagggttccaacagttggcacgca

SEQ ID NO: 16764 - DNA, 25 bp, Mus musculus
aaagggttccaagagttggcacgca

SEQ ID NO: 16765 - DNA, 25 bp, Mus musculus
aaagggttcctcaagggctgtgctt

SEQ ID NO: 16766 - DNA, 25 bp, Mus musculus
aaagggttcctctagggctgtgctt

SEQ ID NO: 16767 - DNA, 25 bp, Mus musculus
aaagggttgcagaggccacttcact

SEQ ID NO: 16768 - DNA, 25 bp, Mus musculus
aaagggttgcagtggccacttcact

SEQ ID NO: 16769 - DNA, 25 bp, Mus musculus
aaagggttggctactatctaggaca

SEQ ID NO: 16770 - DNA, 25 bp, Mus musculus
aaagggttggcttctatctaggaca

SEQ ID NO: 16771 - DNA, 25 bp, Mus musculus
aaagggttgtcactgatctgcaggc

SEQ ID NO: 16772 - DNA, 25 bp, Mus musculus
aaagggttgtcagtgatctgcaggc

SEQ ID NO: 16773 - DNA, 25 bp, Mus musculus
aaaggtaaagctcatgtccccattc

SEQ ID NO: 16774 - DNA, 25 bp, Mus musculus
aaaggtaaagctgatgtccccattc

SEQ ID NO: 16775 - DNA, 25 bp, Mus musculus
aaaggtaacagcagtcctccagctt

SEQ ID NO: 16776 - DNA, 25 bp, Mus musculus
aaaggtaacagctgtcctccagctt

SEQ ID NO: 16777 - DNA, 25 bp, Mus musculus
aaaggtaacctgactctcttcagtg

SEQ ID NO: 16778 - DNA, 25 bp, Mus musculus
aaaggtaacctgtctctcttcagtg

SEQ ID NO: 16779 - DNA, 25 bp, Mus musculus
aaaggtaatttcatagcaaacacac

SEQ ID NO: 16780 - DNA, 25 bp, Mus musculus
aaaggtaatttcttagcaaacacac

SEQ ID NO: 16781 - DNA, 25 bp, Mus musculus
aaaggtacactacgaggcagcaact

SEQ ID NO: 16782 - DNA, 25 bp, Mus musculus
aaaggtacactaggaggcagcaact

SEQ ID NO: 16783 - DNA, 25 bp, Mus musculus
aaaggtacatccagcagtggtaatt

SEQ ID NO: 16784 - DNA, 25 bp, Mus musculus
aaaggtacatcctgcagtggtaatt

SEQ ID NO: 16785 - DNA, 25 bp, Mus musculus
aaaggtaccagaactcctgtcaaga

SEQ ID NO: 16786 - DNA, 25 bp, Mus musculus
aaaggtaccagatctcctgtcaaga

SEQ ID NO: 16787 - DNA, 25 bp, Mus musculus
aaaggtaccaggacaggcccagctc

SEQ ID NO: 16788 - DNA, 25 bp, Mus musculus
aaaggtaccaggtcaggcccagctc

SEQ ID NO: 16789 - DNA, 25 bp, Mus musculus
aaaggtaccagtaacctagcagctg

SEQ ID NO: 16790 - DNA, 25 bp, Mus musculus
aaaggtaccagttacctagcagctg

SEQ ID NO: 16791 - DNA, 25 bp, Mus musculus
aaaggtacctgaaatccagctagaa

SEQ ID NO: 16792 - DNA, 25 bp, Mus musculus
aaaggtacctgaatctcacttctct

SEQ ID NO: 16793 - DNA, 25 bp, Mus musculus
aaaggtacctgatatccagctagaa

SEQ ID NO: 16794 - DNA, 25 bp, Mus musculus
aaaggtacctgattctcacttctct

SEQ ID NO: 16795 - DNA, 25 bp, Mus musculus
aaaggtacctgtcaacttccttgct

SEQ ID NO: 16796 - DNA, 25 bp, Mus musculus
aaaggtacctgtgaacttccttgct

SEQ ID NO: 16797 - DNA, 25 bp, Mus musculus
aaaggtacggttagctgcttgtgct

SEQ ID NO: 16798 - DNA, 25 bp, Mus musculus
aaaggtacggtttgctgcttgtgct

SEQ ID NO: 16799 - DNA, 25 bp, Mus musculus
aaaggtacgtctatctcctgagtct

SEQ ID NO: 16800 - DNA, 25 bp, Mus musculus
aaaggtacgtctttctcctgagtct

SEQ ID NO: 16801 - DNA, 25 bp, Mus musculus
aaaggtacgtgtcagccttgaccac

SEQ ID NO: 16802 - DNA, 25 bp, Mus musculus
aaaggtacgtgtgagccttgaccac

SEQ ID NO: 16803 - DNA, 25 bp, Mus musculus
aaaggtactcgcagcaggcatgtcc

SEQ ID NO: 16804 - DNA, 25 bp, Mus musculus
aaaggtactcgctgcaggcatgtcc

SEQ ID NO: 16805 - DNA, 25 bp, Mus musculus
aaaggtacttcacagcattgccaat

SEQ ID NO: 16806 - DNA, 25 bp, Mus musculus
aaaggtacttcagagcattgccaat

SEQ ID NO: 16807 - DNA, 25 bp, Mus musculus
aaaggtacttgcaggacagcctcct

SEQ ID NO: 16808 - DNA, 25 bp, Mus musculus
aaaggtacttgctggacagcctcct

SEQ ID NO: 16809 - DNA, 25 bp, Mus musculus
aaaggtagccatcttccagaaccca

SEQ ID NO: 16810 - DNA, 25 bp, Mus musculus
aaaggtagccatgttccagaaccca

SEQ ID NO: 16811 - DNA, 25 bp, Mus musculus
aaaggtaggactcccttcagggagt

SEQ ID NO: 16812 - DNA, 25 bp, Mus musculus
aaaggtaggactgccttcagggagt

SEQ ID NO: 16813 - DNA, 25 bp, Mus musculus
aaaggtagtgtcctctggtgtctgc

SEQ ID NO: 16814 - DNA, 25 bp, Mus musculus
aaaggtagtgtcgtctggtgtctgc

SEQ ID NO: 16815 - DNA, 25 bp, Mus musculus
aaaggtagttgccaagcgcctcagg

SEQ ID NO: 16816 - DNA, 25 bp, Mus musculus
aaaggtagttgcgaagcgcctcagg

SEQ ID NO: 16817 - DNA, 25 bp, Mus musculus
aaaggtataattcatctccagcagt

SEQ ID NO: 16818 - DNA, 25 bp, Mus musculus
aaaggtataattgatctccagcagt

SEQ ID NO: 16819 - DNA, 25 bp, Mus musculus
aaaggtatcagccatgcgctaccag

SEQ ID NO: 16820 - DNA, 25 bp, Mus musculus
aaaggtatcagcgatgcgctaccag

SEQ ID NO: 16821 - DNA, 25 bp, Mus musculus
aaaggtatcatgagtacagctcagt

SEQ ID NO: 16822 - DNA, 25 bp, Mus musculus
aaaggtatcatgtgtacagctcagt

SEQ ID NO: 16823 - DNA, 25 bp, Mus musculus
aaaggtatccttcgacagataacaa

SEQ ID NO: 16824 - DNA, 25 bp, Mus musculus
aaaggtatccttggacagataacaa

SEQ ID NO: 16825 - DNA, 25 bp, Mus musculus
aaaggtatgcaccattcctaacaaa

SEQ ID NO: 16826 - DNA, 25 bp, Mus musculus
aaaggtatgcacgattcctaacaaa

SEQ ID NO: 16827 - DNA, 25 bp, Mus musculus
aaaggtatggatcagccctgcctgc

SEQ ID NO: 16828 - DNA, 25 bp, Mus musculus
aaaggtatggatgagccctgcctgc

SEQ ID NO: 16829 - DNA, 25 bp, Mus musculus
aaaggtatgtgcatgactgcttcaa

SEQ ID NO: 16830 - DNA, 25 bp, Mus musculus
aaaggtatgtgcttgactgcttcaa

SEQ ID NO: 16831 - DNA, 25 bp, Mus musculus
aaaggtatgtgtcgccatgtcccac

SEQ ID NO: 16832 - DNA, 25 bp, Mus musculus
aaaggtatgtgtggccatgtcccac

SEQ ID NO: 16833 - DNA, 25 bp, Mus musculus
aaaggtattctgacctggtgttcct

SEQ ID NO: 16834 - DNA, 25 bp, Mus musculus
aaaggtattctgtcctggtgttcct

SEQ ID NO: 16835 - DNA, 25 bp, Mus musculus
aaaggtattgctctggttgtctcca

SEQ ID NO: 16836 - DNA, 25 bp, Mus musculus
aaaggtattgctgtggttgtctcca

SEQ ID NO: 16837 - DNA, 25 bp, Mus musculus
aaaggtattggccaccaagcctgat

SEQ ID NO: 16838 - DNA, 25 bp, Mus musculus
aaaggtattggcgaccaagcctgat

SEQ ID NO: 16839 - DNA, 25 bp, Mus musculus
aaaggtcaaccaactccaatttcag

SEQ ID NO: 16840 - DNA, 25 bp, Mus musculus
aaaggtcaaccatctccaatttcag

SEQ ID NO: 16841 - DNA, 25 bp, Mus musculus
aaaggtcaagttagcctctagtgca

SEQ ID NO: 16842 - DNA, 25 bp, Mus musculus
aaaggtcaagtttgcctctagtgca

SEQ ID NO: 16843 - DNA, 25 bp, Mus musculus
aaaggtcaatgcagtcctgggctct

SEQ ID NO: 16844 - DNA, 25 bp, Mus musculus
aaaggtcaatgctgtcctgggctct

SEQ ID NO: 16845 - DNA, 25 bp, Mus musculus
aaaggtcacaatatcatggtcatct

SEQ ID NO: 16846 - DNA, 25 bp, Mus musculus
aaaggtcacaatttcatggtcatct

SEQ ID NO: 16847 - DNA, 25 bp, Mus musculus
aaaggtcacactaactccaacatgc

SEQ ID NO: 16848 - DNA, 25 bp, Mus musculus
aaaggtcacacttactccaacatgc

SEQ ID NO: 16849 - DNA, 25 bp, Mus musculus
aaaggtcaccaaccaggactgctgc

SEQ ID NO: 16850 - DNA, 25 bp, Mus musculus
aaaggtcaccaagcaggactgctgc

SEQ ID NO: 16851 - DNA, 25 bp, Mus musculus
aaaggtcacgtgactaccctcagtg

SEQ ID NO: 16852 - DNA, 25 bp, Mus musculus
aaaggtcacgtgtctaccctcagtg

SEQ ID NO: 16853 - DNA, 25 bp, Mus musculus
aaaggtcactcactcaaagtggctg

SEQ ID NO: 16854 - DNA, 25 bp, Mus musculus
aaaggtcactcagtcaaagtggctg

SEQ ID NO: 16855 - DNA, 25 bp, Mus musculus
aaaggtcactcccatgttatttttg

SEQ ID NO: 16856 - DNA, 25 bp, Mus musculus
aaaggtcactccgatgttatttttg

SEQ ID NO: 16857 - DNA, 25 bp, Mus musculus
aaaggtcactgaagagtccgcaaga

SEQ ID NO: 16858 - DNA, 25 bp, Mus musculus
aaaggtcactgatgagtccgcaaga

SEQ ID NO: 16859 - DNA, 25 bp, Mus musculus
aaaggtcactgtaactcgagattaa

SEQ ID NO: 16860 - DNA, 25 bp, Mus musculus
aaaggtcactgttactcgagattaa

SEQ ID NO: 16861 - DNA, 25 bp, Mus musculus
aaaggtcagcaaaaccggtgccgag

SEQ ID NO: 16862 - DNA, 25 bp, Mus musculus
aaaggtcagcaataccggtgccgag

SEQ ID NO: 16863 - DNA, 25 bp, Mus musculus
aaaggtcagcctccctttggagctg

SEQ ID NO: 16864 - DNA, 25 bp, Mus musculus
aaaggtcagcctgcctttggagctg

SEQ ID NO: 16865 - DNA, 25 bp, Mus musculus
aaaggtcaggttacactggcccaca

SEQ ID NO: 16866 - DNA, 25 bp, Mus musculus
aaaggtcaggtttcactggcccaca

SEQ ID NO: 16867 - DNA, 25 bp, Mus musculus
aaaggtcatattaggctcacacact

SEQ ID NO: 16868 - DNA, 25 bp, Mus musculus
aaaggtcatatttggctcacacact

SEQ ID NO: 16869 - DNA, 25 bp, Mus musculus
aaaggtcatcccagtccacgggagg

SEQ ID NO: 16870 - DNA, 25 bp, Mus musculus
aaaggtcatccctgtccacgggagg

SEQ ID NO: 16871 - DNA, 25 bp, Mus musculus
aaaggtcattcgaatgtcacatgtt

SEQ ID NO: 16872 - DNA, 25 bp, Mus musculus
aaaggtcattcgtatgtcacatgtt

SEQ ID NO: 16873 - DNA, 25 bp, Mus musculus
aaaggtcattgtcacctccataggc

SEQ ID NO: 16874 - DNA, 25 bp, Mus musculus
aaaggtcattgtgacctccataggc

SEQ ID NO: 16875 - DNA, 25 bp, Mus musculus
aaaggtccaatcagatcgggtagca

SEQ ID NO: 16876 - DNA, 25 bp, Mus musculus
aaaggtccaatctgatcgggtagca

SEQ ID NO: 16877 - DNA, 25 bp, Mus musculus
aaaggtccacagctatcctatctac

SEQ ID NO: 16878 - DNA, 25 bp, Mus musculus
aaaggtccacaggtatcctatctac

SEQ ID NO: 16879 - DNA, 25 bp, Mus musculus
aaaggtccaggcacttcagcagtat

SEQ ID NO: 16880 - DNA, 25 bp, Mus musculus
aaaggtccaggctcttcagcagtat

SEQ ID NO: 16881 - DNA, 25 bp, Mus musculus
aaaggtccatgtctcctgtacttgc

SEQ ID NO: 16882 - DNA, 25 bp, Mus musculus
aaaggtccatgtgtcctgtacttgc

SEQ ID NO: 16883 - DNA, 25 bp, Mus musculus
aaaggtcctcacaccattcatgtcc

SEQ ID NO: 16884 - DNA, 25 bp, Mus musculus
aaaggtcctcactccattcatgtcc

SEQ ID NO: 16885 - DNA, 25 bp, Mus musculus
aaaggtcctcagcacaagcatcttg

SEQ ID NO: 16886 - DNA, 25 bp, Mus musculus
aaaggtcctcaggacaagcatcttg

SEQ ID NO: 16887 - DNA, 25 bp, Mus musculus
aaaggtcctcatcagcagctataac

SEQ ID NO: 16888 - DNA, 25 bp, Mus musculus
aaaggtcctcatcaggagctgcaac

SEQ ID NO: 16889 - DNA, 25 bp, Mus musculus
aaaggtcctcatgagcagctataac

SEQ ID NO: 16890 - DNA, 25 bp, Mus musculus
aaaggtcctcatgaggagctgcaac

SEQ ID NO: 16891 - DNA, 25 bp, Mus musculus
aaaggtcctcctcattacactatgc

SEQ ID NO: 16892 - DNA, 25 bp, Mus musculus
aaaggtcctcctgattacactatgc

SEQ ID NO: 16893 - DNA, 25 bp, Mus musculus
aaaggtcctctgaatgcagggatga

SEQ ID NO: 16894 - DNA, 25 bp, Mus musculus
aaaggtcctctgtatgcagggatga

SEQ ID NO: 16895 - DNA, 25 bp, Mus musculus
aaaggtcctgtgacgagatggtccc

SEQ ID NO: 16896 - DNA, 25 bp, Mus musculus
aaaggtcctgtgtcgagatggtccc

SEQ ID NO: 16897 - DNA, 25 bp, Mus musculus
aaaggtccttcaaatagtgccatga

SEQ ID NO: 16898 - DNA, 25 bp, Mus musculus
aaaggtccttcatatagtgccatga

SEQ ID NO: 16899 - DNA, 25 bp, Mus musculus
aaaggtcgactacaggcgttgattt

SEQ ID NO: 16900 - DNA, 25 bp, Mus musculus
aaaggtcgactagaggcgttgattt

SEQ ID NO: 16901 - DNA, 25 bp, Mus musculus
aaaggtcgccgtactgaaatgcttg

SEQ ID NO: 16902 - DNA, 25 bp, Mus musculus
aaaggtcgccgttctgaaatgcttg

SEQ ID NO: 16903 - DNA, 25 bp, Mus musculus
aaaggtcggagaactttcttctgcc

SEQ ID NO: 16904 - DNA, 25 bp, Mus musculus
aaaggtcggagatctttcttctgcc

SEQ ID NO: 16905 - DNA, 25 bp, Mus musculus
aaaggtctaaggacctgcctccaag

SEQ ID NO: 16906 - DNA, 25 bp, Mus musculus
aaaggtctaaggtcctgcctccaag

SEQ ID NO: 16907 - DNA, 25 bp, Mus musculus
aaaggtctccagaagatgtccctgt

SEQ ID NO: 16908 - DNA, 25 bp, Mus musculus
aaaggtctccagtagatgtccctgt

SEQ ID NO: 16909 - DNA, 25 bp, Mus musculus
aaaggtctcctcagtgatgcagagc

SEQ ID NO: 16910 - DNA, 25 bp, Mus musculus
aaaggtctcctctgtgatgcagagc

SEQ ID NO: 16911 - DNA, 25 bp, Mus musculus
aaaggtctctaaatcagttcatgcc

SEQ ID NO: 16912 - DNA, 25 bp, Mus musculus
aaaggtctctaactcctggatgcca

SEQ ID NO: 16913 - DNA, 25 bp, Mus musculus
aaaggtctctaagtcctggatgcca

SEQ ID NO: 16914 - DNA, 25 bp, Mus musculus
aaaggtctctaattcagttcatgcc

SEQ ID NO: 16915 - DNA, 25 bp, Mus musculus
aaaggtctctcacctagagtccatg

SEQ ID NO: 16916 - DNA, 25 bp, Mus musculus
aaaggtctctcagctagagtccatg

SEQ ID NO: 16917 - DNA, 25 bp, Mus musculus
aaaggtctctctcttcccaaatgct

SEQ ID NO: 16918 - DNA, 25 bp, Mus musculus
aaaggtctctctgttcccaaatgct

SEQ ID NO: 16919 - DNA, 25 bp, Mus musculus
aaaggtctgacaacattatttacta

SEQ ID NO: 16920 - DNA, 25 bp, Mus musculus
aaaggtctgacatcattatttacta

SEQ ID NO: 16921 - DNA, 25 bp, Mus musculus
aaaggtctgcacacagtggtacctg

SEQ ID NO: 16922 - DNA, 25 bp, Mus musculus
aaaggtctgcactcagtggtacctg

SEQ ID NO: 16923 - DNA, 25 bp, Mus musculus
aaaggtctgcgcagttcgagcacac

SEQ ID NO: 16924 - DNA, 25 bp, Mus musculus
aaaggtctgcgctgttcgagcacac

SEQ ID NO: 16925 - DNA, 25 bp, Mus musculus
aaaggtctgctgaagcagtcagcaa

SEQ ID NO: 16926 - DNA, 25 bp, Mus musculus
aaaggtctgctgtagcagtcagcaa

SEQ ID NO: 16927 - DNA, 25 bp, Mus musculus
aaaggtctggccagtggtagcagca

SEQ ID NO: 16928 - DNA, 25 bp, Mus musculus
aaaggtctggcctgtggtagcagca

SEQ ID NO: 16929 - DNA, 25 bp, Mus musculus
aaaggtctggtaagccaggcccatg

SEQ ID NO: 16930 - DNA, 25 bp, Mus musculus
aaaggtctggtatgccaggcccatg

SEQ ID NO: 16931 - DNA, 25 bp, Mus musculus
aaaggtctgtatcattttaatgcat

SEQ ID NO: 16932 - DNA, 25 bp, Mus musculus
aaaggtctgtatgattttaatgcat

SEQ ID NO: 16933 - DNA, 25 bp, Mus musculus
aaaggtctgtccatctatgtcacag

SEQ ID NO: 16934 - DNA, 25 bp, Mus musculus
aaaggtctgtccttctatgtcacag

SEQ ID NO: 16935 - DNA, 25 bp, Mus musculus
aaaggtctgtgtctggccccattgg

SEQ ID NO: 16936 - DNA, 25 bp, Mus musculus
aaaggtctgtgtgtggccccattgg

SEQ ID NO: 16937 - DNA, 25 bp, Mus musculus
aaaggtctgttgctgcatacctcca

SEQ ID NO: 16938 - DNA, 25 bp, Mus musculus
aaaggtctgttggtgcatacctcca

SEQ ID NO: 16939 - DNA, 25 bp, Mus musculus
aaaggtctgtttacattctggtgct

SEQ ID NO: 16940 - DNA, 25 bp, Mus musculus
aaaggtctgttttcattctggtgct

SEQ ID NO: 16941 - DNA, 25 bp, Mus musculus
aaaggtcttgctattatgggctggc

SEQ ID NO: 16942 - DNA, 25 bp, Mus musculus
aaaggtcttgcttttatgggctggc

SEQ ID NO: 16943 - DNA, 25 bp, Mus musculus
aaaggtcttggtcttgccacatgtc

SEQ ID NO: 16944 - DNA, 25 bp, Mus musculus
aaaggtcttggtgttgccacatgtc

SEQ ID NO: 16945 - DNA, 25 bp, Mus musculus
aaaggtcttgtaatattccagaagc

SEQ ID NO: 16946 - DNA, 25 bp, Mus musculus
aaaggtcttgtattattccagaagc

SEQ ID NO: 16947 - DNA, 25 bp, Mus musculus
aaaggtcttgtgatctaattctagt

SEQ ID NO: 16948 - DNA, 25 bp, Mus musculus
aaaggtcttgtgttctaattctagt

SEQ ID NO: 16949 - DNA, 25 bp, Mus musculus
aaaggtctttccattttgcttcgag

SEQ ID NO: 16950 - DNA, 25 bp, Mus musculus
aaaggtctttcctttttgcttcgag

SEQ ID NO: 16951 - DNA, 25 bp, Mus musculus
aaaggtgaaactaagcttcttgctt

SEQ ID NO: 16952 - DNA, 25 bp, Mus musculus
aaaggtgaaacttagcttcttgctt

SEQ ID NO: 16953 - DNA, 25 bp, Mus musculus
aaaggtgaacccaactcagtgtgaa

SEQ ID NO: 16954 - DNA, 25 bp, Mus musculus
aaaggtgaaccctactcagtgtgaa

SEQ ID NO: 16955 - DNA, 25 bp, Mus musculus
aaaggtgaacgacgctctccaggtc

SEQ ID NO: 16956 - DNA, 25 bp, Mus musculus
aaaggtgaacgaggctctccaggtc

SEQ ID NO: 16957 - DNA, 25 bp, Mus musculus
aaaggtgaatctactgtatgccaac

SEQ ID NO: 16958 - DNA, 25 bp, Mus musculus
aaaggtgaatcttctgtatgccaac

SEQ ID NO: 16959 - DNA, 25 bp, Mus musculus
aaaggtgacaaacgccacgtctgct

SEQ ID NO: 16960 - DNA, 25 bp, Mus musculus
aaaggtgacaaaggccacgtctgct

SEQ ID NO: 16961 - DNA, 25 bp, Mus musculus
aaaggtgacagaacctgacattcaa

SEQ ID NO: 16962 - DNA, 25 bp, Mus musculus
aaaggtgacagatcctgacattcaa

SEQ ID NO: 16963 - DNA, 25 bp, Mus musculus
aaaggtgacagcatcattgttgatc

SEQ ID NO: 16964 - DNA, 25 bp, Mus musculus
aaaggtgacagcttcattgttgatc

SEQ ID NO: 16965 - DNA, 25 bp, Mus musculus
aaaggtgaccagcagctcccgggat

SEQ ID NO: 16966 - DNA, 25 bp, Mus musculus
aaaggtgaccaggagctcccgggat

SEQ ID NO: 16967 - DNA, 25 bp, Mus musculus
aaaggtgacccgcatggtgtccatc

SEQ ID NO: 16968 - DNA, 25 bp, Mus musculus
aaaggtgacccggatggtgtccatc

SEQ ID NO: 16969 - DNA, 25 bp, Mus musculus
aaaggtgacctcacagccagagagc

SEQ ID NO: 16970 - DNA, 25 bp, Mus musculus
aaaggtgacctctcagccagagagc

SEQ ID NO: 16971 - DNA, 25 bp, Mus musculus
aaaggtgactggcttttcacgtgat

SEQ ID NO: 16972 - DNA, 25 bp, Mus musculus
aaaggtgactgggttttcacgtgat

SEQ ID NO: 16973 - DNA, 25 bp, Mus musculus
aaaggtgactgtcgtccggaacttg

SEQ ID NO: 16974 - DNA, 25 bp, Mus musculus
aaaggtgactgtggtccggaacttg

SEQ ID NO: 16975 - DNA, 25 bp, Mus musculus
aaaggtgagctcagtgttgccctcc

SEQ ID NO: 16976 - DNA, 25 bp, Mus musculus
aaaggtgagctctgtgttgccctcc

SEQ ID NO: 16977 - DNA, 25 bp, Mus musculus
aaaggtgagcttagaactgtagata

SEQ ID NO: 16978 - DNA, 25 bp, Mus musculus
aaaggtgagctttgaactgtagata

SEQ ID NO: 16979 - DNA, 25 bp, Mus musculus
aaaggtgagtccaactcatccagtc

SEQ ID NO: 16980 - DNA, 25 bp, Mus musculus
aaaggtgagtcctactcatccagtc

SEQ ID NO: 16981 - DNA, 25 bp, Mus musculus
aaaggtgatggaaaggtctcttgaa

SEQ ID NO: 16982 - DNA, 25 bp, Mus musculus
aaaggtgatggataggtctcttgaa

SEQ ID NO: 16983 - DNA, 25 bp, Mus musculus
aaaggtgattggcactggctcccag

SEQ ID NO: 16984 - DNA, 25 bp, Mus musculus
aaaggtgattgggactggctcccag

SEQ ID NO: 16985 - DNA, 25 bp, Mus musculus
aaaggtgatttcagcccatctgact

SEQ ID NO: 16986 - DNA, 25 bp, Mus musculus
aaaggtgatttctgcccatctgact

SEQ ID NO: 16987 - DNA, 25 bp, Mus musculus
aaaggtgcacagattcagttttcaa

SEQ ID NO: 16988 - DNA, 25 bp, Mus musculus
aaaggtgcacagtttcagttttcaa

SEQ ID NO: 16989 - DNA, 25 bp, Mus musculus
aaaggtgcagagaccctgctccgat

SEQ ID NO: 16990 - DNA, 25 bp, Mus musculus
aaaggtgcagagtccctgctccgat

SEQ ID NO: 16991 - DNA, 25 bp, Mus musculus
aaaggtgcagatcccaaatctgtgg

SEQ ID NO: 16992 - DNA, 25 bp, Mus musculus
aaaggtgcagatgccaaatctgtgg

SEQ ID NO: 16993 - DNA, 25 bp, Mus musculus
aaaggtgcagccaccagttgtcgaa

SEQ ID NO: 16994 - DNA, 25 bp, Mus musculus
aaaggtgcagcctccagttgtcgaa

SEQ ID NO: 16995 - DNA, 25 bp, Mus musculus
aaaggtgcaggcataaagcagatct

SEQ ID NO: 16996 - DNA, 25 bp, Mus musculus
aaaggtgcaggcttaaagcagatct

SEQ ID NO: 16997 - DNA, 25 bp, Mus musculus
aaaggtgcaggtccgtttcatctgt

SEQ ID NO: 16998 - DNA, 25 bp, Mus musculus
aaaggtgcaggtgcgtttcatctgt

SEQ ID NO: 16999 - DNA, 25 bp, Mus musculus
aaaggtgcattaattctgacattga

SEQ ID NO: 17000 - DNA, 25 bp, Mus musculus
aaaggtgcattatttctgacattga

SEQ ID NO: 17001 - DNA, 25 bp, Mus musculus
aaaggtgcccagaattcactaacag

SEQ ID NO: 17002 - DNA, 25 bp, Mus musculus
aaaggtgcccagtattcactaacag

SEQ ID NO: 17003 - DNA, 25 bp, Mus musculus
aaaggtgcccctagaggtccaggag

SEQ ID NO: 17004 - DNA, 25 bp, Mus musculus
aaaggtgccccttgaggtccaggag

SEQ ID NO: 17005 - DNA, 25 bp, Mus musculus
aaaggtgccctgcaacccagagctt

SEQ ID NO: 17006 - DNA, 25 bp, Mus musculus
aaaggtgccctggaacccagagctt

SEQ ID NO: 17007 - DNA, 25 bp, Mus musculus
aaaggtgccgtcactttaagttctg

SEQ ID NO: 17008 - DNA, 25 bp, Mus musculus
aaaggtgccgtctctttaagttctg

SEQ ID NO: 17009 - DNA, 25 bp, Mus musculus
aaaggtgcctcaccatagccagcat

SEQ ID NO: 17010 - DNA, 25 bp, Mus musculus
aaaggtgcctcagcatagccagcat

SEQ ID NO: 17011 - DNA, 25 bp, Mus musculus
aaaggtgcctctagtaagccagtgc

SEQ ID NO: 17012 - DNA, 25 bp, Mus musculus
aaaggtgcctcttgtaagccagtgc

SEQ ID NO: 17013 - DNA, 25 bp, Mus musculus
aaaggtgcctgcatccaagactacc

SEQ ID NO: 17014 - DNA, 25 bp, Mus musculus
aaaggtgcctgcttccaagactacc

SEQ ID NO: 17015 - DNA, 25 bp, Mus musculus
aaaggtgccttaaggaggtccagct

SEQ ID NO: 17016 - DNA, 25 bp, Mus musculus
aaaggtgccttatggaggtccagct

SEQ ID NO: 17017 - DNA, 25 bp, Mus musculus
aaaggtgccttgagggaccatgaaa

SEQ ID NO: 17018 - DNA, 25 bp, Mus musculus
aaaggtgccttgatggtgttagtga

SEQ ID NO: 17019 - DNA, 25 bp, Mus musculus
aaaggtgccttgtgggaccatgaaa

SEQ ID NO: 17020 - DNA, 25 bp, Mus musculus
aaaggtgccttgttggtgttagtga

SEQ ID NO: 17021 - DNA, 25 bp, Mus musculus
aaaggtgctactaatgtgcctggca

SEQ ID NO: 17022 - DNA, 25 bp, Mus musculus
aaaggtgctactcggcaccatccaa

SEQ ID NO: 17023 - DNA, 25 bp, Mus musculus
aaaggtgctactgggcaccatccaa

SEQ ID NO: 17024 - DNA, 25 bp, Mus musculus
aaaggtgctacttatgtgcctggca

SEQ ID NO: 17025 - DNA, 25 bp, Mus musculus
aaaggtgctatacatggacgccatg

SEQ ID NO: 17026 - DNA, 25 bp, Mus musculus
aaaggtgctatagatggacgccatg

SEQ ID NO: 17027 - DNA, 25 bp, Mus musculus
aaaggtgctatgctgcccatgagct

SEQ ID NO: 17028 - DNA, 25 bp, Mus musculus
aaaggtgctatggtgcccatgagct

SEQ ID NO: 17029 - DNA, 25 bp, Mus musculus
aaaggtgctcctaggcgaagtcatc

SEQ ID NO: 17030 - DNA, 25 bp, Mus musculus
aaaggtgctcctagtgggacatcct

SEQ ID NO: 17031 - DNA, 25 bp, Mus musculus
aaaggtgctccttggcgaagtcatc

SEQ ID NO: 17032 - DNA, 25 bp, Mus musculus
aaaggtgctccttgtgggacatcct

SEQ ID NO: 17033 - DNA, 25 bp, Mus musculus
aaaggtgctggacaatcgccggcct

SEQ ID NO: 17034 - DNA, 25 bp, Mus musculus
aaaggtgctggacttgggctcctca

SEQ ID NO: 17035 - DNA, 25 bp, Mus musculus
aaaggtgctggagaatcgccggcct

SEQ ID NO: 17036 - DNA, 25 bp, Mus musculus
aaaggtgctggagttgggctcctca

SEQ ID NO: 17037 - DNA, 25 bp, Mus musculus
aaaggtgctggcatctaagcctggc

SEQ ID NO: 17038 - DNA, 25 bp, Mus musculus
aaaggtgctggcttctaagcctggc

SEQ ID NO: 17039 - DNA, 25 bp, Mus musculus
aaaggtgctggtcactatcgaagaa

SEQ ID NO: 17040 - DNA, 25 bp, Mus musculus
aaaggtgctggtgactatcgaagaa

SEQ ID NO: 17041 - DNA, 25 bp, Mus musculus
aaaggtgctgtcagagttgtatctc

SEQ ID NO: 17042 - DNA, 25 bp, Mus musculus
aaaggtgctgtctgagttgtatctc

SEQ ID NO: 17043 - DNA, 25 bp, Mus musculus
aaaggtgctgtgatcctcatgagtt

SEQ ID NO: 17044 - DNA, 25 bp, Mus musculus
aaaggtgctgtgttcctcatgagtt

SEQ ID NO: 17045 - DNA, 25 bp, Mus musculus
aaaggtgctgttatcagtctccaca

SEQ ID NO: 17046 - DNA, 25 bp, Mus musculus
aaaggtgctgttttcagtctccaca

SEQ ID NO: 17047 - DNA, 25 bp, Mus musculus
aaaggtgctttaaggcgtcctctgc

SEQ ID NO: 17048 - DNA, 25 bp, Mus musculus
aaaggtgctttatggcgtcctctgc

SEQ ID NO: 17049 - DNA, 25 bp, Mus musculus
aaaggtgctttcataggtgctggct

SEQ ID NO: 17050 - DNA, 25 bp, Mus musculus
aaaggtgctttcatggttcctgccc

SEQ ID NO: 17051 - DNA, 25 bp, Mus musculus
aaaggtgctttcttaggtgctggct

SEQ ID NO: 17052 - DNA, 25 bp, Mus musculus
aaaggtgctttcttggttcctgccc

SEQ ID NO: 17053 - DNA, 25 bp, Mus musculus
aaaggtggaacacacgtggccctcg

SEQ ID NO: 17054 - DNA, 25 bp, Mus musculus
aaaggtggaacagacgtggccctcg

SEQ ID NO: 17055 - DNA, 25 bp, Mus musculus
aaaggtggacttagagccaagcaca

SEQ ID NO: 17056 - DNA, 25 bp, Mus musculus
aaaggtggactttgagccaagcaca

SEQ ID NO: 17057 - DNA, 25 bp, Mus musculus
aaaggtggagctccaaatggaattt

SEQ ID NO: 17058 - DNA, 25 bp, Mus musculus
aaaggtggagctgcaaatggaattt

SEQ ID NO: 17059 - DNA, 25 bp, Mus musculus
aaaggtggcagactccaggttgtcc

SEQ ID NO: 17060 - DNA, 25 bp, Mus musculus
aaaggtggcagagtccaggttgtcc

SEQ ID NO: 17061 - DNA, 25 bp, Mus musculus
aaaggtggccagcaaaaacagaaag

SEQ ID NO: 17062 - DNA, 25 bp, Mus musculus
aaaggtggccaggaaaaacagaaag

SEQ ID NO: 17063 - DNA, 25 bp, Mus musculus
aaaggtggcctccagagcatcaccc

SEQ ID NO: 17064 - DNA, 25 bp, Mus musculus
aaaggtggcctcgagagcatcaccc

SEQ ID NO: 17065 - DNA, 25 bp, Mus musculus
aaaggtggccttctgatcaacgaaa

SEQ ID NO: 17066 - DNA, 25 bp, Mus musculus
aaaggtggccttgtgatcaacgaaa

SEQ ID NO: 17067 - DNA, 25 bp, Mus musculus
aaaggtggctagctgcttccatagc

SEQ ID NO: 17068 - DNA, 25 bp, Mus musculus
aaaggtggctaggtgcttccatagc

SEQ ID NO: 17069 - DNA, 25 bp, Mus musculus
aaaggtggctctccgggtcctattc

SEQ ID NO: 17070 - DNA, 25 bp, Mus musculus
aaaggtggctctgcgggtcctattc

SEQ ID NO: 17071 - DNA, 25 bp, Mus musculus
aaaggtggcttccactgatgtggct

SEQ ID NO: 17072 - DNA, 25 bp, Mus musculus
aaaggtggcttcgactgatgtggct

SEQ ID NO: 17073 - DNA, 25 bp, Mus musculus
aaaggtgggactcttgcagccaagt

SEQ ID NO: 17074 - DNA, 25 bp, Mus musculus
aaaggtgggactgttgcagccaagt

SEQ ID NO: 17075 - DNA, 25 bp, Mus musculus
aaaggtgggctccagtaagcacaag

SEQ ID NO: 17076 - DNA, 25 bp, Mus musculus
aaaggtgggctcgagtaagcacaag

SEQ ID NO: 17077 - DNA, 25 bp, Mus musculus
aaaggtgggtcacggtgtgtgttca

SEQ ID NO: 17078 - DNA, 25 bp, Mus musculus
aaaggtgggtcagggtgtgtgttca

SEQ ID NO: 17079 - DNA, 25 bp, Mus musculus
aaaggtggtaggatcttctctctct

SEQ ID NO: 17080 - DNA, 25 bp, Mus musculus
aaaggtggtaggttcttctctctct

SEQ ID NO: 17081 - DNA, 25 bp, Mus musculus
aaaggtggtcacaccagatcctgtt

SEQ ID NO: 17082 - DNA, 25 bp, Mus musculus
aaaggtggtcactccagatcctgtt

SEQ ID NO: 17083 - DNA, 25 bp, Mus musculus
aaaggtggtcatatggctggctata

SEQ ID NO: 17084 - DNA, 25 bp, Mus musculus
aaaggtggtcatttggctggctata

SEQ ID NO: 17085 - DNA, 25 bp, Mus musculus
aaaggtggtgaacctcttggcctct

SEQ ID NO: 17086 - DNA, 25 bp, Mus musculus
aaaggtggtgaagctcttggcctct

SEQ ID NO: 17087 - DNA, 25 bp, Mus musculus
aaaggtgtaaagagcaccaggctaa

SEQ ID NO: 17088 - DNA, 25 bp, Mus musculus
aaaggtgtaaagtgcaccaggctaa

SEQ ID NO: 17089 - DNA, 25 bp, Mus musculus
aaaggtgtacccactgactacacat

SEQ ID NO: 17090 - DNA, 25 bp, Mus musculus
aaaggtgtaccctctgactacacat

SEQ ID NO: 17091 - DNA, 25 bp, Mus musculus
aaaggtgtacgaccagatgcccgaa

SEQ ID NO: 17092 - DNA, 25 bp, Mus musculus
aaaggtgtacgagcagatgcccgaa

SEQ ID NO: 17093 - DNA, 25 bp, Mus musculus
aaaggtgtacgcattctgtacgtga

SEQ ID NO: 17094 - DNA, 25 bp, Mus musculus
aaaggtgtacgctttctgtacgtga

SEQ ID NO: 17095 - DNA, 25 bp, Mus musculus
aaaggtgtatcaatcccctgcccca

SEQ ID NO: 17096 - DNA, 25 bp, Mus musculus
aaaggtgtatcattcccctgcccca

SEQ ID NO: 17097 - DNA, 25 bp, Mus musculus
aaaggtgtcatacgtcaaggctatt

SEQ ID NO: 17098 - DNA, 25 bp, Mus musculus
aaaggtgtcataggtcaaggctatt

SEQ ID NO: 17099 - DNA, 25 bp, Mus musculus
aaaggtgtcatcaagaagcgctgta

SEQ ID NO: 17100 - DNA, 25 bp, Mus musculus
aaaggtgtcatctagaagcgctgta

SEQ ID NO: 17101 - DNA, 25 bp, Mus musculus
aaaggtgtccggagcaagccaagta

SEQ ID NO: 17102 - DNA, 25 bp, Mus musculus
aaaggtgtccggtgcaagccaagta

SEQ ID NO: 17103 - DNA, 25 bp, Mus musculus
aaaggtgtcgttccttttgcatgtg

SEQ ID NO: 17104 - DNA, 25 bp, Mus musculus
aaaggtgtcgttgcttttgcatgtg

SEQ ID NO: 17105 - DNA, 25 bp, Mus musculus
aaaggtgtcttcatcacagactctc

SEQ ID NO: 17106 - DNA, 25 bp, Mus musculus
aaaggtgtcttcttcacagactctc

SEQ ID NO: 17107 - DNA, 25 bp, Mus musculus
aaaggtgtgagcaccacctcctttt

SEQ ID NO: 17108 - DNA, 25 bp, Mus musculus
aaaggtgtgagctccacctcctttt

SEQ ID NO: 17109 - DNA, 25 bp, Mus musculus
aaaggtgtggagatcctcctcagct

SEQ ID NO: 17110 - DNA, 25 bp, Mus musculus
aaaggtgtggagttcctcctcagct

SEQ ID NO: 17111 - DNA, 25 bp, Mus musculus
aaaggtgtggcaattcagttgtaat

SEQ ID NO: 17112 - DNA, 25 bp, Mus musculus
aaaggtgtggcatttcagttgtaat

SEQ ID NO: 17113 - DNA, 25 bp, Mus musculus
aaaggtgtggctccttggttagctc

SEQ ID NO: 17114 - DNA, 25 bp, Mus musculus
aaaggtgtggctgcttggttagctc

SEQ ID NO: 17115 - DNA, 25 bp, Mus musculus
aaaggtgtgtatcgccatgcctgaa

SEQ ID NO: 17116 - DNA, 25 bp, Mus musculus
aaaggtgtgtatggccatgcctgaa

SEQ ID NO: 17117 - DNA, 25 bp, Mus musculus
aaaggtgtgtttcctatgttgatag

SEQ ID NO: 17118 - DNA, 25 bp, Mus musculus
aaaggtgtgtttgctatgttgatag

SEQ ID NO: 17119 - DNA, 25 bp, Mus musculus
aaaggtgttcagagttcacgtgtga

SEQ ID NO: 17120 - DNA, 25 bp, Mus musculus
aaaggtgttcagtgttcacgtgtga

SEQ ID NO: 17121 - DNA, 25 bp, Mus musculus
aaaggtgttccacgcctcaactcaa

SEQ ID NO: 17122 - DNA, 25 bp, Mus musculus
aaaggtgttccaggcctcaactcaa

SEQ ID NO: 17123 - DNA, 25 bp, Mus musculus
aaaggtgttctacctgtttgcatca

SEQ ID NO: 17124 - DNA, 25 bp, Mus musculus
aaaggtgttctagctgtttgcatca

SEQ ID NO: 17125 - DNA, 25 bp, Mus musculus
aaaggtgttggcacgctgtatttaa

SEQ ID NO: 17126 - DNA, 25 bp, Mus musculus
aaaggtgttggctcgctgtatttaa

SEQ ID NO: 17127 - DNA, 25 bp, Mus musculus
aaaggtgttgtcaggtctgttttca

SEQ ID NO: 17128 - DNA, 25 bp, Mus musculus
aaaggtgttgtctggtctgttttca

SEQ ID NO: 17129 - DNA, 25 bp, Mus musculus
aaaggtgttgttatgaagtttgctg

SEQ ID NO: 17130 - DNA, 25 bp, Mus musculus
aaaggtgttgttttgaagtttgctg

SEQ ID NO: 17131 - DNA, 25 bp, Mus musculus
aaaggtgtttccatgacctgaccag

SEQ ID NO: 17132 - DNA, 25 bp, Mus musculus
aaaggtgtttccttgacctgaccag

SEQ ID NO: 17133 - DNA, 25 bp, Mus musculus
aaaggtgtttgtaccgtgactgtag

SEQ ID NO: 17134 - DNA, 25 bp, Mus musculus
aaaggtgtttgttccgtgactgtag

SEQ ID NO: 17135 - DNA, 25 bp, Mus musculus
aaaggttaaagcactgtccacgctc

SEQ ID NO: 17136 - DNA, 25 bp, Mus musculus
aaaggttaaagctctgtccacgctc

SEQ ID NO: 17137 - DNA, 25 bp, Mus musculus
aaaggttagcctctcataacccagc

SEQ ID NO: 17138 - DNA, 25 bp, Mus musculus
aaaggttagcctgtcataacccagc

SEQ ID NO: 17139 - DNA, 25 bp, Mus musculus
aaaggttaggtgctgacgttataca

SEQ ID NO: 17140 - DNA, 25 bp, Mus musculus
aaaggttaggtggtgacgttataca

SEQ ID NO: 17141 - DNA, 25 bp, Mus musculus
aaaggttatagtactctgtgagctg

SEQ ID NO: 17142 - DNA, 25 bp, Mus musculus
aaaggttatagttctctgtgagctg

SEQ ID NO: 17143 - DNA, 25 bp, Mus musculus
aaaggttatgtaccctgttctgtga

SEQ ID NO: 17144 - DNA, 25 bp, Mus musculus
aaaggttatgtagcctgttctgtga

SEQ ID NO: 17145 - DNA, 25 bp, Mus musculus
aaaggttcacataccacgtcctgga

SEQ ID NO: 17146 - DNA, 25 bp, Mus musculus
aaaggttcacattccacgtcctgga

SEQ ID NO: 17147 - DNA, 25 bp, Mus musculus
aaaggttcagggactctattccaag

SEQ ID NO: 17148 - DNA, 25 bp, Mus musculus
aaaggttcagggtctctattccaag

SEQ ID NO: 17149 - DNA, 25 bp, Mus musculus
aaaggttcagtgacttgtgatttca

SEQ ID NO: 17150 - DNA, 25 bp, Mus musculus
aaaggttcagtgtcttgtgatttca

SEQ ID NO: 17151 - DNA, 25 bp, Mus musculus
aaaggttcatggacacagtggagta

SEQ ID NO: 17152 - DNA, 25 bp, Mus musculus
aaaggttcatggtcacagtggagta

SEQ ID NO: 17153 - DNA, 25 bp, Mus musculus
aaaggttcccacagagtaggaccat

SEQ ID NO: 17154 - DNA, 25 bp, Mus musculus
aaaggttcccactgagtaggaccat

SEQ ID NO: 17155 - DNA, 25 bp, Mus musculus
aaaggttcccagactccgcagccgg

SEQ ID NO: 17156 - DNA, 25 bp, Mus musculus
aaaggttcccagtctccgcagccgg

SEQ ID NO: 17157 - DNA, 25 bp, Mus musculus
aaaggttccgacagtggcatcgtga

SEQ ID NO: 17158 - DNA, 25 bp, Mus musculus
aaaggttccgactgtggcatcgtga

SEQ ID NO: 17159 - DNA, 25 bp, Mus musculus
aaaggttccgtcctaaggcatctga

SEQ ID NO: 17160 - DNA, 25 bp, Mus musculus
aaaggttccgtcgtaaggcatctga

SEQ ID NO: 17161 - DNA, 25 bp, Mus musculus
aaaggttcctataatggcccagata

SEQ ID NO: 17162 - DNA, 25 bp, Mus musculus
aaaggttcctattatggcccagata

SEQ ID NO: 17163 - DNA, 25 bp, Mus musculus
aaaggttcctgaagtcgtttgtcaa

SEQ ID NO: 17164 - DNA, 25 bp, Mus musculus
aaaggttcctgatgtcgtttgtcaa

SEQ ID NO: 17165 - DNA, 25 bp, Mus musculus
aaaggttcggaccatgcggatgcac

SEQ ID NO: 17166 - DNA, 25 bp, Mus musculus
aaaggttcggacgatgcggatgcac

SEQ ID NO: 17167 - DNA, 25 bp, Mus musculus
aaaggttcgtttcaaggctggcaag

SEQ ID NO: 17168 - DNA, 25 bp, Mus musculus
aaaggttcgtttgaaggctggcaag

SEQ ID NO: 17169 - DNA, 25 bp, Mus musculus
aaaggttctcatcggttgtgactgt

SEQ ID NO: 17170 - DNA, 25 bp, Mus musculus
aaaggttctcatgggttgtgactgt

SEQ ID NO: 17171 - DNA, 25 bp, Mus musculus
aaaggttctctcagtcggcggaaga

SEQ ID NO: 17172 - DNA, 25 bp, Mus musculus
aaaggttctctctgtcggcggaaga

SEQ ID NO: 17173 - DNA, 25 bp, Mus musculus
aaaggttctggcaatcgctgtatcc

SEQ ID NO: 17174 - DNA, 25 bp, Mus musculus
aaaggttctggctatcgctgtatcc

SEQ ID NO: 17175 - DNA, 25 bp, Mus musculus
aaaggttctgtcagccaatggcagc

SEQ ID NO: 17176 - DNA, 25 bp, Mus musculus
aaaggttctgtctgccaatggcagc

SEQ ID NO: 17177 - DNA, 25 bp, Mus musculus
aaaggttcttcaattacttcatgtg

SEQ ID NO: 17178 - DNA, 25 bp, Mus musculus
aaaggttcttcatttacttcatgtg

SEQ ID NO: 17179 - DNA, 25 bp, Mus musculus
aaaggttgagacagcacttgatcga

SEQ ID NO: 17180 - DNA, 25 bp, Mus musculus
aaaggttgagactgcacttgatcga

SEQ ID NO: 17181 - DNA, 25 bp, Mus musculus
aaaggttgatgccacagtcccgagt

SEQ ID NO: 17182 - DNA, 25 bp, Mus musculus
aaaggttgatgcgacagtcccgagt

SEQ ID NO: 17183 - DNA, 25 bp, Mus musculus
aaaggttgcacacattccattttgt

SEQ ID NO: 17184 - DNA, 25 bp, Mus musculus
aaaggttgcacagattccattttgt

SEQ ID NO: 17185 - DNA, 25 bp, Mus musculus
aaaggttgcagtaatctgtccagaa

SEQ ID NO: 17186 - DNA, 25 bp, Mus musculus
aaaggttgcagttatctgtccagaa

SEQ ID NO: 17187 - DNA, 25 bp, Mus musculus
aaaggttgcataccatttgcagttg

SEQ ID NO: 17188 - DNA, 25 bp, Mus musculus
aaaggttgcatagcatttgcagttg

SEQ ID NO: 17189 - DNA, 25 bp, Mus musculus
aaaggttgctcactatgggctgcca

SEQ ID NO: 17190 - DNA, 25 bp, Mus musculus
aaaggttgctcagtatgggctgcca

SEQ ID NO: 17191 - DNA, 25 bp, Mus musculus
aaaggttggctcacatcagccttaa

SEQ ID NO: 17192 - DNA, 25 bp, Mus musculus
aaaggttggctctcatcagccttaa

SEQ ID NO: 17193 - DNA, 25 bp, Mus musculus
aaaggttgggagctctagtgcccac

SEQ ID NO: 17194 - DNA, 25 bp, Mus musculus
aaaggttgggaggtctagtgcccac

SEQ ID NO: 17195 - DNA, 25 bp, Mus musculus
aaaggttgtcatcgcatcttttgct

SEQ ID NO: 17196 - DNA, 25 bp, Mus musculus
aaaggttgtcatggcatcttttgct

SEQ ID NO: 17197 - DNA, 25 bp, Mus musculus
aaaggttgttaaactgactttgcag

SEQ ID NO: 17198 - DNA, 25 bp, Mus musculus
aaaggttgttaatctgactttgcag

SEQ ID NO: 17199 - DNA, 25 bp, Mus musculus
aaaggttgttatcaagtggcacaag

SEQ ID NO: 17200 - DNA, 25 bp, Mus musculus
aaaggttgttatgaagtggcacaag

SEQ ID NO: 17201 - DNA, 25 bp, Mus musculus
aaaggtttaaagcagatgctgattt

SEQ ID NO: 17202 - DNA, 25 bp, Mus musculus
aaaggtttaaaggagatgctgattt

SEQ ID NO: 17203 - DNA, 25 bp, Mus musculus
aaaggtttagtaaaatgccagcaca

SEQ ID NO: 17204 - DNA, 25 bp, Mus musculus
aaaggtttagtataatgccagcaca

SEQ ID NO: 17205 - DNA, 25 bp, Mus musculus
aaaggtttatatagctctgtcacta

SEQ ID NO: 17206 - DNA, 25 bp, Mus musculus
aaaggtttatattgctctgtcacta

SEQ ID NO: 17207 - DNA, 25 bp, Mus musculus
aaaggtttcagcctggtggcagaca

SEQ ID NO: 17208 - DNA, 25 bp, Mus musculus
aaaggtttcagcgtggtggcagaca

SEQ ID NO: 17209 - DNA, 25 bp, Mus musculus
aaaggtttccatatggcaaagccat

SEQ ID NO: 17210 - DNA, 25 bp, Mus musculus
aaaggtttccatttggcaaagccat

SEQ ID NO: 17211 - DNA, 25 bp, Mus musculus
aaaggtttcctgagatgagtcctct

SEQ ID NO: 17212 - DNA, 25 bp, Mus musculus
aaaggtttcctgtgatgagtcctct

SEQ ID NO: 17213 - DNA, 25 bp, Mus musculus
aaaggtttctatacgctgtctgtga

SEQ ID NO: 17214 - DNA, 25 bp, Mus musculus
aaaggtttctattcgctgtctgtga

SEQ ID NO: 17215 - DNA, 25 bp, Mus musculus
aaaggtttctctctcctgtttcagt

SEQ ID NO: 17216 - DNA, 25 bp, Mus musculus
aaaggtttctctgtcctgtttcagt

SEQ ID NO: 17217 - DNA, 25 bp, Mus musculus
aaaggtttctgcaactctgctttat

SEQ ID NO: 17218 - DNA, 25 bp, Mus musculus
aaaggtttctgctactctgctttat

SEQ ID NO: 17219 - DNA, 25 bp, Mus musculus
aaaggtttctgtcttacatgagagg

SEQ ID NO: 17220 - DNA, 25 bp, Mus musculus
aaaggtttctgtgttacatgagagg

SEQ ID NO: 17221 - DNA, 25 bp, Mus musculus
aaaggtttgctaattgttctggtag

SEQ ID NO: 17222 - DNA, 25 bp, Mus musculus
aaaggtttgctatttgttctggtag

SEQ ID NO: 17223 - DNA, 25 bp, Mus musculus
aaaggtttgctgagtgtccacccct

SEQ ID NO: 17224 - DNA, 25 bp, Mus musculus
aaaggtttgctgtgtgtccacccct

SEQ ID NO: 17225 - DNA, 25 bp, Mus musculus
aaaggtttggctatgatggcctgac

SEQ ID NO: 17226 - DNA, 25 bp, Mus musculus
aaaggtttggctttgatggcctgac

SEQ ID NO: 17227 - DNA, 25 bp, Mus musculus
aaaggtttgggcactgctattcagg

SEQ ID NO: 17228 - DNA, 25 bp, Mus musculus
aaaggtttgggctctgctattcagg

SEQ ID NO: 17229 - DNA, 25 bp, Mus musculus
aaaggttttcatatgagtccgtgct

SEQ ID NO: 17230 - DNA, 25 bp, Mus musculus
aaaggttttcatttgagtccgtgct

SEQ ID NO: 17231 - DNA, 25 bp, Mus musculus
aaaggttttccaagctcaagatcac

SEQ ID NO: 17232 - DNA, 25 bp, Mus musculus
aaaggttttccatgctcaagatcac

SEQ ID NO: 17233 - DNA, 25 bp, Mus musculus
aaaggttttcggaggcgctggtgat

SEQ ID NO: 17234 - DNA, 25 bp, Mus musculus
aaaggttttcggtggcgctggtgat

SEQ ID NO: 17235 - DNA, 25 bp, Mus musculus
aaaggttttgctacatccaggacag

SEQ ID NO: 17236 - DNA, 25 bp, Mus musculus
aaaggttttgcttcatccaggacag

SEQ ID NO: 17237 - DNA, 25 bp, Mus musculus
aaagtaaaaagtcctgagtcatgtc

SEQ ID NO: 17238 - DNA, 25 bp, Mus musculus
aaagtaaaaagtgctgagtcatgtc

SEQ ID NO: 17239 - DNA, 25 bp, Mus musculus
aaagtaaaactgcttcgtctgccct

SEQ ID NO: 17240 - DNA, 25 bp, Mus musculus
aaagtaaaactggttcgtctgccct

SEQ ID NO: 17241 - DNA, 25 bp, Mus musculus
aaagtaacaatgaccagctccagaa

SEQ ID NO: 17242 - DNA, 25 bp, Mus musculus
aaagtaacaatgtccagctccagaa

SEQ ID NO: 17243 - DNA, 25 bp, Mus musculus
aaagtaacacttatggcatgaacat

SEQ ID NO: 17244 - DNA, 25 bp, Mus musculus
aaagtaacacttttggcatgaacat

SEQ ID NO: 17245 - DNA, 25 bp, Mus musculus
aaagtaacattgcttctgacctccc

SEQ ID NO: 17246 - DNA, 25 bp, Mus musculus
aaagtaacattggttctgacctccc

SEQ ID NO: 17247 - DNA, 25 bp, Mus musculus
aaagtaaccctaactcttaagcttg

SEQ ID NO: 17248 - DNA, 25 bp, Mus musculus
aaagtaaccctatctcttaagcttg

SEQ ID NO: 17249 - DNA, 25 bp, Mus musculus
aaagtaactagtccagagaaagctg

SEQ ID NO: 17250 - DNA, 25 bp, Mus musculus
aaagtaactagtgcagagaaagctg

SEQ ID NO: 17251 - DNA, 25 bp, Mus musculus
aaagtaactgatctttctagcaaac

SEQ ID NO: 17252 - DNA, 25 bp, Mus musculus
aaagtaactgatgtttctagcaaac

SEQ ID NO: 17253 - DNA, 25 bp, Mus musculus
aaagtaagacacagccccccctctg

SEQ ID NO: 17254 - DNA, 25 bp, Mus musculus
aaagtaagacactgccccccctctg

SEQ ID NO: 17255 - DNA, 25 bp, Mus musculus
aaagtaagcactcttctgccccacg

SEQ ID NO: 17256 - DNA, 25 bp, Mus musculus
aaagtaagcactgttctgccccacg

SEQ ID NO: 17257 - DNA, 25 bp, Mus musculus
aaagtaagctgtacctcacatctgg

SEQ ID NO: 17258 - DNA, 25 bp, Mus musculus
aaagtaagctgttcctcacatctgg

SEQ ID NO: 17259 - DNA, 25 bp, Mus musculus
aaagtaaggagtcaggtcaagtgta

SEQ ID NO: 17260 - DNA, 25 bp, Mus musculus
aaagtaaggagtgaggtcaagtgta

SEQ ID NO: 17261 - DNA, 25 bp, Mus musculus
aaagtaaggctgacataggccaaat

SEQ ID NO: 17262 - DNA, 25 bp, Mus musculus
aaagtaaggctgtcataggccaaat

SEQ ID NO: 17263 - DNA, 25 bp, Mus musculus
aaagtaagtcaacagccatggcagc

SEQ ID NO: 17264 - DNA, 25 bp, Mus musculus
aaagtaagtcaagagccatggcagc

SEQ ID NO: 17265 - DNA, 25 bp, Mus musculus
aaagtaagttccagtttcaacatgg

SEQ ID NO: 17266 - DNA, 25 bp, Mus musculus
aaagtaagttcctgtttcaacatgg

SEQ ID NO: 17267 - DNA, 25 bp, Mus musculus
aaagtaatactaactgacagctcag

SEQ ID NO: 17268 - DNA, 25 bp, Mus musculus
aaagtaatactatctgacagctcag

SEQ ID NO: 17269 - DNA, 25 bp, Mus musculus
aaagtaatatggaccgggctagcaa

SEQ ID NO: 17270 - DNA, 25 bp, Mus musculus
aaagtaatatggtccgggctagcaa

SEQ ID NO: 17271 - DNA, 25 bp, Mus musculus
aaagtaatctgtcggcagctttcgt

SEQ ID NO: 17272 - DNA, 25 bp, Mus musculus
aaagtaatctgtgggcagctttcgt

SEQ ID NO: 17273 - DNA, 25 bp, Mus musculus
aaagtaatgccacccggaccacgct

SEQ ID NO: 17274 - DNA, 25 bp, Mus musculus
aaagtaatgccagccggaccacgct

SEQ ID NO: 17275 - DNA, 25 bp, Mus musculus
aaagtaatgcccagtatgctgcctc

SEQ ID NO: 17276 - DNA, 25 bp, Mus musculus
aaagtaatgccctgtatgctgcctc

SEQ ID NO: 17277 - DNA, 25 bp, Mus musculus
aaagtaatgtaacccttcagggtgg

SEQ ID NO: 17278 - DNA, 25 bp, Mus musculus
aaagtaatgtaagccttcagggtgg

SEQ ID NO: 17279 - DNA, 25 bp, Mus musculus
aaagtaatgtttaggtcaggcactg

SEQ ID NO: 17280 - DNA, 25 bp, Mus musculus
aaagtaatgttttggtcaggcactg

SEQ ID NO: 17281 - DNA, 25 bp, Mus musculus
aaagtaattctcagccatgacgttt

SEQ ID NO: 17282 - DNA, 25 bp, Mus musculus
aaagtaattctctgccatgacgttt

SEQ ID NO: 17283 - DNA, 25 bp, Mus musculus
aaagtaattggacctgtttcagcat

SEQ ID NO: 17284 - DNA, 25 bp, Mus musculus
aaagtaattggagctgtttcagcat

SEQ ID NO: 17285 - DNA, 25 bp, Mus musculus
aaagtaatttgaagcctggaagtgt

SEQ ID NO: 17286 - DNA, 25 bp, Mus musculus
aaagtaatttgatgcctggaagtgt

SEQ ID NO: 17287 - DNA, 25 bp, Mus musculus
aaagtacaagtcacagcctgtttga

SEQ ID NO: 17288 - DNA, 25 bp, Mus musculus
aaagtacaagtctcagcctgtttga

SEQ ID NO: 17289 - DNA, 25 bp, Mus musculus
aaagtacacagcctcaactcctctt

SEQ ID NO: 17290 - DNA, 25 bp, Mus musculus
aaagtacacagccttctgcctctgt

SEQ ID NO: 17291 - DNA, 25 bp, Mus musculus
aaagtacacagcgtcaactcctctt

SEQ ID NO: 17292 - DNA, 25 bp, Mus musculus
aaagtacacagcgttctgcctctgt

SEQ ID NO: 17293 - DNA, 25 bp, Mus musculus
aaagtacactcaactactgatgctg

SEQ ID NO: 17294 - DNA, 25 bp, Mus musculus
aaagtacactcatctactgatgctg

SEQ ID NO: 17295 - DNA, 25 bp, Mus musculus
aaagtacactgtccatatggaaagc

SEQ ID NO: 17296 - DNA, 25 bp, Mus musculus
aaagtacactgtgcatatggaaagc

SEQ ID NO: 17297 - DNA, 25 bp, Mus musculus
aaagtacagagcagacaaaagttct

SEQ ID NO: 17298 - DNA, 25 bp, Mus musculus
aaagtacagagctgacaaaagttct

SEQ ID NO: 17299 - DNA, 25 bp, Mus musculus
aaagtacagaggcttcaccatccca

SEQ ID NO: 17300 - DNA, 25 bp, Mus musculus
aaagtacagagggttcaccatccca

SEQ ID NO: 17301 - DNA, 25 bp, Mus musculus
aaagtacagcatagctattagcgct

SEQ ID NO: 17302 - DNA, 25 bp, Mus musculus
aaagtacagcattgctattagcgct

SEQ ID NO: 17303 - DNA, 25 bp, Mus musculus
aaagtacaggctccttacgagggtg

SEQ ID NO: 17304 - DNA, 25 bp, Mus musculus
aaagtacaggctgcttacgagggtg

SEQ ID NO: 17305 - DNA, 25 bp, Mus musculus
aaagtacagggtaattcttccagat

SEQ ID NO: 17306 - DNA, 25 bp, Mus musculus
aaagtacagggttattcttccagat

SEQ ID NO: 17307 - DNA, 25 bp, Mus musculus
aaagtacatgtgctgtacacgacaa

SEQ ID NO: 17308 - DNA, 25 bp, Mus musculus
aaagtacatgtggtgtacacgacaa

SEQ ID NO: 17309 - DNA, 25 bp, Mus musculus
aaagtaccaagcatgatcctcagat

SEQ ID NO: 17310 - DNA, 25 bp, Mus musculus
aaagtaccaagcttgatcctcagat

SEQ ID NO: 17311 - DNA, 25 bp, Mus musculus
aaagtaccacagaccactccctggg

SEQ ID NO: 17312 - DNA, 25 bp, Mus musculus
aaagtaccacagtccactccctggg

SEQ ID NO: 17313 - DNA, 25 bp, Mus musculus
aaagtaccacttatgaattcgataa

SEQ ID NO: 17314 - DNA, 25 bp, Mus musculus
aaagtaccacttttgaattcgataa

SEQ ID NO: 17315 - DNA, 25 bp, Mus musculus
aaagtaccaggcactaggtcggcgc

SEQ ID NO: 17316 - DNA, 25 bp, Mus musculus
aaagtaccaggctctaggtcggcgc

SEQ ID NO: 17317 - DNA, 25 bp, Mus musculus
aaagtaccatttcagaccccagcaa

SEQ ID NO: 17318 - DNA, 25 bp, Mus musculus
aaagtaccatttgagaccccagcaa

SEQ ID NO: 17319 - DNA, 25 bp, Mus musculus
aaagtacccagcattcattgtcaac

SEQ ID NO: 17320 - DNA, 25 bp, Mus musculus
aaagtacccagctttcattgtcaac

SEQ ID NO: 17321 - DNA, 25 bp, Mus musculus
aaagtacccatgctcctggagattc

SEQ ID NO: 17322 - DNA, 25 bp, Mus musculus
aaagtacccatggtcctggagattc

SEQ ID NO: 17323 - DNA, 25 bp, Mus musculus
aaagtaccccgaaactccagtgtca

SEQ ID NO: 17324 - DNA, 25 bp, Mus musculus
aaagtaccccgatactccagtgtca

SEQ ID NO: 17325 - DNA, 25 bp, Mus musculus
aaagtaccctgactttggcttcagt

SEQ ID NO: 17326 - DNA, 25 bp, Mus musculus
aaagtaccctgagtttggcttcagt

SEQ ID NO: 17327 - DNA, 25 bp, Mus musculus
aaagtaccgatgcttcagctacctg

SEQ ID NO: 17328 - DNA, 25 bp, Mus musculus
aaagtaccgatggttcagctacctg

SEQ ID NO: 17329 - DNA, 25 bp, Mus musculus
aaagtaccgcttccactgagacagt

SEQ ID NO: 17330 - DNA, 25 bp, Mus musculus
aaagtaccgcttgcactgagacagt

SEQ ID NO: 17331 - DNA, 25 bp, Mus musculus
aaagtacctagcatccagtgaggaa

SEQ ID NO: 17332 - DNA, 25 bp, Mus musculus
aaagtacctagcttccagtgaggaa

SEQ ID NO: 17333 - DNA, 25 bp, Mus musculus
aaagtacctattatctcttcagtat

SEQ ID NO: 17334 - DNA, 25 bp, Mus musculus
aaagtacctattttctcttcagtat

SEQ ID NO: 17335 - DNA, 25 bp, Mus musculus
aaagtacctgatcatgcgctaccgc

SEQ ID NO: 17336 - DNA, 25 bp, Mus musculus
aaagtacctgatgatgcgctaccgc

SEQ ID NO: 17337 - DNA, 25 bp, Mus musculus
aaagtacctgtacgcgatcagccca

SEQ ID NO: 17338 - DNA, 25 bp, Mus musculus
aaagtacctgtaggcgatcagccca

SEQ ID NO: 17339 - DNA, 25 bp, Mus musculus
aaagtacctgttcagtcttgctagg

SEQ ID NO: 17340 - DNA, 25 bp, Mus musculus
aaagtacctgttgagtcttgctagg

SEQ ID NO: 17341 - DNA, 25 bp, Mus musculus
aaagtaccttacagatgccaaatct

SEQ ID NO: 17342 - DNA, 25 bp, Mus musculus
aaagtaccttactgatgccaaatct

SEQ ID NO: 17343 - DNA, 25 bp, Mus musculus
aaagtacctttcattggcaacacat

SEQ ID NO: 17344 - DNA, 25 bp, Mus musculus
aaagtacctttctttggcaacacat

SEQ ID NO: 17345 - DNA, 25 bp, Mus musculus
aaagtacggaagctggcaaggagct

SEQ ID NO: 17346 - DNA, 25 bp, Mus musculus
aaagtacggaaggtggcaaggagct

SEQ ID NO: 17347 - DNA, 25 bp, Mus musculus
aaagtacgggcaaagttgtccatga

SEQ ID NO: 17348 - DNA, 25 bp, Mus musculus
aaagtacgggcatagttgtccatga

SEQ ID NO: 17349 - DNA, 25 bp, Mus musculus
aaagtacgtgatcccgaggacgcgc

SEQ ID NO: 17350 - DNA, 25 bp, Mus musculus
aaagtacgtgatgccgaggacgcgc

SEQ ID NO: 17351 - DNA, 25 bp, Mus musculus
aaagtacgtgtcatctcagtctgtc

SEQ ID NO: 17352 - DNA, 25 bp, Mus musculus
aaagtacgtgtcttctcagtctgtc

SEQ ID NO: 17353 - DNA, 25 bp, Mus musculus
aaagtactagaacgacatgcggaaa

SEQ ID NO: 17354 - DNA, 25 bp, Mus musculus
aaagtactagaaggacatgcggaaa

SEQ ID NO: 17355 - DNA, 25 bp, Mus musculus
aaagtactgagccttctcctgagcc

SEQ ID NO: 17356 - DNA, 25 bp, Mus musculus
aaagtactgagcgttctcctgagcc

SEQ ID NO: 17357 - DNA, 25 bp, Mus musculus
aaagtactgatgatcctgatgttag

SEQ ID NO: 17358 - DNA, 25 bp, Mus musculus
aaagtactgatgttcctgatgttag

SEQ ID NO: 17359 - DNA, 25 bp, Mus musculus
aaagtactgccccatttcattgttc

SEQ ID NO: 17360 - DNA, 25 bp, Mus musculus
aaagtactgcccgatttcattgttc

SEQ ID NO: 17361 - DNA, 25 bp, Mus musculus
aaagtactggtcagcctgttgggca

SEQ ID NO: 17362 - DNA, 25 bp, Mus musculus
aaagtactggtctgcctgttgggca

SEQ ID NO: 17363 - DNA, 25 bp, Mus musculus
aaagtactgtttaagcagtgcacgt

SEQ ID NO: 17364 - DNA, 25 bp, Mus musculus
aaagtactgttttagcagtgcacgt

SEQ ID NO: 17365 - DNA, 25 bp, Mus musculus
aaagtacttgagctgtttgtgtaat

SEQ ID NO: 17366 - DNA, 25 bp, Mus musculus
aaagtacttgaggtgtttgtgtaat

SEQ ID NO: 17367 - DNA, 25 bp, Mus musculus
aaagtagaacttacctctggtaatg

SEQ ID NO: 17368 - DNA, 25 bp, Mus musculus
aaagtagaactttcctctggtaatg

SEQ ID NO: 17369 - DNA, 25 bp, Mus musculus
aaagtagaaggtcccttggtcctgc

SEQ ID NO: 17370 - DNA, 25 bp, Mus musculus
aaagtagaaggtgccttggtcctgc

SEQ ID NO: 17371 - DNA, 25 bp, Mus musculus
aaagtagagggacagctgctgctca

SEQ ID NO: 17372 - DNA, 25 bp, Mus musculus
aaagtagagggagagctgctgctca

SEQ ID NO: 17373 - DNA, 25 bp, Mus musculus
aaagtagattctatttaagtgtgtg

SEQ ID NO: 17374 - DNA, 25 bp, Mus musculus
aaagtagattctttttaagtgtgtg

SEQ ID NO: 17375 - DNA, 25 bp, Mus musculus
aaagtagcacacattatccacaggg

SEQ ID NO: 17376 - DNA, 25 bp, Mus musculus
aaagtagcacactttatccacaggg

SEQ ID NO: 17377 - DNA, 25 bp, Mus musculus
aaagtagcattcagcaccagtgccc

SEQ ID NO: 17378 - DNA, 25 bp, Mus musculus
aaagtagcattctgcaccagtgccc

SEQ ID NO: 17379 - DNA, 25 bp, Mus musculus
aaagtagccattagtttatcaggag

SEQ ID NO: 17380 - DNA, 25 bp, Mus musculus
aaagtagccatttgtttatcaggag

SEQ ID NO: 17381 - DNA, 25 bp, Mus musculus
aaagtagcccaacagttcctgctga

SEQ ID NO: 17382 - DNA, 25 bp, Mus musculus
aaagtagcccaagagttcctgctga

SEQ ID NO: 17383 - DNA, 25 bp, Mus musculus
aaagtagcccttctctaacaataat

SEQ ID NO: 17384 - DNA, 25 bp, Mus musculus
aaagtagcccttgtctaacaataat

SEQ ID NO: 17385 - DNA, 25 bp, Mus musculus
aaagtagctctgactcttaggccat

SEQ ID NO: 17386 - DNA, 25 bp, Mus musculus
aaagtagctctgatcctgatggcaa

SEQ ID NO: 17387 - DNA, 25 bp, Mus musculus
aaagtagctctgtctcttaggccat

SEQ ID NO: 17388 - DNA, 25 bp, Mus musculus
aaagtagctctgttcctgatggcaa

SEQ ID NO: 17389 - DNA, 25 bp, Mus musculus
aaagtagctgacagattggccagga

SEQ ID NO: 17390 - DNA, 25 bp, Mus musculus
aaagtagctgactgattggccagga

SEQ ID NO: 17391 - DNA, 25 bp, Mus musculus
aaagtagctgctacctaagggatat

SEQ ID NO: 17392 - DNA, 25 bp, Mus musculus
aaagtagctgcttcctaagggatat

SEQ ID NO: 17393 - DNA, 25 bp, Mus musculus
aaagtagctgttctgcttgtaaatt

SEQ ID NO: 17394 - DNA, 25 bp, Mus musculus
aaagtagctgttgtgcttgtaaatt

SEQ ID NO: 17395 - DNA, 25 bp, Mus musculus
aaagtagcttgtatggaccctctgt

SEQ ID NO: 17396 - DNA, 25 bp, Mus musculus
aaagtagcttgtttggaccctctgt

SEQ ID NO: 17397 - DNA, 25 bp, Mus musculus
aaagtaggacacaacggaggcaggt

SEQ ID NO: 17398 - DNA, 25 bp, Mus musculus
aaagtaggacactacggaggcaggt

SEQ ID NO: 17399 - DNA, 25 bp, Mus musculus
aaagtaggccaccataaggctgtta

SEQ ID NO: 17400 - DNA, 25 bp, Mus musculus
aaagtaggccacgataaggctgtta

SEQ ID NO: 17401 - DNA, 25 bp, Mus musculus
aaagtaggccagcatttattctccc

SEQ ID NO: 17402 - DNA, 25 bp, Mus musculus
aaagtaggccaggatttattctccc

SEQ ID NO: 17403 - DNA, 25 bp, Mus musculus
aaagtaggcctaaagctgtctcatc

SEQ ID NO: 17404 - DNA, 25 bp, Mus musculus
aaagtaggcctatagctgtctcatc

SEQ ID NO: 17405 - DNA, 25 bp, Mus musculus
aaagtagggctgaccgccctaagag

SEQ ID NO: 17406 - DNA, 25 bp, Mus musculus
aaagtagggctgattctcctcgtca

SEQ ID NO: 17407 - DNA, 25 bp, Mus musculus
aaagtagggctgtccgccctaagag

SEQ ID NO: 17408 - DNA, 25 bp, Mus musculus
aaagtagggctgtttctcctcgtca

SEQ ID NO: 17409 - DNA, 25 bp, Mus musculus
aaagtagggtcaaggctgccaagta

SEQ ID NO: 17410 - DNA, 25 bp, Mus musculus
aaagtagggtcatggctgccaagta

SEQ ID NO: 17411 - DNA, 25 bp, Mus musculus
aaagtaggtaacaccagctaatgac

SEQ ID NO: 17412 - DNA, 25 bp, Mus musculus
aaagtaggtaactccagctaatgac

SEQ ID NO: 17413 - DNA, 25 bp, Mus musculus
aaagtagtacttatgcgtggataag

SEQ ID NO: 17414 - DNA, 25 bp, Mus musculus
aaagtagtacttttgcgtggataag

SEQ ID NO: 17415 - DNA, 25 bp, Mus musculus
aaagtagtcgtcaggtgtctaggtc

SEQ ID NO: 17416 - DNA, 25 bp, Mus musculus
aaagtagtcgtctggtgtctaggtc

SEQ ID NO: 17417 - DNA, 25 bp, Mus musculus
aaagtagtctttctttgctccccat

SEQ ID NO: 17418 - DNA, 25 bp, Mus musculus
aaagtagtctttgtttgctccccat

SEQ ID NO: 17419 - DNA, 25 bp, Mus musculus
aaagtagtgtgcagactgtatcaaa

SEQ ID NO: 17420 - DNA, 25 bp, Mus musculus
aaagtagtgtgctgactgtatcaaa

SEQ ID NO: 17421 - DNA, 25 bp, Mus musculus
aaagtagttactatcatggctgaaa

SEQ ID NO: 17422 - DNA, 25 bp, Mus musculus
aaagtagttactttcatggctgaaa

SEQ ID NO: 17423 - DNA, 25 bp, Mus musculus
aaagtagttcaactggtggcccctg

SEQ ID NO: 17424 - DNA, 25 bp, Mus musculus
aaagtagttcaagtggtggcccctg

SEQ ID NO: 17425 - DNA, 25 bp, Mus musculus
aaagtagtttacagccctgcacagc

SEQ ID NO: 17426 - DNA, 25 bp, Mus musculus
aaagtagtttactgccctgcacagc

SEQ ID NO: 17427 - DNA, 25 bp, Mus musculus
aaagtatacctcacactcagcattg

SEQ ID NO: 17428 - DNA, 25 bp, Mus musculus
aaagtatacctctcactcagcattg

SEQ ID NO: 17429 - DNA, 25 bp, Mus musculus
aaagtatatagcatgccgggccttg

SEQ ID NO: 17430 - DNA, 25 bp, Mus musculus
aaagtatatagcttgccgggccttg

SEQ ID NO: 17431 - DNA, 25 bp, Mus musculus
aaagtatatctgagtccgaaacata

SEQ ID NO: 17432 - DNA, 25 bp, Mus musculus
aaagtatatctgtgtccgaaacata

SEQ ID NO: 17433 - DNA, 25 bp, Mus musculus
aaagtatatggcacacaaaggaaaa

SEQ ID NO: 17434 - DNA, 25 bp, Mus musculus
aaagtatatggctcacaaaggaaaa

SEQ ID NO: 17435 - DNA, 25 bp, Mus musculus
aaagtatatgttcacctccagtgta

SEQ ID NO: 17436 - DNA, 25 bp, Mus musculus
aaagtatatgttgacctccagtgta

SEQ ID NO: 17437 - DNA, 25 bp, Mus musculus
aaagtatcacctactaggattggga

SEQ ID NO: 17438 - DNA, 25 bp, Mus musculus
aaagtatcaccttctaggattggga

SEQ ID NO: 17439 - DNA, 25 bp, Mus musculus
aaagtatcatctatgtggccacggg

SEQ ID NO: 17440 - DNA, 25 bp, Mus musculus
aaagtatcatctttgtggccacggg

SEQ ID NO: 17441 - DNA, 25 bp, Mus musculus
aaagtatcctgaatcccctgggagt

SEQ ID NO: 17442 - DNA, 25 bp, Mus musculus
aaagtatcctgattcccctgggagt

SEQ ID NO: 17443 - DNA, 25 bp, Mus musculus
aaagtatccttccatgcctgagtaa

SEQ ID NO: 17444 - DNA, 25 bp, Mus musculus
aaagtatccttcgatgcctgagtaa

SEQ ID NO: 17445 - DNA, 25 bp, Mus musculus
aaagtatcggtcaatctcgtgccta

SEQ ID NO: 17446 - DNA, 25 bp, Mus musculus
aaagtatcggtctatctcgtgccta

SEQ ID NO: 17447 - DNA, 25 bp, Mus musculus
aaagtatctatgagcagcacttgcc

SEQ ID NO: 17448 - DNA, 25 bp, Mus musculus
aaagtatctatgtgcagcacttgcc

SEQ ID NO: 17449 - DNA, 25 bp, Mus musculus
aaagtatctggcctttctccggaag

SEQ ID NO: 17450 - DNA, 25 bp, Mus musculus
aaagtatctggcgtttctccggaag

SEQ ID NO: 17451 - DNA, 25 bp, Mus musculus
aaagtatctgtcataccttcatatg

SEQ ID NO: 17452 - DNA, 25 bp, Mus musculus
aaagtatctgtcttaccttcatatg

SEQ ID NO: 17453 - DNA, 25 bp, Mus musculus
aaagtatctgttctgtttaggacac

SEQ ID NO: 17454 - DNA, 25 bp, Mus musculus
aaagtatctgttgtgtttaggacac

SEQ ID NO: 17455 - DNA, 25 bp, Mus musculus
aaagtatcttataccctgtgcttaa

SEQ ID NO: 17456 - DNA, 25 bp, Mus musculus
aaagtatcttattccctgtgcttaa

SEQ ID NO: 17457 - DNA, 25 bp, Mus musculus
aaagtatcttcaccaaccctacatc

SEQ ID NO: 17458 - DNA, 25 bp, Mus musculus
aaagtatcttcagcaaccctacatc

SEQ ID NO: 17459 - DNA, 25 bp, Mus musculus
aaagtatcttgtccagactcgctgc

SEQ ID NO: 17460 - DNA, 25 bp, Mus musculus
aaagtatcttgtgcagactcgctgc

SEQ ID NO: 17461 - DNA, 25 bp, Mus musculus
aaagtatgagctcggacggcccgct

SEQ ID NO: 17462 - DNA, 25 bp, Mus musculus
aaagtatgagctgggacggcccgct

SEQ ID NO: 17463 - DNA, 25 bp, Mus musculus
aaagtatgccttctggttgtgtcat

SEQ ID NO: 17464 - DNA, 25 bp, Mus musculus
aaagtatgccttgtggttgtgtcat

SEQ ID NO: 17465 - DNA, 25 bp, Mus musculus
aaagtatgcgttcctgggttggctt

SEQ ID NO: 17466 - DNA, 25 bp, Mus musculus
aaagtatgcgttgctgggttggctt

SEQ ID NO: 17467 - DNA, 25 bp, Mus musculus
aaagtatgcttcactccagcgtgac

SEQ ID NO: 17468 - DNA, 25 bp, Mus musculus
aaagtatgcttctctccagcgtgac

SEQ ID NO: 17469 - DNA, 25 bp, Mus musculus
aaagtatggccactagttcacttga

SEQ ID NO: 17470 - DNA, 25 bp, Mus musculus
aaagtatggccagtagttcacttga

SEQ ID NO: 17471 - DNA, 25 bp, Mus musculus
aaagtatggtcacagctgctcttac

SEQ ID NO: 17472 - DNA, 25 bp, Mus musculus
aaagtatggtcagagctgctcttac

SEQ ID NO: 17473 - DNA, 25 bp, Mus musculus
aaagtatgtagaattgtggctcaaa

SEQ ID NO: 17474 - DNA, 25 bp, Mus musculus
aaagtatgtagatttgtggctcaaa

SEQ ID NO: 17475 - DNA, 25 bp, Mus musculus
aaagtatgtagtatcaccaccacct

SEQ ID NO: 17476 - DNA, 25 bp, Mus musculus
aaagtatgtagtttcaccaccacct

SEQ ID NO: 17477 - DNA, 25 bp, Mus musculus
aaagtatgtattatgccctgcagct

SEQ ID NO: 17478 - DNA, 25 bp, Mus musculus
aaagtatgtattttgccctgcagct

SEQ ID NO: 17479 - DNA, 25 bp, Mus musculus
aaagtatgtctcactgcacacaggg

SEQ ID NO: 17480 - DNA, 25 bp, Mus musculus
aaagtatgtctcatgatgggtgaag

SEQ ID NO: 17481 - DNA, 25 bp, Mus musculus
aaagtatgtctctctgcacacaggg

SEQ ID NO: 17482 - DNA, 25 bp, Mus musculus
aaagtatgtctcttgatgggtgaag

SEQ ID NO: 17483 - DNA, 25 bp, Mus musculus
aaagtattatgcattcttgtcaatt

SEQ ID NO: 17484 - DNA, 25 bp, Mus musculus
aaagtattatgctttcttgtcaatt

SEQ ID NO: 17485 - DNA, 25 bp, Mus musculus
aaagtattcacgatgaggcccacct

SEQ ID NO: 17486 - DNA, 25 bp, Mus musculus
aaagtattcacgttgaggcccacct

SEQ ID NO: 17487 - DNA, 25 bp, Mus musculus
aaagtattccacaacaaatccaaat

SEQ ID NO: 17488 - DNA, 25 bp, Mus musculus
aaagtattccactacaaatccaaat

SEQ ID NO: 17489 - DNA, 25 bp, Mus musculus
aaagtattcctgatagatttactat

SEQ ID NO: 17490 - DNA, 25 bp, Mus musculus
aaagtattcctgttagatttactat

SEQ ID NO: 17491 - DNA, 25 bp, Mus musculus
aaagtattcttgaatctcagttttg

SEQ ID NO: 17492 - DNA, 25 bp, Mus musculus
aaagtattcttgtatctcagttttg

SEQ ID NO: 17493 - DNA, 25 bp, Mus musculus
aaagtattctttatgtccttccaga

SEQ ID NO: 17494 - DNA, 25 bp, Mus musculus
aaagtattctttttgtccttccaga

SEQ ID NO: 17495 - DNA, 25 bp, Mus musculus
aaagtattgactagcctcagtccct

SEQ ID NO: 17496 - DNA, 25 bp, Mus musculus
aaagtattgacttgcctcagtccct

SEQ ID NO: 17497 - DNA, 25 bp, Mus musculus
aaagtattgctgactgtctctatcc

SEQ ID NO: 17498 - DNA, 25 bp, Mus musculus
aaagtattgctgatccaacaatgtc

SEQ ID NO: 17499 - DNA, 25 bp, Mus musculus
aaagtattgctgtctgtctctatcc

SEQ ID NO: 17500 - DNA, 25 bp, Mus musculus
aaagtattgctgttccaacaatgtc

SEQ ID NO: 17501 - DNA, 25 bp, Mus musculus
aaagtattgtccacgggaggcagac

SEQ ID NO: 17502 - DNA, 25 bp, Mus musculus
aaagtattgtcctcgggaggcagac

SEQ ID NO: 17503 - DNA, 25 bp, Mus musculus
aaagtatttctaaatcacccctggc

SEQ ID NO: 17504 - DNA, 25 bp, Mus musculus
aaagtatttctatatcacccctggc

SEQ ID NO: 17505 - DNA, 25 bp, Mus musculus
aaagtatttgggactgaattgcact

SEQ ID NO: 17506 - DNA, 25 bp, Mus musculus
aaagtatttgggtctgaattgcact

SEQ ID NO: 17507 - DNA, 25 bp, Mus musculus
aaagtcaaaagcctctgaatccctg

SEQ ID NO: 17508 - DNA, 25 bp, Mus musculus
aaagtcaaaagcgtctgaatccctg

SEQ ID NO: 17509 - DNA, 25 bp, Mus musculus
aaagtcaaacaaatccctgcccaag

SEQ ID NO: 17510 - DNA, 25 bp, Mus musculus
aaagtcaaacaattccctgcccaag

SEQ ID NO: 17511 - DNA, 25 bp, Mus musculus
aaagtcaaatgtcgctgttgagtcc

SEQ ID NO: 17512 - DNA, 25 bp, Mus musculus
aaagtcaaatgtggctgttgagtcc

SEQ ID NO: 17513 - DNA, 25 bp, Mus musculus
aaagtcaacacactggccaggcaag

SEQ ID NO: 17514 - DNA, 25 bp, Mus musculus
aaagtcaacacagtggccaggcaag

SEQ ID NO: 17515 - DNA, 25 bp, Mus musculus
aaagtcaacctaatgggcctgtctt

SEQ ID NO: 17516 - DNA, 25 bp, Mus musculus
aaagtcaacctattgggcctgtctt

SEQ ID NO: 17517 - DNA, 25 bp, Mus musculus
aaagtcaactggctggcgcacaatg

SEQ ID NO: 17518 - DNA, 25 bp, Mus musculus
aaagtcaactgggtggcgcacaatg

SEQ ID NO: 17519 - DNA, 25 bp, Mus musculus
aaagtcaagcatacagagggtgtta

SEQ ID NO: 17520 - DNA, 25 bp, Mus musculus
aaagtcaagcattcagagggtgtta

SEQ ID NO: 17521 - DNA, 25 bp, Mus musculus
aaagtcaaggaacgccttcagctcg

SEQ ID NO: 17522 - DNA, 25 bp, Mus musculus
aaagtcaaggaaggccttcagctcg

SEQ ID NO: 17523 - DNA, 25 bp, Mus musculus
aaagtcaagttcaccagctctagca

SEQ ID NO: 17524 - DNA, 25 bp, Mus musculus
aaagtcaagttctccagctctagca

SEQ ID NO: 17525 - DNA, 25 bp, Mus musculus
aaagtcaatgacaaccgtaccaagt

SEQ ID NO: 17526 - DNA, 25 bp, Mus musculus
aaagtcaatgactaccgtaccaagt

SEQ ID NO: 17527 - DNA, 25 bp, Mus musculus
aaagtcaatgctctacatccatcca

SEQ ID NO: 17528 - DNA, 25 bp, Mus musculus
aaagtcaatgctgtacatccatcca

SEQ ID NO: 17529 - DNA, 25 bp, Mus musculus
aaagtcaattttcctgaatcacaat

SEQ ID NO: 17530 - DNA, 25 bp, Mus musculus
aaagtcaattttgctgaatcacaat

SEQ ID NO: 17531 - DNA, 25 bp, Mus musculus
aaagtcacaaccatcttgatagtgt

SEQ ID NO: 17532 - DNA, 25 bp, Mus musculus
aaagtcacaaccttcttgatagtgt

SEQ ID NO: 17533 - DNA, 25 bp, Mus musculus
aaagtcacacgaactggacctgcag

SEQ ID NO: 17534 - DNA, 25 bp, Mus musculus
aaagtcacacgatctggacctgcag

SEQ ID NO: 17535 - DNA, 25 bp, Mus musculus
aaagtcacagcacatttctttttct

SEQ ID NO: 17536 - DNA, 25 bp, Mus musculus
aaagtcacagcacccactgttggcg

SEQ ID NO: 17537 - DNA, 25 bp, Mus musculus
aaagtcacagcagatttctttttct

SEQ ID NO: 17538 - DNA, 25 bp, Mus musculus
aaagtcacagcagccactgttggcg

SEQ ID NO: 17539 - DNA, 25 bp, Mus musculus
aaagtcacagtcatcaaactacggg

SEQ ID NO: 17540 - DNA, 25 bp, Mus musculus
aaagtcacagtccatttccttgctg

SEQ ID NO: 17541 - DNA, 25 bp, Mus musculus
aaagtcacagtcgatttccttgctg

SEQ ID NO: 17542 - DNA, 25 bp, Mus musculus
aaagtcacagtcttcaaactacggg

SEQ ID NO: 17543 - DNA, 25 bp, Mus musculus
aaagtcacatgaacccagttcccag

SEQ ID NO: 17544 - DNA, 25 bp, Mus musculus
aaagtcacatgatcccagttcccag

SEQ ID NO: 17545 - DNA, 25 bp, Mus musculus
aaagtcacattcagtctagttccct

SEQ ID NO: 17546 - DNA, 25 bp, Mus musculus
aaagtcacattctgtctagttccct

SEQ ID NO: 17547 - DNA, 25 bp, Mus musculus
aaagtcaccatgaacttggagaaac

SEQ ID NO: 17548 - DNA, 25 bp, Mus musculus
aaagtcaccatgtacttggagaaac

SEQ ID NO: 17549 - DNA, 25 bp, Mus musculus
aaagtcaccccacagcgtgaggaag

SEQ ID NO: 17550 - DNA, 25 bp, Mus musculus
aaagtcaccccagagcgtgaggaag

SEQ ID NO: 17551 - DNA, 25 bp, Mus musculus
aaagtcacctctcctattgtagaaa

SEQ ID NO: 17552 - DNA, 25 bp, Mus musculus
aaagtcacctctctttcctctgtgg

SEQ ID NO: 17553 - DNA, 25 bp, Mus musculus
aaagtcacctctgctattgtagaaa

SEQ ID NO: 17554 - DNA, 25 bp, Mus musculus
aaagtcacctctgtttcctctgtgg

SEQ ID NO: 17555 - DNA, 25 bp, Mus musculus
aaagtcacctggaagaggctccgct

SEQ ID NO: 17556 - DNA, 25 bp, Mus musculus
aaagtcacctggtagaggctccgct

SEQ ID NO: 17557 - DNA, 25 bp, Mus musculus
aaagtcacggatcgctcttcgtcct

SEQ ID NO: 17558 - DNA, 25 bp, Mus musculus
aaagtcacggatggctcttcgtcct

SEQ ID NO: 17559 - DNA, 25 bp, Mus musculus
aaagtcacggccattttgtgctaca

SEQ ID NO: 17560 - DNA, 25 bp, Mus musculus
aaagtcacggcctttttgtgctaca

SEQ ID NO: 17561 - DNA, 25 bp, Mus musculus
aaagtcacgtgcaagagttacctct

SEQ ID NO: 17562 - DNA, 25 bp, Mus musculus
aaagtcacgtgctagagttacctct

SEQ ID NO: 17563 - DNA, 25 bp, Mus musculus
aaagtcactcttcctgtgaagccta

SEQ ID NO: 17564 - DNA, 25 bp, Mus musculus
aaagtcactcttgctgtgaagccta

SEQ ID NO: 17565 - DNA, 25 bp, Mus musculus
aaagtcactgaacactctgcctcaa

SEQ ID NO: 17566 - DNA, 25 bp, Mus musculus
aaagtcactgaagactctgcctcaa

SEQ ID NO: 17567 - DNA, 25 bp, Mus musculus
aaagtcactgtgcatacccaaccgg

SEQ ID NO: 17568 - DNA, 25 bp, Mus musculus
aaagtcactgtggatacccaaccgg

SEQ ID NO: 17569 - DNA, 25 bp, Mus musculus
aaagtcacttatacacactaccacc

SEQ ID NO: 17570 - DNA, 25 bp, Mus musculus
aaagtcacttattcacactaccacc

SEQ ID NO: 17571 - DNA, 25 bp, Mus musculus
aaagtcacttgcctagatcagccac

SEQ ID NO: 17572 - DNA, 25 bp, Mus musculus
aaagtcacttgcgtagatcagccac

SEQ ID NO: 17573 - DNA, 25 bp, Mus musculus
aaagtcactttgcttctctgtgctt

SEQ ID NO: 17574 - DNA, 25 bp, Mus musculus
aaagtcactttggttctctgtgctt

SEQ ID NO: 17575 - DNA, 25 bp, Mus musculus
aaagtcagaatgactcgagcccgag

SEQ ID NO: 17576 - DNA, 25 bp, Mus musculus
aaagtcagaatgtctcgagcccgag

SEQ ID NO: 17577 - DNA, 25 bp, Mus musculus
aaagtcagatgtcggccttcagttc

SEQ ID NO: 17578 - DNA, 25 bp, Mus musculus
aaagtcagatgtgggccttcagttc

SEQ ID NO: 17579 - DNA, 25 bp, Mus musculus
aaagtcagcagaaatcttacggcct

SEQ ID NO: 17580 - DNA, 25 bp, Mus musculus
aaagtcagcagatatcttacggcct

SEQ ID NO: 17581 - DNA, 25 bp, Mus musculus
aaagtcagccagacaccttgtactg

SEQ ID NO: 17582 - DNA, 25 bp, Mus musculus
aaagtcagccagtcaccttgtactg

SEQ ID NO: 17583 - DNA, 25 bp, Mus musculus
aaagtcagccccagaaacgcagtgc

SEQ ID NO: 17584 - DNA, 25 bp, Mus musculus
aaagtcagcccctgaaacgcagtgc

SEQ ID NO: 17585 - DNA, 25 bp, Mus musculus
aaagtcagcctgcactggctacacg

SEQ ID NO: 17586 - DNA, 25 bp, Mus musculus
aaagtcagcctggactggctacacg

SEQ ID NO: 17587 - DNA, 25 bp, Mus musculus
aaagtcagccttagtgttgatacaa

SEQ ID NO: 17588 - DNA, 25 bp, Mus musculus
aaagtcagcctttgtgttgatacaa

SEQ ID NO: 17589 - DNA, 25 bp, Mus musculus
aaagtcagctgacggatggtcgtca

SEQ ID NO: 17590 - DNA, 25 bp, Mus musculus
aaagtcagctgagggatggtcgtca

SEQ ID NO: 17591 - DNA, 25 bp, Mus musculus
aaagtcaggaggctattctcccttc

SEQ ID NO: 17592 - DNA, 25 bp, Mus musculus
aaagtcaggagggtattctcccttc

SEQ ID NO: 17593 - DNA, 25 bp, Mus musculus
aaagtcaggatgcagaccaggcctc

SEQ ID NO: 17594 - DNA, 25 bp, Mus musculus
aaagtcaggatggagaccaggcctc

SEQ ID NO: 17595 - DNA, 25 bp, Mus musculus
aaagtcagggtcaccctgcagaaaa

SEQ ID NO: 17596 - DNA, 25 bp, Mus musculus
aaagtcagggtctccctgcagaaaa

SEQ ID NO: 17597 - DNA, 25 bp, Mus musculus
aaagtcaggtacacgatagttctta

SEQ ID NO: 17598 - DNA, 25 bp, Mus musculus
aaagtcaggtactcgatagttctta

SEQ ID NO: 17599 - DNA, 25 bp, Mus musculus
aaagtcagtatgctttgcctctcaa

SEQ ID NO: 17600 - DNA, 25 bp, Mus musculus
aaagtcagtatggtttgcctctcaa

SEQ ID NO: 17601 - DNA, 25 bp, Mus musculus
aaagtcagtgatcctggtgaggcca

SEQ ID NO: 17602 - DNA, 25 bp, Mus musculus
aaagtcagtgatgctggtgaggcca

SEQ ID NO: 17603 - DNA, 25 bp, Mus musculus
aaagtcagtgctccatagtttggta

SEQ ID NO: 17604 - DNA, 25 bp, Mus musculus
aaagtcagtgctgcatagtttggta

SEQ ID NO: 17605 - DNA, 25 bp, Mus musculus
aaagtcataacaaatttggcctaca

SEQ ID NO: 17606 - DNA, 25 bp, Mus musculus
aaagtcataacatatttggcctaca

SEQ ID NO: 17607 - DNA, 25 bp, Mus musculus
aaagtcataccaatgggcctggaac

SEQ ID NO: 17608 - DNA, 25 bp, Mus musculus
aaagtcataccattgggcctggaac

SEQ ID NO: 17609 - DNA, 25 bp, Mus musculus
aaagtcatactcctcatttttctgt

SEQ ID NO: 17610 - DNA, 25 bp, Mus musculus
aaagtcatactcgtcatttttctgt

SEQ ID NO: 17611 - DNA, 25 bp, Mus musculus
aaagtcatagagaagctggtagagc

SEQ ID NO: 17612 - DNA, 25 bp, Mus musculus
aaagtcatagagtagctggtagagc

SEQ ID NO: 17613 - DNA, 25 bp, Mus musculus
aaagtcatagtgagccaccgttggc

SEQ ID NO: 17614 - DNA, 25 bp, Mus musculus
aaagtcatagtgtgccaccgttggc

SEQ ID NO: 17615 - DNA, 25 bp, Mus musculus
aaagtcatattcacaaattcatcat

SEQ ID NO: 17616 - DNA, 25 bp, Mus musculus
aaagtcatattctcaaattcatcat

SEQ ID NO: 17617 - DNA, 25 bp, Mus musculus
aaagtcatccagattgtggccttgg

SEQ ID NO: 17618 - DNA, 25 bp, Mus musculus
aaagtcatccagtttgtggccttgg

SEQ ID NO: 17619 - DNA, 25 bp, Mus musculus
aaagtcatcctgagaagaatgcaat

SEQ ID NO: 17620 - DNA, 25 bp, Mus musculus
aaagtcatcctgtgaagaatgcaat

SEQ ID NO: 17621 - DNA, 25 bp, Mus musculus
aaagtcatccttaggctgaggctac

SEQ ID NO: 17622 - DNA, 25 bp, Mus musculus
aaagtcatcctttggctgaggctac

SEQ ID NO: 17623 - DNA, 25 bp, Mus musculus
aaagtcatctcaaggatctccagga

SEQ ID NO: 17624 - DNA, 25 bp, Mus musculus
aaagtcatctcatggatctccagga

SEQ ID NO: 17625 - DNA, 25 bp, Mus musculus
aaagtcatctgtagcccaagttcca

SEQ ID NO: 17626 - DNA, 25 bp, Mus musculus
aaagtcatctgttgcccaagttcca

SEQ ID NO: 17627 - DNA, 25 bp, Mus musculus
aaagtcatcttcacatattttatct

SEQ ID NO: 17628 - DNA, 25 bp, Mus musculus
aaagtcatcttctcatattttatct

SEQ ID NO: 17629 - DNA, 25 bp, Mus musculus
aaagtcatgataagtcccccaaggg

SEQ ID NO: 17630 - DNA, 25 bp, Mus musculus
aaagtcatgatatgtcccccaaggg

SEQ ID NO: 17631 - DNA, 25 bp, Mus musculus
aaagtcatgccacccagaggcaagt

SEQ ID NO: 17632 - DNA, 25 bp, Mus musculus
aaagtcatgccagccagaggcaagt

SEQ ID NO: 17633 - DNA, 25 bp, Mus musculus
aaagtcattcatcatcctttccacc

SEQ ID NO: 17634 - DNA, 25 bp, Mus musculus
aaagtcattcatccacatcggaaaa

SEQ ID NO: 17635 - DNA, 25 bp, Mus musculus
aaagtcattcatgatcctttccacc

SEQ ID NO: 17636 - DNA, 25 bp, Mus musculus
aaagtcattcatgcacatcggaaaa

SEQ ID NO: 17637 - DNA, 25 bp, Mus musculus
aaagtcattgcccagttgaaggtca

SEQ ID NO: 17638 - DNA, 25 bp, Mus musculus
aaagtcattgccgagttgaaggtca

SEQ ID NO: 17639 - DNA, 25 bp, Mus musculus
aaagtcatttccctgtttttgctgt

SEQ ID NO: 17640 - DNA, 25 bp, Mus musculus
aaagtcatttccgtgtttttgctgt

SEQ ID NO: 17641 - DNA, 25 bp, Mus musculus
aaagtcattttgaatctgccaagtg

SEQ ID NO: 17642 - DNA, 25 bp, Mus musculus
aaagtcattttgtatctgccaagtg

SEQ ID NO: 17643 - DNA, 25 bp, Mus musculus
aaagtccaaacaactagtccctgtg

SEQ ID NO: 17644 - DNA, 25 bp, Mus musculus
aaagtccaaacatctagtccctgtg

SEQ ID NO: 17645 - DNA, 25 bp, Mus musculus
aaagtccaagttacagggctcgatg

SEQ ID NO: 17646 - DNA, 25 bp, Mus musculus
aaagtccaagtttcagggctcgatg

SEQ ID NO: 17647 - DNA, 25 bp, Mus musculus
aaagtccaatacattttccaaccat

SEQ ID NO: 17648 - DNA, 25 bp, Mus musculus
aaagtccaatactttttccaaccat

SEQ ID NO: 17649 - DNA, 25 bp, Mus musculus
aaagtccaatccatcgcctgagaac

SEQ ID NO: 17650 - DNA, 25 bp, Mus musculus
aaagtccaatccttcgcctgagaac

SEQ ID NO: 17651 - DNA, 25 bp, Mus musculus
aaagtccacactaaggcatcctgag

SEQ ID NO: 17652 - DNA, 25 bp, Mus musculus
aaagtccacacttaggcatcctgag

SEQ ID NO: 17653 - DNA, 25 bp, Mus musculus
aaagtccacatactgcacttggttt

SEQ ID NO: 17654 - DNA, 25 bp, Mus musculus
aaagtccacatagtgcacttggttt

SEQ ID NO: 17655 - DNA, 25 bp, Mus musculus
aaagtccaccgaagctggagagctg

SEQ ID NO: 17656 - DNA, 25 bp, Mus musculus
aaagtccaccgatgctggagagctg

SEQ ID NO: 17657 - DNA, 25 bp, Mus musculus
aaagtccaccttcctcagtatttaa

SEQ ID NO: 17658 - DNA, 25 bp, Mus musculus
aaagtccaccttgctcagtatttaa

SEQ ID NO: 17659 - DNA, 25 bp, Mus musculus
aaagtccactggatctatgggtcat

SEQ ID NO: 17660 - DNA, 25 bp, Mus musculus
aaagtccactggattgcttgctgtc

SEQ ID NO: 17661 - DNA, 25 bp, Mus musculus
aaagtccactggttctatgggtcat

SEQ ID NO: 17662 - DNA, 25 bp, Mus musculus
aaagtccactggtttgcttgctgtc

SEQ ID NO: 17663 - DNA, 25 bp, Mus musculus
aaagtccagaggcagcgcgagtttc

SEQ ID NO: 17664 - DNA, 25 bp, Mus musculus
aaagtccagagggagcgcgagtttc

SEQ ID NO: 17665 - DNA, 25 bp, Mus musculus
aaagtccagcagaagtcacagatat

SEQ ID NO: 17666 - DNA, 25 bp, Mus musculus
aaagtccagcagtagtcacagatat

SEQ ID NO: 17667 - DNA, 25 bp, Mus musculus
aaagtccagcttctccattgaaact

SEQ ID NO: 17668 - DNA, 25 bp, Mus musculus
aaagtccagcttgtccattgaaact

SEQ ID NO: 17669 - DNA, 25 bp, Mus musculus
aaagtccatattcctcttggcagaa

SEQ ID NO: 17670 - DNA, 25 bp, Mus musculus
aaagtccatattgctcttggcagaa

SEQ ID NO: 17671 - DNA, 25 bp, Mus musculus
aaagtccatcagatgccttgagcgg

SEQ ID NO: 17672 - DNA, 25 bp, Mus musculus
aaagtccatcagttgccttgagcgg

SEQ ID NO: 17673 - DNA, 25 bp, Mus musculus
aaagtccatgcacgccaagggtctc

SEQ ID NO: 17674 - DNA, 25 bp, Mus musculus
aaagtccatgcaggccaagggtctc

SEQ ID NO: 17675 - DNA, 25 bp, Mus musculus
aaagtccatgccacatatttctcgt

SEQ ID NO: 17676 - DNA, 25 bp, Mus musculus
aaagtccatgcctcatatttctcgt

SEQ ID NO: 17677 - DNA, 25 bp, Mus musculus
aaagtccatgtgcagttagtttgtt

SEQ ID NO: 17678 - DNA, 25 bp, Mus musculus
aaagtccatgtggagttagtttgtt

SEQ ID NO: 17679 - DNA, 25 bp, Mus musculus
aaagtcccaatcatgtcattttcaa

SEQ ID NO: 17680 - DNA, 25 bp, Mus musculus
aaagtcccaatcttgtcattttcaa

SEQ ID NO: 17681 - DNA, 25 bp, Mus musculus
aaagtcccaatgacaggtgatcatc

SEQ ID NO: 17682 - DNA, 25 bp, Mus musculus
aaagtcccaatgtcaggtgatcatc

SEQ ID NO: 17683 - DNA, 25 bp, Mus musculus
aaagtcccagacaataactcctcag

SEQ ID NO: 17684 - DNA, 25 bp, Mus musculus
aaagtcccagactataactcctcag

SEQ ID NO: 17685 - DNA, 25 bp, Mus musculus
aaagtcccagggatcacaatgagct

SEQ ID NO: 17686 - DNA, 25 bp, Mus musculus
aaagtcccagggttcacaatgagct

SEQ ID NO: 17687 - DNA, 25 bp, Mus musculus
aaagtcccataacgcagaaccctag

SEQ ID NO: 17688 - DNA, 25 bp, Mus musculus
aaagtcccataaggcagaaccctag

SEQ ID NO: 17689 - DNA, 25 bp, Mus musculus
aaagtcccatgtcccctaatgtttt

SEQ ID NO: 17690 - DNA, 25 bp, Mus musculus
aaagtcccatgtgccctaatgtttt

SEQ ID NO: 17691 - DNA, 25 bp, Mus musculus
aaagtccccacacgtccttgaagat

SEQ ID NO: 17692 - DNA, 25 bp, Mus musculus
aaagtccccacaggtccttgaagat

SEQ ID NO: 17693 - DNA, 25 bp, Mus musculus
aaagtcccctatccgaggagatggt

SEQ ID NO: 17694 - DNA, 25 bp, Mus musculus
aaagtcccctatgcgaggagatggt

SEQ ID NO: 17695 - DNA, 25 bp, Mus musculus
aaagtcccctcaccaatggcgagtc

SEQ ID NO: 17696 - DNA, 25 bp, Mus musculus
aaagtcccctcagcaatggcgagtc

SEQ ID NO: 17697 - DNA, 25 bp, Mus musculus
aaagtcccgactcctggcacagagg

SEQ ID NO: 17698 - DNA, 25 bp, Mus musculus
aaagtcccgactgctggcacagagg

SEQ ID NO: 17699 - DNA, 25 bp, Mus musculus
aaagtccctataccctttgcttgct

SEQ ID NO: 17700 - DNA, 25 bp, Mus musculus
aaagtccctatagcctttgcttgct

SEQ ID NO: 17701 - DNA, 25 bp, Mus musculus
aaagtccctgagagtctcctggaaa

SEQ ID NO: 17702 - DNA, 25 bp, Mus musculus
aaagtccctgagtgtctcctggaaa

SEQ ID NO: 17703 - DNA, 25 bp, Mus musculus
aaagtccctggaaatctcggtgtgg

SEQ ID NO: 17704 - DNA, 25 bp, Mus musculus
aaagtccctggactgtgtgacagac

SEQ ID NO: 17705 - DNA, 25 bp, Mus musculus
aaagtccctggagtgtgtgacagac

SEQ ID NO: 17706 - DNA, 25 bp, Mus musculus
aaagtccctggatatctcggtgtgg

SEQ ID NO: 17707 - DNA, 25 bp, Mus musculus
aaagtcctagaaccagggccatcct

SEQ ID NO: 17708 - DNA, 25 bp, Mus musculus
aaagtcctagaagcagggccatcct

SEQ ID NO: 17709 - DNA, 25 bp, Mus musculus
aaagtcctatctctttgttctcttg

SEQ ID NO: 17710 - DNA, 25 bp, Mus musculus
aaagtcctatctgtttgttctcttg

SEQ ID NO: 17711 - DNA, 25 bp, Mus musculus
aaagtcctatggagtgttcctgcaa

SEQ ID NO: 17712 - DNA, 25 bp, Mus musculus
aaagtcctatggtgtgttcctgcaa

SEQ ID NO: 17713 - DNA, 25 bp, Mus musculus
aaagtcctattgaggctctatcctt

SEQ ID NO: 17714 - DNA, 25 bp, Mus musculus
aaagtcctattgtggctctatcctt

SEQ ID NO: 17715 - DNA, 25 bp, Mus musculus
aaagtcctcagaataagccaccatt

SEQ ID NO: 17716 - DNA, 25 bp, Mus musculus
aaagtcctcagattaagccaccatt

SEQ ID NO: 17717 - DNA, 25 bp, Mus musculus
aaagtcctcccgagcttggtgtgtg

SEQ ID NO: 17718 - DNA, 25 bp, Mus musculus
aaagtcctcccgtgcttggtgtgtg

SEQ ID NO: 17719 - DNA, 25 bp, Mus musculus
aaagtcctctccacattgcataggt

SEQ ID NO: 17720 - DNA, 25 bp, Mus musculus
aaagtcctctcctcattgcataggt

SEQ ID NO: 17721 - DNA, 25 bp, Mus musculus
aaagtcctcttcaaatggcctcagt

SEQ ID NO: 17722 - DNA, 25 bp, Mus musculus
aaagtcctcttctaatggcctcagt

SEQ ID NO: 17723 - DNA, 25 bp, Mus musculus
aaagtcctgatgactgccagaactt

SEQ ID NO: 17724 - DNA, 25 bp, Mus musculus
aaagtcctgatgtctgccagaactt

SEQ ID NO: 17725 - DNA, 25 bp, Mus musculus
aaagtcctgcatcacgtggctaata

SEQ ID NO: 17726 - DNA, 25 bp, Mus musculus
aaagtcctgcatgacgtggctaata

SEQ ID NO: 17727 - DNA, 25 bp, Mus musculus
aaagtcctgcctcggactctgagtc

SEQ ID NO: 17728 - DNA, 25 bp, Mus musculus
aaagtcctgcctgggactctgagtc

SEQ ID NO: 17729 - DNA, 25 bp, Mus musculus
aaagtcctggatcctgtccgaggca

SEQ ID NO: 17730 - DNA, 25 bp, Mus musculus
aaagtcctggatgctgtccgaggca

SEQ ID NO: 17731 - DNA, 25 bp, Mus musculus
aaagtcctggcccatggtgttgatc

SEQ ID NO: 17732 - DNA, 25 bp, Mus musculus
aaagtcctggccgatggtgttgatc

SEQ ID NO: 17733 - DNA, 25 bp, Mus musculus
aaagtcctggtacagtcggtctgca

SEQ ID NO: 17734 - DNA, 25 bp, Mus musculus
aaagtcctggtagagtcggtctgca

SEQ ID NO: 17735 - DNA, 25 bp, Mus musculus
aaagtcctgtctctaaacttcaagg

SEQ ID NO: 17736 - DNA, 25 bp, Mus musculus
aaagtcctgtctgtaaacttcaagg

SEQ ID NO: 17737 - DNA, 25 bp, Mus musculus
aaagtcctgtgcaggttttgctaga

SEQ ID NO: 17738 - DNA, 25 bp, Mus musculus
aaagtcctgtgctggttttgctaga

SEQ ID NO: 17739 - DNA, 25 bp, Mus musculus
aaagtccttactcagatgggctctc

SEQ ID NO: 17740 - DNA, 25 bp, Mus musculus
aaagtccttactgagatgggctctc

SEQ ID NO: 17741 - DNA, 25 bp, Mus musculus
aaagtccttagaccagtgacacctg

SEQ ID NO: 17742 - DNA, 25 bp, Mus musculus
aaagtccttagagcagtgacacctg

SEQ ID NO: 17743 - DNA, 25 bp, Mus musculus
aaagtccttatgagtttcaccgata

SEQ ID NO: 17744 - DNA, 25 bp, Mus musculus
aaagtccttatgctcatcctccaat

SEQ ID NO: 17745 - DNA, 25 bp, Mus musculus
aaagtccttatggtcatcctccaat

SEQ ID NO: 17746 - DNA, 25 bp, Mus musculus
aaagtccttatgtgtttcaccgata

SEQ ID NO: 17747 - DNA, 25 bp, Mus musculus
aaagtccttctgctgtcccccggtg

SEQ ID NO: 17748 - DNA, 25 bp, Mus musculus
aaagtccttctggtgtcccccggtg

SEQ ID NO: 17749 - DNA, 25 bp, Mus musculus
aaagtccttgtgatggtgtgtcttc

SEQ ID NO: 17750 - DNA, 25 bp, Mus musculus
aaagtccttgtgttggtgtgtcttc

SEQ ID NO: 17751 - DNA, 25 bp, Mus musculus
aaagtcctttccaatgcacttcgat

SEQ ID NO: 17752 - DNA, 25 bp, Mus musculus
aaagtcctttcctatgcacttcgat

SEQ ID NO: 17753 - DNA, 25 bp, Mus musculus
aaagtcgaattgctccttccttgtg

SEQ ID NO: 17754 - DNA, 25 bp, Mus musculus
aaagtcgaattggtccttccttgtg

SEQ ID NO: 17755 - DNA, 25 bp, Mus musculus
aaagtcgacatccatacgcgtggtc

SEQ ID NO: 17756 - DNA, 25 bp, Mus musculus
aaagtcgacatcgatacgcgtggtc

SEQ ID NO: 17757 - DNA, 25 bp, Mus musculus
aaagtcgactttctgagttgcccag

SEQ ID NO: 17758 - DNA, 25 bp, Mus musculus
aaagtcgactttgtgagttgcccag

SEQ ID NO: 17759 - DNA, 25 bp, Mus musculus
aaagtcgagagcattctgcctacct

SEQ ID NO: 17760 - DNA, 25 bp, Mus musculus
aaagtcgagagctttctgcctacct

SEQ ID NO: 17761 - DNA, 25 bp, Mus musculus
aaagtcgagcccacttcaagaacag

SEQ ID NO: 17762 - DNA, 25 bp, Mus musculus
aaagtcgagccctcttcaagaacag

SEQ ID NO: 17763 - DNA, 25 bp, Mus musculus
aaagtcgaggccaccattgagccag

SEQ ID NO: 17764 - DNA, 25 bp, Mus musculus
aaagtcgaggcctccattgagccag

SEQ ID NO: 17765 - DNA, 25 bp, Mus musculus
aaagtcgccaagatgaacatccctc

SEQ ID NO: 17766 - DNA, 25 bp, Mus musculus
aaagtcgccaagttgaacatccctc

SEQ ID NO: 17767 - DNA, 25 bp, Mus musculus
aaagtcgcccatagtgggtgtgcct

SEQ ID NO: 17768 - DNA, 25 bp, Mus musculus
aaagtcgcccattgtgggtgtgcct

SEQ ID NO: 17769 - DNA, 25 bp, Mus musculus
aaagtcgccttcactgccctgagga

SEQ ID NO: 17770 - DNA, 25 bp, Mus musculus
aaagtcgccttctctgccctgagga

SEQ ID NO: 17771 - DNA, 25 bp, Mus musculus
aaagtcggccagctcaagcacagga

SEQ ID NO: 17772 - DNA, 25 bp, Mus musculus
aaagtcggccaggtcaagcacagga

SEQ ID NO: 17773 - DNA, 25 bp, Mus musculus
aaagtcggcctccactgcagctcgg

SEQ ID NO: 17774 - DNA, 25 bp, Mus musculus
aaagtcggcctcgactgcagctcgg

SEQ ID NO: 17775 - DNA, 25 bp, Mus musculus
aaagtcgggctgatgctgaacacca

SEQ ID NO: 17776 - DNA, 25 bp, Mus musculus
aaagtcgggctgttgctgaacacca

SEQ ID NO: 17777 - DNA, 25 bp, Mus musculus
aaagtcgggtatatgggtggctcca

SEQ ID NO: 17778 - DNA, 25 bp, Mus musculus
aaagtcgggtatttgggtggctcca

SEQ ID NO: 17779 - DNA, 25 bp, Mus musculus
aaagtcggtactcggatcttcaaca

SEQ ID NO: 17780 - DNA, 25 bp, Mus musculus
aaagtcggtactgggatcttcaaca

SEQ ID NO: 17781 - DNA, 25 bp, Mus musculus
aaagtcggtgttctacatagcataa

SEQ ID NO: 17782 - DNA, 25 bp, Mus musculus
aaagtcggtgttgtacatagcataa

SEQ ID NO: 17783 - DNA, 25 bp, Mus musculus
aaagtcgtatacagatttgggatct

SEQ ID NO: 17784 - DNA, 25 bp, Mus musculus
aaagtcgtatactgatttgggatct

SEQ ID NO: 17785 - DNA, 25 bp, Mus musculus
aaagtcgtccgcaatgagggtttct

SEQ ID NO: 17786 - DNA, 25 bp, Mus musculus
aaagtcgtccgctatgagggtttct

SEQ ID NO: 17787 - DNA, 25 bp, Mus musculus
aaagtcgttaccaatgtactccaca

SEQ ID NO: 17788 - DNA, 25 bp, Mus musculus
aaagtcgttacctatgtactccaca

SEQ ID NO: 17789 - DNA, 25 bp, Mus musculus
aaagtctaaatgagcctgggtggta

SEQ ID NO: 17790 - DNA, 25 bp, Mus musculus
aaagtctaaatgtgcctgggtggta

SEQ ID NO: 17791 - DNA, 25 bp, Mus musculus
aaagtctaacagcacgagtcttaat

SEQ ID NO: 17792 - DNA, 25 bp, Mus musculus
aaagtctaacaggacgagtcttaat

SEQ ID NO: 17793 - DNA, 25 bp, Mus musculus
aaagtctaagtaccatatcctgtcc

SEQ ID NO: 17794 - DNA, 25 bp, Mus musculus
aaagtctaagtagcatatcctgtcc

SEQ ID NO: 17795 - DNA, 25 bp, Mus musculus
aaagtctacagacatcttccaggcc

SEQ ID NO: 17796 - DNA, 25 bp, Mus musculus
aaagtctacagagatcttccaggcc

SEQ ID NO: 17797 - DNA, 25 bp, Mus musculus
aaagtctacatgcaaggttgctgag

SEQ ID NO: 17798 - DNA, 25 bp, Mus musculus
aaagtctacatggaaggttgctgag

SEQ ID NO: 17799 - DNA, 25 bp, Mus musculus
aaagtctacctacagaaagtcacag

SEQ ID NO: 17800 - DNA, 25 bp, Mus musculus
aaagtctacctagagaaagtcacag

SEQ ID NO: 17801 - DNA, 25 bp, Mus musculus
aaagtctacctgaccaacattacac

SEQ ID NO: 17802 - DNA, 25 bp, Mus musculus
aaagtctacctgtccaacattacac

SEQ ID NO: 17803 - DNA, 25 bp, Mus musculus
aaagtctacgtcagtgggcgtggca

SEQ ID NO: 17804 - DNA, 25 bp, Mus musculus
aaagtctacgtctgtgggcgtggca

SEQ ID NO: 17805 - DNA, 25 bp, Mus musculus
aaagtctactaaagtccatgctttg

SEQ ID NO: 17806 - DNA, 25 bp, Mus musculus
aaagtctactaatgtccatgctttg

SEQ ID NO: 17807 - DNA, 25 bp, Mus musculus
aaagtctagactcaagagcccttga

SEQ ID NO: 17808 - DNA, 25 bp, Mus musculus
aaagtctagactgaagagcccttga

SEQ ID NO: 17809 - DNA, 25 bp, Mus musculus
aaagtctaggctcctggatggtttt

SEQ ID NO: 17810 - DNA, 25 bp, Mus musculus
aaagtctaggctgctggatggtttt

SEQ ID NO: 17811 - DNA, 25 bp, Mus musculus
aaagtctagggtctctgaagcattt

SEQ ID NO: 17812 - DNA, 25 bp, Mus musculus
aaagtctagggtgtctgaagcattt

SEQ ID NO: 17813 - DNA, 25 bp, Mus musculus
aaagtctagtggatcgtgctgccaa

SEQ ID NO: 17814 - DNA, 25 bp, Mus musculus
aaagtctagtggttcgtgctgccaa

SEQ ID NO: 17815 - DNA, 25 bp, Mus musculus
aaagtctagttacaacatcctggta

SEQ ID NO: 17816 - DNA, 25 bp, Mus musculus
aaagtctagttagaacatcctggta

SEQ ID NO: 17817 - DNA, 25 bp, Mus musculus
aaagtctatcatcagttattgagat

SEQ ID NO: 17818 - DNA, 25 bp, Mus musculus
aaagtctatcatgagttattgagat

SEQ ID NO: 17819 - DNA, 25 bp, Mus musculus
aaagtctatcttctattctattcta

SEQ ID NO: 17820 - DNA, 25 bp, Mus musculus
aaagtctatcttgtattctattcta

SEQ ID NO: 17821 - DNA, 25 bp, Mus musculus
aaagtctcaaggacaccattgcccg

SEQ ID NO: 17822 - DNA, 25 bp, Mus musculus
aaagtctcaaggtcaccattgcccg

SEQ ID NO: 17823 - DNA, 25 bp, Mus musculus
aaagtctcacaccattcatgcaaac

SEQ ID NO: 17824 - DNA, 25 bp, Mus musculus
aaagtctcacacgattcatgcaaac

SEQ ID NO: 17825 - DNA, 25 bp, Mus musculus
aaagtctcagcaagcactgtcagaa

SEQ ID NO: 17826 - DNA, 25 bp, Mus musculus
aaagtctcagcatgcactgtcagaa

SEQ ID NO: 17827 - DNA, 25 bp, Mus musculus
aaagtctcagggacagttcccaggc

SEQ ID NO: 17828 - DNA, 25 bp, Mus musculus
aaagtctcagggtcagttcccaggc

SEQ ID NO: 17829 - DNA, 25 bp, Mus musculus
aaagtctccaatcgctttccaatgc

SEQ ID NO: 17830 - DNA, 25 bp, Mus musculus
aaagtctccaatggctttccaatgc

SEQ ID NO: 17831 - DNA, 25 bp, Mus musculus
aaagtctccaggactccagggacgg

SEQ ID NO: 17832 - DNA, 25 bp, Mus musculus
aaagtctccaggtctccagggacgg

SEQ ID NO: 17833 - DNA, 25 bp, Mus musculus
aaagtctccatcaatcaacaccatt

SEQ ID NO: 17834 - DNA, 25 bp, Mus musculus
aaagtctccatctatcaacaccatt

SEQ ID NO: 17835 - DNA, 25 bp, Mus musculus
aaagtctcccgcagaatgcagtcca

SEQ ID NO: 17836 - DNA, 25 bp, Mus musculus
aaagtctcccgctgaatgcagtcca

SEQ ID NO: 17837 - DNA, 25 bp, Mus musculus
aaagtctcctccactgactggtttc

SEQ ID NO: 17838 - DNA, 25 bp, Mus musculus
aaagtctcctcctctgactggtttc

SEQ ID NO: 17839 - DNA, 25 bp, Mus musculus
aaagtctcgagcagtccgttcctta

SEQ ID NO: 17840 - DNA, 25 bp, Mus musculus
aaagtctcgagctgtccgttcctta

SEQ ID NO: 17841 - DNA, 25 bp, Mus musculus
aaagtctctaccattctcttatcat

SEQ ID NO: 17842 - DNA, 25 bp, Mus musculus
aaagtctctacctttctcttatcat

SEQ ID NO: 17843 - DNA, 25 bp, Mus musculus
aaagtctctactcgaatgcatgtgg

SEQ ID NO: 17844 - DNA, 25 bp, Mus musculus
aaagtctctactggaatgcatgtgg

SEQ ID NO: 17845 - DNA, 25 bp, Mus musculus
aaagtctctagcagactctttcttt

SEQ ID NO: 17846 - DNA, 25 bp, Mus musculus
aaagtctctagctgactctttcttt

SEQ ID NO: 17847 - DNA, 25 bp, Mus musculus
aaagtctctcatccttctgtccgtg

SEQ ID NO: 17848 - DNA, 25 bp, Mus musculus
aaagtctctcatgcttctgtccgtg

SEQ ID NO: 17849 - DNA, 25 bp, Mus musculus
aaagtctctctgatcatgtcaataa

SEQ ID NO: 17850 - DNA, 25 bp, Mus musculus
aaagtctctctgcttaagctgctcc

SEQ ID NO: 17851 - DNA, 25 bp, Mus musculus
aaagtctctctggttaagctgctcc

SEQ ID NO: 17852 - DNA, 25 bp, Mus musculus
aaagtctctctgttcatgtcaataa

SEQ ID NO: 17853 - DNA, 25 bp, Mus musculus
aaagtctctggcaggtcagctggta

SEQ ID NO: 17854 - DNA, 25 bp, Mus musculus
aaagtctctggctggtcagctggta

SEQ ID NO: 17855 - DNA, 25 bp, Mus musculus
aaagtctcttacatcttagtgtgga

SEQ ID NO: 17856 - DNA, 25 bp, Mus musculus
aaagtctcttacttcttagtgtgga

SEQ ID NO: 17857 - DNA, 25 bp, Mus musculus
aaagtctcttccaggctaccttcag

SEQ ID NO: 17858 - DNA, 25 bp, Mus musculus
aaagtctcttcctggctaccttcag

SEQ ID NO: 17859 - DNA, 25 bp, Mus musculus
aaagtctgagctatctctcatctgt

SEQ ID NO: 17860 - DNA, 25 bp, Mus musculus
aaagtctgagctttctctcatctgt

SEQ ID NO: 17861 - DNA, 25 bp, Mus musculus
aaagtctgagttaaccgtctgaatg

SEQ ID NO: 17862 - DNA, 25 bp, Mus musculus
aaagtctgagttactgtgcggtgct

SEQ ID NO: 17863 - DNA, 25 bp, Mus musculus
aaagtctgagtttaccgtctgaatg

SEQ ID NO: 17864 - DNA, 25 bp, Mus musculus
aaagtctgagtttctgtgcggtgct

SEQ ID NO: 17865 - DNA, 25 bp, Mus musculus
aaagtctgcagaatctatcccacac

SEQ ID NO: 17866 - DNA, 25 bp, Mus musculus
aaagtctgcagattctatcccacac

SEQ ID NO: 17867 - DNA, 25 bp, Mus musculus
aaagtctgcttgcatgacctcaggt

SEQ ID NO: 17868 - DNA, 25 bp, Mus musculus
aaagtctgcttggatgacctcaggt

SEQ ID NO: 17869 - DNA, 25 bp, Mus musculus
aaagtctggatcctgttctcacatt

SEQ ID NO: 17870 - DNA, 25 bp, Mus musculus
aaagtctggatcgtgttctcacatt

SEQ ID NO: 17871 - DNA, 25 bp, Mus musculus
aaagtctggcaactttactgtcctg

SEQ ID NO: 17872 - DNA, 25 bp, Mus musculus
aaagtctggcaagtttactgtcctg

SEQ ID NO: 17873 - DNA, 25 bp, Mus musculus
aaagtctggcttagcgggcaacaca

SEQ ID NO: 17874 - DNA, 25 bp, Mus musculus
aaagtctggctttgcgggcaacaca

SEQ ID NO: 17875 - DNA, 25 bp, Mus musculus
aaagtctgggttactagcatggagt

SEQ ID NO: 17876 - DNA, 25 bp, Mus musculus
aaagtctgggtttctagcatggagt

SEQ ID NO: 17877 - DNA, 25 bp, Mus musculus
aaagtctggtatctgcatttcccca

SEQ ID NO: 17878 - DNA, 25 bp, Mus musculus
aaagtctggtatgtgcatttcccca

SEQ ID NO: 17879 - DNA, 25 bp, Mus musculus
aaagtctgtatgaccatacccctga

SEQ ID NO: 17880 - DNA, 25 bp, Mus musculus
aaagtctgtatgtccatacccctga

SEQ ID NO: 17881 - DNA, 25 bp, Mus musculus
aaagtctgtcagatgttgaatctat

SEQ ID NO: 17882 - DNA, 25 bp, Mus musculus
aaagtctgtcagttgttgaatctat

SEQ ID NO: 17883 - DNA, 25 bp, Mus musculus
aaagtctgtcggaaatgtcttttct

SEQ ID NO: 17884 - DNA, 25 bp, Mus musculus
aaagtctgtcggtaatgtcttttct

SEQ ID NO: 17885 - DNA, 25 bp, Mus musculus
aaagtctgtcttcgattttgttcct

SEQ ID NO: 17886 - DNA, 25 bp, Mus musculus
aaagtctgtcttggattttgttcct

SEQ ID NO: 17887 - DNA, 25 bp, Mus musculus
aaagtctgtgctcatcatggacggg

SEQ ID NO: 17888 - DNA, 25 bp, Mus musculus
aaagtctgtgctgatcatggacggg

SEQ ID NO: 17889 - DNA, 25 bp, Mus musculus
aaagtctgtggaccacgctgtctac

SEQ ID NO: 17890 - DNA, 25 bp, Mus musculus
aaagtctgtggagcacgctgtctac

SEQ ID NO: 17891 - DNA, 25 bp, Mus musculus
aaagtctgtgtaaatgtctcataaa

SEQ ID NO: 17892 - DNA, 25 bp, Mus musculus
aaagtctgtgtatatgtctcataaa

SEQ ID NO: 17893 - DNA, 25 bp, Mus musculus
aaagtctgtgtcagtctcaacctag

SEQ ID NO: 17894 - DNA, 25 bp, Mus musculus
aaagtctgtgtctgtctcaacctag

SEQ ID NO: 17895 - DNA, 25 bp, Mus musculus
aaagtctgtttacacactcacctgt

SEQ ID NO: 17896 - DNA, 25 bp, Mus musculus
aaagtctgtttagacactcacctgt

SEQ ID NO: 17897 - DNA, 25 bp, Mus musculus
aaagtctgtttgctgatccgtttgc

SEQ ID NO: 17898 - DNA, 25 bp, Mus musculus
aaagtctgtttggtgatccgtttgc

SEQ ID NO: 17899 - DNA, 25 bp, Mus musculus
aaagtcttagttcctcaggctccta

SEQ ID NO: 17900 - DNA, 25 bp, Mus musculus
aaagtcttagttgctcaggctccta

SEQ ID NO: 17901 - DNA, 25 bp, Mus musculus
aaagtcttcaatcgacctactggaa

SEQ ID NO: 17902 - DNA, 25 bp, Mus musculus
aaagtcttcaatggacctactggaa

SEQ ID NO: 17903 - DNA, 25 bp, Mus musculus
aaagtcttccaaacagtactccagg

SEQ ID NO: 17904 - DNA, 25 bp, Mus musculus
aaagtcttccaatcagtactccagg

SEQ ID NO: 17905 - DNA, 25 bp, Mus musculus
aaagtcttccatcagcagtgatcgg

SEQ ID NO: 17906 - DNA, 25 bp, Mus musculus
aaagtcttccatgagcagtgatcgg

SEQ ID NO: 17907 - DNA, 25 bp, Mus musculus
aaagtcttcccgcataacctggatg

SEQ ID NO: 17908 - DNA, 25 bp, Mus musculus
aaagtcttcccggataacctggatg

SEQ ID NO: 17909 - DNA, 25 bp, Mus musculus
aaagtcttcctgatgtgcgttgtcg

SEQ ID NO: 17910 - DNA, 25 bp, Mus musculus
aaagtcttcctgttgtgcgttgtcg

SEQ ID NO: 17911 - DNA, 25 bp, Mus musculus
aaagtcttcttcatggttcagttta

SEQ ID NO: 17912 - DNA, 25 bp, Mus musculus
aaagtcttcttcttggttcagttta

SEQ ID NO: 17913 - DNA, 25 bp, Mus musculus
aaagtcttgaccacctatcaatctt

SEQ ID NO: 17914 - DNA, 25 bp, Mus musculus
aaagtcttgacctcctatcaatctt

SEQ ID NO: 17915 - DNA, 25 bp, Mus musculus
aaagtcttgactaacggtgcctgtg

SEQ ID NO: 17916 - DNA, 25 bp, Mus musculus
aaagtcttgacttacggtgcctgtg

SEQ ID NO: 17917 - DNA, 25 bp, Mus musculus
aaagtcttgatgagttgcctaggct

SEQ ID NO: 17918 - DNA, 25 bp, Mus musculus
aaagtcttgatgtgttgcctaggct

SEQ ID NO: 17919 - DNA, 25 bp, Mus musculus
aaagtcttgcaaagtctccctcctg

SEQ ID NO: 17920 - DNA, 25 bp, Mus musculus
aaagtcttgcaatgtctccctcctg

SEQ ID NO: 17921 - DNA, 25 bp, Mus musculus
aaagtcttgccgaattgggacctga

SEQ ID NO: 17922 - DNA, 25 bp, Mus musculus
aaagtcttgccgtattgggacctga

SEQ ID NO: 17923 - DNA, 25 bp, Mus musculus
aaagtcttgcttacagcttccaggg

SEQ ID NO: 17924 - DNA, 25 bp, Mus musculus
aaagtcttgctttcagcttccaggg

SEQ ID NO: 17925 - DNA, 25 bp, Mus musculus
aaagtcttggttcttcatggttgaa

SEQ ID NO: 17926 - DNA, 25 bp, Mus musculus
aaagtcttggttgttcatggttgaa

SEQ ID NO: 17927 - DNA, 25 bp, Mus musculus
aaagtcttgtgtagttgggttatca

SEQ ID NO: 17928 - DNA, 25 bp, Mus musculus
aaagtcttgtgtcggagagttgaaa

SEQ ID NO: 17929 - DNA, 25 bp, Mus musculus
aaagtcttgtgtgggagagttgaaa

SEQ ID NO: 17930 - DNA, 25 bp, Mus musculus
aaagtcttgtgttgttgggttatca

SEQ ID NO: 17931 - DNA, 25 bp, Mus musculus
aaagtgaaactgcatgtcatctgac

SEQ ID NO: 17932 - DNA, 25 bp, Mus musculus
aaagtgaaactggatgtcatctgac

SEQ ID NO: 17933 - DNA, 25 bp, Mus musculus
aaagtgaaagttacaatgccaaatg

SEQ ID NO: 17934 - DNA, 25 bp, Mus musculus
aaagtgaaagtttcaatgccaaatg

SEQ ID NO: 17935 - DNA, 25 bp, Mus musculus
aaagtgaacagcaccagggccagat

SEQ ID NO: 17936 - DNA, 25 bp, Mus musculus
aaagtgaacagctccagggccagat

SEQ ID NO: 17937 - DNA, 25 bp, Mus musculus
aaagtgaagatgacagccatcccga

SEQ ID NO: 17938 - DNA, 25 bp, Mus musculus
aaagtgaagatgtcagccatcccga

SEQ ID NO: 17939 - DNA, 25 bp, Mus musculus
aaagtgaagcacaccggccagatct

SEQ ID NO: 17940 - DNA, 25 bp, Mus musculus
aaagtgaagcactccggccagatct

SEQ ID NO: 17941 - DNA, 25 bp, Mus musculus
aaagtgaagcagaaggcttgtctat

SEQ ID NO: 17942 - DNA, 25 bp, Mus musculus
aaagtgaagcagtaggcttgtctat

SEQ ID NO: 17943 - DNA, 25 bp, Mus musculus
aaagtgaagcgcatcaccccacgtc

SEQ ID NO: 17944 - DNA, 25 bp, Mus musculus
aaagtgaagcgcttcaccccacgtc

SEQ ID NO: 17945 - DNA, 25 bp, Mus musculus
aaagtgaagggcatgcatcctccag

SEQ ID NO: 17946 - DNA, 25 bp, Mus musculus
aaagtgaagggcttgcatcctccag

SEQ ID NO: 17947 - DNA, 25 bp, Mus musculus
aaagtgaatgataagtccgtgggtg

SEQ ID NO: 17948 - DNA, 25 bp, Mus musculus
aaagtgaatgattagtccgtgggtg

SEQ ID NO: 17949 - DNA, 25 bp, Mus musculus
aaagtgaattccacatgcgcaagca

SEQ ID NO: 17950 - DNA, 25 bp, Mus musculus
aaagtgaattcctcatgcgcaagca

SEQ ID NO: 17951 - DNA, 25 bp, Mus musculus
aaagtgacatcaccacatccgcttt

SEQ ID NO: 17952 - DNA, 25 bp, Mus musculus
aaagtgacatcagcacatccgcttt

SEQ ID NO: 17953 - DNA, 25 bp, Mus musculus
aaagtgacatttaccaaggtgcgaa

SEQ ID NO: 17954 - DNA, 25 bp, Mus musculus
aaagtgacattttccaaggtgcgaa

SEQ ID NO: 17955 - DNA, 25 bp, Mus musculus
aaagtgaccctgcagactttatccc

SEQ ID NO: 17956 - DNA, 25 bp, Mus musculus
aaagtgaccctggagactttatccc

SEQ ID NO: 17957 - DNA, 25 bp, Mus musculus
aaagtgacctatcctcaacctgact

SEQ ID NO: 17958 - DNA, 25 bp, Mus musculus
aaagtgacctatgctcaacctgact

SEQ ID NO: 17959 - DNA, 25 bp, Mus musculus
aaagtgacggtcacctgtctcagaa

SEQ ID NO: 17960 - DNA, 25 bp, Mus musculus
aaagtgacggtctcctgtctcagaa

SEQ ID NO: 17961 - DNA, 25 bp, Mus musculus
aaagtgacgtccacacagaccacag

SEQ ID NO: 17962 - DNA, 25 bp, Mus musculus
aaagtgacgtcctcacagaccacag

SEQ ID NO: 17963 - DNA, 25 bp, Mus musculus
aaagtgactaggcagctacccaggt

SEQ ID NO: 17964 - DNA, 25 bp, Mus musculus
aaagtgactagggagctacccaggt

SEQ ID NO: 17965 - DNA, 25 bp, Mus musculus
aaagtgactatgcttcccggtggct

SEQ ID NO: 17966 - DNA, 25 bp, Mus musculus
aaagtgactatggttcccggtggct

SEQ ID NO: 17967 - DNA, 25 bp, Mus musculus
aaagtgactcctattgtatgcctac

SEQ ID NO: 17968 - DNA, 25 bp, Mus musculus
aaagtgactccttttgtatgcctac

SEQ ID NO: 17969 - DNA, 25 bp, Mus musculus
aaagtgactctgactaacgcggtta

SEQ ID NO: 17970 - DNA, 25 bp, Mus musculus
aaagtgactctgtctaacgcggtta

SEQ ID NO: 17971 - DNA, 25 bp, Mus musculus
aaagtgactggacccggttcgagat

SEQ ID NO: 17972 - DNA, 25 bp, Mus musculus
aaagtgactggagccggttcgagat

SEQ ID NO: 17973 - DNA, 25 bp, Mus musculus
aaagtgactggcagttgcccacacc

SEQ ID NO: 17974 - DNA, 25 bp, Mus musculus
aaagtgactggctgttgcccacacc

SEQ ID NO: 17975 - DNA, 25 bp, Mus musculus
aaagtgactgtgagtgacccagcac

SEQ ID NO: 17976 - DNA, 25 bp, Mus musculus
aaagtgactgtgtgtgacccagcac

SEQ ID NO: 17977 - DNA, 25 bp, Mus musculus
aaagtgacttccctgagctagcctc

SEQ ID NO: 17978 - DNA, 25 bp, Mus musculus
aaagtgacttccgtgagctagcctc

SEQ ID NO: 17979 - DNA, 25 bp, Mus musculus
aaagtgacttctattgtacctttgt

SEQ ID NO: 17980 - DNA, 25 bp, Mus musculus
aaagtgacttcttttgtacctttgt

SEQ ID NO: 17981 - DNA, 25 bp, Mus musculus
aaagtgagatctctcactgtgtgaa

SEQ ID NO: 17982 - DNA, 25 bp, Mus musculus
aaagtgagatctgtcactgtgtgaa

SEQ ID NO: 17983 - DNA, 25 bp, Mus musculus
aaagtgagccgccatggtctggtcc

SEQ ID NO: 17984 - DNA, 25 bp, Mus musculus
aaagtgagccgcgatggtctggtcc

SEQ ID NO: 17985 - DNA, 25 bp, Mus musculus
aaagtgagcctgatggccctgctta

SEQ ID NO: 17986 - DNA, 25 bp, Mus musculus
aaagtgagcctgttggccctgctta

SEQ ID NO: 17987 - DNA, 25 bp, Mus musculus
aaagtgagcgctccagggcccgtta

SEQ ID NO: 17988 - DNA, 25 bp, Mus musculus
aaagtgagcgctgcagggcccgtta

SEQ ID NO: 17989 - DNA, 25 bp, Mus musculus
aaagtgagctgcagtcttttcatgt

SEQ ID NO: 17990 - DNA, 25 bp, Mus musculus
aaagtgagctgctgtcttttcatgt

SEQ ID NO: 17991 - DNA, 25 bp, Mus musculus
aaagtgaggagcctggctctcgtcc

SEQ ID NO: 17992 - DNA, 25 bp, Mus musculus
aaagtgaggagcgtggctctcgtcc

SEQ ID NO: 17993 - DNA, 25 bp, Mus musculus
aaagtgaggcttcctaaccctgtag

SEQ ID NO: 17994 - DNA, 25 bp, Mus musculus
aaagtgaggcttgctaaccctgtag

SEQ ID NO: 17995 - DNA, 25 bp, Mus musculus
aaagtgagggacaaaactacatgga

SEQ ID NO: 17996 - DNA, 25 bp, Mus musculus
aaagtgagggactaaactacatgga

SEQ ID NO: 17997 - DNA, 25 bp, Mus musculus
aaagtgaggttgactgtggccatct

SEQ ID NO: 17998 - DNA, 25 bp, Mus musculus
aaagtgaggttgtctgtggccatct

SEQ ID NO: 17999 - DNA, 25 bp, Mus musculus
aaagtgagttgtattcaagcctttg

SEQ ID NO: 18000 - DNA, 25 bp, Mus musculus
aaagtgagttgttttcaagcctttg

SEQ ID NO: 18001 - DNA, 25 bp, Mus musculus
aaagtgatacatacaggacggacat

SEQ ID NO: 18002 - DNA, 25 bp, Mus musculus
aaagtgatacattcaggacggacat

SEQ ID NO: 18003 - DNA, 25 bp, Mus musculus
aaagtgataccccaggcgtgagagt

SEQ ID NO: 18004 - DNA, 25 bp, Mus musculus
aaagtgatacccgaggcgtgagagt

SEQ ID NO: 18005 - DNA, 25 bp, Mus musculus
aaagtgatagccaggccctgcgtca

SEQ ID NO: 18006 - DNA, 25 bp, Mus musculus
aaagtgatagcctggccctgcgtca

SEQ ID NO: 18007 - DNA, 25 bp, Mus musculus
aaagtgatccctcgtgtgtgctgac

SEQ ID NO: 18008 - DNA, 25 bp, Mus musculus
aaagtgatccctggtgtgtgctgac

SEQ ID NO: 18009 - DNA, 25 bp, Mus musculus
aaagtgatccgtcacagtctctggg

SEQ ID NO: 18010 - DNA, 25 bp, Mus musculus
aaagtgatccgtgacagtctctggg

SEQ ID NO: 18011 - DNA, 25 bp, Mus musculus
aaagtgatcttcacagactactgca

SEQ ID NO: 18012 - DNA, 25 bp, Mus musculus
aaagtgatcttctcagactactgca

SEQ ID NO: 18013 - DNA, 25 bp, Mus musculus
aaagtgatgaagacattcagtacag

SEQ ID NO: 18014 - DNA, 25 bp, Mus musculus
aaagtgatgaagtcattcagtacag

SEQ ID NO: 18015 - DNA, 25 bp, Mus musculus
aaagtgatgacaaggttacctggtt

SEQ ID NO: 18016 - DNA, 25 bp, Mus musculus
aaagtgatgacatggttacctggtt

SEQ ID NO: 18017 - DNA, 25 bp, Mus musculus
aaagtgatgagaccccaacagttcc

SEQ ID NO: 18018 - DNA, 25 bp, Mus musculus
aaagtgatgagagcccaacagttcc

SEQ ID NO: 18019 - DNA, 25 bp, Mus musculus
aaagtgatgaggcagttttatgaac

SEQ ID NO: 18020 - DNA, 25 bp, Mus musculus
aaagtgatgagggagttttatgaac

SEQ ID NO: 18021 - DNA, 25 bp, Mus musculus
aaagtgatgcaccagtcactcccga

SEQ ID NO: 18022 - DNA, 25 bp, Mus musculus
aaagtgatgcacgagtcactcccga

SEQ ID NO: 18023 - DNA, 25 bp, Mus musculus
aaagtgatgctgctgtctgactctt

SEQ ID NO: 18024 - DNA, 25 bp, Mus musculus
aaagtgatgctggtgtctgactctt

SEQ ID NO: 18025 - DNA, 25 bp, Mus musculus
aaagtgatggtgcttgtggtcccta

SEQ ID NO: 18026 - DNA, 25 bp, Mus musculus
aaagtgatggtggttgtggtcccta

SEQ ID NO: 18027 - DNA, 25 bp, Mus musculus
aaagtgattcacaagcccagggcca

SEQ ID NO: 18028 - DNA, 25 bp, Mus musculus
aaagtgattcactagcccagggcca

SEQ ID NO: 18029 - DNA, 25 bp, Mus musculus
aaagtgattggtccggaagttccag

SEQ ID NO: 18030 - DNA, 25 bp, Mus musculus
aaagtgattggtgcggaagttccag

SEQ ID NO: 18031 - DNA, 25 bp, Mus musculus
aaagtgattgtgcacacctgtaacc

SEQ ID NO: 18032 - DNA, 25 bp, Mus musculus
aaagtgattgtggacacctgtaacc

SEQ ID NO: 18033 - DNA, 25 bp, Mus musculus
aaagtgatttccaagttatactaca

SEQ ID NO: 18034 - DNA, 25 bp, Mus musculus
aaagtgatttcctagttatactaca

SEQ ID NO: 18035 - DNA, 25 bp, Mus musculus
aaagtgatttggatgcagctatgaa

SEQ ID NO: 18036 - DNA, 25 bp, Mus musculus
aaagtgatttggttgcagctatgaa

SEQ ID NO: 18037 - DNA, 25 bp, Mus musculus
aaagtgcaaccaaccatgcagcttc

SEQ ID NO: 18038 - DNA, 25 bp, Mus musculus
aaagtgcaaccatccatgcagcttc

SEQ ID NO: 18039 - DNA, 25 bp, Mus musculus
aaagtgcaacgacgccagaaccgaa

SEQ ID NO: 18040 - DNA, 25 bp, Mus musculus
aaagtgcaacgaggccagaaccgaa

SEQ ID NO: 18041 - DNA, 25 bp, Mus musculus
aaagtgcaagacaacctacccactg

SEQ ID NO: 18042 - DNA, 25 bp, Mus musculus
aaagtgcaagactacctacccactg

SEQ ID NO: 18043 - DNA, 25 bp, Mus musculus
aaagtgcaagctagtaattcctgca

SEQ ID NO: 18044 - DNA, 25 bp, Mus musculus
aaagtgcaagcttgtaattcctgca

SEQ ID NO: 18045 - DNA, 25 bp, Mus musculus
aaagtgcaatctaaggagacccaag

SEQ ID NO: 18046 - DNA, 25 bp, Mus musculus
aaagtgcaatcttaggagacccaag

SEQ ID NO: 18047 - DNA, 25 bp, Mus musculus
aaagtgcaattgatcgcgagagtaa

SEQ ID NO: 18048 - DNA, 25 bp, Mus musculus
aaagtgcaattgttcgcgagagtaa

SEQ ID NO: 18049 - DNA, 25 bp, Mus musculus
aaagtgcagagccaggagctagtct

SEQ ID NO: 18050 - DNA, 25 bp, Mus musculus
aaagtgcagagcgaggagctagtct

SEQ ID NO: 18051 - DNA, 25 bp, Mus musculus
aaagtgcagcctaacaagccagcag

SEQ ID NO: 18052 - DNA, 25 bp, Mus musculus
aaagtgcagcctacctgtttgtgag

SEQ ID NO: 18053 - DNA, 25 bp, Mus musculus
aaagtgcagccttacaagccagcag

SEQ ID NO: 18054 - DNA, 25 bp, Mus musculus
aaagtgcagccttcctgtttgtgag

SEQ ID NO: 18055 - DNA, 25 bp, Mus musculus
aaagtgcagctacaagtccccatca

SEQ ID NO: 18056 - DNA, 25 bp, Mus musculus
aaagtgcagctagaagtccccatca

SEQ ID NO: 18057 - DNA, 25 bp, Mus musculus
aaagtgcagctcaaacgttcgaaga

SEQ ID NO: 18058 - DNA, 25 bp, Mus musculus
aaagtgcagctctaacgttcgaaga

SEQ ID NO: 18059 - DNA, 25 bp, Mus musculus
aaagtgcagctgctcagatgccatc

SEQ ID NO: 18060 - DNA, 25 bp, Mus musculus
aaagtgcagctggtcagatgccatc

SEQ ID NO: 18061 - DNA, 25 bp, Mus musculus
aaagtgcaggctctgctaaaaccac

SEQ ID NO: 18062 - DNA, 25 bp, Mus musculus
aaagtgcaggctgtgctaaaaccac

SEQ ID NO: 18063 - DNA, 25 bp, Mus musculus
aaagtgcataacctaccatcagtac

SEQ ID NO: 18064 - DNA, 25 bp, Mus musculus
aaagtgcataacgtaccatcagtac

SEQ ID NO: 18065 - DNA, 25 bp, Mus musculus
aaagtgccaaacatcctcggaactg

SEQ ID NO: 18066 - DNA, 25 bp, Mus musculus
aaagtgccaaacttcctcggaactg

SEQ ID NO: 18067 - DNA, 25 bp, Mus musculus
aaagtgccatctataacctgggcct

SEQ ID NO: 18068 - DNA, 25 bp, Mus musculus
aaagtgccatctttaacctgggcct

SEQ ID NO: 18069 - DNA, 25 bp, Mus musculus
aaagtgcccactcactttggcagat

SEQ ID NO: 18070 - DNA, 25 bp, Mus musculus
aaagtgcccactgactttggcagat

SEQ ID NO: 18071 - DNA, 25 bp, Mus musculus
aaagtgcccagaccttgaaccggat

SEQ ID NO: 18072 - DNA, 25 bp, Mus musculus
aaagtgcccagagcttgaaccggat

SEQ ID NO: 18073 - DNA, 25 bp, Mus musculus
aaagtgcccaggcatgctagcatcc

SEQ ID NO: 18074 - DNA, 25 bp, Mus musculus
aaagtgcccagggatgctagcatcc

SEQ ID NO: 18075 - DNA, 25 bp, Mus musculus
aaagtgcccagtatccaggaatcct

SEQ ID NO: 18076 - DNA, 25 bp, Mus musculus
aaagtgcccagtttccaggaatcct

SEQ ID NO: 18077 - DNA, 25 bp, Mus musculus
aaagtgcccattctcaatcacctgg

SEQ ID NO: 18078 - DNA, 25 bp, Mus musculus
aaagtgcccattgtcaatcacctgg

SEQ ID NO: 18079 - DNA, 25 bp, Mus musculus
aaagtgccctggattcttatgcagt

SEQ ID NO: 18080 - DNA, 25 bp, Mus musculus
aaagtgccctggtttcttatgcagt

SEQ ID NO: 18081 - DNA, 25 bp, Mus musculus
aaagtgccgccgattttatggttga

SEQ ID NO: 18082 - DNA, 25 bp, Mus musculus
aaagtgccgccgtttttatggttga

SEQ ID NO: 18083 - DNA, 25 bp, Mus musculus
aaagtgccgctgcatccacacatag

SEQ ID NO: 18084 - DNA, 25 bp, Mus musculus
aaagtgccgctggatccacacatag

SEQ ID NO: 18085 - DNA, 25 bp, Mus musculus
aaagtgcctctactcttgagaaacc

SEQ ID NO: 18086 - DNA, 25 bp, Mus musculus
aaagtgcctctagtcttgagaaacc

SEQ ID NO: 18087 - DNA, 25 bp, Mus musculus
aaagtgcctgggactgtgctttcca

SEQ ID NO: 18088 - DNA, 25 bp, Mus musculus
aaagtgcctgggtctgtgctttcca

SEQ ID NO: 18089 - DNA, 25 bp, Mus musculus
aaagtgccttagacagagggtcagg

SEQ ID NO: 18090 - DNA, 25 bp, Mus musculus
aaagtgccttagtcagagggtcagg

SEQ ID NO: 18091 - DNA, 25 bp, Mus musculus
aaagtgccttgcaggtcattgttgt

SEQ ID NO: 18092 - DNA, 25 bp, Mus musculus
aaagtgccttgctggtcattgttgt

SEQ ID NO: 18093 - DNA, 25 bp, Mus musculus
aaagtgcgcgaaccgcgccgtttgc

SEQ ID NO: 18094 - DNA, 25 bp, Mus musculus
aaagtgcgcgaagcgcgccgtttgc

SEQ ID NO: 18095 - DNA, 25 bp, Mus musculus
aaagtgcggctcactaacgggtgtg

SEQ ID NO: 18096 - DNA, 25 bp, Mus musculus
aaagtgcggctctctaacgggtgtg

SEQ ID NO: 18097 - DNA, 25 bp, Mus musculus
aaagtgcgggtgcttgttgtaacaa

SEQ ID NO: 18098 - DNA, 25 bp, Mus musculus
aaagtgcgggtggttgttgtaacaa

SEQ ID NO: 18099 - DNA, 25 bp, Mus musculus
aaagtgcggtttccctgtcaattgc

SEQ ID NO: 18100 - DNA, 25 bp, Mus musculus
aaagtgcggtttgcctgtcaattgc

SEQ ID NO: 18101 - DNA, 25 bp, Mus musculus
aaagtgcgtatgctgccactttctc

SEQ ID NO: 18102 - DNA, 25 bp, Mus musculus
aaagtgcgtatggtgccactttctc

SEQ ID NO: 18103 - DNA, 25 bp, Mus musculus
aaagtgctaaggactgtcgcccgaa

SEQ ID NO: 18104 - DNA, 25 bp, Mus musculus
aaagtgctaaggtctgtcgcccgaa

SEQ ID NO: 18105 - DNA, 25 bp, Mus musculus
aaagtgctacttatgcctaccaaaa

SEQ ID NO: 18106 - DNA, 25 bp, Mus musculus
aaagtgctacttttgcctaccaaaa

SEQ ID NO: 18107 - DNA, 25 bp, Mus musculus
aaagtgctagcacggaatgccttcc

SEQ ID NO: 18108 - DNA, 25 bp, Mus musculus
aaagtgctagcagggaatgccttcc

SEQ ID NO: 18109 - DNA, 25 bp, Mus musculus
aaagtgctagctcatgtacgtacga

SEQ ID NO: 18110 - DNA, 25 bp, Mus musculus
aaagtgctagctgatgtacgtacga

SEQ ID NO: 18111 - DNA, 25 bp, Mus musculus
aaagtgctcagcctcagttcagttg

SEQ ID NO: 18112 - DNA, 25 bp, Mus musculus
aaagtgctcagcgtcagttcagttg

SEQ ID NO: 18113 - DNA, 25 bp, Mus musculus
aaagtgctcataacacttccactgg

SEQ ID NO: 18114 - DNA, 25 bp, Mus musculus
aaagtgctcatatcacttccactgg

SEQ ID NO: 18115 - DNA, 25 bp, Mus musculus
aaagtgctccccaaagtgccccagg

SEQ ID NO: 18116 - DNA, 25 bp, Mus musculus
aaagtgctcccctaagtgccccagg

SEQ ID NO: 18117 - DNA, 25 bp, Mus musculus
aaagtgctctccaatactgatgtga

SEQ ID NO: 18118 - DNA, 25 bp, Mus musculus
aaagtgctctcctatactgatgtga

SEQ ID NO: 18119 - DNA, 25 bp, Mus musculus
aaagtgctctggaacttggtatttt

SEQ ID NO: 18120 - DNA, 25 bp, Mus musculus
aaagtgctctggtacttggtatttt

SEQ ID NO: 18121 - DNA, 25 bp, Mus musculus
aaagtgctgaagagggctctggtcc

SEQ ID NO: 18122 - DNA, 25 bp, Mus musculus
aaagtgctgaagtgggctctggtcc

SEQ ID NO: 18123 - DNA, 25 bp, Mus musculus
aaagtgctgagccagcccagtggac

SEQ ID NO: 18124 - DNA, 25 bp, Mus musculus
aaagtgctgagcgagcccagtggac

SEQ ID NO: 18125 - DNA, 25 bp, Mus musculus
aaagtgctggacagccctgtgcctg

SEQ ID NO: 18126 - DNA, 25 bp, Mus musculus
aaagtgctggactgccctgtgcctg

SEQ ID NO: 18127 - DNA, 25 bp, Mus musculus
aaagtgctggagaccatctctggtg

SEQ ID NO: 18128 - DNA, 25 bp, Mus musculus
aaagtgctggagtccatctctggtg

SEQ ID NO: 18129 - DNA, 25 bp, Mus musculus
aaagtgctggtgaaattgggaataa

SEQ ID NO: 18130 - DNA, 25 bp, Mus musculus
aaagtgctggtgtaattgggaataa

SEQ ID NO: 18131 - DNA, 25 bp, Mus musculus
aaagtgctgtgaagtgtctgtatgt

SEQ ID NO: 18132 - DNA, 25 bp, Mus musculus
aaagtgctgtgatgtgtctgtatgt

SEQ ID NO: 18133 - DNA, 25 bp, Mus musculus
aaagtgctgtgtcttctgctcctta

SEQ ID NO: 18134 - DNA, 25 bp, Mus musculus
aaagtgctgtgtgttctgctcctta

SEQ ID NO: 18135 - DNA, 25 bp, Mus musculus
aaagtgctgtttactgtggttttag

SEQ ID NO: 18136 - DNA, 25 bp, Mus musculus
aaagtgctgtttactttgctcctgt

SEQ ID NO: 18137 - DNA, 25 bp, Mus musculus
aaagtgctgtttattccccttctga

SEQ ID NO: 18138 - DNA, 25 bp, Mus musculus
aaagtgctgttttctgtggttttag

SEQ ID NO: 18139 - DNA, 25 bp, Mus musculus
aaagtgctgttttctttgctcctgt

SEQ ID NO: 18140 - DNA, 25 bp, Mus musculus
aaagtgctgttttttccccttctga

SEQ ID NO: 18141 - DNA, 25 bp, Mus musculus
aaagtgcttaccctgccaggaccac

SEQ ID NO: 18142 - DNA, 25 bp, Mus musculus
aaagtgcttaccgtgccaggaccac

SEQ ID NO: 18143 - DNA, 25 bp, Mus musculus
aaagtgcttcttcgagactatcctt

SEQ ID NO: 18144 - DNA, 25 bp, Mus musculus
aaagtgcttcttggagactatcctt

SEQ ID NO: 18145 - DNA, 25 bp, Mus musculus
aaagtgcttgccagacgtgtgagac

SEQ ID NO: 18146 - DNA, 25 bp, Mus musculus
aaagtgcttgcctgacgtgtgagac

SEQ ID NO: 18147 - DNA, 25 bp, Mus musculus
aaagtgcttgtaattgtattctcca

SEQ ID NO: 18148 - DNA, 25 bp, Mus musculus
aaagtgcttgtacatcaggtgacct

SEQ ID NO: 18149 - DNA, 25 bp, Mus musculus
aaagtgcttgtacccatttccatgc

SEQ ID NO: 18150 - DNA, 25 bp, Mus musculus
aaagtgcttgtagatcaggtgacct

SEQ ID NO: 18151 - DNA, 25 bp, Mus musculus
aaagtgcttgtagccatttccatgc

SEQ ID NO: 18152 - DNA, 25 bp, Mus musculus
aaagtgcttgtatttgtattctcca

SEQ ID NO: 18153 - DNA, 25 bp, Mus musculus
aaagtgcttgtcacacagaggagcc

SEQ ID NO: 18154 - DNA, 25 bp, Mus musculus
aaagtgcttgtcactgccaaatggc

SEQ ID NO: 18155 - DNA, 25 bp, Mus musculus
aaagtgcttgtctcacagaggagcc

SEQ ID NO: 18156 - DNA, 25 bp, Mus musculus
aaagtgcttgtctctgccaaatggc

SEQ ID NO: 18157 - DNA, 25 bp, Mus musculus
aaagtgctttaaacctctcagcggt

SEQ ID NO: 18158 - DNA, 25 bp, Mus musculus
aaagtgctttaatcctctcagcggt

SEQ ID NO: 18159 - DNA, 25 bp, Mus musculus
aaagtgctttatccttcccaatggg

SEQ ID NO: 18160 - DNA, 25 bp, Mus musculus
aaagtgctttatgcttcccaatggg

SEQ ID NO: 18161 - DNA, 25 bp, Mus musculus
aaagtgctttgaagatgtaatacct

SEQ ID NO: 18162 - DNA, 25 bp, Mus musculus
aaagtgctttgaccttgtttaactc

SEQ ID NO: 18163 - DNA, 25 bp, Mus musculus
aaagtgctttgagcttgtttaactc

SEQ ID NO: 18164 - DNA, 25 bp, Mus musculus
aaagtgctttgatgatgtaatacct

SEQ ID NO: 18165 - DNA, 25 bp, Mus musculus
aaagtgctttgtctttgtacgccca

SEQ ID NO: 18166 - DNA, 25 bp, Mus musculus
aaagtgctttgtgtttgtacgccca

SEQ ID NO: 18167 - DNA, 25 bp, Mus musculus
aaagtgcttttcatactgtaatctt

SEQ ID NO: 18168 - DNA, 25 bp, Mus musculus
aaagtgcttttcttactgtaatctt

SEQ ID NO: 18169 - DNA, 25 bp, Mus musculus
aaagtggaacccatgctcactcaaa

SEQ ID NO: 18170 - DNA, 25 bp, Mus musculus
aaagtggaacccttgctcactcaaa

SEQ ID NO: 18171 - DNA, 25 bp, Mus musculus
aaagtggaaggtcgagtctcatcag

SEQ ID NO: 18172 - DNA, 25 bp, Mus musculus
aaagtggaaggtggagtctcatcag

SEQ ID NO: 18173 - DNA, 25 bp, Mus musculus
aaagtggaagtcacttaacctcaga

SEQ ID NO: 18174 - DNA, 25 bp, Mus musculus
aaagtggaagtctcttaacctcaga

SEQ ID NO: 18175 - DNA, 25 bp, Mus musculus
aaagtggaatgactgccccttccag

SEQ ID NO: 18176 - DNA, 25 bp, Mus musculus
aaagtggaatgagtgccccttccag

SEQ ID NO: 18177 - DNA, 25 bp, Mus musculus
aaagtggaatgcagtggccctctgg

SEQ ID NO: 18178 - DNA, 25 bp, Mus musculus
aaagtggaatgccacttcctcggtc

SEQ ID NO: 18179 - DNA, 25 bp, Mus musculus
aaagtggaatgcgacttcctcggtc

SEQ ID NO: 18180 - DNA, 25 bp, Mus musculus
aaagtggaatgctgtggccctctgg

SEQ ID NO: 18181 - DNA, 25 bp, Mus musculus
aaagtggaatgtccccacacagagt

SEQ ID NO: 18182 - DNA, 25 bp, Mus musculus
aaagtggaatgtgcccacacagagt

SEQ ID NO: 18183 - DNA, 25 bp, Mus musculus
aaagtggacataatccataccctgg

SEQ ID NO: 18184 - DNA, 25 bp, Mus musculus
aaagtggacatattccataccctgg

SEQ ID NO: 18185 - DNA, 25 bp, Mus musculus
aaagtggacgatcttgttggtagac

SEQ ID NO: 18186 - DNA, 25 bp, Mus musculus
aaagtggacgatgttgttggtagac

SEQ ID NO: 18187 - DNA, 25 bp, Mus musculus
aaagtggacgctcctatggccggcc

SEQ ID NO: 18188 - DNA, 25 bp, Mus musculus
aaagtggacgctgctatggccggcc

SEQ ID NO: 18189 - DNA, 25 bp, Mus musculus
aaagtggactgcatggtcacctgct

SEQ ID NO: 18190 - DNA, 25 bp, Mus musculus
aaagtggactgcttggtcacctgct

SEQ ID NO: 18191 - DNA, 25 bp, Mus musculus
aaagtggacttcagatgctagaaag

SEQ ID NO: 18192 - DNA, 25 bp, Mus musculus
aaagtggacttctgatgctagaaag

SEQ ID NO: 18193 - DNA, 25 bp, Mus musculus
aaagtggagaccctcagagctgcca

SEQ ID NO: 18194 - DNA, 25 bp, Mus musculus
aaagtggagaccgtcagagctgcca

SEQ ID NO: 18195 - DNA, 25 bp, Mus musculus
aaagtggagatcatcgttcacatat

SEQ ID NO: 18196 - DNA, 25 bp, Mus musculus
aaagtggagatcttcgttcacatat

SEQ ID NO: 18197 - DNA, 25 bp, Mus musculus
aaagtggagattcttgccatcaacg

SEQ ID NO: 18198 - DNA, 25 bp, Mus musculus
aaagtggagattgttgccatcaacg

SEQ ID NO: 18199 - DNA, 25 bp, Mus musculus
aaagtggaggccatcgtgatgtatt

SEQ ID NO: 18200 - DNA, 25 bp, Mus musculus
aaagtggaggccttcgtgatgtatt

SEQ ID NO: 18201 - DNA, 25 bp, Mus musculus
aaagtggatcttcctcctcagctaa

SEQ ID NO: 18202 - DNA, 25 bp, Mus musculus
aaagtggatcttgctcctcagctaa

SEQ ID NO: 18203 - DNA, 25 bp, Mus musculus
aaagtggatgtgatatcccaacaaa

SEQ ID NO: 18204 - DNA, 25 bp, Mus musculus
aaagtggatgtgttatcccaacaaa

SEQ ID NO: 18205 - DNA, 25 bp, Mus musculus
aaagtggattgtattccttcaacat

SEQ ID NO: 18206 - DNA, 25 bp, Mus musculus
aaagtggattgttttccttcaacat

SEQ ID NO: 18207 - DNA, 25 bp, Mus musculus
aaagtggcatgacagttttccggct

SEQ ID NO: 18208 - DNA, 25 bp, Mus musculus
aaagtggcatgagagttttccggct

SEQ ID NO: 18209 - DNA, 25 bp, Mus musculus
aaagtggccaagaaagtgccctaca

SEQ ID NO: 18210 - DNA, 25 bp, Mus musculus
aaagtggccaagtaagtgccctaca

SEQ ID NO: 18211 - DNA, 25 bp, Mus musculus
aaagtggccaccacaaaaacacagc

SEQ ID NO: 18212 - DNA, 25 bp, Mus musculus
aaagtggccacctcaaaaacacagc

SEQ ID NO: 18213 - DNA, 25 bp, Mus musculus
aaagtggccatcactacatcggtcc

SEQ ID NO: 18214 - DNA, 25 bp, Mus musculus
aaagtggccatctctacatcggtcc

SEQ ID NO: 18215 - DNA, 25 bp, Mus musculus
aaagtggccctgaggcaacagacca

SEQ ID NO: 18216 - DNA, 25 bp, Mus musculus
aaagtggccctgtggcaacagacca

SEQ ID NO: 18217 - DNA, 25 bp, Mus musculus
aaagtggcctgtagcctagtcctgc

SEQ ID NO: 18218 - DNA, 25 bp, Mus musculus
aaagtggcctgttgcctagtcctgc

SEQ ID NO: 18219 - DNA, 25 bp, Mus musculus
aaagtggcctttctgttacatgtgt

SEQ ID NO: 18220 - DNA, 25 bp, Mus musculus
aaagtggcctttctttctgatggaa

SEQ ID NO: 18221 - DNA, 25 bp, Mus musculus
aaagtggcctttgtgttacatgtgt

SEQ ID NO: 18222 - DNA, 25 bp, Mus musculus
aaagtggcctttgtttctgatggaa

SEQ ID NO: 18223 - DNA, 25 bp, Mus musculus
aaagtggcgccaccatcggagccag

SEQ ID NO: 18224 - DNA, 25 bp, Mus musculus
aaagtggcgccagcatcggagccag

SEQ ID NO: 18225 - DNA, 25 bp, Mus musculus
aaagtggcggctaaacgtgctgcgt

SEQ ID NO: 18226 - DNA, 25 bp, Mus musculus
aaagtggcggcttaacgtgctgcgt

SEQ ID NO: 18227 - DNA, 25 bp, Mus musculus
aaagtggctagcactggccctactt

SEQ ID NO: 18228 - DNA, 25 bp, Mus musculus
aaagtggctagctctggccctactt

SEQ ID NO: 18229 - DNA, 25 bp, Mus musculus
aaagtggctgacaccaagaagctgg

SEQ ID NO: 18230 - DNA, 25 bp, Mus musculus
aaagtggctgactccaagaagctgg

SEQ ID NO: 18231 - DNA, 25 bp, Mus musculus
aaagtggctgcgactgactggacat

SEQ ID NO: 18232 - DNA, 25 bp, Mus musculus
aaagtggctgcgtctgactggacat

SEQ ID NO: 18233 - DNA, 25 bp, Mus musculus
aaagtggctggcatccaagactagc

SEQ ID NO: 18234 - DNA, 25 bp, Mus musculus
aaagtggctggcttccaagactagc

SEQ ID NO: 18235 - DNA, 25 bp, Mus musculus
aaagtggctgttaacctgcaagaag

SEQ ID NO: 18236 - DNA, 25 bp, Mus musculus
aaagtggctgtttacctgcaagaag

SEQ ID NO: 18237 - DNA, 25 bp, Mus musculus
aaagtgggaagcctcagccagttcc

SEQ ID NO: 18238 - DNA, 25 bp, Mus musculus
aaagtgggaagcgtcagccagttcc

SEQ ID NO: 18239 - DNA, 25 bp, Mus musculus
aaagtgggagtaaccgtggcaatgt

SEQ ID NO: 18240 - DNA, 25 bp, Mus musculus
aaagtgggagtatccgtggcaatgt

SEQ ID NO: 18241 - DNA, 25 bp, Mus musculus
aaagtgggcacccacttgctcgagg

SEQ ID NO: 18242 - DNA, 25 bp, Mus musculus
aaagtgggcaccgacttgctcgagg

SEQ ID NO: 18243 - DNA, 25 bp, Mus musculus
aaagtgggcagacctgaccctgtga

SEQ ID NO: 18244 - DNA, 25 bp, Mus musculus
aaagtgggcagagctgaccctgtga

SEQ ID NO: 18245 - DNA, 25 bp, Mus musculus
aaagtgggcatcatcatcaaagtca

SEQ ID NO: 18246 - DNA, 25 bp, Mus musculus
aaagtgggcatcttcatcaaagtca

SEQ ID NO: 18247 - DNA, 25 bp, Mus musculus
aaagtgggccacacttcaacttcga

SEQ ID NO: 18248 - DNA, 25 bp, Mus musculus
aaagtgggccactcttcaacttcga

SEQ ID NO: 18249 - DNA, 25 bp, Mus musculus
aaagtgggccagatatttgctgcct

SEQ ID NO: 18250 - DNA, 25 bp, Mus musculus
aaagtgggccagttatttgctgcct

SEQ ID NO: 18251 - DNA, 25 bp, Mus musculus
aaagtgggcccaagagaaactcgat

SEQ ID NO: 18252 - DNA, 25 bp, Mus musculus
aaagtgggcccatgagaaactcgat

SEQ ID NO: 18253 - DNA, 25 bp, Mus musculus
aaagtgggcgccattctcgtccaca

SEQ ID NO: 18254 - DNA, 25 bp, Mus musculus
aaagtgggcgcctttctcgtccaca

SEQ ID NO: 18255 - DNA, 25 bp, Mus musculus
aaagtgggcgctccagagctcaccg

SEQ ID NO: 18256 - DNA, 25 bp, Mus musculus
aaagtgggcgctgcagagctcaccg

SEQ ID NO: 18257 - DNA, 25 bp, Mus musculus
aaagtgggcgtgaccagtctcatcc

SEQ ID NO: 18258 - DNA, 25 bp, Mus musculus
aaagtgggcgtgtccagtctcatcc

SEQ ID NO: 18259 - DNA, 25 bp, Mus musculus
aaagtgggctatcgtcctcctttag

SEQ ID NO: 18260 - DNA, 25 bp, Mus musculus
aaagtgggctatggtcctcctttag

SEQ ID NO: 18261 - DNA, 25 bp, Mus musculus
aaagtgggttgcaaagtctctgaaa

SEQ ID NO: 18262 - DNA, 25 bp, Mus musculus
aaagtgggttgctaagtctctgaaa

SEQ ID NO: 18263 - DNA, 25 bp, Mus musculus
aaagtgggtttccatctcacatgat

SEQ ID NO: 18264 - DNA, 25 bp, Mus musculus
aaagtgggtttcgatctcacatgat

SEQ ID NO: 18265 - DNA, 25 bp, Mus musculus
aaagtggtagctctgccagtggcca

SEQ ID NO: 18266 - DNA, 25 bp, Mus musculus
aaagtggtagctgtgccagtggcca

SEQ ID NO: 18267 - DNA, 25 bp, Mus musculus
aaagtggtagtgaagaccttctctg

SEQ ID NO: 18268 - DNA, 25 bp, Mus musculus
aaagtggtagtgtagaccttctctg

SEQ ID NO: 18269 - DNA, 25 bp, Mus musculus
aaagtggtatccactgatgtcagcg

SEQ ID NO: 18270 - DNA, 25 bp, Mus musculus
aaagtggtatcctctgatgtcagcg

SEQ ID NO: 18271 - DNA, 25 bp, Mus musculus
aaagtggtcagcctattcaccatga

SEQ ID NO: 18272 - DNA, 25 bp, Mus musculus
aaagtggtcagcgtattcaccatga

SEQ ID NO: 18273 - DNA, 25 bp, Mus musculus
aaagtggtcctaatcagcagcagag

SEQ ID NO: 18274 - DNA, 25 bp, Mus musculus
aaagtggtcctattcagcagcagag

SEQ ID NO: 18275 - DNA, 25 bp, Mus musculus
aaagtggtcctcagcattctccatt

SEQ ID NO: 18276 - DNA, 25 bp, Mus musculus
aaagtggtcctctgcattctccatt

SEQ ID NO: 18277 - DNA, 25 bp, Mus musculus
aaagtggtcgtgcatcaactggaaa

SEQ ID NO: 18278 - DNA, 25 bp, Mus musculus
aaagtggtcgtggatcaactggaaa

SEQ ID NO: 18279 - DNA, 25 bp, Mus musculus
aaagtggtgacaccgctggaccgca

SEQ ID NO: 18280 - DNA, 25 bp, Mus musculus
aaagtggtgacagcgctggaccgca

SEQ ID NO: 18281 - DNA, 25 bp, Mus musculus
aaagtggtgattatcctgtgtcagg

SEQ ID NO: 18282 - DNA, 25 bp, Mus musculus
aaagtggtgattttcctgtgtcagg

SEQ ID NO: 18283 - DNA, 25 bp, Mus musculus
aaagtggtgtttctggcattcgtcc

SEQ ID NO: 18284 - DNA, 25 bp, Mus musculus
aaagtggtgtttgtggcattcgtcc

SEQ ID NO: 18285 - DNA, 25 bp, Mus musculus
aaagtggttatgacttgacgcccct

SEQ ID NO: 18286 - DNA, 25 bp, Mus musculus
aaagtggttatgtcttgacgcccct

SEQ ID NO: 18287 - DNA, 25 bp, Mus musculus
aaagtggttgttacatgagtattga

SEQ ID NO: 18288 - DNA, 25 bp, Mus musculus
aaagtggttgtttcatgagtattga

SEQ ID NO: 18289 - DNA, 25 bp, Mus musculus
aaagtgtactacacatccagtccag

SEQ ID NO: 18290 - DNA, 25 bp, Mus musculus
aaagtgtactactcatccagtccag

SEQ ID NO: 18291 - DNA, 25 bp, Mus musculus
aaagtgtactatcgccattctctac

SEQ ID NO: 18292 - DNA, 25 bp, Mus musculus
aaagtgtactatggccattctctac

SEQ ID NO: 18293 - DNA, 25 bp, Mus musculus
aaagtgtagccgaagagggacctct

SEQ ID NO: 18294 - DNA, 25 bp, Mus musculus
aaagtgtagccgtagagggacctct

SEQ ID NO: 18295 - DNA, 25 bp, Mus musculus
aaagtgtatcaaaggcaggtcctgc

SEQ ID NO: 18296 - DNA, 25 bp, Mus musculus
aaagtgtatcaatggcaggtcctgc

SEQ ID NO: 18297 - DNA, 25 bp, Mus musculus
aaagtgtatgaacactccggcatcc

SEQ ID NO: 18298 - DNA, 25 bp, Mus musculus
aaagtgtatgaagactccggcatcc

SEQ ID NO: 18299 - DNA, 25 bp, Mus musculus
aaagtgtcacaaatccctaggctca

SEQ ID NO: 18300 - DNA, 25 bp, Mus musculus
aaagtgtcacaattccctaggctca

SEQ ID NO: 18301 - DNA, 25 bp, Mus musculus
aaagtgtcacggctatcctgaggtg

SEQ ID NO: 18302 - DNA, 25 bp, Mus musculus
aaagtgtcacgggtatcctgaggtg

SEQ ID NO: 18303 - DNA, 25 bp, Mus musculus
aaagtgtcactaatgcatgcatgct

SEQ ID NO: 18304 - DNA, 25 bp, Mus musculus
aaagtgtcactattgcatgcatgct

SEQ ID NO: 18305 - DNA, 25 bp, Mus musculus
aaagtgtcagacaacgagtattaaa

SEQ ID NO: 18306 - DNA, 25 bp, Mus musculus
aaagtgtcagactacgagtattaaa

SEQ ID NO: 18307 - DNA, 25 bp, Mus musculus
aaagtgtcccgaagatgtcgaagct

SEQ ID NO: 18308 - DNA, 25 bp, Mus musculus
aaagtgtcccgatgatgtcgaagct

SEQ ID NO: 18309 - DNA, 25 bp, Mus musculus
aaagtgtccctacgagccacagttg

SEQ ID NO: 18310 - DNA, 25 bp, Mus musculus
aaagtgtccctaggagccacagttg

SEQ ID NO: 18311 - DNA, 25 bp, Mus musculus
aaagtgtccctgctgtttgaccatc

SEQ ID NO: 18312 - DNA, 25 bp, Mus musculus
aaagtgtccctggtgtttgaccatc

SEQ ID NO: 18313 - DNA, 25 bp, Mus musculus
aaagtgtcctgcaagtcctggcagt

SEQ ID NO: 18314 - DNA, 25 bp, Mus musculus
aaagtgtcctgctagtcctggcagt

SEQ ID NO: 18315 - DNA, 25 bp, Mus musculus
aaagtgtccttgaatatatcctaac

SEQ ID NO: 18316 - DNA, 25 bp, Mus musculus
aaagtgtccttgtatatatcctaac

SEQ ID NO: 18317 - DNA, 25 bp, Mus musculus
aaagtgtctgctctatcctagttct

SEQ ID NO: 18318 - DNA, 25 bp, Mus musculus
aaagtgtctgctgtatcctagttct

SEQ ID NO: 18319 - DNA, 25 bp, Mus musculus
aaagtgtctggaacctcagcatctg

SEQ ID NO: 18320 - DNA, 25 bp, Mus musculus
aaagtgtctggatcctcagcatctg

SEQ ID NO: 18321 - DNA, 25 bp, Mus musculus
aaagtgtctgtccatgttcttgcca

SEQ ID NO: 18322 - DNA, 25 bp, Mus musculus
aaagtgtctgtcgatgttcttgcca

SEQ ID NO: 18323 - DNA, 25 bp, Mus musculus
aaagtgtcttgtctccacggcctcc

SEQ ID NO: 18324 - DNA, 25 bp, Mus musculus
aaagtgtcttgtgtccacggcctcc

SEQ ID NO: 18325 - DNA, 25 bp, Mus musculus
aaagtgtgacaaccaagccttctct

SEQ ID NO: 18326 - DNA, 25 bp, Mus musculus
aaagtgtgacaagcaagccttctct

SEQ ID NO: 18327 - DNA, 25 bp, Mus musculus
aaagtgtgaccaagcactgctttta

SEQ ID NO: 18328 - DNA, 25 bp, Mus musculus
aaagtgtgaccatgcactgctttta

SEQ ID NO: 18329 - DNA, 25 bp, Mus musculus
aaagtgtgacccataatctctcact

SEQ ID NO: 18330 - DNA, 25 bp, Mus musculus
aaagtgtgacccttaatctctcact

SEQ ID NO: 18331 - DNA, 25 bp, Mus musculus
aaagtgtgagccctcactgcctggg

SEQ ID NO: 18332 - DNA, 25 bp, Mus musculus
aaagtgtgagccgtcactgcctggg

SEQ ID NO: 18333 - DNA, 25 bp, Mus musculus
aaagtgtgatttcctcaccggtctc

SEQ ID NO: 18334 - DNA, 25 bp, Mus musculus
aaagtgtgatttgctcaccggtctc

SEQ ID NO: 18335 - DNA, 25 bp, Mus musculus
aaagtgtgcgatctgcccttggatc

SEQ ID NO: 18336 - DNA, 25 bp, Mus musculus
aaagtgtgcgatgtgcccttggatc

SEQ ID NO: 18337 - DNA, 25 bp, Mus musculus
aaagtgtggaccagtgcacaggccc

SEQ ID NO: 18338 - DNA, 25 bp, Mus musculus
aaagtgtggacctgtgcacaggccc

SEQ ID NO: 18339 - DNA, 25 bp, Mus musculus
aaagtgtggctgcttcgaacgtcaa

SEQ ID NO: 18340 - DNA, 25 bp, Mus musculus
aaagtgtggctggttcgaacgtcaa

SEQ ID NO: 18341 - DNA, 25 bp, Mus musculus
aaagtgtgggttctgagcacccctc

SEQ ID NO: 18342 - DNA, 25 bp, Mus musculus
aaagtgtgggttgtgagcacccctc

SEQ ID NO: 18343 - DNA, 25 bp, Mus musculus
aaagtgtgtcccctatctgcatgct

SEQ ID NO: 18344 - DNA, 25 bp, Mus musculus
aaagtgtgtcccgtatctgcatgct

SEQ ID NO: 18345 - DNA, 25 bp, Mus musculus
aaagtgtgtcttagtcactactgaa

SEQ ID NO: 18346 - DNA, 25 bp, Mus musculus
aaagtgtgtctttgtcactactgaa

SEQ ID NO: 18347 - DNA, 25 bp, Mus musculus
aaagtgtgtggaatactggagcccc

SEQ ID NO: 18348 - DNA, 25 bp, Mus musculus
aaagtgtgtggattactggagcccc

SEQ ID NO: 18349 - DNA, 25 bp, Mus musculus
aaagtgtgttctaccaagattcaga

SEQ ID NO: 18350 - DNA, 25 bp, Mus musculus
aaagtgtgttcttccaagattcaga

SEQ ID NO: 18351 - DNA, 25 bp, Mus musculus
aaagtgtgttggaacctcagatttg

SEQ ID NO: 18352 - DNA, 25 bp, Mus musculus
aaagtgtgttggtacctcagatttg

SEQ ID NO: 18353 - DNA, 25 bp, Mus musculus
aaagtgttatacagatccctcccct

SEQ ID NO: 18354 - DNA, 25 bp, Mus musculus
aaagtgttatactgatccctcccct

SEQ ID NO: 18355 - DNA, 25 bp, Mus musculus
aaagtgttatgccacaacttcaggc

SEQ ID NO: 18356 - DNA, 25 bp, Mus musculus
aaagtgttatgcgacaacttcaggc

SEQ ID NO: 18357 - DNA, 25 bp, Mus musculus
aaagtgttcatgacgcttctcagca

SEQ ID NO: 18358 - DNA, 25 bp, Mus musculus
aaagtgttcatgtcgcttctcagca

SEQ ID NO: 18359 - DNA, 25 bp, Mus musculus
aaagtgttccgtaccatctgcaaag

SEQ ID NO: 18360 - DNA, 25 bp, Mus musculus
aaagtgttccgttccatctgcaaag

SEQ ID NO: 18361 - DNA, 25 bp, Mus musculus
aaagtgttcgaccttgtagcttgaa

SEQ ID NO: 18362 - DNA, 25 bp, Mus musculus
aaagtgttcgacgttgtagcttgaa

SEQ ID NO: 18363 - DNA, 25 bp, Mus musculus
aaagtgttctatatcccagttcata

SEQ ID NO: 18364 - DNA, 25 bp, Mus musculus
aaagtgttctatttcccagttcata

SEQ ID NO: 18365 - DNA, 25 bp, Mus musculus
aaagtgttctcgctgctagtcattg

SEQ ID NO: 18366 - DNA, 25 bp, Mus musculus
aaagtgttctcggtgctagtcattg

SEQ ID NO: 18367 - DNA, 25 bp, Mus musculus
aaagtgttgactcttgttcactact

SEQ ID NO: 18368 - DNA, 25 bp, Mus musculus
aaagtgttgactgttgttcactact

SEQ ID NO: 18369 - DNA, 25 bp, Mus musculus
aaagtgttgcctatggccaagtata

SEQ ID NO: 18370 - DNA, 25 bp, Mus musculus
aaagtgttgcctttggccaagtata

SEQ ID NO: 18371 - DNA, 25 bp, Mus musculus
aaagtgttgtgaccatgcttcggaa

SEQ ID NO: 18372 - DNA, 25 bp, Mus musculus
aaagtgttgtgagcatgcttcggaa

SEQ ID NO: 18373 - DNA, 25 bp, Mus musculus
aaagtgtttgctatgctgccatttc

SEQ ID NO: 18374 - DNA, 25 bp, Mus musculus
aaagtgtttgctttgctgccatttc

SEQ ID NO: 18375 - DNA, 25 bp, Mus musculus
aaagtgtttgtcactccgatttgaa

SEQ ID NO: 18376 - DNA, 25 bp, Mus musculus
aaagtgtttgtccttctgtccattc

SEQ ID NO: 18377 - DNA, 25 bp, Mus musculus
aaagtgtttgtcgttctgtccattc

SEQ ID NO: 18378 - DNA, 25 bp, Mus musculus
aaagtgtttgtctctccgatttgaa

SEQ ID NO: 18379 - DNA, 25 bp, Mus musculus
aaagtgttttctatattaggcgtga

SEQ ID NO: 18380 - DNA, 25 bp, Mus musculus
aaagtgttttctttattaggcgtga

SEQ ID NO: 18381 - DNA, 25 bp, Mus musculus
aaagttaactctctgtattcttaca

SEQ ID NO: 18382 - DNA, 25 bp, Mus musculus
aaagttaactctgtgtattcttaca

SEQ ID NO: 18383 - DNA, 25 bp, Mus musculus
aaagttaactgcctatatctggcaa

SEQ ID NO: 18384 - DNA, 25 bp, Mus musculus
aaagttaactgcgtatatctggcaa

SEQ ID NO: 18385 - DNA, 25 bp, Mus musculus
aaagttaacttcacatagcagccat

SEQ ID NO: 18386 - DNA, 25 bp, Mus musculus
aaagttaacttctcatagcagccat

SEQ ID NO: 18387 - DNA, 25 bp, Mus musculus
aaagttaagagccagccccaggcgg

SEQ ID NO: 18388 - DNA, 25 bp, Mus musculus
aaagttaagagcgagccccaggcgg

SEQ ID NO: 18389 - DNA, 25 bp, Mus musculus
aaagttaagcatattgacccaagtg

SEQ ID NO: 18390 - DNA, 25 bp, Mus musculus
aaagttaagcattttgacccaagtg

SEQ ID NO: 18391 - DNA, 25 bp, Mus musculus
aaagttaagcccatgtatgtgcact

SEQ ID NO: 18392 - DNA, 25 bp, Mus musculus
aaagttaagcccttgtatgtgcact

SEQ ID NO: 18393 - DNA, 25 bp, Mus musculus
aaagttaataatcaagtcccaggag

SEQ ID NO: 18394 - DNA, 25 bp, Mus musculus
aaagttaataatgaagtcccaggag

SEQ ID NO: 18395 - DNA, 25 bp, Mus musculus
aaagttacactcatgccaacctaat

SEQ ID NO: 18396 - DNA, 25 bp, Mus musculus
aaagttacactcttgccaacctaat

SEQ ID NO: 18397 - DNA, 25 bp, Mus musculus
aaagttacactgaatcctgccacct

SEQ ID NO: 18398 - DNA, 25 bp, Mus musculus
aaagttacactgtatcctgccacct

SEQ ID NO: 18399 - DNA, 25 bp, Mus musculus
aaagttacagaacaggtgagcctaa

SEQ ID NO: 18400 - DNA, 25 bp, Mus musculus
aaagttacagaagaggtgagcctaa

SEQ ID NO: 18401 - DNA, 25 bp, Mus musculus
aaagttacattcctctgcctcagct

SEQ ID NO: 18402 - DNA, 25 bp, Mus musculus
aaagttacattcgtctgcctcagct

SEQ ID NO: 18403 - DNA, 25 bp, Mus musculus
aaagttacatttctgctgtcataca

SEQ ID NO: 18404 - DNA, 25 bp, Mus musculus
aaagttacatttgtgctgtcataca

SEQ ID NO: 18405 - DNA, 25 bp, Mus musculus
aaagttaccctcactgacctcagtg

SEQ ID NO: 18406 - DNA, 25 bp, Mus musculus
aaagttaccctctctgacctcagtg

SEQ ID NO: 18407 - DNA, 25 bp, Mus musculus
aaagttactatgattacctacatga

SEQ ID NO: 18408 - DNA, 25 bp, Mus musculus
aaagttactatgtttacctacatga

SEQ ID NO: 18409 - DNA, 25 bp, Mus musculus
aaagttactctaaggcctgcagtgt

SEQ ID NO: 18410 - DNA, 25 bp, Mus musculus
aaagttactctaccagtccaggcca

SEQ ID NO: 18411 - DNA, 25 bp, Mus musculus
aaagttactctagcagtccaggcca

SEQ ID NO: 18412 - DNA, 25 bp, Mus musculus
aaagttactctatggcctgcagtgt

SEQ ID NO: 18413 - DNA, 25 bp, Mus musculus
aaagttacttatagtcaatggataa

SEQ ID NO: 18414 - DNA, 25 bp, Mus musculus
aaagttacttattgtcaatggataa

SEQ ID NO: 18415 - DNA, 25 bp, Mus musculus
aaagttagagtcaacttggtggtgt

SEQ ID NO: 18416 - DNA, 25 bp, Mus musculus
aaagttagagtctacttggtggtgt

SEQ ID NO: 18417 - DNA, 25 bp, Mus musculus
aaagttagcataagacattttgttc

SEQ ID NO: 18418 - DNA, 25 bp, Mus musculus
aaagttagcatatgacattttgttc

SEQ ID NO: 18419 - DNA, 25 bp, Mus musculus
aaagttagcccaccttgtggttgct

SEQ ID NO: 18420 - DNA, 25 bp, Mus musculus
aaagttagcccagcttgtggttgct

SEQ ID NO: 18421 - DNA, 25 bp, Mus musculus
aaagttagccttactagattcatat

SEQ ID NO: 18422 - DNA, 25 bp, Mus musculus
aaagttagcctttctagattcatat

SEQ ID NO: 18423 - DNA, 25 bp, Mus musculus
aaagttagctgcactattcctcggg

SEQ ID NO: 18424 - DNA, 25 bp, Mus musculus
aaagttagctgctctattcctcggg

SEQ ID NO: 18425 - DNA, 25 bp, Mus musculus
aaagttaggagcaccacacagcatc

SEQ ID NO: 18426 - DNA, 25 bp, Mus musculus
aaagttaggagctccacacagcatc

SEQ ID NO: 18427 - DNA, 25 bp, Mus musculus
aaagttagtctgaacaaggtggagc

SEQ ID NO: 18428 - DNA, 25 bp, Mus musculus
aaagttagtctgtacaaggtggagc

SEQ ID NO: 18429 - DNA, 25 bp, Mus musculus
aaagttagtgtgctagtctacatcc

SEQ ID NO: 18430 - DNA, 25 bp, Mus musculus
aaagttagtgtggtagtctacatcc

SEQ ID NO: 18431 - DNA, 25 bp, Mus musculus
aaagttatcaatctgcatgtctgta

SEQ ID NO: 18432 - DNA, 25 bp, Mus musculus
aaagttatcaatgtgcatgtctgta

SEQ ID NO: 18433 - DNA, 25 bp, Mus musculus
aaagttatcttgatgttttcagtct

SEQ ID NO: 18434 - DNA, 25 bp, Mus musculus
aaagttatcttgttgttttcagtct

SEQ ID NO: 18435 - DNA, 25 bp, Mus musculus
aaagttatgcccagtatgtccaccg

SEQ ID NO: 18436 - DNA, 25 bp, Mus musculus
aaagttatgccctgtatgtccaccg

SEQ ID NO: 18437 - DNA, 25 bp, Mus musculus
aaagttatgtatctcccattcccag

SEQ ID NO: 18438 - DNA, 25 bp, Mus musculus
aaagttatgtatgtcccattcccag

SEQ ID NO: 18439 - DNA, 25 bp, Mus musculus
aaagttattcttacacggagctgga

SEQ ID NO: 18440 - DNA, 25 bp, Mus musculus
aaagttattctttcacggagctgga

SEQ ID NO: 18441 - DNA, 25 bp, Mus musculus
aaagttattgagatcctgtggcaga

SEQ ID NO: 18442 - DNA, 25 bp, Mus musculus
aaagttattgagttcctgtggcaga

SEQ ID NO: 18443 - DNA, 25 bp, Mus musculus
aaagttatttctatatgccttgtat

SEQ ID NO: 18444 - DNA, 25 bp, Mus musculus
aaagttatttctttatgccttgtat

SEQ ID NO: 18445 - DNA, 25 bp, Mus musculus
aaagttattttaccttcctcaatag

SEQ ID NO: 18446 - DNA, 25 bp, Mus musculus
aaagttattttagcttcctcaatag

SEQ ID NO: 18447 - DNA, 25 bp, Mus musculus
aaagttattttgagcgatccaggtc

SEQ ID NO: 18448 - DNA, 25 bp, Mus musculus
aaagttattttgtgcgatccaggtc

SEQ ID NO: 18449 - DNA, 25 bp, Mus musculus
aaagttcaactgactaaagcctcga

SEQ ID NO: 18450 - DNA, 25 bp, Mus musculus
aaagttcaactgtctaaagcctcga

SEQ ID NO: 18451 - DNA, 25 bp, Mus musculus
aaagttcaagataatcctgtctaaa

SEQ ID NO: 18452 - DNA, 25 bp, Mus musculus
aaagttcaagattatcctgtctaaa

SEQ ID NO: 18453 - DNA, 25 bp, Mus musculus
aaagttcaagcaccagaaatacgaa

SEQ ID NO: 18454 - DNA, 25 bp, Mus musculus
aaagttcaagcaccccagcaggaag

SEQ ID NO: 18455 - DNA, 25 bp, Mus musculus
aaagttcaagcagcagaaatacgaa

SEQ ID NO: 18456 - DNA, 25 bp, Mus musculus
aaagttcaagcagcccagcaggaag

SEQ ID NO: 18457 - DNA, 25 bp, Mus musculus
aaagttcaatgcaagtctctggagg

SEQ ID NO: 18458 - DNA, 25 bp, Mus musculus
aaagttcaatgctagtctctggagg

SEQ ID NO: 18459 - DNA, 25 bp, Mus musculus
aaagttcaccaaatcggcaactcca

SEQ ID NO: 18460 - DNA, 25 bp, Mus musculus
aaagttcaccaattcggcaactcca

SEQ ID NO: 18461 - DNA, 25 bp, Mus musculus
aaagttcaccacagttagttcggca

SEQ ID NO: 18462 - DNA, 25 bp, Mus musculus
aaagttcaccactgttagttcggca

SEQ ID NO: 18463 - DNA, 25 bp, Mus musculus
aaagttcagaagacttgctctcact

SEQ ID NO: 18464 - DNA, 25 bp, Mus musculus
aaagttcagaagtcttgctctcact

SEQ ID NO: 18465 - DNA, 25 bp, Mus musculus
aaagttcagactcctgcactgcgag

SEQ ID NO: 18466 - DNA, 25 bp, Mus musculus
aaagttcagactgctgcactgcgag

SEQ ID NO: 18467 - DNA, 25 bp, Mus musculus
aaagttcagcctacattaatcgcat

SEQ ID NO: 18468 - DNA, 25 bp, Mus musculus
aaagttcagccttcattaatcgcat

SEQ ID NO: 18469 - DNA, 25 bp, Mus musculus
aaagttcaggcgactctggtagcaa

SEQ ID NO: 18470 - DNA, 25 bp, Mus musculus
aaagttcaggcgtctctggtagcaa

SEQ ID NO: 18471 - DNA, 25 bp, Mus musculus
aaagttcagtagacctgttcagaaa

SEQ ID NO: 18472 - DNA, 25 bp, Mus musculus
aaagttcagtagtcctgttcagaaa

SEQ ID NO: 18473 - DNA, 25 bp, Mus musculus
aaagttcagtcgctggcggatcgca

SEQ ID NO: 18474 - DNA, 25 bp, Mus musculus
aaagttcagtcggtggcggatcgca

SEQ ID NO: 18475 - DNA, 25 bp, Mus musculus
aaagttcagtggaagccctctatcg

SEQ ID NO: 18476 - DNA, 25 bp, Mus musculus
aaagttcagtggtagccctctatcg

SEQ ID NO: 18477 - DNA, 25 bp, Mus musculus
aaagttcatactcttcagctccctc

SEQ ID NO: 18478 - DNA, 25 bp, Mus musculus
aaagttcatactgttcagctccctc

SEQ ID NO: 18479 - DNA, 25 bp, Mus musculus
aaagttcatcctcttgagctcctaa

SEQ ID NO: 18480 - DNA, 25 bp, Mus musculus
aaagttcatcctgttgagctcctaa

SEQ ID NO: 18481 - DNA, 25 bp, Mus musculus
aaagttcatctcaatgtgcagctat

SEQ ID NO: 18482 - DNA, 25 bp, Mus musculus
aaagttcatctctatgtgcagctat

SEQ ID NO: 18483 - DNA, 25 bp, Mus musculus
aaagttcatctgcaaagtagggtca

SEQ ID NO: 18484 - DNA, 25 bp, Mus musculus
aaagttcatctggaaagtagggtca

SEQ ID NO: 18485 - DNA, 25 bp, Mus musculus
aaagttcatgtgcacgcaggagctc

SEQ ID NO: 18486 - DNA, 25 bp, Mus musculus
aaagttcatgtggacgcaggagctc

SEQ ID NO: 18487 - DNA, 25 bp, Mus musculus
aaagttccaacacggctcgtgatct

SEQ ID NO: 18488 - DNA, 25 bp, Mus musculus
aaagttccaacagggctcgtgatct

SEQ ID NO: 18489 - DNA, 25 bp, Mus musculus
aaagttccaagcattatagtcctgg

SEQ ID NO: 18490 - DNA, 25 bp, Mus musculus
aaagttccaagctttatagtcctgg

SEQ ID NO: 18491 - DNA, 25 bp, Mus musculus
aaagttccactcacttgtactgtca

SEQ ID NO: 18492 - DNA, 25 bp, Mus musculus
aaagttccactctcttgtactgtca

SEQ ID NO: 18493 - DNA, 25 bp, Mus musculus
aaagttccacttccatttcagaggt

SEQ ID NO: 18494 - DNA, 25 bp, Mus musculus
aaagttccacttgcatttcagaggt

SEQ ID NO: 18495 - DNA, 25 bp, Mus musculus
aaagttccagatcttagccaagcaa

SEQ ID NO: 18496 - DNA, 25 bp, Mus musculus
aaagttccagatgttagccaagcaa

SEQ ID NO: 18497 - DNA, 25 bp, Mus musculus
aaagttcccaaactgggtcagcaga

SEQ ID NO: 18498 - DNA, 25 bp, Mus musculus
aaagttcccaaagtgggtcagcaga

SEQ ID NO: 18499 - DNA, 25 bp, Mus musculus
aaagttcccaagaagcttgactcct

SEQ ID NO: 18500 - DNA, 25 bp, Mus musculus
aaagttcccaagagaccttctctgg

SEQ ID NO: 18501 - DNA, 25 bp, Mus musculus
aaagttcccaagtagcttgactcct

SEQ ID NO: 18502 - DNA, 25 bp, Mus musculus
aaagttcccaagtgaccttctctgg

SEQ ID NO: 18503 - DNA, 25 bp, Mus musculus
aaagttcccacaactctctcaagaa

SEQ ID NO: 18504 - DNA, 25 bp, Mus musculus
aaagttcccacatctctctcaagaa

SEQ ID NO: 18505 - DNA, 25 bp, Mus musculus
aaagttcccagccatatgtcaggaa

SEQ ID NO: 18506 - DNA, 25 bp, Mus musculus
aaagttcccagcgatatgtcaggaa

SEQ ID NO: 18507 - DNA, 25 bp, Mus musculus
aaagttccccatatctagagactat

SEQ ID NO: 18508 - DNA, 25 bp, Mus musculus
aaagttccccatttctagagactat

SEQ ID NO: 18509 - DNA, 25 bp, Mus musculus
aaagttcccctgacaatggcaatgg

SEQ ID NO: 18510 - DNA, 25 bp, Mus musculus
aaagttcccctgtcaatggcaatgg

SEQ ID NO: 18511 - DNA, 25 bp, Mus musculus
aaagttccctctcattagtcctttg

SEQ ID NO: 18512 - DNA, 25 bp, Mus musculus
aaagttccctctgattagtcctttg

SEQ ID NO: 18513 - DNA, 25 bp, Mus musculus
aaagttccctgccagcacacgttgg

SEQ ID NO: 18514 - DNA, 25 bp, Mus musculus
aaagttccctgcgagcacacgttgg

SEQ ID NO: 18515 - DNA, 25 bp, Mus musculus
aaagttcccttgattttgtcataca

SEQ ID NO: 18516 - DNA, 25 bp, Mus musculus
aaagttcccttgtttttgtcataca

SEQ ID NO: 18517 - DNA, 25 bp, Mus musculus
aaagttccgttcatatctctgatgg

SEQ ID NO: 18518 - DNA, 25 bp, Mus musculus
aaagttccgttcttatctctgatgg

SEQ ID NO: 18519 - DNA, 25 bp, Mus musculus
aaagttcctaagctgatgttttcat

SEQ ID NO: 18520 - DNA, 25 bp, Mus musculus
aaagttcctaaggtgatgttttcat

SEQ ID NO: 18521 - DNA, 25 bp, Mus musculus
aaagttcctcagataatttcagtgt

SEQ ID NO: 18522 - DNA, 25 bp, Mus musculus
aaagttcctcagcatctctcctatt

SEQ ID NO: 18523 - DNA, 25 bp, Mus musculus
aaagttcctcaggatctctcctatt

SEQ ID NO: 18524 - DNA, 25 bp, Mus musculus
aaagttcctcagttaatttcagtgt

SEQ ID NO: 18525 - DNA, 25 bp, Mus musculus
aaagttcctgaacttctgggctgtg

SEQ ID NO: 18526 - DNA, 25 bp, Mus musculus
aaagttcctgaagttctgggctgtg

SEQ ID NO: 18527 - DNA, 25 bp, Mus musculus
aaagttcctgacacagtctactgtc

SEQ ID NO: 18528 - DNA, 25 bp, Mus musculus
aaagttcctgactcagtctactgtc

SEQ ID NO: 18529 - DNA, 25 bp, Mus musculus
aaagttcctgcactcatgggccaaa

SEQ ID NO: 18530 - DNA, 25 bp, Mus musculus
aaagttcctgcagtcatgggccaaa

SEQ ID NO: 18531 - DNA, 25 bp, Mus musculus
aaagttcctgccctcagcaatgacg

SEQ ID NO: 18532 - DNA, 25 bp, Mus musculus
aaagttcctgccgtcagcaatgacg

SEQ ID NO: 18533 - DNA, 25 bp, Mus musculus
aaagttcctggcagatggctctgtt

SEQ ID NO: 18534 - DNA, 25 bp, Mus musculus
aaagttcctggctgatggctctgtt

SEQ ID NO: 18535 - DNA, 25 bp, Mus musculus
aaagttcctgtcatcagttcttctt

SEQ ID NO: 18536 - DNA, 25 bp, Mus musculus
aaagttcctgtcttcagttcttctt

SEQ ID NO: 18537 - DNA, 25 bp, Mus musculus
aaagttccttgtcaggtcagggcca

SEQ ID NO: 18538 - DNA, 25 bp, Mus musculus
aaagttccttgtgaggtcagggcca

SEQ ID NO: 18539 - DNA, 25 bp, Mus musculus
aaagttcgctgcaagcatccagggc

SEQ ID NO: 18540 - DNA, 25 bp, Mus musculus
aaagttcgctgctagcatccagggc

SEQ ID NO: 18541 - DNA, 25 bp, Mus musculus
aaagttcggcctagttctgtcaaat

SEQ ID NO: 18542 - DNA, 25 bp, Mus musculus
aaagttcggccttgttctgtcaaat

SEQ ID NO: 18543 - DNA, 25 bp, Mus musculus
aaagttctaagtatcatgctaagta

SEQ ID NO: 18544 - DNA, 25 bp, Mus musculus
aaagttctaagtttcatgctaagta

SEQ ID NO: 18545 - DNA, 25 bp, Mus musculus
aaagttctactaccgctgattgaaa

SEQ ID NO: 18546 - DNA, 25 bp, Mus musculus
aaagttctactagcgctgattgaaa

SEQ ID NO: 18547 - DNA, 25 bp, Mus musculus
aaagttctaggcctgttcagagaca

SEQ ID NO: 18548 - DNA, 25 bp, Mus musculus
aaagttctaggcgtgttcagagaca

SEQ ID NO: 18549 - DNA, 25 bp, Mus musculus
aaagttctagtccattgccctcatt

SEQ ID NO: 18550 - DNA, 25 bp, Mus musculus
aaagttctagtcgattgccctcatt

SEQ ID NO: 18551 - DNA, 25 bp, Mus musculus
aaagttctcccaaggccacaaagga

SEQ ID NO: 18552 - DNA, 25 bp, Mus musculus
aaagttctcccatggccacaaagga

SEQ ID NO: 18553 - DNA, 25 bp, Mus musculus
aaagttctccctcaaatatgttcct

SEQ ID NO: 18554 - DNA, 25 bp, Mus musculus
aaagttctccctgaaatatgttcct

SEQ ID NO: 18555 - DNA, 25 bp, Mus musculus
aaagttctcctcactggctgctggt

SEQ ID NO: 18556 - DNA, 25 bp, Mus musculus
aaagttctcctctctggctgctggt

SEQ ID NO: 18557 - DNA, 25 bp, Mus musculus
aaagttctcttcagaagctcaagag

SEQ ID NO: 18558 - DNA, 25 bp, Mus musculus
aaagttctcttctgaagctcaagag

SEQ ID NO: 18559 - DNA, 25 bp, Mus musculus
aaagttctctttatatcttcagaat

SEQ ID NO: 18560 - DNA, 25 bp, Mus musculus
aaagttctctttccttagcagtgcg

SEQ ID NO: 18561 - DNA, 25 bp, Mus musculus
aaagttctctttgcttagcagtgcg

SEQ ID NO: 18562 - DNA, 25 bp, Mus musculus
aaagttctctttttatcttcagaat

SEQ ID NO: 18563 - DNA, 25 bp, Mus musculus
aaagttctgaacagctcactatatc

SEQ ID NO: 18564 - DNA, 25 bp, Mus musculus
aaagttctgaactgctcactatatc

SEQ ID NO: 18565 - DNA, 25 bp, Mus musculus
aaagttctgagtcctttacaaagaa

SEQ ID NO: 18566 - DNA, 25 bp, Mus musculus
aaagttctgagtgctttacaaagaa

SEQ ID NO: 18567 - DNA, 25 bp, Mus musculus
aaagttctgcagctcatttcactga

SEQ ID NO: 18568 - DNA, 25 bp, Mus musculus
aaagttctgcaggtcatttcactga

SEQ ID NO: 18569 - DNA, 25 bp, Mus musculus
aaagttctgcttcacaagtccccat

SEQ ID NO: 18570 - DNA, 25 bp, Mus musculus
aaagttctgcttgacaagtccccat

SEQ ID NO: 18571 - DNA, 25 bp, Mus musculus
aaagttctgtgtatcaaggactgaa

SEQ ID NO: 18572 - DNA, 25 bp, Mus musculus
aaagttctgtgtttcaaggactgaa

SEQ ID NO: 18573 - DNA, 25 bp, Mus musculus
aaagttcttagcagactgtcctgct

SEQ ID NO: 18574 - DNA, 25 bp, Mus musculus
aaagttcttagcatcaaggtgggat

SEQ ID NO: 18575 - DNA, 25 bp, Mus musculus
aaagttcttagctgactgtcctgct

SEQ ID NO: 18576 - DNA, 25 bp, Mus musculus
aaagttcttagcttcaaggtgggat

SEQ ID NO: 18577 - DNA, 25 bp, Mus musculus
aaagttcttaggaatgtgcatgtat

SEQ ID NO: 18578 - DNA, 25 bp, Mus musculus
aaagttcttaggtatgtgcatgtat

SEQ ID NO: 18579 - DNA, 25 bp, Mus musculus
aaagttcttctacggtgagccacct

SEQ ID NO: 18580 - DNA, 25 bp, Mus musculus
aaagttcttctagggtgagccacct

SEQ ID NO: 18581 - DNA, 25 bp, Mus musculus
aaagttcttctcctcatgagggaca

SEQ ID NO: 18582 - DNA, 25 bp, Mus musculus
aaagttcttctcgtcatgagggaca

SEQ ID NO: 18583 - DNA, 25 bp, Mus musculus
aaagttcttcttcagtgcggatcaa

SEQ ID NO: 18584 - DNA, 25 bp, Mus musculus
aaagttcttcttgagtgcggatcaa

SEQ ID NO: 18585 - DNA, 25 bp, Mus musculus
aaagttcttggtccttatgcaaggc

SEQ ID NO: 18586 - DNA, 25 bp, Mus musculus
aaagttcttggtgcttatgcaaggc

SEQ ID NO: 18587 - DNA, 25 bp, Mus musculus
aaagttcttgtccagagccaggccc

SEQ ID NO: 18588 - DNA, 25 bp, Mus musculus
aaagttcttgtcgagagccaggccc

SEQ ID NO: 18589 - DNA, 25 bp, Mus musculus
aaagttgaacgcacctgaggcatgt

SEQ ID NO: 18590 - DNA, 25 bp, Mus musculus
aaagttgaacgctcctgaggcatgt

SEQ ID NO: 18591 - DNA, 25 bp, Mus musculus
aaagttgaacttctccctagagcct

SEQ ID NO: 18592 - DNA, 25 bp, Mus musculus
aaagttgaacttgtccctagagcct

SEQ ID NO: 18593 - DNA, 25 bp, Mus musculus
aaagttgaattcagcctccaggatc

SEQ ID NO: 18594 - DNA, 25 bp, Mus musculus
aaagttgaattctgcctccaggatc

SEQ ID NO: 18595 - DNA, 25 bp, Mus musculus
aaagttgacatcactagcagttggg

SEQ ID NO: 18596 - DNA, 25 bp, Mus musculus
aaagttgacatctctagcagttggg

SEQ ID NO: 18597 - DNA, 25 bp, Mus musculus
aaagttgaccatccttccaggacca

SEQ ID NO: 18598 - DNA, 25 bp, Mus musculus
aaagttgaccatgcttccaggacca

SEQ ID NO: 18599 - DNA, 25 bp, Mus musculus
aaagttgaccgaatgaagctggcag

SEQ ID NO: 18600 - DNA, 25 bp, Mus musculus
aaagttgaccgattgaagctggcag

SEQ ID NO: 18601 - DNA, 25 bp, Mus musculus
aaagttgagctaccagattctgtag

SEQ ID NO: 18602 - DNA, 25 bp, Mus musculus
aaagttgagctagcagattctgtag

SEQ ID NO: 18603 - DNA, 25 bp, Mus musculus
aaagttgagctcattccaccaagtc

SEQ ID NO: 18604 - DNA, 25 bp, Mus musculus
aaagttgagctctttccaccaagtc

SEQ ID NO: 18605 - DNA, 25 bp, Mus musculus
aaagttgagtcgcttcagtccatcc

SEQ ID NO: 18606 - DNA, 25 bp, Mus musculus
aaagttgagtcggttcagtccatcc

SEQ ID NO: 18607 - DNA, 25 bp, Mus musculus
aaagttgatcttccaggtggaacat

SEQ ID NO: 18608 - DNA, 25 bp, Mus musculus
aaagttgatcttgcaggtggaacat

SEQ ID NO: 18609 - DNA, 25 bp, Mus musculus
aaagttgatgtgaggccgccaagcc

SEQ ID NO: 18610 - DNA, 25 bp, Mus musculus
aaagttgatgtgtggccgccaagcc

SEQ ID NO: 18611 - DNA, 25 bp, Mus musculus
aaagttgattacctcgctcattctc

SEQ ID NO: 18612 - DNA, 25 bp, Mus musculus
aaagttgattacgtcgctcattctc

SEQ ID NO: 18613 - DNA, 25 bp, Mus musculus
aaagttgcagcacaaatcctgggaa

SEQ ID NO: 18614 - DNA, 25 bp, Mus musculus
aaagttgcagcagaaatcctgggaa

SEQ ID NO: 18615 - DNA, 25 bp, Mus musculus
aaagttgcagtcctagcttctgaca

SEQ ID NO: 18616 - DNA, 25 bp, Mus musculus
aaagttgcagtcgtagcttctgaca

SEQ ID NO: 18617 - DNA, 25 bp, Mus musculus
aaagttgcatgacctgggcccagac

SEQ ID NO: 18618 - DNA, 25 bp, Mus musculus
aaagttgcatgagctgggcccagac

SEQ ID NO: 18619 - DNA, 25 bp, Mus musculus
aaagttgcatgcagtggcatttgtg

SEQ ID NO: 18620 - DNA, 25 bp, Mus musculus
aaagttgcatgcctgactgagataa

SEQ ID NO: 18621 - DNA, 25 bp, Mus musculus
aaagttgcatgcgtgactgagataa

SEQ ID NO: 18622 - DNA, 25 bp, Mus musculus
aaagttgcatgctgtggcatttgtg

SEQ ID NO: 18623 - DNA, 25 bp, Mus musculus
aaagttgccaacctcgacgggctag

SEQ ID NO: 18624 - DNA, 25 bp, Mus musculus
aaagttgccaacgtcgacgggctag

SEQ ID NO: 18625 - DNA, 25 bp, Mus musculus
aaagttgccattagagagggctgga

SEQ ID NO: 18626 - DNA, 25 bp, Mus musculus
aaagttgccatttgagagggctgga

SEQ ID NO: 18627 - DNA, 25 bp, Mus musculus
aaagttgccctgagagttgagttac

SEQ ID NO: 18628 - DNA, 25 bp, Mus musculus
aaagttgccctgtgagttgagttac

SEQ ID NO: 18629 - DNA, 25 bp, Mus musculus
aaagttgccgatcccgtgtgtgtgc

SEQ ID NO: 18630 - DNA, 25 bp, Mus musculus
aaagttgccgatgccgtgtgtgtgc

SEQ ID NO: 18631 - DNA, 25 bp, Mus musculus
aaagttgcctggaggctattggaag

SEQ ID NO: 18632 - DNA, 25 bp, Mus musculus
aaagttgcctggtggctattggaag

SEQ ID NO: 18633 - DNA, 25 bp, Mus musculus
aaagttgcctgtctctttctgactc

SEQ ID NO: 18634 - DNA, 25 bp, Mus musculus
aaagttgcctgtgtctttctgactc

SEQ ID NO: 18635 - DNA, 25 bp, Mus musculus
aaagttgcggttaacagcacctgct

SEQ ID NO: 18636 - DNA, 25 bp, Mus musculus
aaagttgcggtttacagcacctgct

SEQ ID NO: 18637 - DNA, 25 bp, Mus musculus
aaagttgctaggagagctgatcctg

SEQ ID NO: 18638 - DNA, 25 bp, Mus musculus
aaagttgctaggtgagctgatcctg

SEQ ID NO: 18639 - DNA, 25 bp, Mus musculus
aaagttgctgctcgacacgaactcc

SEQ ID NO: 18640 - DNA, 25 bp, Mus musculus
aaagttgctgctggacacgaactcc

SEQ ID NO: 18641 - DNA, 25 bp, Mus musculus
aaagttgctgtaattacttccataa

SEQ ID NO: 18642 - DNA, 25 bp, Mus musculus
aaagttgctgtacttggcccattct

SEQ ID NO: 18643 - DNA, 25 bp, Mus musculus
aaagttgctgtagttggcccattct

SEQ ID NO: 18644 - DNA, 25 bp, Mus musculus
aaagttgctgtatttacttccataa

SEQ ID NO: 18645 - DNA, 25 bp, Mus musculus
aaagttgctgtgagtaccaagccta

SEQ ID NO: 18646 - DNA, 25 bp, Mus musculus
aaagttgctgtgtgtaccaagccta

SEQ ID NO: 18647 - DNA, 25 bp, Mus musculus
aaagttgctgttagagccaggcttc

SEQ ID NO: 18648 - DNA, 25 bp, Mus musculus
aaagttgctgtttgagccaggcttc

SEQ ID NO: 18649 - DNA, 25 bp, Mus musculus
aaagttgcttcacagacttagtggg

SEQ ID NO: 18650 - DNA, 25 bp, Mus musculus
aaagttgcttcagagacttagtggg

SEQ ID NO: 18651 - DNA, 25 bp, Mus musculus
aaagttggaaccattctcacccatg

SEQ ID NO: 18652 - DNA, 25 bp, Mus musculus
aaagttggaacctttctcacccatg

SEQ ID NO: 18653 - DNA, 25 bp, Mus musculus
aaagttggagaacttagacgagtga

SEQ ID NO: 18654 - DNA, 25 bp, Mus musculus
aaagttggagaagttagacgagtga

SEQ ID NO: 18655 - DNA, 25 bp, Mus musculus
aaagttggaggccaactctctctac

SEQ ID NO: 18656 - DNA, 25 bp, Mus musculus
aaagttggaggcgaactctctctac

SEQ ID NO: 18657 - DNA, 25 bp, Mus musculus
aaagttggcatgaccatccacttca

SEQ ID NO: 18658 - DNA, 25 bp, Mus musculus
aaagttggcatgtccatccacttca

SEQ ID NO: 18659 - DNA, 25 bp, Mus musculus
aaagttggcctaacaccagggcgtg

SEQ ID NO: 18660 - DNA, 25 bp, Mus musculus
aaagttggcctatcaccagggcgtg

SEQ ID NO: 18661 - DNA, 25 bp, Mus musculus
aaagttggcctcacggcttatgtgc

SEQ ID NO: 18662 - DNA, 25 bp, Mus musculus
aaagttggcctcattgtgggcccag

SEQ ID NO: 18663 - DNA, 25 bp, Mus musculus
aaagttggcctctcggcttatgtgc

SEQ ID NO: 18664 - DNA, 25 bp, Mus musculus
aaagttggcctctttgtgggcccag

SEQ ID NO: 18665 - DNA, 25 bp, Mus musculus
aaagttggctcacgacccatgttgc

SEQ ID NO: 18666 - DNA, 25 bp, Mus musculus
aaagttggctcaggacccatgttgc

SEQ ID NO: 18667 - DNA, 25 bp, Mus musculus
aaagttggctccagagactgggaca

SEQ ID NO: 18668 - DNA, 25 bp, Mus musculus
aaagttggctcctgagactgggaca

SEQ ID NO: 18669 - DNA, 25 bp, Mus musculus
aaagttggcttcacgggtcttctat

SEQ ID NO: 18670 - DNA, 25 bp, Mus musculus
aaagttggcttctcgggtcttctat

SEQ ID NO: 18671 - DNA, 25 bp, Mus musculus
aaagttggcttgactcatcataccc

SEQ ID NO: 18672 - DNA, 25 bp, Mus musculus
aaagttggcttgtctcatcataccc

SEQ ID NO: 18673 - DNA, 25 bp, Mus musculus
aaagttgggaagatgccttcagcta

SEQ ID NO: 18674 - DNA, 25 bp, Mus musculus
aaagttgggaagttgccttcagcta

SEQ ID NO: 18675 - DNA, 25 bp, Mus musculus
aaagttgggacacatgtttcctcta

SEQ ID NO: 18676 - DNA, 25 bp, Mus musculus
aaagttgggacagatgtttcctcta

SEQ ID NO: 18677 - DNA, 25 bp, Mus musculus
aaagttggtataacagttggtctgc

SEQ ID NO: 18678 - DNA, 25 bp, Mus musculus
aaagttggtatatcagttggtctgc

SEQ ID NO: 18679 - DNA, 25 bp, Mus musculus
aaagttggtgtaatttgttcatata

SEQ ID NO: 18680 - DNA, 25 bp, Mus musculus
aaagttggtgtattttgttcatata

SEQ ID NO: 18681 - DNA, 25 bp, Mus musculus
aaagttgtaataccattttgaatgt

SEQ ID NO: 18682 - DNA, 25 bp, Mus musculus
aaagttgtaatagcattttgaatgt

SEQ ID NO: 18683 - DNA, 25 bp, Mus musculus
aaagttgtacaaccttgcgatgtgt

SEQ ID NO: 18684 - DNA, 25 bp, Mus musculus
aaagttgtacaagcttgcgatgtgt

SEQ ID NO: 18685 - DNA, 25 bp, Mus musculus
aaagttgtactgagatgttaaattc

SEQ ID NO: 18686 - DNA, 25 bp, Mus musculus
aaagttgtactgtgatgttaaattc

SEQ ID NO: 18687 - DNA, 25 bp, Mus musculus
aaagttgtagctatcaagtctgtaa

SEQ ID NO: 18688 - DNA, 25 bp, Mus musculus
aaagttgtagctttcaagtctgtaa

SEQ ID NO: 18689 - DNA, 25 bp, Mus musculus
aaagttgtataaactgtctaatcag

SEQ ID NO: 18690 - DNA, 25 bp, Mus musculus
aaagttgtataatctgtctaatcag

SEQ ID NO: 18691 - DNA, 25 bp, Mus musculus
aaagttgtatcgaatctgccagcca

SEQ ID NO: 18692 - DNA, 25 bp, Mus musculus
aaagttgtatcgtatctgccagcca

SEQ ID NO: 18693 - DNA, 25 bp, Mus musculus
aaagttgtcaatccagcccagtcac

SEQ ID NO: 18694 - DNA, 25 bp, Mus musculus
aaagttgtcaatgcagcccagtcac

SEQ ID NO: 18695 - DNA, 25 bp, Mus musculus
aaagttgtccatctgtgctcacaaa

SEQ ID NO: 18696 - DNA, 25 bp, Mus musculus
aaagttgtccatgtgtgctcacaaa

SEQ ID NO: 18697 - DNA, 25 bp, Mus musculus
aaagttgtcttacctgtcagtgtat

SEQ ID NO: 18698 - DNA, 25 bp, Mus musculus
aaagttgtcttagctgtcagtgtat

SEQ ID NO: 18699 - DNA, 25 bp, Mus musculus
aaagttgtctttatcatgccataga

SEQ ID NO: 18700 - DNA, 25 bp, Mus musculus
aaagttgtctttttcatgccataga

SEQ ID NO: 18701 - DNA, 25 bp, Mus musculus
aaagttgtgaacctatggcctattt

SEQ ID NO: 18702 - DNA, 25 bp, Mus musculus
aaagttgtgaacgtatggcctattt

SEQ ID NO: 18703 - DNA, 25 bp, Mus musculus
aaagttgtgcatctgaccactgcaa

SEQ ID NO: 18704 - DNA, 25 bp, Mus musculus
aaagttgtgcatgtgaccactgcaa

SEQ ID NO: 18705 - DNA, 25 bp, Mus musculus
aaagttgtgctacactcacctcttg

SEQ ID NO: 18706 - DNA, 25 bp, Mus musculus
aaagttgtgctagactcacctcttg

SEQ ID NO: 18707 - DNA, 25 bp, Mus musculus
aaagttgtgtgccacattgcttggg

SEQ ID NO: 18708 - DNA, 25 bp, Mus musculus
aaagttgtgtgcgacattgcttggg

SEQ ID NO: 18709 - DNA, 25 bp, Mus musculus
aaagttgttcttctagcctctggct

SEQ ID NO: 18710 - DNA, 25 bp, Mus musculus
aaagttgttcttgtagcctctggct

SEQ ID NO: 18711 - DNA, 25 bp, Mus musculus
aaagttgttgatcttggcaggttaa

SEQ ID NO: 18712 - DNA, 25 bp, Mus musculus
aaagttgttgatgttggcaggttaa

SEQ ID NO: 18713 - DNA, 25 bp, Mus musculus
aaagttgttgttccagccatccgaa

SEQ ID NO: 18714 - DNA, 25 bp, Mus musculus
aaagttgttgttgcagccatccgaa

SEQ ID NO: 18715 - DNA, 25 bp, Mus musculus
aaagtttagagcagtggcctgccat

SEQ ID NO: 18716 - DNA, 25 bp, Mus musculus
aaagtttagagctgtggcctgccat

SEQ ID NO: 18717 - DNA, 25 bp, Mus musculus
aaagtttagcccctcggctggatag

SEQ ID NO: 18718 - DNA, 25 bp, Mus musculus
aaagtttagcccgtcggctggatag

SEQ ID NO: 18719 - DNA, 25 bp, Mus musculus
aaagtttagccgagttctttggcag

SEQ ID NO: 18720 - DNA, 25 bp, Mus musculus
aaagtttagccgtgttctttggcag

SEQ ID NO: 18721 - DNA, 25 bp, Mus musculus
aaagtttaggcccacacagataaga

SEQ ID NO: 18722 - DNA, 25 bp, Mus musculus
aaagtttaggccgacacagataaga

SEQ ID NO: 18723 - DNA, 25 bp, Mus musculus
aaagtttagggcagtatgtctgaaa

SEQ ID NO: 18724 - DNA, 25 bp, Mus musculus
aaagtttagggctgtatgtctgaaa

SEQ ID NO: 18725 - DNA, 25 bp, Mus musculus
aaagtttagtttagtagcagtgaat

SEQ ID NO: 18726 - DNA, 25 bp, Mus musculus
aaagtttagttttgtagcagtgaat

SEQ ID NO: 18727 - DNA, 25 bp, Mus musculus
aaagtttatccgcttccattgtgtg

SEQ ID NO: 18728 - DNA, 25 bp, Mus musculus
aaagtttatccggttccattgtgtg

SEQ ID NO: 18729 - DNA, 25 bp, Mus musculus
aaagtttatctgacaccatacctgc

SEQ ID NO: 18730 - DNA, 25 bp, Mus musculus
aaagtttatctgtcaccatacctgc

SEQ ID NO: 18731 - DNA, 25 bp, Mus musculus
aaagtttatgcacctctcaggagca

SEQ ID NO: 18732 - DNA, 25 bp, Mus musculus
aaagtttatgcagctctcaggagca

SEQ ID NO: 18733 - DNA, 25 bp, Mus musculus
aaagtttcacaacttgaccttgact

SEQ ID NO: 18734 - DNA, 25 bp, Mus musculus
aaagtttcacaagttgaccttgact

SEQ ID NO: 18735 - DNA, 25 bp, Mus musculus
aaagtttcatttccagtcaagtgac

SEQ ID NO: 18736 - DNA, 25 bp, Mus musculus
aaagtttcatttgcagtcaagtgac

SEQ ID NO: 18737 - DNA, 25 bp, Mus musculus
aaagtttccacaaaggaccgcatgg

SEQ ID NO: 18738 - DNA, 25 bp, Mus musculus
aaagtttccacataggaccgcatgg

SEQ ID NO: 18739 - DNA, 25 bp, Mus musculus
aaagtttccagaaagctttgctgca

SEQ ID NO: 18740 - DNA, 25 bp, Mus musculus
aaagtttccagatagctttgctgca

SEQ ID NO: 18741 - DNA, 25 bp, Mus musculus
aaagtttccaggacatccctggctt

SEQ ID NO: 18742 - DNA, 25 bp, Mus musculus
aaagtttccaggtcatccctggctt

SEQ ID NO: 18743 - DNA, 25 bp, Mus musculus
aaagtttccatgctcctatgggata

SEQ ID NO: 18744 - DNA, 25 bp, Mus musculus
aaagtttccatggtcctatgggata

SEQ ID NO: 18745 - DNA, 25 bp, Mus musculus
aaagtttcccagcttgtggtggtga

SEQ ID NO: 18746 - DNA, 25 bp, Mus musculus
aaagtttcccaggttgtggtggtga

SEQ ID NO: 18747 - DNA, 25 bp, Mus musculus
aaagtttctcagagtttctatagcc

SEQ ID NO: 18748 - DNA, 25 bp, Mus musculus
aaagtttctcagtgtttctatagcc

SEQ ID NO: 18749 - DNA, 25 bp, Mus musculus
aaagtttctgctaccttcgttgcta

SEQ ID NO: 18750 - DNA, 25 bp, Mus musculus
aaagtttctgcttccttcgttgcta

SEQ ID NO: 18751 - DNA, 25 bp, Mus musculus
aaagtttctgtgctcctgctgtgca

SEQ ID NO: 18752 - DNA, 25 bp, Mus musculus
aaagtttctgtggtcctgctgtgca

SEQ ID NO: 18753 - DNA, 25 bp, Mus musculus
aaagtttgaagcctgactggccttc

SEQ ID NO: 18754 - DNA, 25 bp, Mus musculus
aaagtttgaagcgtgactggccttc

SEQ ID NO: 18755 - DNA, 25 bp, Mus musculus
aaagtttgagataatcctaggctac

SEQ ID NO: 18756 - DNA, 25 bp, Mus musculus
aaagtttgagatcgccctgaggctg

SEQ ID NO: 18757 - DNA, 25 bp, Mus musculus
aaagtttgagatggccctgaggctg

SEQ ID NO: 18758 - DNA, 25 bp, Mus musculus
aaagtttgagattatcctaggctac

SEQ ID NO: 18759 - DNA, 25 bp, Mus musculus
aaagtttgagggagccatctataga

SEQ ID NO: 18760 - DNA, 25 bp, Mus musculus
aaagtttgagggtgccatctataga

SEQ ID NO: 18761 - DNA, 25 bp, Mus musculus
aaagtttgatgcaccatttgacgat

SEQ ID NO: 18762 - DNA, 25 bp, Mus musculus
aaagtttgatgctccatttgacgat

SEQ ID NO: 18763 - DNA, 25 bp, Mus musculus
aaagtttgcaacaccagacctgatg

SEQ ID NO: 18764 - DNA, 25 bp, Mus musculus
aaagtttgcaactccagacctgatg

SEQ ID NO: 18765 - DNA, 25 bp, Mus musculus
aaagtttgcaatcagcactcctcca

SEQ ID NO: 18766 - DNA, 25 bp, Mus musculus
aaagtttgcaatgagcactcctcca

SEQ ID NO: 18767 - DNA, 25 bp, Mus musculus
aaagtttgcaggaccttgttgctca

SEQ ID NO: 18768 - DNA, 25 bp, Mus musculus
aaagtttgcaggtccttgttgctca

SEQ ID NO: 18769 - DNA, 25 bp, Mus musculus
aaagtttgccagaacttcagaggag

SEQ ID NO: 18770 - DNA, 25 bp, Mus musculus
aaagtttgccagtacttcagaggag

SEQ ID NO: 18771 - DNA, 25 bp, Mus musculus
aaagtttgcgtgcttggcacttgtt

SEQ ID NO: 18772 - DNA, 25 bp, Mus musculus
aaagtttgcgtggttggcacttgtt

SEQ ID NO: 18773 - DNA, 25 bp, Mus musculus
aaagtttggaagcagcgatgccgaa

SEQ ID NO: 18774 - DNA, 25 bp, Mus musculus
aaagtttggaaggagcgatgccgaa

SEQ ID NO: 18775 - DNA, 25 bp, Mus musculus
aaagtttgggagaagtgcacacctt

SEQ ID NO: 18776 - DNA, 25 bp, Mus musculus
aaagtttgggagtagtgcacacctt

SEQ ID NO: 18777 - DNA, 25 bp, Mus musculus
aaagtttgtcaaacagctcaaaggg

SEQ ID NO: 18778 - DNA, 25 bp, Mus musculus
aaagtttgtcaatcagctcaaaggg

SEQ ID NO: 18779 - DNA, 25 bp, Mus musculus
aaagtttgtgctcctatgtttgtat

SEQ ID NO: 18780 - DNA, 25 bp, Mus musculus
aaagtttgtgctgctatgtttgtat

SEQ ID NO: 18781 - DNA, 25 bp, Mus musculus
aaagtttgttccatgtttggctgaa

SEQ ID NO: 18782 - DNA, 25 bp, Mus musculus
aaagtttgttccttgtttggctgaa

SEQ ID NO: 18783 - DNA, 25 bp, Mus musculus
aaagtttgttgaactctgggcagct

SEQ ID NO: 18784 - DNA, 25 bp, Mus musculus
aaagtttgttgatctctgggcagct

SEQ ID NO: 18785 - DNA, 25 bp, Mus musculus
aaagttttcagaagagtgccagcat

SEQ ID NO: 18786 - DNA, 25 bp, Mus musculus
aaagttttcagatgagtgccagcat

SEQ ID NO: 18787 - DNA, 25 bp, Mus musculus
aaagttttcattactcacacctcat

SEQ ID NO: 18788 - DNA, 25 bp, Mus musculus
aaagttttcatttctcacacctcat

SEQ ID NO: 18789 - DNA, 25 bp, Mus musculus
aaagttttccacatggctcaagtta

SEQ ID NO: 18790 - DNA, 25 bp, Mus musculus
aaagttttccacttggctcaagtta

SEQ ID NO: 18791 - DNA, 25 bp, Mus musculus
aaagttttccatactatacgttcag

SEQ ID NO: 18792 - DNA, 25 bp, Mus musculus
aaagttttccattctatacgttcag

SEQ ID NO: 18793 - DNA, 25 bp, Mus musculus
aaagttttctgacacttctgtgtct

SEQ ID NO: 18794 - DNA, 25 bp, Mus musculus
aaagttttctgagacttctgtgtct

SEQ ID NO: 18795 - DNA, 25 bp, Mus musculus
aaagttttcttgactataattctgt

SEQ ID NO: 18796 - DNA, 25 bp, Mus musculus
aaagttttcttgtctataattctgt

SEQ ID NO: 18797 - DNA, 25 bp, Mus musculus
aaagttttgatccatctccatcctt

SEQ ID NO: 18798 - DNA, 25 bp, Mus musculus
aaagttttgatcgatctccatcctt

SEQ ID NO: 18799 - DNA, 25 bp, Mus musculus
aaagttttgcttcagcctactgtgt

SEQ ID NO: 18800 - DNA, 25 bp, Mus musculus
aaagttttgcttgagcctactgtgt

SEQ ID NO: 18801 - DNA, 25 bp, Mus musculus
aaagttttggcaaatttaggtcagc

SEQ ID NO: 18802 - DNA, 25 bp, Mus musculus
aaagttttggcatatttaggtcagc

SEQ ID NO: 18803 - DNA, 25 bp, Mus musculus
aaagttttggtgaggcatttgtcat

SEQ ID NO: 18804 - DNA, 25 bp, Mus musculus
aaagttttggtgtggcatttgtcat

SEQ ID NO: 18805 - DNA, 25 bp, Mus musculus
aaagttttttgcatgtgtgtacaca

SEQ ID NO: 18806 - DNA, 25 bp, Mus musculus
aaagttttttgcttgtgtgtacaca

SEQ ID NO: 18807 - DNA, 25 bp, Mus musculus
aaagttttttggactcagcttcatt

SEQ ID NO: 18808 - DNA, 25 bp, Mus musculus
aaagttttttggtctcagcttcatt

SEQ ID NO: 18809 - DNA, 25 bp, Mus musculus
aaataaaactcaccctttgcatgcc

SEQ ID NO: 18810 - DNA, 25 bp, Mus musculus
aaataaaactcagcctttgcatgcc

SEQ ID NO: 18811 - DNA, 25 bp, Mus musculus
aaataaaactctcctgctgcaggat

SEQ ID NO: 18812 - DNA, 25 bp, Mus musculus
aaataaaactctgctgctgcaggat

SEQ ID NO: 18813 - DNA, 25 bp, Mus musculus
aaataaaatcatccatcacacctcc

SEQ ID NO: 18814 - DNA, 25 bp, Mus musculus
aaataaaatcatgcatcacacctcc

SEQ ID NO: 18815 - DNA, 25 bp, Mus musculus
aaataaacagtaccttcaccactca

SEQ ID NO: 18816 - DNA, 25 bp, Mus musculus
aaataaacagtagcttcaccactca

SEQ ID NO: 18817 - DNA, 25 bp, Mus musculus
aaataaacccatacagtgtgctaat

SEQ ID NO: 18818 - DNA, 25 bp, Mus musculus
aaataaacccattcagtgtgctaat

SEQ ID NO: 18819 - DNA, 25 bp, Mus musculus
aaataaaccgtcatctagcctaaga

SEQ ID NO: 18820 - DNA, 25 bp, Mus musculus
aaataaaccgtcttctagcctaaga

SEQ ID NO: 18821 - DNA, 25 bp, Mus musculus
aaataaacctcgctctgcttctttc

SEQ ID NO: 18822 - DNA, 25 bp, Mus musculus
aaataaacctcggtctgcttctttc

SEQ ID NO: 18823 - DNA, 25 bp, Mus musculus
aaataaacctttccagcctttcact

SEQ ID NO: 18824 - DNA, 25 bp, Mus musculus
aaataaacctttgcagcctttcact

SEQ ID NO: 18825 - DNA, 25 bp, Mus musculus
aaataaacgccaacggcccattgga

SEQ ID NO: 18826 - DNA, 25 bp, Mus musculus
aaataaacgccatcggcccattgga

SEQ ID NO: 18827 - DNA, 25 bp, Mus musculus
aaataaacgtgcctcctctgacctc

SEQ ID NO: 18828 - DNA, 25 bp, Mus musculus
aaataaacgtgcgtcctctgacctc

SEQ ID NO: 18829 - DNA, 25 bp, Mus musculus
aaataaactctgattcctcagggag

SEQ ID NO: 18830 - DNA, 25 bp, Mus musculus
aaataaactctgtttcctcagggag

SEQ ID NO: 18831 - DNA, 25 bp, Mus musculus
aaataaactcttcgcgcctgagcat

SEQ ID NO: 18832 - DNA, 25 bp, Mus musculus
aaataaactcttggcgcctgagcat

SEQ ID NO: 18833 - DNA, 25 bp, Mus musculus
aaataaacttacagtgctgtcctct

SEQ ID NO: 18834 - DNA, 25 bp, Mus musculus
aaataaacttactgtgctgtcctct

SEQ ID NO: 18835 - DNA, 25 bp, Mus musculus
aaataaacttcacctttcagtgttc

SEQ ID NO: 18836 - DNA, 25 bp, Mus musculus
aaataaacttcagctttcagtgttc

SEQ ID NO: 18837 - DNA, 25 bp, Mus musculus
aaataaagatgtcacattctgagca

SEQ ID NO: 18838 - DNA, 25 bp, Mus musculus
aaataaagatgtgacattctgagca

SEQ ID NO: 18839 - DNA, 25 bp, Mus musculus
aaataaagcctcagctggctctgtc

SEQ ID NO: 18840 - DNA, 25 bp, Mus musculus
aaataaagcctcatgttcctgcact

SEQ ID NO: 18841 - DNA, 25 bp, Mus musculus
aaataaagcctctgctggctctgtc

SEQ ID NO: 18842 - DNA, 25 bp, Mus musculus
aaataaagcctcttgttcctgcact

SEQ ID NO: 18843 - DNA, 25 bp, Mus musculus
aaataaagctgaccccagaagccct

SEQ ID NO: 18844 - DNA, 25 bp, Mus musculus
aaataaagctgagcccagaagccct

SEQ ID NO: 18845 - DNA, 25 bp, Mus musculus
aaataaaggcagcactcaccccaca

SEQ ID NO: 18846 - DNA, 25 bp, Mus musculus
aaataaaggcaggactcaccccaca

SEQ ID NO: 18847 - DNA, 25 bp, Mus musculus
aaataaaggctaatgccaggcaggc

SEQ ID NO: 18848 - DNA, 25 bp, Mus musculus
aaataaaggctattgccaggcaggc

SEQ ID NO: 18849 - DNA, 25 bp, Mus musculus
aaataaagtctgcagccgtgccact

SEQ ID NO: 18850 - DNA, 25 bp, Mus musculus
aaataaagtctggagccgtgccact

SEQ ID NO: 18851 - DNA, 25 bp, Mus musculus
aaataaagtcttctctcggcgtccg

SEQ ID NO: 18852 - DNA, 25 bp, Mus musculus
aaataaagtcttgtctcggcgtccg

SEQ ID NO: 18853 - DNA, 25 bp, Mus musculus
aaataaatacccagactaggagtct

SEQ ID NO: 18854 - DNA, 25 bp, Mus musculus
aaataaataccctgactaggagtct

SEQ ID NO: 18855 - DNA, 25 bp, Mus musculus
aaataaatcagcatgggccagggtt

SEQ ID NO: 18856 - DNA, 25 bp, Mus musculus
aaataaatcagccatggacagagga

SEQ ID NO: 18857 - DNA, 25 bp, Mus musculus
aaataaatcagcgatggacagagga

SEQ ID NO: 18858 - DNA, 25 bp, Mus musculus
aaataaatcagcttgggccagggtt

SEQ ID NO: 18859 - DNA, 25 bp, Mus musculus
aaataaatcaggaaggccagagcca

SEQ ID NO: 18860 - DNA, 25 bp, Mus musculus
aaataaatcaggtaggccagagcca

SEQ ID NO: 18861 - DNA, 25 bp, Mus musculus
aaataaatcgagatccctggcttga

SEQ ID NO: 18862 - DNA, 25 bp, Mus musculus
aaataaatcgagttccctggcttga

SEQ ID NO: 18863 - DNA, 25 bp, Mus musculus
aaataaatcttcagccatcagtggt

SEQ ID NO: 18864 - DNA, 25 bp, Mus musculus
aaataaatcttctgccatcagtggt

SEQ ID NO: 18865 - DNA, 25 bp, Mus musculus
aaataaatgcccacagtcctgacta

SEQ ID NO: 18866 - DNA, 25 bp, Mus musculus
aaataaatgccctcagtcctgacta

SEQ ID NO: 18867 - DNA, 25 bp, Mus musculus
aaataaatgcctacctgcgagccgc

SEQ ID NO: 18868 - DNA, 25 bp, Mus musculus
aaataaatgccttcctgcgagccgc

SEQ ID NO: 18869 - DNA, 25 bp, Mus musculus
aaataaatgtaaatgctcccttatg

SEQ ID NO: 18870 - DNA, 25 bp, Mus musculus
aaataaatgtaattgctcccttatg

SEQ ID NO: 18871 - DNA, 25 bp, Mus musculus
aaataaatgtgcaattttcacagta

SEQ ID NO: 18872 - DNA, 25 bp, Mus musculus
aaataaatgtgcagccccaggagcc

SEQ ID NO: 18873 - DNA, 25 bp, Mus musculus
aaataaatgtgctattttcacagta

SEQ ID NO: 18874 - DNA, 25 bp, Mus musculus
aaataaatgtgctgccccaggagcc

SEQ ID NO: 18875 - DNA, 25 bp, Mus musculus
aaataaatgtggcactccctccctg

SEQ ID NO: 18876 - DNA, 25 bp, Mus musculus
aaataaatgtgggactccctccctg

SEQ ID NO: 18877 - DNA, 25 bp, Mus musculus
aaataaatgtttcggcctgagcgat

SEQ ID NO: 18878 - DNA, 25 bp, Mus musculus
aaataaatgtttgggcctgagcgat

SEQ ID NO: 18879 - DNA, 25 bp, Mus musculus
aaataacacttaactttgaagctat

SEQ ID NO: 18880 - DNA, 25 bp, Mus musculus
aaataacacttatctttgaagctat

SEQ ID NO: 18881 - DNA, 25 bp, Mus musculus
aaataacaggcaatggcatttctgc

SEQ ID NO: 18882 - DNA, 25 bp, Mus musculus
aaataacaggcattggcatttctgc

SEQ ID NO: 18883 - DNA, 25 bp, Mus musculus
aaataacatcgtcgttccccagtct

SEQ ID NO: 18884 - DNA, 25 bp, Mus musculus
aaataacatcgtggttccccagtct

SEQ ID NO: 18885 - DNA, 25 bp, Mus musculus
aaataacatttcctcctgtggctca

SEQ ID NO: 18886 - DNA, 25 bp, Mus musculus
aaataacatttcgtcctgtggctca

SEQ ID NO: 18887 - DNA, 25 bp, Mus musculus
aaataaccagtgaagtggccctttg

SEQ ID NO: 18888 - DNA, 25 bp, Mus musculus
aaataaccagtgtagtggccctttg

SEQ ID NO: 18889 - DNA, 25 bp, Mus musculus
aaataaccatacagtactctctcct

SEQ ID NO: 18890 - DNA, 25 bp, Mus musculus
aaataaccatactgtactctctcct

SEQ ID NO: 18891 - DNA, 25 bp, Mus musculus
aaataacccctcagattccttgatt

SEQ ID NO: 18892 - DNA, 25 bp, Mus musculus
aaataacccctctgattccttgatt

SEQ ID NO: 18893 - DNA, 25 bp, Mus musculus
aaataaccctgaccttgtgtataat

SEQ ID NO: 18894 - DNA, 25 bp, Mus musculus
aaataaccctgagcttgtgtataat

SEQ ID NO: 18895 - DNA, 25 bp, Mus musculus
aaataaccgctgacatgtgcacacc

SEQ ID NO: 18896 - DNA, 25 bp, Mus musculus
aaataaccgctgtcatgtgcacacc

SEQ ID NO: 18897 - DNA, 25 bp, Mus musculus
aaataaccggctccggctggaaagc

SEQ ID NO: 18898 - DNA, 25 bp, Mus musculus
aaataaccggctgcggctggaaagc

SEQ ID NO: 18899 - DNA, 25 bp, Mus musculus
aaataacctggaaacgcaagttctg

SEQ ID NO: 18900 - DNA, 25 bp, Mus musculus
aaataacctggatacgcaagttctg

SEQ ID NO: 18901 - DNA, 25 bp, Mus musculus
aaataacctggtctgttgatggctt

SEQ ID NO: 18902 - DNA, 25 bp, Mus musculus
aaataacctggtgtgttgatggctt

SEQ ID NO: 18903 - DNA, 25 bp, Mus musculus
aaataacgacggcattggctccaac

SEQ ID NO: 18904 - DNA, 25 bp, Mus musculus
aaataacgacgggattggctccaac

SEQ ID NO: 18905 - DNA, 25 bp, Mus musculus
aaataacgatcacctccttaaagga

SEQ ID NO: 18906 - DNA, 25 bp, Mus musculus
aaataacgatcagctccttaaagga

SEQ ID NO: 18907 - DNA, 25 bp, Mus musculus
aaataactactgactctgtgtgtac

SEQ ID NO: 18908 - DNA, 25 bp, Mus musculus
aaataactactgtctctgtgtgtac

SEQ ID NO: 18909 - DNA, 25 bp, Mus musculus
aaataactcataatagcacttactg

SEQ ID NO: 18910 - DNA, 25 bp, Mus musculus
aaataactcatattagcacttactg

SEQ ID NO: 18911 - DNA, 25 bp, Mus musculus
aaataactcctactgttttgtatat

SEQ ID NO: 18912 - DNA, 25 bp, Mus musculus
aaataactcctagtgttttgtatat

SEQ ID NO: 18913 - DNA, 25 bp, Mus musculus
aaataactccttcctgatgctttga

SEQ ID NO: 18914 - DNA, 25 bp, Mus musculus
aaataactccttgctgatgctttga

SEQ ID NO: 18915 - DNA, 25 bp, Mus musculus
aaataactcggacccgctatttctg

SEQ ID NO: 18916 - DNA, 25 bp, Mus musculus
aaataactcggagccgctatttctg

SEQ ID NO: 18917 - DNA, 25 bp, Mus musculus
aaataactctgacactggttgctga

SEQ ID NO: 18918 - DNA, 25 bp, Mus musculus
aaataactctgagactggttgctga

SEQ ID NO: 18919 - DNA, 25 bp, Mus musculus
aaataactgactcttccctgaaatt

SEQ ID NO: 18920 - DNA, 25 bp, Mus musculus
aaataactgactgttccctgaaatt

SEQ ID NO: 18921 - DNA, 25 bp, Mus musculus
aaataactgcttccttccacaggtc

SEQ ID NO: 18922 - DNA, 25 bp, Mus musculus
aaataactgcttgcttccacaggtc

SEQ ID NO: 18923 - DNA, 25 bp, Mus musculus
aaataactggcaccatctacccttt

SEQ ID NO: 18924 - DNA, 25 bp, Mus musculus
aaataactggcagcatctacccttt

SEQ ID NO: 18925 - DNA, 25 bp, Mus musculus
aaataactggccacttctatgcttg

SEQ ID NO: 18926 - DNA, 25 bp, Mus musculus
aaataactggcctcttctatgcttg

SEQ ID NO: 18927 - DNA, 25 bp, Mus musculus
aaataactgtcaatggtgcccttaa

SEQ ID NO: 18928 - DNA, 25 bp, Mus musculus
aaataactgtcattggtgcccttaa

SEQ ID NO: 18929 - DNA, 25 bp, Mus musculus
aaataactgttaagaggagattctc

SEQ ID NO: 18930 - DNA, 25 bp, Mus musculus
aaataactgttatgaggagattctc

SEQ ID NO: 18931 - DNA, 25 bp, Mus musculus
aaataacttcatcagcgtttgctaa

SEQ ID NO: 18932 - DNA, 25 bp, Mus musculus
aaataacttcatgagcgtttgctaa

SEQ ID NO: 18933 - DNA, 25 bp, Mus musculus
aaataacttgacacactgtgacttt

SEQ ID NO: 18934 - DNA, 25 bp, Mus musculus
aaataacttgactcactgtgacttt

SEQ ID NO: 18935 - DNA, 25 bp, Mus musculus
aaataagaaagcagtcttccgtggg

SEQ ID NO: 18936 - DNA, 25 bp, Mus musculus
aaataagaaagctgtcttccgtggg

SEQ ID NO: 18937 - DNA, 25 bp, Mus musculus
aaataagaggccctgactcaagcaa

SEQ ID NO: 18938 - DNA, 25 bp, Mus musculus
aaataagaggccgtgactcaagcaa

SEQ ID NO: 18939 - DNA, 25 bp, Mus musculus
aaataagcacttacagatacacttt

SEQ ID NO: 18940 - DNA, 25 bp, Mus musculus
aaataagcactttcagatacacttt

SEQ ID NO: 18941 - DNA, 25 bp, Mus musculus
aaataagcccggcagcttctctgga

SEQ ID NO: 18942 - DNA, 25 bp, Mus musculus
aaataagcccgggagcttctctgga

SEQ ID NO: 18943 - DNA, 25 bp, Mus musculus
aaataagccgcgatgccaatgcagt

SEQ ID NO: 18944 - DNA, 25 bp, Mus musculus
aaataagccgcgttgccaatgcagt

SEQ ID NO: 18945 - DNA, 25 bp, Mus musculus
aaataagcttccaggcattctctat

SEQ ID NO: 18946 - DNA, 25 bp, Mus musculus
aaataagcttcctggcattctctat

SEQ ID NO: 18947 - DNA, 25 bp, Mus musculus
aaataagcttgtctgcgtgtctaca

SEQ ID NO: 18948 - DNA, 25 bp, Mus musculus
aaataagcttgtgtgcgtgtctaca

SEQ ID NO: 18949 - DNA, 25 bp, Mus musculus
aaataaggacggacacactccgctt

SEQ ID NO: 18950 - DNA, 25 bp, Mus musculus
aaataaggacggtcacactccgctt

SEQ ID NO: 18951 - DNA, 25 bp, Mus musculus
aaataaggatctcccacactgctct

SEQ ID NO: 18952 - DNA, 25 bp, Mus musculus
aaataaggatctgccacactgctct

SEQ ID NO: 18953 - DNA, 25 bp, Mus musculus
aaataaggcacccagcagctacagc

SEQ ID NO: 18954 - DNA, 25 bp, Mus musculus
aaataaggcaccgagcagctacagc

SEQ ID NO: 18955 - DNA, 25 bp, Mus musculus
aaataaggccttcctagatgtgcac

SEQ ID NO: 18956 - DNA, 25 bp, Mus musculus
aaataaggccttgctagatgtgcac

SEQ ID NO: 18957 - DNA, 25 bp, Mus musculus
aaataaggtcttctccatgcttaag

SEQ ID NO: 18958 - DNA, 25 bp, Mus musculus
aaataaggtcttgtccatgcttaag

SEQ ID NO: 18959 - DNA, 25 bp, Mus musculus
aaataagtcctgatttcactcgcat

SEQ ID NO: 18960 - DNA, 25 bp, Mus musculus
aaataagtcctgttttcactcgcat

SEQ ID NO: 18961 - DNA, 25 bp, Mus musculus
aaataagtcgtcacgccttggttct

SEQ ID NO: 18962 - DNA, 25 bp, Mus musculus
aaataagtcgtctcgccttggttct

SEQ ID NO: 18963 - DNA, 25 bp, Mus musculus
aaataagttgtgactgccagtgttg

SEQ ID NO: 18964 - DNA, 25 bp, Mus musculus
aaataagttgtgtctgccagtgttg

SEQ ID NO: 18965 - DNA, 25 bp, Mus musculus
aaataagttgttagctcatggaaat

SEQ ID NO: 18966 - DNA, 25 bp, Mus musculus
aaataagttgtttgctcatggaaat

SEQ ID NO: 18967 - DNA, 25 bp, Mus musculus
aaataataagttccctgttccagaa

SEQ ID NO: 18968 - DNA, 25 bp, Mus musculus
aaataataagttgcctgttccagaa

SEQ ID NO: 18969 - DNA, 25 bp, Mus musculus
aaataatacacacaccccacttatt

SEQ ID NO: 18970 - DNA, 25 bp, Mus musculus
aaataatacacagaccccacttatt

SEQ ID NO: 18971 - DNA, 25 bp, Mus musculus
aaataatatgtacacgtgcctgaga

SEQ ID NO: 18972 - DNA, 25 bp, Mus musculus
aaataatatgtagacgtgcctgaga

SEQ ID NO: 18973 - DNA, 25 bp, Mus musculus
aaataatcacttaacagccctgctg

SEQ ID NO: 18974 - DNA, 25 bp, Mus musculus
aaataatcactttacagccctgctg

SEQ ID NO: 18975 - DNA, 25 bp, Mus musculus
aaataatcatctagttcttactgtc

SEQ ID NO: 18976 - DNA, 25 bp, Mus musculus
aaataatcatcttgttcttactgtc

SEQ ID NO: 18977 - DNA, 25 bp, Mus musculus
aaataatcattgactgctgctctcc

SEQ ID NO: 18978 - DNA, 25 bp, Mus musculus
aaataatcattgtctgctgctctcc

SEQ ID NO: 18979 - DNA, 25 bp, Mus musculus
aaataatctcgccaaatacactgag

SEQ ID NO: 18980 - DNA, 25 bp, Mus musculus
aaataatctcgcgaaatacactgag

SEQ ID NO: 18981 - DNA, 25 bp, Mus musculus
aaataatctcgtataaggcaatggg

SEQ ID NO: 18982 - DNA, 25 bp, Mus musculus
aaataatctcgtttaaggcaatggg

SEQ ID NO: 18983 - DNA, 25 bp, Mus musculus
aaataatgaagtctagctgggcctg

SEQ ID NO: 18984 - DNA, 25 bp, Mus musculus
aaataatgaagtgtagctgggcctg

SEQ ID NO: 18985 - DNA, 25 bp, Mus musculus
aaataatgacttccttccagttccg

SEQ ID NO: 18986 - DNA, 25 bp, Mus musculus
aaataatgacttgcttccagttccg

SEQ ID NO: 18987 - DNA, 25 bp, Mus musculus
aaataatgccagctttttgccaaga

SEQ ID NO: 18988 - DNA, 25 bp, Mus musculus
aaataatgccaggtttttgccaaga

SEQ ID NO: 18989 - DNA, 25 bp, Mus musculus
aaataatgcccgatgatgccttctt

SEQ ID NO: 18990 - DNA, 25 bp, Mus musculus
aaataatgcccgttgatgccttctt

SEQ ID NO: 18991 - DNA, 25 bp, Mus musculus
aaataatgcctcagtctagcatgcc

SEQ ID NO: 18992 - DNA, 25 bp, Mus musculus
aaataatgcctctgtctagcatgcc

SEQ ID NO: 18993 - DNA, 25 bp, Mus musculus
aaataatgctaaattcacagtgtga

SEQ ID NO: 18994 - DNA, 25 bp, Mus musculus
aaataatgctaatttcacagtgtga

SEQ ID NO: 18995 - DNA, 25 bp, Mus musculus
aaataatgctcacagctccactatt

SEQ ID NO: 18996 - DNA, 25 bp, Mus musculus
aaataatgctcagagctccactatt

SEQ ID NO: 18997 - DNA, 25 bp, Mus musculus
aaataatggcccagtcattgcctgt

SEQ ID NO: 18998 - DNA, 25 bp, Mus musculus
aaataatggccctgtcattgcctgt

SEQ ID NO: 18999 - DNA, 25 bp, Mus musculus
aaataattacatattgccaccctgt

SEQ ID NO: 19000 - DNA, 25 bp, Mus musculus
aaataattacattttgccaccctgt

SEQ ID NO: 19001 - DNA, 25 bp, Mus musculus
aaataattactacgcctggagggat

SEQ ID NO: 19002 - DNA, 25 bp, Mus musculus
aaataattactaggcctggagggat

SEQ ID NO: 19003 - DNA, 25 bp, Mus musculus
aaataattcaccaattttgtatttg

SEQ ID NO: 19004 - DNA, 25 bp, Mus musculus
aaataattcacctattttgtatttg

SEQ ID NO: 19005 - DNA, 25 bp, Mus musculus
aaataattccgtaccgagtggctgc

SEQ ID NO: 19006 - DNA, 25 bp, Mus musculus
aaataattccgttccgagtggctgc

SEQ ID NO: 19007 - DNA, 25 bp, Mus musculus
aaataattccttatgcactgtttgc

SEQ ID NO: 19008 - DNA, 25 bp, Mus musculus
aaataattccttttgcactgtttgc

SEQ ID NO: 19009 - DNA, 25 bp, Mus musculus
aaataattcttgagctcccttcttt

SEQ ID NO: 19010 - DNA, 25 bp, Mus musculus
aaataattcttgtgctcccttcttt

SEQ ID NO: 19011 - DNA, 25 bp, Mus musculus
aaataattgcacacacttggtggaa

SEQ ID NO: 19012 - DNA, 25 bp, Mus musculus
aaataattgcactcacttggtggaa

SEQ ID NO: 19013 - DNA, 25 bp, Mus musculus
aaataattgcttctcacctgattgc

SEQ ID NO: 19014 - DNA, 25 bp, Mus musculus
aaataattgcttgtcacctgattgc

SEQ ID NO: 19015 - DNA, 25 bp, Mus musculus
aaataatttcttcctgtgttatgtc

SEQ ID NO: 19016 - DNA, 25 bp, Mus musculus
aaataatttcttgctgtgttatgtc

SEQ ID NO: 19017 - DNA, 25 bp, Mus musculus
aaataattttatctgctggcttctg

SEQ ID NO: 19018 - DNA, 25 bp, Mus musculus
aaataattttatgtgctggcttctg

SEQ ID NO: 19019 - DNA, 25 bp, Mus musculus
aaatacaacagcacggctatttttt

SEQ ID NO: 19020 - DNA, 25 bp, Mus musculus
aaatacaacagctcggctatttttt

SEQ ID NO: 19021 - DNA, 25 bp, Mus musculus
aaatacaacatccatgggacaggaa

SEQ ID NO: 19022 - DNA, 25 bp, Mus musculus
aaatacaacatcgatgggacaggaa

SEQ ID NO: 19023 - DNA, 25 bp, Mus musculus
aaatacaaccagaacaggagacact

SEQ ID NO: 19024 - DNA, 25 bp, Mus musculus
aaatacaaccagtacaggagacact

SEQ ID NO: 19025 - DNA, 25 bp, Mus musculus
aaatacaagcccctagacctgcgac

SEQ ID NO: 19026 - DNA, 25 bp, Mus musculus
aaatacaagcccgtagacctgcgac

SEQ ID NO: 19027 - DNA, 25 bp, Mus musculus
aaatacaagcctcgattggaggtcc

SEQ ID NO: 19028 - DNA, 25 bp, Mus musculus
aaatacaagcctggattggaggtcc

SEQ ID NO: 19029 - DNA, 25 bp, Mus musculus
aaatacaagggccagaaggacctgg

SEQ ID NO: 19030 - DNA, 25 bp, Mus musculus
aaatacaagggcgagaaggacctgg

SEQ ID NO: 19031 - DNA, 25 bp, Mus musculus
aaatacaatcaacttcttacagact

SEQ ID NO: 19032 - DNA, 25 bp, Mus musculus
aaatacaatcaagttcttacagact

SEQ ID NO: 19033 - DNA, 25 bp, Mus musculus
aaatacaattatcttggcctctctc

SEQ ID NO: 19034 - DNA, 25 bp, Mus musculus
aaatacaattatgttggcctctctc

SEQ ID NO: 19035 - DNA, 25 bp, Mus musculus
aaatacaattgtagattctggctat

SEQ ID NO: 19036 - DNA, 25 bp, Mus musculus
aaatacaattgttgattctggctat

SEQ ID NO: 19037 - DNA, 25 bp, Mus musculus
aaatacacatgaccccattgctatt

SEQ ID NO: 19038 - DNA, 25 bp, Mus musculus
aaatacacatgagcccattgctatt

SEQ ID NO: 19039 - DNA, 25 bp, Mus musculus
aaatacacattacttctgtcatcta

SEQ ID NO: 19040 - DNA, 25 bp, Mus musculus
aaatacacattagttctgtcatcta

SEQ ID NO: 19041 - DNA, 25 bp, Mus musculus
aaatacaccatcacatcatagccca

SEQ ID NO: 19042 - DNA, 25 bp, Mus musculus
aaatacaccatctcatcatagccca

SEQ ID NO: 19043 - DNA, 25 bp, Mus musculus
aaatacacgtgtacagtcccgttca

SEQ ID NO: 19044 - DNA, 25 bp, Mus musculus
aaatacacgtgttcagtcccgttca

SEQ ID NO: 19045 - DNA, 25 bp, Mus musculus
aaatacacgttgcttcaggccaatg

SEQ ID NO: 19046 - DNA, 25 bp, Mus musculus
aaatacacgttggttcaggccaatg

SEQ ID NO: 19047 - DNA, 25 bp, Mus musculus
aaatacactcacagctggcgtggta

SEQ ID NO: 19048 - DNA, 25 bp, Mus musculus
aaatacactcactgctggcgtggta

SEQ ID NO: 19049 - DNA, 25 bp, Mus musculus
aaatacactgaacgcaccagccaga

SEQ ID NO: 19050 - DNA, 25 bp, Mus musculus
aaatacactgaaggcaccagccaga

SEQ ID NO: 19051 - DNA, 25 bp, Mus musculus
aaatacagaccccagacagcttgac

SEQ ID NO: 19052 - DNA, 25 bp, Mus musculus
aaatacagacccgagacagcttgac

SEQ ID NO: 19053 - DNA, 25 bp, Mus musculus
aaatacagatttctgtcccgtgcca

SEQ ID NO: 19054 - DNA, 25 bp, Mus musculus
aaatacagatttgtgtcccgtgcca

SEQ ID NO: 19055 - DNA, 25 bp, Mus musculus
aaatacagcatcaccgtaaggcata

SEQ ID NO: 19056 - DNA, 25 bp, Mus musculus
aaatacagcatctccgtaaggcata

SEQ ID NO: 19057 - DNA, 25 bp, Mus musculus
aaatacagctgcctggcttggtggc

SEQ ID NO: 19058 - DNA, 25 bp, Mus musculus
aaatacagctgcgtggcttggtggc

SEQ ID NO: 19059 - DNA, 25 bp, Mus musculus
aaatacaggaagagaccgtagccct

SEQ ID NO: 19060 - DNA, 25 bp, Mus musculus
aaatacaggaagtgaccgtagccct

SEQ ID NO: 19061 - DNA, 25 bp, Mus musculus
aaatacaggcatccccatctctaaa

SEQ ID NO: 19062 - DNA, 25 bp, Mus musculus
aaatacaggcatgcccatctctaaa

SEQ ID NO: 19063 - DNA, 25 bp, Mus musculus
aaatacagtattaggagcatcccta

SEQ ID NO: 19064 - DNA, 25 bp, Mus musculus
aaatacagtatttggagcatcccta

SEQ ID NO: 19065 - DNA, 25 bp, Mus musculus
aaatacagtctacttacagtggtga

SEQ ID NO: 19066 - DNA, 25 bp, Mus musculus
aaatacagtctagttacagtggtga

SEQ ID NO: 19067 - DNA, 25 bp, Mus musculus
aaatacagtgctctcgtccttaccc

SEQ ID NO: 19068 - DNA, 25 bp, Mus musculus
aaatacagtgctgtcgtccttaccc

SEQ ID NO: 19069 - DNA, 25 bp, Mus musculus
aaatacagtgtaatagcctcaggat

SEQ ID NO: 19070 - DNA, 25 bp, Mus musculus
aaatacagtgtattagcctcaggat

SEQ ID NO: 19071 - DNA, 25 bp, Mus musculus
aaatacatacgtacatcctcactgt

SEQ ID NO: 19072 - DNA, 25 bp, Mus musculus
aaatacatacgttcatcctcactgt

SEQ ID NO: 19073 - DNA, 25 bp, Mus musculus
aaatacatagggagagctgtttcaa

SEQ ID NO: 19074 - DNA, 25 bp, Mus musculus
aaatacatagggtgagctgtttcaa

SEQ ID NO: 19075 - DNA, 25 bp, Mus musculus
aaatacatagttatgctcagagagg

SEQ ID NO: 19076 - DNA, 25 bp, Mus musculus
aaatacatagttcttgtacctgcta

SEQ ID NO: 19077 - DNA, 25 bp, Mus musculus
aaatacatagttgttgtacctgcta

SEQ ID NO: 19078 - DNA, 25 bp, Mus musculus
aaatacatagttttgctcagagagg

SEQ ID NO: 19079 - DNA, 25 bp, Mus musculus
aaatacatcatgacgggttgccaca

SEQ ID NO: 19080 - DNA, 25 bp, Mus musculus
aaatacatcatgtcgggttgccaca

SEQ ID NO: 19081 - DNA, 25 bp, Mus musculus
aaatacatctctcaatgcctacctt

SEQ ID NO: 19082 - DNA, 25 bp, Mus musculus
aaatacatctctgaatgcctacctt

SEQ ID NO: 19083 - DNA, 25 bp, Mus musculus
aaatacatgagtactggccccgtgg

SEQ ID NO: 19084 - DNA, 25 bp, Mus musculus
aaatacatgagttctggccccgtgg

SEQ ID NO: 19085 - DNA, 25 bp, Mus musculus
aaatacatgtaactcagtcctgagg

SEQ ID NO: 19086 - DNA, 25 bp, Mus musculus
aaatacatgtaagtcagtcctgagg

SEQ ID NO: 19087 - DNA, 25 bp, Mus musculus
aaatacattcccagacgctttgctg

SEQ ID NO: 19088 - DNA, 25 bp, Mus musculus
aaatacattccctgacgctttgctg

SEQ ID NO: 19089 - DNA, 25 bp, Mus musculus
aaatacattgttagcgtccctcatt

SEQ ID NO: 19090 - DNA, 25 bp, Mus musculus
aaatacattgtttgcgtccctcatt

SEQ ID NO: 19091 - DNA, 25 bp, Mus musculus
aaatacatttagacaggcatgctga

SEQ ID NO: 19092 - DNA, 25 bp, Mus musculus
aaatacatttagtcaggcatgctga

SEQ ID NO: 19093 - DNA, 25 bp, Mus musculus
aaatacatttgcagtcagaaacccc

SEQ ID NO: 19094 - DNA, 25 bp, Mus musculus
aaatacatttgctgtcagaaacccc

SEQ ID NO: 19095 - DNA, 25 bp, Mus musculus
aaataccaagatataggtccaggct

SEQ ID NO: 19096 - DNA, 25 bp, Mus musculus
aaataccaagatttaggtccaggct

SEQ ID NO: 19097 - DNA, 25 bp, Mus musculus
aaataccaagggaggagatgctcca

SEQ ID NO: 19098 - DNA, 25 bp, Mus musculus
aaataccaagggtggagatgctcca

SEQ ID NO: 19099 - DNA, 25 bp, Mus musculus
aaataccaattaattccccagcctg

SEQ ID NO: 19100 - DNA, 25 bp, Mus musculus
aaataccaattatttccccagcctg

SEQ ID NO: 19101 - DNA, 25 bp, Mus musculus
aaataccacactctatgggtcaggg

SEQ ID NO: 19102 - DNA, 25 bp, Mus musculus
aaataccacactgtatgggtcaggg

SEQ ID NO: 19103 - DNA, 25 bp, Mus musculus
aaataccactataacatctttaggg

SEQ ID NO: 19104 - DNA, 25 bp, Mus musculus
aaataccactattacatctttaggg

SEQ ID NO: 19105 - DNA, 25 bp, Mus musculus
aaataccagcagctccttttcacag

SEQ ID NO: 19106 - DNA, 25 bp, Mus musculus
aaataccagcaggtccttttcacag

SEQ ID NO: 19107 - DNA, 25 bp, Mus musculus
aaataccagcctaaactatgcagcc

SEQ ID NO: 19108 - DNA, 25 bp, Mus musculus
aaataccagccttaactatgcagcc

SEQ ID NO: 19109 - DNA, 25 bp, Mus musculus
aaataccaggagagactcctgccag

SEQ ID NO: 19110 - DNA, 25 bp, Mus musculus
aaataccaggagtgactcctgccag

SEQ ID NO: 19111 - DNA, 25 bp, Mus musculus
aaataccaggctagtagggctacat

SEQ ID NO: 19112 - DNA, 25 bp, Mus musculus
aaataccaggcttgtagggctacat

SEQ ID NO: 19113 - DNA, 25 bp, Mus musculus
aaataccaggttcccagttgcatcc

SEQ ID NO: 19114 - DNA, 25 bp, Mus musculus
aaataccaggttgccagttgcatcc

SEQ ID NO: 19115 - DNA, 25 bp, Mus musculus
aaataccagtacatgcagggtgtat

SEQ ID NO: 19116 - DNA, 25 bp, Mus musculus
aaataccagtacttgcagggtgtat

SEQ ID NO: 19117 - DNA, 25 bp, Mus musculus
aaataccagtgtcccctctaacctg

SEQ ID NO: 19118 - DNA, 25 bp, Mus musculus
aaataccagtgtgccctctaacctg

SEQ ID NO: 19119 - DNA, 25 bp, Mus musculus
aaataccatacgactgaggcagact

SEQ ID NO: 19120 - DNA, 25 bp, Mus musculus
aaataccatacgtctgaggcagact

SEQ ID NO: 19121 - DNA, 25 bp, Mus musculus
aaataccatcccactgtgagagtgc

SEQ ID NO: 19122 - DNA, 25 bp, Mus musculus
aaataccatccctctgtgagagtgc

SEQ ID NO: 19123 - DNA, 25 bp, Mus musculus
aaataccatgataattccttgcaat

SEQ ID NO: 19124 - DNA, 25 bp, Mus musculus
aaataccatgattattccttgcaat

SEQ ID NO: 19125 - DNA, 25 bp, Mus musculus
aaataccattgcacaaacccctcag

SEQ ID NO: 19126 - DNA, 25 bp, Mus musculus
aaataccattgctcaaacccctcag

SEQ ID NO: 19127 - DNA, 25 bp, Mus musculus
aaataccatttccaacacagctacc

SEQ ID NO: 19128 - DNA, 25 bp, Mus musculus
aaataccatttcgaacacagctacc

SEQ ID NO: 19129 - DNA, 25 bp, Mus musculus
aaatacccaatgacttctgattttt

SEQ ID NO: 19130 - DNA, 25 bp, Mus musculus
aaatacccaatgtcttctgattttt

SEQ ID NO: 19131 - DNA, 25 bp, Mus musculus
aaatacccacgtacaggcgtatcct

SEQ ID NO: 19132 - DNA, 25 bp, Mus musculus
aaatacccacgttcaggcgtatcct

SEQ ID NO: 19133 - DNA, 25 bp, Mus musculus
aaatacccagtgatgggctggctca

SEQ ID NO: 19134 - DNA, 25 bp, Mus musculus
aaatacccagtgttgggctggctca

SEQ ID NO: 19135 - DNA, 25 bp, Mus musculus
aaatacccagttaccatctatcttt

SEQ ID NO: 19136 - DNA, 25 bp, Mus musculus
aaatacccagtttccatctatcttt

SEQ ID NO: 19137 - DNA, 25 bp, Mus musculus
aaataccccagtcactaagtagaat

SEQ ID NO: 19138 - DNA, 25 bp, Mus musculus
aaataccccagtgactaagtagaat

SEQ ID NO: 19139 - DNA, 25 bp, Mus musculus
aaataccccttcctaaatgtcatct

SEQ ID NO: 19140 - DNA, 25 bp, Mus musculus
aaataccccttcgtaaatgtcatct

SEQ ID NO: 19141 - DNA, 25 bp, Mus musculus
aaatacccttgtcaagccagggcct

SEQ ID NO: 19142 - DNA, 25 bp, Mus musculus
aaatacccttgtgaagccagggcct

SEQ ID NO: 19143 - DNA, 25 bp, Mus musculus
aaataccggctaccttgggttacat

SEQ ID NO: 19144 - DNA, 25 bp, Mus musculus
aaataccggctagcttgggttacat

SEQ ID NO: 19145 - DNA, 25 bp, Mus musculus
aaatacctaagaaaacacataccat

SEQ ID NO: 19146 - DNA, 25 bp, Mus musculus
aaatacctaagataacacataccat

SEQ ID NO: 19147 - DNA, 25 bp, Mus musculus
aaatacctactaagtgaccggcatt

SEQ ID NO: 19148 - DNA, 25 bp, Mus musculus
aaatacctactatgtgaccggcatt

SEQ ID NO: 19149 - DNA, 25 bp, Mus musculus
aaatacctcaccctaagttcaatca

SEQ ID NO: 19150 - DNA, 25 bp, Mus musculus
aaatacctcaccgtaagttcaatca

SEQ ID NO: 19151 - DNA, 25 bp, Mus musculus
aaatacctcatcatggaagctgtcg

SEQ ID NO: 19152 - DNA, 25 bp, Mus musculus
aaatacctcatcattcaataaagct

SEQ ID NO: 19153 - DNA, 25 bp, Mus musculus
aaatacctcatcttggaagctgtcg

SEQ ID NO: 19154 - DNA, 25 bp, Mus musculus
aaatacctcatctttcaataaagct

SEQ ID NO: 19155 - DNA, 25 bp, Mus musculus
aaatacctcctaaaactgcatggca

SEQ ID NO: 19156 - DNA, 25 bp, Mus musculus
aaatacctcctataactgcatggca

SEQ ID NO: 19157 - DNA, 25 bp, Mus musculus
aaatacctggatcctgagtacattg

SEQ ID NO: 19158 - DNA, 25 bp, Mus musculus
aaatacctggatgctgagtacattg

SEQ ID NO: 19159 - DNA, 25 bp, Mus musculus
aaatacctggcacctttgtgcaatt

SEQ ID NO: 19160 - DNA, 25 bp, Mus musculus
aaatacctggcagctttgtgcaatt

SEQ ID NO: 19161 - DNA, 25 bp, Mus musculus
aaatacctggccaaaaccgtcactg

SEQ ID NO: 19162 - DNA, 25 bp, Mus musculus
aaatacctggcctaaaccgtcactg

SEQ ID NO: 19163 - DNA, 25 bp, Mus musculus
aaatacctggttcctgacagtcttc

SEQ ID NO: 19164 - DNA, 25 bp, Mus musculus
aaatacctggttgctgacagtcttc

SEQ ID NO: 19165 - DNA, 25 bp, Mus musculus
aaatacctgtgaccttgttttttgg

SEQ ID NO: 19166 - DNA, 25 bp, Mus musculus
aaatacctgtgagcttgttttttgg

SEQ ID NO: 19167 - DNA, 25 bp, Mus musculus
aaatacctgtgcatacccaatttgc

SEQ ID NO: 19168 - DNA, 25 bp, Mus musculus
aaatacctgtgcttacccaatttgc

SEQ ID NO: 19169 - DNA, 25 bp, Mus musculus
aaataccttcaacatccactggtgc

SEQ ID NO: 19170 - DNA, 25 bp, Mus musculus
aaataccttcaagatccactggtgc

SEQ ID NO: 19171 - DNA, 25 bp, Mus musculus
aaataccttgcccagtgtctaggca

SEQ ID NO: 19172 - DNA, 25 bp, Mus musculus
aaataccttgccgagtgtctaggca

SEQ ID NO: 19173 - DNA, 25 bp, Mus musculus
aaataccttgctagacctctgttgg

SEQ ID NO: 19174 - DNA, 25 bp, Mus musculus
aaataccttgcttgacctctgttgg

SEQ ID NO: 19175 - DNA, 25 bp, Mus musculus
aaatacgaaatcaacgttctgcgaa

SEQ ID NO: 19176 - DNA, 25 bp, Mus musculus
aaatacgaaatctacgttctgcgaa

SEQ ID NO: 19177 - DNA, 25 bp, Mus musculus
aaatacgaatcaaaaccaagtgaat

SEQ ID NO: 19178 - DNA, 25 bp, Mus musculus
aaatacgaatcataaccaagtgaat

SEQ ID NO: 19179 - DNA, 25 bp, Mus musculus
aaatacgacaggagtgtcccctgcc

SEQ ID NO: 19180 - DNA, 25 bp, Mus musculus
aaatacgacaggtgtgtcccctgcc

SEQ ID NO: 19181 - DNA, 25 bp, Mus musculus
aaatacgacattcaactagactggt

SEQ ID NO: 19182 - DNA, 25 bp, Mus musculus
aaatacgacattgaactagactggt

SEQ ID NO: 19183 - DNA, 25 bp, Mus musculus
aaatacgccgacctttctcataatc

SEQ ID NO: 19184 - DNA, 25 bp, Mus musculus
aaatacgccgacgtttctcataatc

SEQ ID NO: 19185 - DNA, 25 bp, Mus musculus
aaatacgcctctctcatatgctcca

SEQ ID NO: 19186 - DNA, 25 bp, Mus musculus
aaatacgcctctgtcatatgctcca

SEQ ID NO: 19187 - DNA, 25 bp, Mus musculus
aaatacgcttctacgtcatgttgtg

SEQ ID NO: 19188 - DNA, 25 bp, Mus musculus
aaatacgcttcttcgtcatgttgtg

SEQ ID NO: 19189 - DNA, 25 bp, Mus musculus
aaatacggaaccagtgagcccttca

SEQ ID NO: 19190 - DNA, 25 bp, Mus musculus
aaatacggaacctgtgagcccttca

SEQ ID NO: 19191 - DNA, 25 bp, Mus musculus
aaatacggacagcttggccacaagg

SEQ ID NO: 19192 - DNA, 25 bp, Mus musculus
aaatacggacaggttggccacaagg

SEQ ID NO: 19193 - DNA, 25 bp, Mus musculus
aaatacggcagacaattccccagct

SEQ ID NO: 19194 - DNA, 25 bp, Mus musculus
aaatacggcagagaattccccagct

SEQ ID NO: 19195 - DNA, 25 bp, Mus musculus
aaatacggcgctcgcaagaagcccc

SEQ ID NO: 19196 - DNA, 25 bp, Mus musculus
aaatacggcgctggcaagaagcccc

SEQ ID NO: 19197 - DNA, 25 bp, Mus musculus
aaatacggtattagctttgattcca

SEQ ID NO: 19198 - DNA, 25 bp, Mus musculus
aaatacggtatttgctttgattcca

SEQ ID NO: 19199 - DNA, 25 bp, Mus musculus
aaatacgtatttcttgtccacacca

SEQ ID NO: 19200 - DNA, 25 bp, Mus musculus
aaatacgtatttgttgtccacacca

SEQ ID NO: 19201 - DNA, 25 bp, Mus musculus
aaatacgtctgcacccctgggttca

SEQ ID NO: 19202 - DNA, 25 bp, Mus musculus
aaatacgtctgctcccctgggttca

SEQ ID NO: 19203 - DNA, 25 bp, Mus musculus
aaatacgtgcgtagcctgtgacgtt

SEQ ID NO: 19204 - DNA, 25 bp, Mus musculus
aaatacgtgcgttgcctgtgacgtt

SEQ ID NO: 19205 - DNA, 25 bp, Mus musculus
aaatacgtgtccagtaatttcagca

SEQ ID NO: 19206 - DNA, 25 bp, Mus musculus
aaatacgtgtcctgtaatttcagca

SEQ ID NO: 19207 - DNA, 25 bp, Mus musculus
aaatacgttccaactttgcaagctg

SEQ ID NO: 19208 - DNA, 25 bp, Mus musculus
aaatacgttccatctttgcaagctg

SEQ ID NO: 19209 - DNA, 25 bp, Mus musculus
aaatacgttggactggtgcctgcca

SEQ ID NO: 19210 - DNA, 25 bp, Mus musculus
aaatacgttggagtggtgcctgcca

SEQ ID NO: 19211 - DNA, 25 bp, Mus musculus
aaatactaacacctgacttcctatc

SEQ ID NO: 19212 - DNA, 25 bp, Mus musculus
aaatactaacacgtgacttcctatc

SEQ ID NO: 19213 - DNA, 25 bp, Mus musculus
aaatactaagtgagtgcggcggtca

SEQ ID NO: 19214 - DNA, 25 bp, Mus musculus
aaatactaagtgtgtgcggcggtca

SEQ ID NO: 19215 - DNA, 25 bp, Mus musculus
aaatactacggcaagctgcttcctt

SEQ ID NO: 19216 - DNA, 25 bp, Mus musculus
aaatactacggctagctgcttcctt

SEQ ID NO: 19217 - DNA, 25 bp, Mus musculus
aaatactactgcactgaccagcaca

SEQ ID NO: 19218 - DNA, 25 bp, Mus musculus
aaatactactgctctgaccagcaca

SEQ ID NO: 19219 - DNA, 25 bp, Mus musculus
aaatactagactacattaggcaggg

SEQ ID NO: 19220 - DNA, 25 bp, Mus musculus
aaatactagacttcattaggcaggg

SEQ ID NO: 19221 - DNA, 25 bp, Mus musculus
aaatactattcccaccacacatacg

SEQ ID NO: 19222 - DNA, 25 bp, Mus musculus
aaatactattccgaccacacatacg

SEQ ID NO: 19223 - DNA, 25 bp, Mus musculus
aaatactcacctacaagccctaaat

SEQ ID NO: 19224 - DNA, 25 bp, Mus musculus
aaatactcaccttcaagccctaaat

SEQ ID NO: 19225 - DNA, 25 bp, Mus musculus
aaatactcagccatgcactgctgtg

SEQ ID NO: 19226 - DNA, 25 bp, Mus musculus
aaatactcagccttgcactgctgtg

SEQ ID NO: 19227 - DNA, 25 bp, Mus musculus
aaatactcatcaatgtttgtgtgga

SEQ ID NO: 19228 - DNA, 25 bp, Mus musculus
aaatactcatcattgtttgtgtgga

SEQ ID NO: 19229 - DNA, 25 bp, Mus musculus
aaatactcatgcaggctaacgaagg

SEQ ID NO: 19230 - DNA, 25 bp, Mus musculus
aaatactcatgctggctaacgaagg

SEQ ID NO: 19231 - DNA, 25 bp, Mus musculus
aaatactcatgtccatttcaaaata

SEQ ID NO: 19232 - DNA, 25 bp, Mus musculus
aaatactcatgtgcatttcaaaata

SEQ ID NO: 19233 - DNA, 25 bp, Mus musculus
aaatactccatcaaagttcccgaag

SEQ ID NO: 19234 - DNA, 25 bp, Mus musculus
aaatactccatctaagttcccgaag

SEQ ID NO: 19235 - DNA, 25 bp, Mus musculus
aaatactctcaaacccgtgtacaac

SEQ ID NO: 19236 - DNA, 25 bp, Mus musculus
aaatactctcaatcccgtgtacaac

SEQ ID NO: 19237 - DNA, 25 bp, Mus musculus
aaatactctgacagggcagccggct

SEQ ID NO: 19238 - DNA, 25 bp, Mus musculus
aaatactctgactgggcagccggct

SEQ ID NO: 19239 - DNA, 25 bp, Mus musculus
aaatactctggtagcctctgatcca

SEQ ID NO: 19240 - DNA, 25 bp, Mus musculus
aaatactctggttgcctctgatcca

SEQ ID NO: 19241 - DNA, 25 bp, Mus musculus
aaatactcttgccaggatcagaagc

SEQ ID NO: 19242 - DNA, 25 bp, Mus musculus
aaatactcttgcgaggatcagaagc

SEQ ID NO: 19243 - DNA, 25 bp, Mus musculus
aaatactgaatgctcttgggtctgt

SEQ ID NO: 19244 - DNA, 25 bp, Mus musculus
aaatactgaatggtcttgggtctgt

SEQ ID NO: 19245 - DNA, 25 bp, Mus musculus
aaatactgacgtatacatagaatgt

SEQ ID NO: 19246 - DNA, 25 bp, Mus musculus
aaatactgacgtttacatagaatgt

SEQ ID NO: 19247 - DNA, 25 bp, Mus musculus
aaatactgactgagctaccctgagc

SEQ ID NO: 19248 - DNA, 25 bp, Mus musculus
aaatactgactgtgctaccctgagc

SEQ ID NO: 19249 - DNA, 25 bp, Mus musculus
aaatactgatcacccttttctgtct

SEQ ID NO: 19250 - DNA, 25 bp, Mus musculus
aaatactgatcagccttttctgtct

SEQ ID NO: 19251 - DNA, 25 bp, Mus musculus
aaatactgatttaagcttgtgacta

SEQ ID NO: 19252 - DNA, 25 bp, Mus musculus
aaatactgatttcgctggtctttat

SEQ ID NO: 19253 - DNA, 25 bp, Mus musculus
aaatactgatttggctggtctttat

SEQ ID NO: 19254 - DNA, 25 bp, Mus musculus
aaatactgattttagcttgtgacta

SEQ ID NO: 19255 - DNA, 25 bp, Mus musculus
aaatactgcactaacagtccacctt

SEQ ID NO: 19256 - DNA, 25 bp, Mus musculus
aaatactgcacttacagtccacctt

SEQ ID NO: 19257 - DNA, 25 bp, Mus musculus
aaatactgcagcctgtgcttacatc

SEQ ID NO: 19258 - DNA, 25 bp, Mus musculus
aaatactgcagcgtgtgcttacatc

SEQ ID NO: 19259 - DNA, 25 bp, Mus musculus
aaatactgccatacctggcgctgca

SEQ ID NO: 19260 - DNA, 25 bp, Mus musculus
aaatactgccattcctggcgctgca

SEQ ID NO: 19261 - DNA, 25 bp, Mus musculus
aaatactgctttcctttcccagctg

SEQ ID NO: 19262 - DNA, 25 bp, Mus musculus
aaatactgctttgctttcccagctg

SEQ ID NO: 19263 - DNA, 25 bp, Mus musculus
aaatactggaccaattttgcccgca

SEQ ID NO: 19264 - DNA, 25 bp, Mus musculus
aaatactggacctattttgcccgca

SEQ ID NO: 19265 - DNA, 25 bp, Mus musculus
aaatactggactaaatttgttgcca

SEQ ID NO: 19266 - DNA, 25 bp, Mus musculus
aaatactggacttaatttgttgcca

SEQ ID NO: 19267 - DNA, 25 bp, Mus musculus
aaatactggcagatgacgtcccctg

SEQ ID NO: 19268 - DNA, 25 bp, Mus musculus
aaatactggcagttgacgtcccctg

SEQ ID NO: 19269 - DNA, 25 bp, Mus musculus
aaatactggcctatctcggaggagc

SEQ ID NO: 19270 - DNA, 25 bp, Mus musculus
aaatactggcctttctcggaggagc

SEQ ID NO: 19271 - DNA, 25 bp, Mus musculus
aaatactggctacacggtgccctta

SEQ ID NO: 19272 - DNA, 25 bp, Mus musculus
aaatactggctagacggtgccctta

SEQ ID NO: 19273 - DNA, 25 bp, Mus musculus
aaatactgggcgcttgcattgcccg

SEQ ID NO: 19274 - DNA, 25 bp, Mus musculus
aaatactgggcggttgcattgcccg

SEQ ID NO: 19275 - DNA, 25 bp, Mus musculus
aaatactgggtcatattgctgtggt

SEQ ID NO: 19276 - DNA, 25 bp, Mus musculus
aaatactgggtcttattgctgtggt

SEQ ID NO: 19277 - DNA, 25 bp, Mus musculus
aaatactggtgtatcccctgacttg

SEQ ID NO: 19278 - DNA, 25 bp, Mus musculus
aaatactggtgtttcccctgacttg

SEQ ID NO: 19279 - DNA, 25 bp, Mus musculus
aaatactgtaatcgtgcctggcacc

SEQ ID NO: 19280 - DNA, 25 bp, Mus musculus
aaatactgtaatggtgcctggcacc

SEQ ID NO: 19281 - DNA, 25 bp, Mus musculus
aaatactgtacaccccaaggacata

SEQ ID NO: 19282 - DNA, 25 bp, Mus musculus
aaatactgtacagcccaaggacata

SEQ ID NO: 19283 - DNA, 25 bp, Mus musculus
aaatactgtactagctatagaacca

SEQ ID NO: 19284 - DNA, 25 bp, Mus musculus
aaatactgtacttgctatagaacca

SEQ ID NO: 19285 - DNA, 25 bp, Mus musculus
aaatactgtctgaactaaactgtat

SEQ ID NO: 19286 - DNA, 25 bp, Mus musculus
aaatactgtctgtactaaactgtat

SEQ ID NO: 19287 - DNA, 25 bp, Mus musculus
aaatactgtcttctctttaggttga

SEQ ID NO: 19288 - DNA, 25 bp, Mus musculus
aaatactgtcttgtctttaggttga

SEQ ID NO: 19289 - DNA, 25 bp, Mus musculus
aaatactgtgttccatgctatatac

SEQ ID NO: 19290 - DNA, 25 bp, Mus musculus
aaatactgtgttgcatgctatatac

SEQ ID NO: 19291 - DNA, 25 bp, Mus musculus
aaatacttacccagagatttgtggt

SEQ ID NO: 19292 - DNA, 25 bp, Mus musculus
aaatacttaccctgagatttgtggt

SEQ ID NO: 19293 - DNA, 25 bp, Mus musculus
aaatacttcacgcatatgtcagcag

SEQ ID NO: 19294 - DNA, 25 bp, Mus musculus
aaatacttcacggatatgtcagcag

SEQ ID NO: 19295 - DNA, 25 bp, Mus musculus
aaatacttcagaactggcttctttt

SEQ ID NO: 19296 - DNA, 25 bp, Mus musculus
aaatacttcagatctggcttctttt

SEQ ID NO: 19297 - DNA, 25 bp, Mus musculus
aaatacttccagagttcctcatcat

SEQ ID NO: 19298 - DNA, 25 bp, Mus musculus
aaatacttccagtgttcctcatcat

SEQ ID NO: 19299 - DNA, 25 bp, Mus musculus
aaatacttcgctctcagggtccgtg

SEQ ID NO: 19300 - DNA, 25 bp, Mus musculus
aaatacttcgctgtcagggtccgtg

SEQ ID NO: 19301 - DNA, 25 bp, Mus musculus
aaatacttgaaaagtatgtctcggg

SEQ ID NO: 19302 - DNA, 25 bp, Mus musculus
aaatacttgaaatgtatgtctcggg

SEQ ID NO: 19303 - DNA, 25 bp, Mus musculus
aaatactttcaacttcagccaatgt

SEQ ID NO: 19304 - DNA, 25 bp, Mus musculus
aaatactttcaagttcagccaatgt

SEQ ID NO: 19305 - DNA, 25 bp, Mus musculus
aaatactttcacctgctctgtgtta

SEQ ID NO: 19306 - DNA, 25 bp, Mus musculus
aaatactttcacgtgctctgtgtta

SEQ ID NO: 19307 - DNA, 25 bp, Mus musculus
aaatactttctgctattaactgaat

SEQ ID NO: 19308 - DNA, 25 bp, Mus musculus
aaatactttctggtattaactgaat

SEQ ID NO: 19309 - DNA, 25 bp, Mus musculus
aaatactttgcaatccagccttgcc

SEQ ID NO: 19310 - DNA, 25 bp, Mus musculus
aaatactttgcattccagccttgcc

SEQ ID NO: 19311 - DNA, 25 bp, Mus musculus
aaatacttttacaccagctattaat

SEQ ID NO: 19312 - DNA, 25 bp, Mus musculus
aaatacttttactccagctattaat

SEQ ID NO: 19313 - DNA, 25 bp, Mus musculus
aaatacttttccacacaattcccag

SEQ ID NO: 19314 - DNA, 25 bp, Mus musculus
aaatacttttcctcacaattcccag

SEQ ID NO: 19315 - DNA, 25 bp, Mus musculus
aaatacttttgtccttctgcatagc

SEQ ID NO: 19316 - DNA, 25 bp, Mus musculus
aaatacttttgtgcttctgcatagc

SEQ ID NO: 19317 - DNA, 25 bp, Mus musculus
aaatagaaaccaccaagtgtatact

SEQ ID NO: 19318 - DNA, 25 bp, Mus musculus
aaatagaaaccagcaagtgtatact

SEQ ID NO: 19319 - DNA, 25 bp, Mus musculus
aaatagaacactcgcaccctcctga

SEQ ID NO: 19320 - DNA, 25 bp, Mus musculus
aaatagaacactggcaccctcctga

SEQ ID NO: 19321 - DNA, 25 bp, Mus musculus
aaatagaacgttcctcaggccttca

SEQ ID NO: 19322 - DNA, 25 bp, Mus musculus
aaatagaacgttgctcaggccttca

SEQ ID NO: 19323 - DNA, 25 bp, Mus musculus
aaatagaactccaggctaacccagg

SEQ ID NO: 19324 - DNA, 25 bp, Mus musculus
aaatagaactcctggctaacccagg

SEQ ID NO: 19325 - DNA, 25 bp, Mus musculus
aaatagaactgtactccctcacagt

SEQ ID NO: 19326 - DNA, 25 bp, Mus musculus
aaatagaactgttctccctcacagt

SEQ ID NO: 19327 - DNA, 25 bp, Mus musculus
aaatagaacttccacacatgcttgt

SEQ ID NO: 19328 - DNA, 25 bp, Mus musculus
aaatagaacttcgacacatgcttgt

SEQ ID NO: 19329 - DNA, 25 bp, Mus musculus
aaatagaagctcagttcttgccctc

SEQ ID NO: 19330 - DNA, 25 bp, Mus musculus
aaatagaagctctgttcttgccctc

SEQ ID NO: 19331 - DNA, 25 bp, Mus musculus
aaatagacatggagtgggggctccc

SEQ ID NO: 19332 - DNA, 25 bp, Mus musculus
aaatagacatggtgtgggggctccc

SEQ ID NO: 19333 - DNA, 25 bp, Mus musculus
aaatagaccctgaaaatctccactt

SEQ ID NO: 19334 - DNA, 25 bp, Mus musculus
aaatagaccctgtaaatctccactt

SEQ ID NO: 19335 - DNA, 25 bp, Mus musculus
aaatagacctcaagtttccaaccca

SEQ ID NO: 19336 - DNA, 25 bp, Mus musculus
aaatagacctcatgtttccaaccca

SEQ ID NO: 19337 - DNA, 25 bp, Mus musculus
aaatagaccttcattctgactgaat

SEQ ID NO: 19338 - DNA, 25 bp, Mus musculus
aaatagaccttctttctgactgaat

SEQ ID NO: 19339 - DNA, 25 bp, Mus musculus
aaatagactacaccgatgccccgga

SEQ ID NO: 19340 - DNA, 25 bp, Mus musculus
aaatagactacagcgatgccccgga

SEQ ID NO: 19341 - DNA, 25 bp, Mus musculus
aaatagactcacatttccatcaata

SEQ ID NO: 19342 - DNA, 25 bp, Mus musculus
aaatagactcacttttccatcaata

SEQ ID NO: 19343 - DNA, 25 bp, Mus musculus
aaatagactctgaggctcttcattt

SEQ ID NO: 19344 - DNA, 25 bp, Mus musculus
aaatagactctgtggctcttcattt

SEQ ID NO: 19345 - DNA, 25 bp, Mus musculus
aaatagagcagacggagccgcctcc

SEQ ID NO: 19346 - DNA, 25 bp, Mus musculus
aaatagagcagagggagccgcctcc

SEQ ID NO: 19347 - DNA, 25 bp, Mus musculus
aaatagagcatgatctaaagcccct

SEQ ID NO: 19348 - DNA, 25 bp, Mus musculus
aaatagagcatgttctaaagcccct

SEQ ID NO: 19349 - DNA, 25 bp, Mus musculus
aaatagaggcctatatctgtcccct

SEQ ID NO: 19350 - DNA, 25 bp, Mus musculus
aaatagaggcctttatctgtcccct

SEQ ID NO: 19351 - DNA, 25 bp, Mus musculus
aaatagatatctctgcctttaaagg

SEQ ID NO: 19352 - DNA, 25 bp, Mus musculus
aaatagatatctgtgcctttaaagg

SEQ ID NO: 19353 - DNA, 25 bp, Mus musculus
aaatagatatgcacattttttaagt

SEQ ID NO: 19354 - DNA, 25 bp, Mus musculus
aaatagatatgctcattttttaagt

SEQ ID NO: 19355 - DNA, 25 bp, Mus musculus
aaatagatccatacctgtcacctca

SEQ ID NO: 19356 - DNA, 25 bp, Mus musculus
aaatagatccattcctgtcacctca

SEQ ID NO: 19357 - DNA, 25 bp, Mus musculus
aaatagatgaacacatttccttctc

SEQ ID NO: 19358 - DNA, 25 bp, Mus musculus
aaatagatgaactcatttccttctc

SEQ ID NO: 19359 - DNA, 25 bp, Mus musculus
aaatagatgcctcagccagacacag

SEQ ID NO: 19360 - DNA, 25 bp, Mus musculus
aaatagatgcctgagccagacacag

SEQ ID NO: 19361 - DNA, 25 bp, Mus musculus
aaatagatgctgaacctagtcaaca

SEQ ID NO: 19362 - DNA, 25 bp, Mus musculus
aaatagatgctgaatgccctgttca

SEQ ID NO: 19363 - DNA, 25 bp, Mus musculus
aaatagatgctgtacctagtcaaca

SEQ ID NO: 19364 - DNA, 25 bp, Mus musculus
aaatagatgctgtatgccctgttca

SEQ ID NO: 19365 - DNA, 25 bp, Mus musculus
aaatagatgtatatgtccaaggctt

SEQ ID NO: 19366 - DNA, 25 bp, Mus musculus
aaatagatgtatttgtccaaggctt

SEQ ID NO: 19367 - DNA, 25 bp, Mus musculus
aaatagattggtcctgttgttccta

SEQ ID NO: 19368 - DNA, 25 bp, Mus musculus
aaatagattggtgctgttgttccta

SEQ ID NO: 19369 - DNA, 25 bp, Mus musculus
aaatagattgttaatggactcacca

SEQ ID NO: 19370 - DNA, 25 bp, Mus musculus
aaatagattgtttatggactcacca

SEQ ID NO: 19371 - DNA, 25 bp, Mus musculus
aaatagcaaagcagccaggcggtgg

SEQ ID NO: 19372 - DNA, 25 bp, Mus musculus
aaatagcaaagctgccaggcggtgg

SEQ ID NO: 19373 - DNA, 25 bp, Mus musculus
aaatagcaacatctcgagctctcag

SEQ ID NO: 19374 - DNA, 25 bp, Mus musculus
aaatagcaacatgtcgagctctcag

SEQ ID NO: 19375 - DNA, 25 bp, Mus musculus
aaatagcacaacacaacccccaggt

SEQ ID NO: 19376 - DNA, 25 bp, Mus musculus
aaatagcacaactcaacccccaggt

SEQ ID NO: 19377 - DNA, 25 bp, Mus musculus
aaatagcacttcagcctcaaattgc

SEQ ID NO: 19378 - DNA, 25 bp, Mus musculus
aaatagcacttctgcctcaaattgc

SEQ ID NO: 19379 - DNA, 25 bp, Mus musculus
aaatagcagacacccctgatcagaa

SEQ ID NO: 19380 - DNA, 25 bp, Mus musculus
aaatagcagacagccctgatcagaa

SEQ ID NO: 19381 - DNA, 25 bp, Mus musculus
aaatagcagacgatgtacctcacac

SEQ ID NO: 19382 - DNA, 25 bp, Mus musculus
aaatagcagacgttgtacctcacac

SEQ ID NO: 19383 - DNA, 25 bp, Mus musculus
aaatagcagccaatggacacctccg

SEQ ID NO: 19384 - DNA, 25 bp, Mus musculus
aaatagcagccattggacacctccg

SEQ ID NO: 19385 - DNA, 25 bp, Mus musculus
aaatagcatatcagacctggtctct

SEQ ID NO: 19386 - DNA, 25 bp, Mus musculus
aaatagcatatctgacctggtctct

SEQ ID NO: 19387 - DNA, 25 bp, Mus musculus
aaatagcatcacctcgttccaaact

SEQ ID NO: 19388 - DNA, 25 bp, Mus musculus
aaatagcatcacgtcgttccaaact

SEQ ID NO: 19389 - DNA, 25 bp, Mus musculus
aaatagccactgctatcatcctact

SEQ ID NO: 19390 - DNA, 25 bp, Mus musculus
aaatagccactggtatcatcctact

SEQ ID NO: 19391 - DNA, 25 bp, Mus musculus
aaatagccaggtcgtgctggcatat

SEQ ID NO: 19392 - DNA, 25 bp, Mus musculus
aaatagccaggtggtgctggcatat

SEQ ID NO: 19393 - DNA, 25 bp, Mus musculus
aaatagcccctacggccaggtgacg

SEQ ID NO: 19394 - DNA, 25 bp, Mus musculus
aaatagcccctagggccaggtgacg

SEQ ID NO: 19395 - DNA, 25 bp, Mus musculus
aaatagccctatactctgcttgaac

SEQ ID NO: 19396 - DNA, 25 bp, Mus musculus
aaatagccctattctctgcttgaac

SEQ ID NO: 19397 - DNA, 25 bp, Mus musculus
aaatagccctgacatagccatcctt

SEQ ID NO: 19398 - DNA, 25 bp, Mus musculus
aaatagccctgagatagccatcctt

SEQ ID NO: 19399 - DNA, 25 bp, Mus musculus
aaatagccgaacaaatgtgtctaaa

SEQ ID NO: 19400 - DNA, 25 bp, Mus musculus
aaatagccgaactaatgtgtctaaa

SEQ ID NO: 19401 - DNA, 25 bp, Mus musculus
aaatagccgtacatcatcacgactc

SEQ ID NO: 19402 - DNA, 25 bp, Mus musculus
aaatagccgtacttcatcacgactc

SEQ ID NO: 19403 - DNA, 25 bp, Mus musculus
aaatagcctcacagttaaacacatc

SEQ ID NO: 19404 - DNA, 25 bp, Mus musculus
aaatagcctcactgttaaacacatc

SEQ ID NO: 19405 - DNA, 25 bp, Mus musculus
aaatagcctcctattccactctact

SEQ ID NO: 19406 - DNA, 25 bp, Mus musculus
aaatagcctccttttccactctact

SEQ ID NO: 19407 - DNA, 25 bp, Mus musculus
aaatagcctgctataatcctagagt

SEQ ID NO: 19408 - DNA, 25 bp, Mus musculus
aaatagcctgctttaatcctagagt

SEQ ID NO: 19409 - DNA, 25 bp, Mus musculus
aaatagcgatgcacacgatctcagc

SEQ ID NO: 19410 - DNA, 25 bp, Mus musculus
aaatagcgatgctcacgatctcagc

SEQ ID NO: 19411 - DNA, 25 bp, Mus musculus
aaatagcgatgtacagttgtatacc

SEQ ID NO: 19412 - DNA, 25 bp, Mus musculus
aaatagcgatgttcagttgtatacc

SEQ ID NO: 19413 - DNA, 25 bp, Mus musculus
aaatagcgcttgctcagatcctggg

SEQ ID NO: 19414 - DNA, 25 bp, Mus musculus
aaatagcgcttggtcagatcctggg

SEQ ID NO: 19415 - DNA, 25 bp, Mus musculus
aaatagctcattctaaacagtgacc

SEQ ID NO: 19416 - DNA, 25 bp, Mus musculus
aaatagctcattgtaaacagtgacc

SEQ ID NO: 19417 - DNA, 25 bp, Mus musculus
aaatagctccctcttcctgtgttgg

SEQ ID NO: 19418 - DNA, 25 bp, Mus musculus
aaatagctccctgttcctgtgttgg

SEQ ID NO: 19419 - DNA, 25 bp, Mus musculus
aaatagctccggaacctcgcgggtg

SEQ ID NO: 19420 - DNA, 25 bp, Mus musculus
aaatagctccggtacctcgcgggtg

SEQ ID NO: 19421 - DNA, 25 bp, Mus musculus
aaatagctcctgagtgtcactgttc

SEQ ID NO: 19422 - DNA, 25 bp, Mus musculus
aaatagctcctgtgtgtcactgttc

SEQ ID NO: 19423 - DNA, 25 bp, Mus musculus
aaatagctcgttaccagatgctttt

SEQ ID NO: 19424 - DNA, 25 bp, Mus musculus
aaatagctcgtttccagatgctttt

SEQ ID NO: 19425 - DNA, 25 bp, Mus musculus
aaatagctctttagtggctcccatg

SEQ ID NO: 19426 - DNA, 25 bp, Mus musculus
aaatagctcttttgtggctcccatg

SEQ ID NO: 19427 - DNA, 25 bp, Mus musculus
aaatagctgcttccatgtctcatag

SEQ ID NO: 19428 - DNA, 25 bp, Mus musculus
aaatagctgcttgcatgtctcatag

SEQ ID NO: 19429 - DNA, 25 bp, Mus musculus
aaatagctggtcactgtgttagata

SEQ ID NO: 19430 - DNA, 25 bp, Mus musculus
aaatagctggtcatcacctagtaat

SEQ ID NO: 19431 - DNA, 25 bp, Mus musculus
aaatagctggtctctgtgttagata

SEQ ID NO: 19432 - DNA, 25 bp, Mus musculus
aaatagctggtcttcacctagtaat

SEQ ID NO: 19433 - DNA, 25 bp, Mus musculus
aaatagctgtgtccctcacaaagct

SEQ ID NO: 19434 - DNA, 25 bp, Mus musculus
aaatagctgtgtgcctcacaaagct

SEQ ID NO: 19435 - DNA, 25 bp, Mus musculus
aaatagcttccaattctagtctaaa

SEQ ID NO: 19436 - DNA, 25 bp, Mus musculus
aaatagcttccatttctagtctaaa

SEQ ID NO: 19437 - DNA, 25 bp, Mus musculus
aaatagcttctgagattgagaccct

SEQ ID NO: 19438 - DNA, 25 bp, Mus musculus
aaatagcttctgtgattgagaccct

SEQ ID NO: 19439 - DNA, 25 bp, Mus musculus
aaatagcttggcctcagtgctgaag

SEQ ID NO: 19440 - DNA, 25 bp, Mus musculus
aaatagcttggcgtcagtgctgaag

SEQ ID NO: 19441 - DNA, 25 bp, Mus musculus
aaataggaacagatgccttttcttc

SEQ ID NO: 19442 - DNA, 25 bp, Mus musculus
aaataggaacagttgccttttcttc

SEQ ID NO: 19443 - DNA, 25 bp, Mus musculus
aaataggaactcatctaaccctgag

SEQ ID NO: 19444 - DNA, 25 bp, Mus musculus
aaataggaactcttctaaccctgag

SEQ ID NO: 19445 - DNA, 25 bp, Mus musculus
aaataggaccagctcttcgaacaca

SEQ ID NO: 19446 - DNA, 25 bp, Mus musculus
aaataggaccaggtcttcgaacaca

SEQ ID NO: 19447 - DNA, 25 bp, Mus musculus
aaataggaccccatgactgatgcct

SEQ ID NO: 19448 - DNA, 25 bp, Mus musculus
aaataggaccccttgactgatgcct

SEQ ID NO: 19449 - DNA, 25 bp, Mus musculus
aaataggactaccataagacacagc

SEQ ID NO: 19450 - DNA, 25 bp, Mus musculus
aaataggactacgataagacacagc

SEQ ID NO: 19451 - DNA, 25 bp, Mus musculus
aaataggactgacaactggcttggt

SEQ ID NO: 19452 - DNA, 25 bp, Mus musculus
aaataggactgagaactggcttggt

SEQ ID NO: 19453 - DNA, 25 bp, Mus musculus
aaataggagataactgctaccgtcc

SEQ ID NO: 19454 - DNA, 25 bp, Mus musculus
aaataggagatatctgctaccgtcc

SEQ ID NO: 19455 - DNA, 25 bp, Mus musculus
aaataggagtggcagctctcaccca

SEQ ID NO: 19456 - DNA, 25 bp, Mus musculus
aaataggagtgggagctctcaccca

SEQ ID NO: 19457 - DNA, 25 bp, Mus musculus
aaataggatattactgagcacaggg

SEQ ID NO: 19458 - DNA, 25 bp, Mus musculus
aaataggatatttctgagcacaggg

SEQ ID NO: 19459 - DNA, 25 bp, Mus musculus
aaataggatggcagttcacgaaccc

SEQ ID NO: 19460 - DNA, 25 bp, Mus musculus
aaataggatggctgttcacgaaccc

SEQ ID NO: 19461 - DNA, 25 bp, Mus musculus
aaataggcacctatcagctggccat

SEQ ID NO: 19462 - DNA, 25 bp, Mus musculus
aaataggcacctttcagctggccat

SEQ ID NO: 19463 - DNA, 25 bp, Mus musculus
aaataggcaggccttctcctgtatc

SEQ ID NO: 19464 - DNA, 25 bp, Mus musculus
aaataggcaggcgttctcctgtatc

SEQ ID NO: 19465 - DNA, 25 bp, Mus musculus
aaataggcatggaggctctggtccg

SEQ ID NO: 19466 - DNA, 25 bp, Mus musculus
aaataggcatggtggctctggtccg

SEQ ID NO: 19467 - DNA, 25 bp, Mus musculus
aaataggctaggcttccaaatacag

SEQ ID NO: 19468 - DNA, 25 bp, Mus musculus
aaataggctagggttccaaatacag

SEQ ID NO: 19469 - DNA, 25 bp, Mus musculus
aaataggctagtcccctctgtgtac

SEQ ID NO: 19470 - DNA, 25 bp, Mus musculus
aaataggctagtgccctctgtgtac

SEQ ID NO: 19471 - DNA, 25 bp, Mus musculus
aaataggctccaattctggtgctgg

SEQ ID NO: 19472 - DNA, 25 bp, Mus musculus
aaataggctccatttctggtgctgg

SEQ ID NO: 19473 - DNA, 25 bp, Mus musculus
aaataggctcttagggtgctgtgta

SEQ ID NO: 19474 - DNA, 25 bp, Mus musculus
aaataggctctttgggtgctgtgta

SEQ ID NO: 19475 - DNA, 25 bp, Mus musculus
aaataggctgctccattcagtcctg

SEQ ID NO: 19476 - DNA, 25 bp, Mus musculus
aaataggctgctgcattcagtcctg

SEQ ID NO: 19477 - DNA, 25 bp, Mus musculus
aaataggcttacaaagcagcagtcc

SEQ ID NO: 19478 - DNA, 25 bp, Mus musculus
aaataggcttactaagcagcagtcc

SEQ ID NO: 19479 - DNA, 25 bp, Mus musculus
aaatagggaccccactcctaatgat

SEQ ID NO: 19480 - DNA, 25 bp, Mus musculus
aaatagggacccgactcctaatgat

SEQ ID NO: 19481 - DNA, 25 bp, Mus musculus
aaatagggactcagtccacaggaag

SEQ ID NO: 19482 - DNA, 25 bp, Mus musculus
aaatagggactctgtccacaggaag

SEQ ID NO: 19483 - DNA, 25 bp, Mus musculus
aaataggtaccactcctcaggacga

SEQ ID NO: 19484 - DNA, 25 bp, Mus musculus
aaataggtaccagtcctcaggacga

SEQ ID NO: 19485 - DNA, 25 bp, Mus musculus
aaataggtacttatgtagtcatgcc

SEQ ID NO: 19486 - DNA, 25 bp, Mus musculus
aaataggtacttcttctttcaggag

SEQ ID NO: 19487 - DNA, 25 bp, Mus musculus
aaataggtacttgttctttcaggag

SEQ ID NO: 19488 - DNA, 25 bp, Mus musculus
aaataggtacttttgtagtcatgcc

SEQ ID NO: 19489 - DNA, 25 bp, Mus musculus
aaataggtagatctcctgttactaa

SEQ ID NO: 19490 - DNA, 25 bp, Mus musculus
aaataggtagatgtcctgttactaa

SEQ ID NO: 19491 - DNA, 25 bp, Mus musculus
aaataggtctgtatggacattcaaa

SEQ ID NO: 19492 - DNA, 25 bp, Mus musculus
aaataggtctgtttggacattcaaa

SEQ ID NO: 19493 - DNA, 25 bp, Mus musculus
aaataggtgcctagagtcctctggc

SEQ ID NO: 19494 - DNA, 25 bp, Mus musculus
aaataggtgccttgagtcctctggc

SEQ ID NO: 19495 - DNA, 25 bp, Mus musculus
aaataggtgtccaactttgagacat

SEQ ID NO: 19496 - DNA, 25 bp, Mus musculus
aaataggtgtcctactttgagacat

SEQ ID NO: 19497 - DNA, 25 bp, Mus musculus
aaataggttcagacagaggccccaa

SEQ ID NO: 19498 - DNA, 25 bp, Mus musculus
aaataggttcagtcagaggccccaa

SEQ ID NO: 19499 - DNA, 25 bp, Mus musculus
aaatagtaagcacgccttggttggc

SEQ ID NO: 19500 - DNA, 25 bp, Mus musculus
aaatagtaagcaggccttggttggc

SEQ ID NO: 19501 - DNA, 25 bp, Mus musculus
aaatagtacctgcttcgagtcctgg

SEQ ID NO: 19502 - DNA, 25 bp, Mus musculus
aaatagtacctggttcgagtcctgg

SEQ ID NO: 19503 - DNA, 25 bp, Mus musculus
aaatagtaggcaacgggaccccgct

SEQ ID NO: 19504 - DNA, 25 bp, Mus musculus
aaatagtaggcatcgggaccccgct

SEQ ID NO: 19505 - DNA, 25 bp, Mus musculus
aaatagtatcggaccaacccagcgt

SEQ ID NO: 19506 - DNA, 25 bp, Mus musculus
aaatagtatcggtccaacccagcgt

SEQ ID NO: 19507 - DNA, 25 bp, Mus musculus
aaatagtatgatcccttgaggtttt

SEQ ID NO: 19508 - DNA, 25 bp, Mus musculus
aaatagtatgatgccttgaggtttt

SEQ ID NO: 19509 - DNA, 25 bp, Mus musculus
aaatagtcacatctttccctaagcc

SEQ ID NO: 19510 - DNA, 25 bp, Mus musculus
aaatagtcacatgtttccctaagcc

SEQ ID NO: 19511 - DNA, 25 bp, Mus musculus
aaatagtcagtgattgtgggagtca

SEQ ID NO: 19512 - DNA, 25 bp, Mus musculus
aaatagtcagtgtttgtgggagtca

SEQ ID NO: 19513 - DNA, 25 bp, Mus musculus
aaatagtcattcatggagtagctcc

SEQ ID NO: 19514 - DNA, 25 bp, Mus musculus
aaatagtcattcttggagtagctcc

SEQ ID NO: 19515 - DNA, 25 bp, Mus musculus
aaatagtcatttcccatgtcctttg

SEQ ID NO: 19516 - DNA, 25 bp, Mus musculus
aaatagtcatttgccatgtcctttg

SEQ ID NO: 19517 - DNA, 25 bp, Mus musculus
aaatagtccatactcatcagtccac

SEQ ID NO: 19518 - DNA, 25 bp, Mus musculus
aaatagtccatagtcatcagtccac

SEQ ID NO: 19519 - DNA, 25 bp, Mus musculus
aaatagtccgcgcttatgataccac

SEQ ID NO: 19520 - DNA, 25 bp, Mus musculus
aaatagtccgcggttatgataccac

SEQ ID NO: 19521 - DNA, 25 bp, Mus musculus
aaatagtcctaacggctctttggct

SEQ ID NO: 19522 - DNA, 25 bp, Mus musculus
aaatagtcctaagggctctttggct

SEQ ID NO: 19523 - DNA, 25 bp, Mus musculus
aaatagtcctcacatcggccctcag

SEQ ID NO: 19524 - DNA, 25 bp, Mus musculus
aaatagtcctcagatcggccctcag

SEQ ID NO: 19525 - DNA, 25 bp, Mus musculus
aaatagtctatccttgcgaccgagg

SEQ ID NO: 19526 - DNA, 25 bp, Mus musculus
aaatagtctatcgttgcgaccgagg

SEQ ID NO: 19527 - DNA, 25 bp, Mus musculus
aaatagtctgttaccttccttggtg

SEQ ID NO: 19528 - DNA, 25 bp, Mus musculus
aaatagtctgtttccttccttggtg

SEQ ID NO: 19529 - DNA, 25 bp, Mus musculus
aaatagtgaagcctgccgtcgatac

SEQ ID NO: 19530 - DNA, 25 bp, Mus musculus
aaatagtgaagcgtgccgtcgatac

SEQ ID NO: 19531 - DNA, 25 bp, Mus musculus
aaatagtgaatgatctgttcccaac

SEQ ID NO: 19532 - DNA, 25 bp, Mus musculus
aaatagtgaatgttctgttcccaac

SEQ ID NO: 19533 - DNA, 25 bp, Mus musculus
aaatagtgccagagttttattgatt

SEQ ID NO: 19534 - DNA, 25 bp, Mus musculus
aaatagtgccagtgttttattgatt

SEQ ID NO: 19535 - DNA, 25 bp, Mus musculus
aaatagtgctataggtagcatcccc

SEQ ID NO: 19536 - DNA, 25 bp, Mus musculus
aaatagtgctattggtagcatcccc

SEQ ID NO: 19537 - DNA, 25 bp, Mus musculus
aaatagtgcttcaggctgtgcgggc

SEQ ID NO: 19538 - DNA, 25 bp, Mus musculus
aaatagtgcttctggctgtgcgggc

SEQ ID NO: 19539 - DNA, 25 bp, Mus musculus
aaatagtggccccttgcaacatttc

SEQ ID NO: 19540 - DNA, 25 bp, Mus musculus
aaatagtggcccgttgcaacatttc

SEQ ID NO: 19541 - DNA, 25 bp, Mus musculus
aaatagtgtaggacccttcttgctt

SEQ ID NO: 19542 - DNA, 25 bp, Mus musculus
aaatagtgtaggtcccttcttgctt

SEQ ID NO: 19543 - DNA, 25 bp, Mus musculus
aaatagtgtgtgctttatgatttgt

SEQ ID NO: 19544 - DNA, 25 bp, Mus musculus
aaatagtgtgtggtttatgatttgt

SEQ ID NO: 19545 - DNA, 25 bp, Mus musculus
aaatagttaccactcattccgcagc

SEQ ID NO: 19546 - DNA, 25 bp, Mus musculus
aaatagttaccagtcattccgcagc

SEQ ID NO: 19547 - DNA, 25 bp, Mus musculus
aaatagttcaggaccaagcccagtg

SEQ ID NO: 19548 - DNA, 25 bp, Mus musculus
aaatagttcaggtccaagcccagtg

SEQ ID NO: 19549 - DNA, 25 bp, Mus musculus
aaatagttcatgaaggtgccctgca

SEQ ID NO: 19550 - DNA, 25 bp, Mus musculus
aaatagttcatgtaggtgccctgca

SEQ ID NO: 19551 - DNA, 25 bp, Mus musculus
aaatagttccttcgcagagatccct

SEQ ID NO: 19552 - DNA, 25 bp, Mus musculus
aaatagttccttggcagagatccct

SEQ ID NO: 19553 - DNA, 25 bp, Mus musculus
aaatagttctgcacattgatccata

SEQ ID NO: 19554 - DNA, 25 bp, Mus musculus
aaatagttctgctcattgatccata

SEQ ID NO: 19555 - DNA, 25 bp, Mus musculus
aaatagttgattagcaggccgggcg

SEQ ID NO: 19556 - DNA, 25 bp, Mus musculus
aaatagttgatttgcaggccgggcg

SEQ ID NO: 19557 - DNA, 25 bp, Mus musculus
aaatagttgcgactcctttccctgt

SEQ ID NO: 19558 - DNA, 25 bp, Mus musculus
aaatagttgcgagtcctttccctgt

SEQ ID NO: 19559 - DNA, 25 bp, Mus musculus
aaatagttggatatcctcatcttca

SEQ ID NO: 19560 - DNA, 25 bp, Mus musculus
aaatagttggatttcctcatcttca

SEQ ID NO: 19561 - DNA, 25 bp, Mus musculus
aaatagttggtcctttgggtgcctg

SEQ ID NO: 19562 - DNA, 25 bp, Mus musculus
aaatagttggtcgtttgggtgcctg

SEQ ID NO: 19563 - DNA, 25 bp, Mus musculus
aaatagttgtgtactgcattggaat

SEQ ID NO: 19564 - DNA, 25 bp, Mus musculus
aaatagttgtgttctgcattggaat

SEQ ID NO: 19565 - DNA, 25 bp, Mus musculus
aaatagtttacccacttgagcaaga

SEQ ID NO: 19566 - DNA, 25 bp, Mus musculus
aaatagtttaccgacttgagcaaga

SEQ ID NO: 19567 - DNA, 25 bp, Mus musculus
aaatagtttcacattcctgtcaaaa

SEQ ID NO: 19568 - DNA, 25 bp, Mus musculus
aaatagtttcactttcctgtcaaaa

SEQ ID NO: 19569 - DNA, 25 bp, Mus musculus
aaatagtttcagatgtttcctgcct

SEQ ID NO: 19570 - DNA, 25 bp, Mus musculus
aaatagtttcagttgtttcctgcct

SEQ ID NO: 19571 - DNA, 25 bp, Mus musculus
aaatagtttctcacagacagaccca

SEQ ID NO: 19572 - DNA, 25 bp, Mus musculus
aaatagtttctctcagacagaccca

SEQ ID NO: 19573 - DNA, 25 bp, Mus musculus
aaatagtttgcaccaggagtctgtt

SEQ ID NO: 19574 - DNA, 25 bp, Mus musculus
aaatagtttgcagcaggagtctgtt

SEQ ID NO: 19575 - DNA, 25 bp, Mus musculus
aaatagtttggcatttctaggagcc

SEQ ID NO: 19576 - DNA, 25 bp, Mus musculus
aaatagtttggcttttctaggagcc

SEQ ID NO: 19577 - DNA, 25 bp, Mus musculus
aaatagtttgtgactcagtgttaat

SEQ ID NO: 19578 - DNA, 25 bp, Mus musculus
aaatagtttgtgtctcagtgttaat

SEQ ID NO: 19579 - DNA, 25 bp, Mus musculus
aaatataatctgctggccggccggg

SEQ ID NO: 19580 - DNA, 25 bp, Mus musculus
aaatataatctggtggccggccggg

SEQ ID NO: 19581 - DNA, 25 bp, Mus musculus
aaatataatttacctacctgttcta

SEQ ID NO: 19582 - DNA, 25 bp, Mus musculus
aaatataatttagctacctgttcta

SEQ ID NO: 19583 - DNA, 25 bp, Mus musculus
aaatatacaaaacgttatgccagtg

SEQ ID NO: 19584 - DNA, 25 bp, Mus musculus
aaatatacaaaaggttatgccagtg

SEQ ID NO: 19585 - DNA, 25 bp, Mus musculus
aaatatacacacataaagaagtctt

SEQ ID NO: 19586 - DNA, 25 bp, Mus musculus
aaatatacacacttaaagaagtctt

SEQ ID NO: 19587 - DNA, 25 bp, Mus musculus
aaatatacacagagcagagaaaccc

SEQ ID NO: 19588 - DNA, 25 bp, Mus musculus
aaatatacacagtgcagagaaaccc

SEQ ID NO: 19589 - DNA, 25 bp, Mus musculus
aaatatacagatcgatgggttccta

SEQ ID NO: 19590 - DNA, 25 bp, Mus musculus
aaatatacagatggatgggttccta

SEQ ID NO: 19591 - DNA, 25 bp, Mus musculus
aaatataccccacggcattttctgt

SEQ ID NO: 19592 - DNA, 25 bp, Mus musculus
aaatataccccagggcattttctgt

SEQ ID NO: 19593 - DNA, 25 bp, Mus musculus
aaatatacctccaattcttggtcca

SEQ ID NO: 19594 - DNA, 25 bp, Mus musculus
aaatatacctcctattcttggtcca

SEQ ID NO: 19595 - DNA, 25 bp, Mus musculus
aaatatactggcaccgactgcgtgg

SEQ ID NO: 19596 - DNA, 25 bp, Mus musculus
aaatatactggctccgactgcgtgg

SEQ ID NO: 19597 - DNA, 25 bp, Mus musculus
aaatatactggtcacttgtggctcc

SEQ ID NO: 19598 - DNA, 25 bp, Mus musculus
aaatatactggtgacttgtggctcc

SEQ ID NO: 19599 - DNA, 25 bp, Mus musculus
aaatatactgtcactttgcctaaag

SEQ ID NO: 19600 - DNA, 25 bp, Mus musculus
aaatatactgtctctttgcctaaag

SEQ ID NO: 19601 - DNA, 25 bp, Mus musculus
aaatatagaaagctccgtcggtcaa

SEQ ID NO: 19602 - DNA, 25 bp, Mus musculus
aaatatagaaaggtccgtcggtcaa

SEQ ID NO: 19603 - DNA, 25 bp, Mus musculus
aaatataggaagacccgccacctgt

SEQ ID NO: 19604 - DNA, 25 bp, Mus musculus
aaatataggaagtcccgccacctgt

SEQ ID NO: 19605 - DNA, 25 bp, Mus musculus
aaatataggcttacttgagcgcgcc

SEQ ID NO: 19606 - DNA, 25 bp, Mus musculus
aaatataggctttcttgagcgcgcc

SEQ ID NO: 19607 - DNA, 25 bp, Mus musculus
aaatatataaacatgcagctttaac

SEQ ID NO: 19608 - DNA, 25 bp, Mus musculus
aaatatataaacttgcagctttaac

SEQ ID NO: 19609 - DNA, 25 bp, Mus musculus
aaatatataggtcgctcatactgat

SEQ ID NO: 19610 - DNA, 25 bp, Mus musculus
aaatatataggtggctcatactgat

SEQ ID NO: 19611 - DNA, 25 bp, Mus musculus
aaatatatatcaccccaacagccct

SEQ ID NO: 19612 - DNA, 25 bp, Mus musculus
aaatatatatcagcccaacagccct

SEQ ID NO: 19613 - DNA, 25 bp, Mus musculus
aaatatatattgaggatggccgcca

SEQ ID NO: 19614 - DNA, 25 bp, Mus musculus
aaatatatattgtggatggccgcca

SEQ ID NO: 19615 - DNA, 25 bp, Mus musculus
aaatatatccccaatcgtggtcctc

SEQ ID NO: 19616 - DNA, 25 bp, Mus musculus
aaatatatcccctatcgtggtcctc

SEQ ID NO: 19617 - DNA, 25 bp, Mus musculus
aaatatatctgcaacgcgctgggct

SEQ ID NO: 19618 - DNA, 25 bp, Mus musculus
aaatatatctgctacgcgctgggct

SEQ ID NO: 19619 - DNA, 25 bp, Mus musculus
aaatatatgcctcgtgggtttgcct

SEQ ID NO: 19620 - DNA, 25 bp, Mus musculus
aaatatatgcctggtgggtttgcct

SEQ ID NO: 19621 - DNA, 25 bp, Mus musculus
aaatatatggcaatgcttgcaataa

SEQ ID NO: 19622 - DNA, 25 bp, Mus musculus
aaatatatggcattgcttgcaataa

SEQ ID NO: 19623 - DNA, 25 bp, Mus musculus
aaatatatgtacacaactaccatgg

SEQ ID NO: 19624 - DNA, 25 bp, Mus musculus
aaatatatgtactcaactaccatgg

SEQ ID NO: 19625 - DNA, 25 bp, Mus musculus
aaatatattaggacacatgattagg

SEQ ID NO: 19626 - DNA, 25 bp, Mus musculus
aaatatattaggtcacatgattagg

SEQ ID NO: 19627 - DNA, 25 bp, Mus musculus
aaatatattcacaagggacacctct

SEQ ID NO: 19628 - DNA, 25 bp, Mus musculus
aaatatattcactagggacacctct

SEQ ID NO: 19629 - DNA, 25 bp, Mus musculus
aaatatattccactcacttcctcga

SEQ ID NO: 19630 - DNA, 25 bp, Mus musculus
aaatatattccagtcacttcctcga

SEQ ID NO: 19631 - DNA, 25 bp, Mus musculus
aaatatattcctacttacagttaag

SEQ ID NO: 19632 - DNA, 25 bp, Mus musculus
aaatatattccttcttacagttaag

SEQ ID NO: 19633 - DNA, 25 bp, Mus musculus
aaatatattgccagttaccaagtga

SEQ ID NO: 19634 - DNA, 25 bp, Mus musculus
aaatatattgcctgttaccaagtga

SEQ ID NO: 19635 - DNA, 25 bp, Mus musculus
aaatatatttcactttgcataaagc

SEQ ID NO: 19636 - DNA, 25 bp, Mus musculus
aaatatatttcagtttgcataaagc

SEQ ID NO: 19637 - DNA, 25 bp, Mus musculus
aaatatatttctctacatgtggctt

SEQ ID NO: 19638 - DNA, 25 bp, Mus musculus
aaatatatttctgtacatgtggctt

SEQ ID NO: 19639 - DNA, 25 bp, Mus musculus
aaatatcaacaaccttgccctatgg

SEQ ID NO: 19640 - DNA, 25 bp, Mus musculus
aaatatcaacaagcttgccctatgg

SEQ ID NO: 19641 - DNA, 25 bp, Mus musculus
aaatatcaagtcaccgttttctctg

SEQ ID NO: 19642 - DNA, 25 bp, Mus musculus
aaatatcaagtctccgttttctctg

SEQ ID NO: 19643 - DNA, 25 bp, Mus musculus
aaatatcaatgcataaccagaacca

SEQ ID NO: 19644 - DNA, 25 bp, Mus musculus
aaatatcaatgcttaaccagaacca

SEQ ID NO: 19645 - DNA, 25 bp, Mus musculus
aaatatcacctcagatattcagagt

SEQ ID NO: 19646 - DNA, 25 bp, Mus musculus
aaatatcacctctgatattcagagt

SEQ ID NO: 19647 - DNA, 25 bp, Mus musculus
aaatatcaggcactccacctacagg

SEQ ID NO: 19648 - DNA, 25 bp, Mus musculus
aaatatcaggcagtccacctacagg

SEQ ID NO: 19649 - DNA, 25 bp, Mus musculus
aaatatcaggccaccaaagctctgt

SEQ ID NO: 19650 - DNA, 25 bp, Mus musculus
aaatatcaggcctccaaagctctgt

SEQ ID NO: 19651 - DNA, 25 bp, Mus musculus
aaatatcagtacaacacactgcttt

SEQ ID NO: 19652 - DNA, 25 bp, Mus musculus
aaatatcagtactacacactgcttt

SEQ ID NO: 19653 - DNA, 25 bp, Mus musculus
aaatatcatcaccattaccaagtgg

SEQ ID NO: 19654 - DNA, 25 bp, Mus musculus
aaatatcatcacgattaccaagtgg

SEQ ID NO: 19655 - DNA, 25 bp, Mus musculus
aaatatcatctcatggagtgcctaa

SEQ ID NO: 19656 - DNA, 25 bp, Mus musculus
aaatatcatctcttggagtgcctaa

SEQ ID NO: 19657 - DNA, 25 bp, Mus musculus
aaatatcatggaattccgtttgttc

SEQ ID NO: 19658 - DNA, 25 bp, Mus musculus
aaatatcatggatttccgtttgttc

SEQ ID NO: 19659 - DNA, 25 bp, Mus musculus
aaatatcatgtacctagctcacagt

SEQ ID NO: 19660 - DNA, 25 bp, Mus musculus
aaatatcatgtagctagctcacagt

SEQ ID NO: 19661 - DNA, 25 bp, Mus musculus
aaatatcattgaactcagagacaat

SEQ ID NO: 19662 - DNA, 25 bp, Mus musculus
aaatatcattgatctcagagacaat

SEQ ID NO: 19663 - DNA, 25 bp, Mus musculus
aaatatcatttgaagctttaaggct

SEQ ID NO: 19664 - DNA, 25 bp, Mus musculus
aaatatcatttgtagctttaaggct

SEQ ID NO: 19665 - DNA, 25 bp, Mus musculus
aaatatccacctacatatacctacc

SEQ ID NO: 19666 - DNA, 25 bp, Mus musculus
aaatatccaccttcatatacctacc

SEQ ID NO: 19667 - DNA, 25 bp, Mus musculus
aaatatccaggcaccatgacagtct

SEQ ID NO: 19668 - DNA, 25 bp, Mus musculus
aaatatccaggctccatgacagtct

SEQ ID NO: 19669 - DNA, 25 bp, Mus musculus
aaatatccagtactcgcctttcctg

SEQ ID NO: 19670 - DNA, 25 bp, Mus musculus
aaatatccagtagtcgcctttcctg

SEQ ID NO: 19671 - DNA, 25 bp, Mus musculus
aaatatccattcattttacttgaca

SEQ ID NO: 19672 - DNA, 25 bp, Mus musculus
aaatatccattctttttacttgaca

SEQ ID NO: 19673 - DNA, 25 bp, Mus musculus
aaatatccatttccaacatttctat

SEQ ID NO: 19674 - DNA, 25 bp, Mus musculus
aaatatccatttgcaacatttctat

SEQ ID NO: 19675 - DNA, 25 bp, Mus musculus
aaatatccccaaaccagaccgtgag

SEQ ID NO: 19676 - DNA, 25 bp, Mus musculus
aaatatccccaatccagaccgtgag

SEQ ID NO: 19677 - DNA, 25 bp, Mus musculus
aaatatccctctcctgtttcttcag

SEQ ID NO: 19678 - DNA, 25 bp, Mus musculus
aaatatccctctctgtttgtcctct

SEQ ID NO: 19679 - DNA, 25 bp, Mus musculus
aaatatccctctgctgtttcttcag

SEQ ID NO: 19680 - DNA, 25 bp, Mus musculus
aaatatccctctgtgtttgtcctct

SEQ ID NO: 19681 - DNA, 25 bp, Mus musculus
aaatatcccttaccctgaaatccac

SEQ ID NO: 19682 - DNA, 25 bp, Mus musculus
aaatatcccttagcctgaaatccac

SEQ ID NO: 19683 - DNA, 25 bp, Mus musculus
aaatatccggccatgacaggacccc

SEQ ID NO: 19684 - DNA, 25 bp, Mus musculus
aaatatccggccttgacaggacccc

SEQ ID NO: 19685 - DNA, 25 bp, Mus musculus
aaatatcctaacattttcgtgaaga

SEQ ID NO: 19686 - DNA, 25 bp, Mus musculus
aaatatcctaactttttcgtgaaga

SEQ ID NO: 19687 - DNA, 25 bp, Mus musculus
aaatatcctcggaagagtgcgccca

SEQ ID NO: 19688 - DNA, 25 bp, Mus musculus
aaatatcctcggtagagtgcgccca

SEQ ID NO: 19689 - DNA, 25 bp, Mus musculus
aaatatcctgaaagacttctctctc

SEQ ID NO: 19690 - DNA, 25 bp, Mus musculus
aaatatcctgaatgacttctctctc

SEQ ID NO: 19691 - DNA, 25 bp, Mus musculus
aaatatcctggtcgagctctttccc

SEQ ID NO: 19692 - DNA, 25 bp, Mus musculus
aaatatcctggtggagctctttccc

SEQ ID NO: 19693 - DNA, 25 bp, Mus musculus
aaatatccttctaccatttgtggta

SEQ ID NO: 19694 - DNA, 25 bp, Mus musculus
aaatatccttcttccatttgtggta

SEQ ID NO: 19695 - DNA, 25 bp, Mus musculus
aaatatccttgtacaacagttccat

SEQ ID NO: 19696 - DNA, 25 bp, Mus musculus
aaatatccttgttcaacagttccat

SEQ ID NO: 19697 - DNA, 25 bp, Mus musculus
aaatatcctttgaagctcgttgtgg

SEQ ID NO: 19698 - DNA, 25 bp, Mus musculus
aaatatcctttgtagctcgttgtgg

SEQ ID NO: 19699 - DNA, 25 bp, Mus musculus
aaatatcgctagagatcgttgccaa

SEQ ID NO: 19700 - DNA, 25 bp, Mus musculus
aaatatcgctagtgatcgttgccaa

SEQ ID NO: 19701 - DNA, 25 bp, Mus musculus
aaatatcgtgatctctgggctgcaa

SEQ ID NO: 19702 - DNA, 25 bp, Mus musculus
aaatatcgtgatgtctgggctgcaa

SEQ ID NO: 19703 - DNA, 25 bp, Mus musculus
aaatatctaccaattgccgggcagt

SEQ ID NO: 19704 - DNA, 25 bp, Mus musculus
aaatatctaccatttgccgggcagt

SEQ ID NO: 19705 - DNA, 25 bp, Mus musculus
aaatatctagtgatgttcccgtggc

SEQ ID NO: 19706 - DNA, 25 bp, Mus musculus
aaatatctagtgttgttcccgtggc

SEQ ID NO: 19707 - DNA, 25 bp, Mus musculus
aaatatctattgacttcctggctaa

SEQ ID NO: 19708 - DNA, 25 bp, Mus musculus
aaatatctattgtcttcctggctaa

SEQ ID NO: 19709 - DNA, 25 bp, Mus musculus
aaatatctcacccatcagttttcct

SEQ ID NO: 19710 - DNA, 25 bp, Mus musculus
aaatatctcaccgatcagttttcct

SEQ ID NO: 19711 - DNA, 25 bp, Mus musculus
aaatatctcagaatgggccatccgt

SEQ ID NO: 19712 - DNA, 25 bp, Mus musculus
aaatatctcagattgggccatccgt

SEQ ID NO: 19713 - DNA, 25 bp, Mus musculus
aaatatctcttgctgaatgtggaca

SEQ ID NO: 19714 - DNA, 25 bp, Mus musculus
aaatatctcttggtgaatgtggaca

SEQ ID NO: 19715 - DNA, 25 bp, Mus musculus
aaatatctgcctcattacctcaaaa

SEQ ID NO: 19716 - DNA, 25 bp, Mus musculus
aaatatctgcctgattacctcaaaa

SEQ ID NO: 19717 - DNA, 25 bp, Mus musculus
aaatatctggcaatctgggagcgtg

SEQ ID NO: 19718 - DNA, 25 bp, Mus musculus
aaatatctggcattctgggagcgtg

SEQ ID NO: 19719 - DNA, 25 bp, Mus musculus
aaatatctgggtatcaagtacttga

SEQ ID NO: 19720 - DNA, 25 bp, Mus musculus
aaatatctgggtttcaagtacttga

SEQ ID NO: 19721 - DNA, 25 bp, Mus musculus
aaatatctgttcatgctgtgattga

SEQ ID NO: 19722 - DNA, 25 bp, Mus musculus
aaatatctgttcttgctgtgattga

SEQ ID NO: 19723 - DNA, 25 bp, Mus musculus
aaatatctgtttcgcccacagggat

SEQ ID NO: 19724 - DNA, 25 bp, Mus musculus
aaatatctgtttggcccacagggat

SEQ ID NO: 19725 - DNA, 25 bp, Mus musculus
aaatatcttattcatactgcagcca

SEQ ID NO: 19726 - DNA, 25 bp, Mus musculus
aaatatcttattgatactgcagcca

SEQ ID NO: 19727 - DNA, 25 bp, Mus musculus
aaatatcttccgaaattccaacatt

SEQ ID NO: 19728 - DNA, 25 bp, Mus musculus
aaatatcttccgtaattccaacatt

SEQ ID NO: 19729 - DNA, 25 bp, Mus musculus
aaatatctttgaactgtgtcttgaa

SEQ ID NO: 19730 - DNA, 25 bp, Mus musculus
aaatatctttgatctgtgtcttgaa

SEQ ID NO: 19731 - DNA, 25 bp, Mus musculus
aaatatgaacacattcactcagcat

SEQ ID NO: 19732 - DNA, 25 bp, Mus musculus
aaatatgaacactttcactcagcat

SEQ ID NO: 19733 - DNA, 25 bp, Mus musculus
aaatatgacagaaagtttccagagt

SEQ ID NO: 19734 - DNA, 25 bp, Mus musculus
aaatatgacagatagtttccagagt

SEQ ID NO: 19735 - DNA, 25 bp, Mus musculus
aaatatgaccataaggagcttcgta

SEQ ID NO: 19736 - DNA, 25 bp, Mus musculus
aaatatgaccattaggagcttcgta

SEQ ID NO: 19737 - DNA, 25 bp, Mus musculus
aaatatgacctgatatacaagtatc

SEQ ID NO: 19738 - DNA, 25 bp, Mus musculus
aaatatgacctgttatacaagtatc

SEQ ID NO: 19739 - DNA, 25 bp, Mus musculus
aaatatgagcctaggctctgcctac

SEQ ID NO: 19740 - DNA, 25 bp, Mus musculus
aaatatgagcctccagagggcattt

SEQ ID NO: 19741 - DNA, 25 bp, Mus musculus
aaatatgagcctgcagagggcattt

SEQ ID NO: 19742 - DNA, 25 bp, Mus musculus
aaatatgagccttggctctgcctac

SEQ ID NO: 19743 - DNA, 25 bp, Mus musculus
aaatatgaggctcaaaggcctttcc

SEQ ID NO: 19744 - DNA, 25 bp, Mus musculus
aaatatgaggctgaaaggcctttcc

SEQ ID NO: 19745 - DNA, 25 bp, Mus musculus
aaatatgagtacatccatggaacca

SEQ ID NO: 19746 - DNA, 25 bp, Mus musculus
aaatatgagtacttccatggaacca

SEQ ID NO: 19747 - DNA, 25 bp, Mus musculus
aaatatgatcacacagttagccttg

SEQ ID NO: 19748 - DNA, 25 bp, Mus musculus
aaatatgatcactcagttagccttg

SEQ ID NO: 19749 - DNA, 25 bp, Mus musculus
aaatatgatcctccgagctccagac

SEQ ID NO: 19750 - DNA, 25 bp, Mus musculus
aaatatgatcctgcgagctccagac

SEQ ID NO: 19751 - DNA, 25 bp, Mus musculus
aaatatgatcgaccagatttcctgg

SEQ ID NO: 19752 - DNA, 25 bp, Mus musculus
aaatatgatcgagcagatttcctgg

SEQ ID NO: 19753 - DNA, 25 bp, Mus musculus
aaatatgattaaactcctgatgcag

SEQ ID NO: 19754 - DNA, 25 bp, Mus musculus
aaatatgattaatctcctgatgcag

SEQ ID NO: 19755 - DNA, 25 bp, Mus musculus
aaatatgcagccaggtgggcttcac

SEQ ID NO: 19756 - DNA, 25 bp, Mus musculus
aaatatgcagcctggtgggcttcac

SEQ ID NO: 19757 - DNA, 25 bp, Mus musculus
aaatatgcagtgaacctcaaccagg

SEQ ID NO: 19758 - DNA, 25 bp, Mus musculus
aaatatgcagtgtacctcaaccagg

SEQ ID NO: 19759 - DNA, 25 bp, Mus musculus
aaatatgcatttaccgatgagcctg

SEQ ID NO: 19760 - DNA, 25 bp, Mus musculus
aaatatgcattttccgatgagcctg

SEQ ID NO: 19761 - DNA, 25 bp, Mus musculus
aaatatgccataagccagcgttccc

SEQ ID NO: 19762 - DNA, 25 bp, Mus musculus
aaatatgccatatgccagcgttccc

SEQ ID NO: 19763 - DNA, 25 bp, Mus musculus
aaatatgccattacacttcgcgagc

SEQ ID NO: 19764 - DNA, 25 bp, Mus musculus
aaatatgccatttcacttcgcgagc

SEQ ID NO: 19765 - DNA, 25 bp, Mus musculus
aaatatgcctaaagctgcagccctt

SEQ ID NO: 19766 - DNA, 25 bp, Mus musculus
aaatatgcctaatgctgcagccctt

SEQ ID NO: 19767 - DNA, 25 bp, Mus musculus
aaatatgcctgcagagttctgtcca

SEQ ID NO: 19768 - DNA, 25 bp, Mus musculus
aaatatgcctgctgagttctgtcca

SEQ ID NO: 19769 - DNA, 25 bp, Mus musculus
aaatatgcctgtcatcctcactgtt

SEQ ID NO: 19770 - DNA, 25 bp, Mus musculus
aaatatgcctgtgatcctcactgtt

SEQ ID NO: 19771 - DNA, 25 bp, Mus musculus
aaatatgccttcctgctgagctgaa

SEQ ID NO: 19772 - DNA, 25 bp, Mus musculus
aaatatgccttcgtgctgagctgaa

SEQ ID NO: 19773 - DNA, 25 bp, Mus musculus
aaatatgccttgaacatgtccacat

SEQ ID NO: 19774 - DNA, 25 bp, Mus musculus
aaatatgccttgtacatgtccacat

SEQ ID NO: 19775 - DNA, 25 bp, Mus musculus
aaatatgcctttcttgtttccaaca

SEQ ID NO: 19776 - DNA, 25 bp, Mus musculus
aaatatgcctttgttgtttccaaca

SEQ ID NO: 19777 - DNA, 25 bp, Mus musculus
aaatatgcgtgtctctctcagtatc

SEQ ID NO: 19778 - DNA, 25 bp, Mus musculus
aaatatgcgtgtgtctctcagtatc

SEQ ID NO: 19779 - DNA, 25 bp, Mus musculus
aaatatgctctgacgtcatcgagga

SEQ ID NO: 19780 - DNA, 25 bp, Mus musculus
aaatatgctctgtcgtcatcgagga

SEQ ID NO: 19781 - DNA, 25 bp, Mus musculus
aaatatgctcttctagttctaggga

SEQ ID NO: 19782 - DNA, 25 bp, Mus musculus
aaatatgctcttgtagttctaggga

SEQ ID NO: 19783 - DNA, 25 bp, Mus musculus
aaatatgctgttaggccagccacct

SEQ ID NO: 19784 - DNA, 25 bp, Mus musculus
aaatatgctgtttggccagccacct

SEQ ID NO: 19785 - DNA, 25 bp, Mus musculus
aaatatgcttgtacgggttcttcta

SEQ ID NO: 19786 - DNA, 25 bp, Mus musculus
aaatatgcttgtctgttcacggaaa

SEQ ID NO: 19787 - DNA, 25 bp, Mus musculus
aaatatgcttgtgtgttcacggaaa

SEQ ID NO: 19788 - DNA, 25 bp, Mus musculus
aaatatgcttgttcgggttcttcta

SEQ ID NO: 19789 - DNA, 25 bp, Mus musculus
aaatatgctttgctcagtggctatg

SEQ ID NO: 19790 - DNA, 25 bp, Mus musculus
aaatatgctttggtcagtggctatg

SEQ ID NO: 19791 - DNA, 25 bp, Mus musculus
aaatatggacccacatgcagtatcc

SEQ ID NO: 19792 - DNA, 25 bp, Mus musculus
aaatatggaccctcatgcagtatcc

SEQ ID NO: 19793 - DNA, 25 bp, Mus musculus
aaatatggagctctaaggaccaaga

SEQ ID NO: 19794 - DNA, 25 bp, Mus musculus
aaatatggagctgtaaggaccaaga

SEQ ID NO: 19795 - DNA, 25 bp, Mus musculus
aaatatggcgccaaacttgttactg

SEQ ID NO: 19796 - DNA, 25 bp, Mus musculus
aaatatggcgcctaacttgttactg

SEQ ID NO: 19797 - DNA, 25 bp, Mus musculus
aaatatggtaaaattccttctgaag

SEQ ID NO: 19798 - DNA, 25 bp, Mus musculus
aaatatggtaaatttccttctgaag

SEQ ID NO: 19799 - DNA, 25 bp, Mus musculus
aaatatggtgtcaggccagcccatg

SEQ ID NO: 19800 - DNA, 25 bp, Mus musculus
aaatatggtgtctggccagcccatg

SEQ ID NO: 19801 - DNA, 25 bp, Mus musculus
aaatatgtaattaggtgagtcagac

SEQ ID NO: 19802 - DNA, 25 bp, Mus musculus
aaatatgtaatttggtgagtcagac

SEQ ID NO: 19803 - DNA, 25 bp, Mus musculus
aaatatgtacctatccctcatgctg

SEQ ID NO: 19804 - DNA, 25 bp, Mus musculus
aaatatgtacctttccctcatgctg

SEQ ID NO: 19805 - DNA, 25 bp, Mus musculus
aaatatgtccttactgttttatcaa

SEQ ID NO: 19806 - DNA, 25 bp, Mus musculus
aaatatgtcctttctgttttatcaa

SEQ ID NO: 19807 - DNA, 25 bp, Mus musculus
aaatatgtctatctcaagccagcct

SEQ ID NO: 19808 - DNA, 25 bp, Mus musculus
aaatatgtctatgtcaagccagcct

SEQ ID NO: 19809 - DNA, 25 bp, Mus musculus
aaatatgtgattcccgtgtcctgtg

SEQ ID NO: 19810 - DNA, 25 bp, Mus musculus
aaatatgtgattgccgtgtcctgtg

SEQ ID NO: 19811 - DNA, 25 bp, Mus musculus
aaatatgtggacctccttcacacaa

SEQ ID NO: 19812 - DNA, 25 bp, Mus musculus
aaatatgtggacgtccttcacacaa

SEQ ID NO: 19813 - DNA, 25 bp, Mus musculus
aaatatgttggcattttaagcaaat

SEQ ID NO: 19814 - DNA, 25 bp, Mus musculus
aaatatgttggctttttaagcaaat

SEQ ID NO: 19815 - DNA, 25 bp, Mus musculus
aaatatgttgtaacttgggccagtg

SEQ ID NO: 19816 - DNA, 25 bp, Mus musculus
aaatatgttgtatcttgggccagtg

SEQ ID NO: 19817 - DNA, 25 bp, Mus musculus
aaatatgtttacatgttgaatcttt

SEQ ID NO: 19818 - DNA, 25 bp, Mus musculus
aaatatgtttacttgttgaatcttt

SEQ ID NO: 19819 - DNA, 25 bp, Mus musculus
aaatattaaatgaagctcagttcct

SEQ ID NO: 19820 - DNA, 25 bp, Mus musculus
aaatattaaatgtagctcagttcct

SEQ ID NO: 19821 - DNA, 25 bp, Mus musculus
aaatattaactgatatgccactggg

SEQ ID NO: 19822 - DNA, 25 bp, Mus musculus
aaatattaactgttatgccactggg

SEQ ID NO: 19823 - DNA, 25 bp, Mus musculus
aaatattaccagacaccacggctat

SEQ ID NO: 19824 - DNA, 25 bp, Mus musculus
aaatattaccagtcaccacggctat

SEQ ID NO: 19825 - DNA, 25 bp, Mus musculus
aaatattaccctccctgtcaagttt

SEQ ID NO: 19826 - DNA, 25 bp, Mus musculus
aaatattaccctgcctgtcaagttt

SEQ ID NO: 19827 - DNA, 25 bp, Mus musculus
aaatattagcttaagtatgcacact

SEQ ID NO: 19828 - DNA, 25 bp, Mus musculus
aaatattagctttagtatgcacact

SEQ ID NO: 19829 - DNA, 25 bp, Mus musculus
aaatattaggccagccaacctctgc

SEQ ID NO: 19830 - DNA, 25 bp, Mus musculus
aaatattaggcctgccaacctctgc

SEQ ID NO: 19831 - DNA, 25 bp, Mus musculus
aaatattaggtgactccatctcaac

SEQ ID NO: 19832 - DNA, 25 bp, Mus musculus
aaatattaggtgtctccatctcaac

SEQ ID NO: 19833 - DNA, 25 bp, Mus musculus
aaatattatacccaaggagaggcca

SEQ ID NO: 19834 - DNA, 25 bp, Mus musculus
aaatattataccgaaggagaggcca

SEQ ID NO: 19835 - DNA, 25 bp, Mus musculus
aaatattatactctgcaccctgtga

SEQ ID NO: 19836 - DNA, 25 bp, Mus musculus
aaatattatactgtgcaccctgtga

SEQ ID NO: 19837 - DNA, 25 bp, Mus musculus
aaatattatctgacggccaaggcag

SEQ ID NO: 19838 - DNA, 25 bp, Mus musculus
aaatattatctgtcggccaaggcag

SEQ ID NO: 19839 - DNA, 25 bp, Mus musculus
aaatattcaataagggtctcctaaa

SEQ ID NO: 19840 - DNA, 25 bp, Mus musculus
aaatattcaatatgggtctcctaaa

SEQ ID NO: 19841 - DNA, 25 bp, Mus musculus
aaatattcatgtcagcagtgttggg

SEQ ID NO: 19842 - DNA, 25 bp, Mus musculus
aaatattcatgtgagcagtgttggg

SEQ ID NO: 19843 - DNA, 25 bp, Mus musculus
aaatattcccatcgtatcaccctca

SEQ ID NO: 19844 - DNA, 25 bp, Mus musculus
aaatattcccatggtatcaccctca

SEQ ID NO: 19845 - DNA, 25 bp, Mus musculus
aaatattccgagacatggctggtat

SEQ ID NO: 19846 - DNA, 25 bp, Mus musculus
aaatattccgagtcatggctggtat

SEQ ID NO: 19847 - DNA, 25 bp, Mus musculus
aaatattccgtgaacagacacccgt

SEQ ID NO: 19848 - DNA, 25 bp, Mus musculus
aaatattccgtgtacagacacccgt

SEQ ID NO: 19849 - DNA, 25 bp, Mus musculus
aaatattcctatacggtgcttctca

SEQ ID NO: 19850 - DNA, 25 bp, Mus musculus
aaatattcctattcggtgcttctca

SEQ ID NO: 19851 - DNA, 25 bp, Mus musculus
aaatattcctctactttgacctgat

SEQ ID NO: 19852 - DNA, 25 bp, Mus musculus
aaatattcctcttctttgacctgat

SEQ ID NO: 19853 - DNA, 25 bp, Mus musculus
aaatattcctttacagagtctaaat

SEQ ID NO: 19854 - DNA, 25 bp, Mus musculus
aaatattccttttcagagtctaaat

SEQ ID NO: 19855 - DNA, 25 bp, Mus musculus
aaatattcggatacacagctggcca

SEQ ID NO: 19856 - DNA, 25 bp, Mus musculus
aaatattcggatctttttagtgcct

SEQ ID NO: 19857 - DNA, 25 bp, Mus musculus
aaatattcggatgtttttagtgcct

SEQ ID NO: 19858 - DNA, 25 bp, Mus musculus
aaatattcggattcacagctggcca

SEQ ID NO: 19859 - DNA, 25 bp, Mus musculus
aaatattctaaaagttctttctgct

SEQ ID NO: 19860 - DNA, 25 bp, Mus musculus
aaatattctaaatgttctttctgct

SEQ ID NO: 19861 - DNA, 25 bp, Mus musculus
aaatattctaacaggtctctttcct

SEQ ID NO: 19862 - DNA, 25 bp, Mus musculus
aaatattctaactggtctctttcct

SEQ ID NO: 19863 - DNA, 25 bp, Mus musculus
aaatattctcacatgctcgacatgt

SEQ ID NO: 19864 - DNA, 25 bp, Mus musculus
aaatattctcacttgctcgacatgt

SEQ ID NO: 19865 - DNA, 25 bp, Mus musculus
aaatattgatgtcaacctccccgac

SEQ ID NO: 19866 - DNA, 25 bp, Mus musculus
aaatattgatgtgaacctccccgac

SEQ ID NO: 19867 - DNA, 25 bp, Mus musculus
aaatattgcctgcaccggaaccatt

SEQ ID NO: 19868 - DNA, 25 bp, Mus musculus
aaatattgcctggaccggaaccatt

SEQ ID NO: 19869 - DNA, 25 bp, Mus musculus
aaatattgccttactggaggagtca

SEQ ID NO: 19870 - DNA, 25 bp, Mus musculus
aaatattgccttcctccattcctta

SEQ ID NO: 19871 - DNA, 25 bp, Mus musculus
aaatattgccttgctccattcctta

SEQ ID NO: 19872 - DNA, 25 bp, Mus musculus
aaatattgcctttctggaggagtca

SEQ ID NO: 19873 - DNA, 25 bp, Mus musculus
aaatattgcttactaccccacatcc

SEQ ID NO: 19874 - DNA, 25 bp, Mus musculus
aaatattgcttagtaccccacatcc

SEQ ID NO: 19875 - DNA, 25 bp, Mus musculus
aaatattggccaccttgtgtcctca

SEQ ID NO: 19876 - DNA, 25 bp, Mus musculus
aaatattggccagcttgtgtcctca

SEQ ID NO: 19877 - DNA, 25 bp, Mus musculus
aaatattggctgactttggacgcgg

SEQ ID NO: 19878 - DNA, 25 bp, Mus musculus
aaatattggctgtctttggacgcgg

SEQ ID NO: 19879 - DNA, 25 bp, Mus musculus
aaatattgtcagaatggctcgggaa

SEQ ID NO: 19880 - DNA, 25 bp, Mus musculus
aaatattgtcagtatggctcgggaa

SEQ ID NO: 19881 - DNA, 25 bp, Mus musculus
aaatatttaccaattgtctctcagg

SEQ ID NO: 19882 - DNA, 25 bp, Mus musculus
aaatatttaccatttgtctctcagg

SEQ ID NO: 19883 - DNA, 25 bp, Mus musculus
aaatatttactgcttgggtgtgtgt

SEQ ID NO: 19884 - DNA, 25 bp, Mus musculus
aaatatttactggttgggtgtgtgt

SEQ ID NO: 19885 - DNA, 25 bp, Mus musculus
aaatatttatctccttcaacttgta

SEQ ID NO: 19886 - DNA, 25 bp, Mus musculus
aaatatttatctgcttcaacttgta

SEQ ID NO: 19887 - DNA, 25 bp, Mus musculus
aaatatttcacgatcctggatgcta

SEQ ID NO: 19888 - DNA, 25 bp, Mus musculus
aaatatttcacgttcctggatgcta

SEQ ID NO: 19889 - DNA, 25 bp, Mus musculus
aaatatttcccaaaatgcacttcaa

SEQ ID NO: 19890 - DNA, 25 bp, Mus musculus
aaatatttcccataatgcacttcaa

SEQ ID NO: 19891 - DNA, 25 bp, Mus musculus
aaatatttccccaactgtcgggcag

SEQ ID NO: 19892 - DNA, 25 bp, Mus musculus
aaatatttccccaggctcagagtcc

SEQ ID NO: 19893 - DNA, 25 bp, Mus musculus
aaatatttcccctactgtcgggcag

SEQ ID NO: 19894 - DNA, 25 bp, Mus musculus
aaatatttcccctggctcagagtcc

SEQ ID NO: 19895 - DNA, 25 bp, Mus musculus
aaatatttcctcattgtcaacacaa

SEQ ID NO: 19896 - DNA, 25 bp, Mus musculus
aaatatttcctctttgtcaacacaa

SEQ ID NO: 19897 - DNA, 25 bp, Mus musculus
aaatatttcctgacttgagtgttcc

SEQ ID NO: 19898 - DNA, 25 bp, Mus musculus
aaatatttcctgtcttgagtgttcc

SEQ ID NO: 19899 - DNA, 25 bp, Mus musculus
aaatatttgactcccttccagagga

SEQ ID NO: 19900 - DNA, 25 bp, Mus musculus
aaatatttgactgccttccagagga

SEQ ID NO: 19901 - DNA, 25 bp, Mus musculus
aaatatttgctgacttccattctga

SEQ ID NO: 19902 - DNA, 25 bp, Mus musculus
aaatatttgctgtcttccattctga

SEQ ID NO: 19903 - DNA, 25 bp, Mus musculus
aaatatttggttacagccctagcct

SEQ ID NO: 19904 - DNA, 25 bp, Mus musculus
aaatatttggtttcagccctagcct

SEQ ID NO: 19905 - DNA, 25 bp, Mus musculus
aaatattttatcaccgtctcacttt

SEQ ID NO: 19906 - DNA, 25 bp, Mus musculus
aaatattttatctccgtctcacttt

SEQ ID NO: 19907 - DNA, 25 bp, Mus musculus
aaatattttcatctgactccttgtc

SEQ ID NO: 19908 - DNA, 25 bp, Mus musculus
aaatattttcatgtgactccttgtc

SEQ ID NO: 19909 - DNA, 25 bp, Mus musculus
aaatattttggacacctgaatggct

SEQ ID NO: 19910 - DNA, 25 bp, Mus musculus
aaatattttggagacctgaatggct

SEQ ID NO: 19911 - DNA, 25 bp, Mus musculus
aaatattttgtgaggtcattttcac

SEQ ID NO: 19912 - DNA, 25 bp, Mus musculus
aaatattttgtgtggtcattttcac

SEQ ID NO: 19913 - DNA, 25 bp, Mus musculus
aaatcaaaacatacggtctgtgtgg

SEQ ID NO: 19914 - DNA, 25 bp, Mus musculus
aaatcaaaacattcggtctgtgtgg

SEQ ID NO: 19915 - DNA, 25 bp, Mus musculus
aaatcaaaagctagtttcatcccaa

SEQ ID NO: 19916 - DNA, 25 bp, Mus musculus
aaatcaaaagcttgtttcatcccaa

SEQ ID NO: 19917 - DNA, 25 bp, Mus musculus
aaatcaaaccatatgctctgtgcta

SEQ ID NO: 19918 - DNA, 25 bp, Mus musculus
aaatcaaaccatttgctctgtgcta

SEQ ID NO: 19919 - DNA, 25 bp, Mus musculus
aaatcaaacctcagtcctgaacgat

SEQ ID NO: 19920 - DNA, 25 bp, Mus musculus
aaatcaaacctctgtcctgaacgat

SEQ ID NO: 19921 - DNA, 25 bp, Mus musculus
aaatcaaaccttaatcggcatcaga

SEQ ID NO: 19922 - DNA, 25 bp, Mus musculus
aaatcaaacctttatcggcatcaga

SEQ ID NO: 19923 - DNA, 25 bp, Mus musculus
aaatcaaacgcacatggtaaaaggt

SEQ ID NO: 19924 - DNA, 25 bp, Mus musculus
aaatcaaacgcagatggtaaaaggt

SEQ ID NO: 19925 - DNA, 25 bp, Mus musculus
aaatcaaacgctctgtagttcggag

SEQ ID NO: 19926 - DNA, 25 bp, Mus musculus
aaatcaaacgctgtgtagttcggag

SEQ ID NO: 19927 - DNA, 25 bp, Mus musculus
aaatcaaacgtcatctcttcttcaa

SEQ ID NO: 19928 - DNA, 25 bp, Mus musculus
aaatcaaacgtcttctcttcttcaa

SEQ ID NO: 19929 - DNA, 25 bp, Mus musculus
aaatcaaactgtagcatggaatgct

SEQ ID NO: 19930 - DNA, 25 bp, Mus musculus
aaatcaaactgttgcatggaatgct

SEQ ID NO: 19931 - DNA, 25 bp, Mus musculus
aaatcaaacttgagccccagtcatc

SEQ ID NO: 19932 - DNA, 25 bp, Mus musculus
aaatcaaacttgtgccccagtcatc

SEQ ID NO: 19933 - DNA, 25 bp, Mus musculus
aaatcaaagatgcagaacgtgtata

SEQ ID NO: 19934 - DNA, 25 bp, Mus musculus
aaatcaaagatggagaacgtgtata

SEQ ID NO: 19935 - DNA, 25 bp, Mus musculus
aaatcaaagctaactcctggcctgc

SEQ ID NO: 19936 - DNA, 25 bp, Mus musculus
aaatcaaagctatctcctggcctgc

SEQ ID NO: 19937 - DNA, 25 bp, Mus musculus
aaatcaaaggatctggccccaaaga

SEQ ID NO: 19938 - DNA, 25 bp, Mus musculus
aaatcaaaggatgtggccccaaaga

SEQ ID NO: 19939 - DNA, 25 bp, Mus musculus
aaatcaaattctctatgtcccatag

SEQ ID NO: 19940 - DNA, 25 bp, Mus musculus
aaatcaaattctgtatgtcccatag

SEQ ID NO: 19941 - DNA, 25 bp, Mus musculus
aaatcaaatttcagtttcatcctgt

SEQ ID NO: 19942 - DNA, 25 bp, Mus musculus
aaatcaaatttctgtttcatcctgt

SEQ ID NO: 19943 - DNA, 25 bp, Mus musculus
aaatcaacaagaaggtggcacaggg

SEQ ID NO: 19944 - DNA, 25 bp, Mus musculus
aaatcaacaagatggtggcacaggg

SEQ ID NO: 19945 - DNA, 25 bp, Mus musculus
aaatcaacaatgacagcgccatgct

SEQ ID NO: 19946 - DNA, 25 bp, Mus musculus
aaatcaacaatgtcagcgccatgct

SEQ ID NO: 19947 - DNA, 25 bp, Mus musculus
aaatcaacagcccaggtttatccct

SEQ ID NO: 19948 - DNA, 25 bp, Mus musculus
aaatcaacagccgaggtttatccct

SEQ ID NO: 19949 - DNA, 25 bp, Mus musculus
aaatcaacagtaagggtgctaaaga

SEQ ID NO: 19950 - DNA, 25 bp, Mus musculus
aaatcaacagtatgggtgctaaaga

SEQ ID NO: 19951 - DNA, 25 bp, Mus musculus
aaatcaacagtcacagtggacagag

SEQ ID NO: 19952 - DNA, 25 bp, Mus musculus
aaatcaacagtctcagtggacagag

SEQ ID NO: 19953 - DNA, 25 bp, Mus musculus
aaatcaacattacccatcagcctct

SEQ ID NO: 19954 - DNA, 25 bp, Mus musculus
aaatcaacattagccatcagcctct

SEQ ID NO: 19955 - DNA, 25 bp, Mus musculus
aaatcaacctttcattgtctaccct

SEQ ID NO: 19956 - DNA, 25 bp, Mus musculus
aaatcaacctttgattgtctaccct

SEQ ID NO: 19957 - DNA, 25 bp, Mus musculus
aaatcaacgaaaactgtgaagtccc

SEQ ID NO: 19958 - DNA, 25 bp, Mus musculus
aaatcaacgaaatctgtgaagtccc

SEQ ID NO: 19959 - DNA, 25 bp, Mus musculus
aaatcaactcataaatagcttcatt

SEQ ID NO: 19960 - DNA, 25 bp, Mus musculus
aaatcaactcattaatagcttcatt

SEQ ID NO: 19961 - DNA, 25 bp, Mus musculus
aaatcaactgctacaataccaacta

SEQ ID NO: 19962 - DNA, 25 bp, Mus musculus
aaatcaactgcttcaataccaacta

SEQ ID NO: 19963 - DNA, 25 bp, Mus musculus
aaatcaagacagacgtgcaggagat

SEQ ID NO: 19964 - DNA, 25 bp, Mus musculus
aaatcaagacagtcgtgcaggagat

SEQ ID NO: 19965 - DNA, 25 bp, Mus musculus
aaatcaagacgcatttctccaacct

SEQ ID NO: 19966 - DNA, 25 bp, Mus musculus
aaatcaagacgcttttctccaacct

SEQ ID NO: 19967 - DNA, 25 bp, Mus musculus
aaatcaagactgaataccaagggaa

SEQ ID NO: 19968 - DNA, 25 bp, Mus musculus
aaatcaagactgtataccaagggaa

SEQ ID NO: 19969 - DNA, 25 bp, Mus musculus
aaatcaagagtcattcctaaggtaa

SEQ ID NO: 19970 - DNA, 25 bp, Mus musculus
aaatcaagagtctttcctaaggtaa

SEQ ID NO: 19971 - DNA, 25 bp, Mus musculus
aaatcaagatgaaatggtgcttaac

SEQ ID NO: 19972 - DNA, 25 bp, Mus musculus
aaatcaagatgatatggtgcttaac

SEQ ID NO: 19973 - DNA, 25 bp, Mus musculus
aaatcaagccggatatcatggtaaa

SEQ ID NO: 19974 - DNA, 25 bp, Mus musculus
aaatcaagccggttatcatggtaaa

SEQ ID NO: 19975 - DNA, 25 bp, Mus musculus
aaatcaagcctgacacattgccgac

SEQ ID NO: 19976 - DNA, 25 bp, Mus musculus
aaatcaagcctgtcacattgccgac

SEQ ID NO: 19977 - DNA, 25 bp, Mus musculus
aaatcaaggcttcgacggccctgtg

SEQ ID NO: 19978 - DNA, 25 bp, Mus musculus
aaatcaaggcttggacggccctgtg

SEQ ID NO: 19979 - DNA, 25 bp, Mus musculus
aaatcaagggagctcccacagaatc

SEQ ID NO: 19980 - DNA, 25 bp, Mus musculus
aaatcaagggaggtcccacagaatc

SEQ ID NO: 19981 - DNA, 25 bp, Mus musculus
aaatcaaggtgaagggttgtgttgt

SEQ ID NO: 19982 - DNA, 25 bp, Mus musculus
aaatcaaggtgatgggttgtgttgt

SEQ ID NO: 19983 - DNA, 25 bp, Mus musculus
aaatcaaggtggcaagcatcaggag

SEQ ID NO: 19984 - DNA, 25 bp, Mus musculus
aaatcaaggtgggaagcatcaggag

SEQ ID NO: 19985 - DNA, 25 bp, Mus musculus
aaatcaagtcctcatactgccttcc

SEQ ID NO: 19986 - DNA, 25 bp, Mus musculus
aaatcaagtcctgatactgccttcc

SEQ ID NO: 19987 - DNA, 25 bp, Mus musculus
aaatcaagtgcacccagaactcctg

SEQ ID NO: 19988 - DNA, 25 bp, Mus musculus
aaatcaagtgcagccagaactcctg

SEQ ID NO: 19989 - DNA, 25 bp, Mus musculus
aaatcaagttccatgttcccacagt

SEQ ID NO: 19990 - DNA, 25 bp, Mus musculus
aaatcaagttccttgttcccacagt

SEQ ID NO: 19991 - DNA, 25 bp, Mus musculus
aaatcaatccatatgggttggtggt

SEQ ID NO: 19992 - DNA, 25 bp, Mus musculus
aaatcaatccatttgggttggtggt

SEQ ID NO: 19993 - DNA, 25 bp, Mus musculus
aaatcaatctcaactactcccgaga

SEQ ID NO: 19994 - DNA, 25 bp, Mus musculus
aaatcaatctcacggctacaatcag

SEQ ID NO: 19995 - DNA, 25 bp, Mus musculus
aaatcaatctcagggctacaatcag

SEQ ID NO: 19996 - DNA, 25 bp, Mus musculus
aaatcaatctcatctactcccgaga

SEQ ID NO: 19997 - DNA, 25 bp, Mus musculus
aaatcaatcttccactatcaacaca

SEQ ID NO: 19998 - DNA, 25 bp, Mus musculus
aaatcaatcttcgactatcaacaca

SEQ ID NO: 19999 - DNA, 25 bp, Mus musculus
aaatcaatgactagcgctacccacc

SEQ ID NO: 20000 - DNA, 25 bp, Mus musculus
aaatcaatgacttgcgctacccacc

SEQ ID NO: 20001 - DNA, 25 bp, Mus musculus
aaatcaatgcccctttgctctcatg

SEQ ID NO: 20002 - DNA, 25 bp, Mus musculus
aaatcaatgcccgtttgctctcatg

SEQ ID NO: 20003 - DNA, 25 bp, Mus musculus
aaatcaatgggacattccttcttag

SEQ ID NO: 20004 - DNA, 25 bp, Mus musculus
aaatcaatgggagattccttcttag

SEQ ID NO: 20005 - DNA, 25 bp, Mus musculus
aaatcaattaggctcccaattccgc

SEQ ID NO: 20006 - DNA, 25 bp, Mus musculus
aaatcaattagggtcccaattccgc

SEQ ID NO: 20007 - DNA, 25 bp, Mus musculus
aaatcacaacgcattgcttctcgac

SEQ ID NO: 20008 - DNA, 25 bp, Mus musculus
aaatcacaacgctttgcttctcgac

SEQ ID NO: 20009 - DNA, 25 bp, Mus musculus
aaatcacaatccagagtttcccctg

SEQ ID NO: 20010 - DNA, 25 bp, Mus musculus
aaatcacaatcctgagtttcccctg

SEQ ID NO: 20011 - DNA, 25 bp, Mus musculus
aaatcacaatgtactggcactaaaa

SEQ ID NO: 20012 - DNA, 25 bp, Mus musculus
aaatcacaatgttctggcactaaaa

SEQ ID NO: 20013 - DNA, 25 bp, Mus musculus
aaatcacacattaggtttggttatg

SEQ ID NO: 20014 - DNA, 25 bp, Mus musculus
aaatcacacattctctgtgcctcag

SEQ ID NO: 20015 - DNA, 25 bp, Mus musculus
aaatcacacattgtctgtgcctcag

SEQ ID NO: 20016 - DNA, 25 bp, Mus musculus
aaatcacacatttggtttggttatg

SEQ ID NO: 20017 - DNA, 25 bp, Mus musculus
aaatcacaccacagctcatatagag

SEQ ID NO: 20018 - DNA, 25 bp, Mus musculus
aaatcacaccactgctcatatagag

SEQ ID NO: 20019 - DNA, 25 bp, Mus musculus
aaatcacaccagcatctactagcca

SEQ ID NO: 20020 - DNA, 25 bp, Mus musculus
aaatcacaccaggatctactagcca

SEQ ID NO: 20021 - DNA, 25 bp, Mus musculus
aaatcacacccaactattctgctgt

SEQ ID NO: 20022 - DNA, 25 bp, Mus musculus
aaatcacacccatctattctgctgt

SEQ ID NO: 20023 - DNA, 25 bp, Mus musculus
aaatcacacctaccagagaaatcca

SEQ ID NO: 20024 - DNA, 25 bp, Mus musculus
aaatcacacctagcagagaaatcca

SEQ ID NO: 20025 - DNA, 25 bp, Mus musculus
aaatcacacttcagacctgtgcgta

SEQ ID NO: 20026 - DNA, 25 bp, Mus musculus
aaatcacacttctgacctgtgcgta

SEQ ID NO: 20027 - DNA, 25 bp, Mus musculus
aaatcacagatcaaccatgcctgct

SEQ ID NO: 20028 - DNA, 25 bp, Mus musculus
aaatcacagatcacttcagacctcc

SEQ ID NO: 20029 - DNA, 25 bp, Mus musculus
aaatcacagatctaccatgcctgct

SEQ ID NO: 20030 - DNA, 25 bp, Mus musculus
aaatcacagatctcttcagacctcc

SEQ ID NO: 20031 - DNA, 25 bp, Mus musculus
aaatcacagatgcaccagttcttcc

SEQ ID NO: 20032 - DNA, 25 bp, Mus musculus
aaatcacagatggaccagttcttcc

SEQ ID NO: 20033 - DNA, 25 bp, Mus musculus
aaatcacagcctatgttgccatcaa

SEQ ID NO: 20034 - DNA, 25 bp, Mus musculus
aaatcacagcctttgttgccatcaa

SEQ ID NO: 20035 - DNA, 25 bp, Mus musculus
aaatcacaggacagggttctctccc

SEQ ID NO: 20036 - DNA, 25 bp, Mus musculus
aaatcacaggactgggttctctccc

SEQ ID NO: 20037 - DNA, 25 bp, Mus musculus
aaatcacaggctaataagacctttc

SEQ ID NO: 20038 - DNA, 25 bp, Mus musculus
aaatcacaggcttataagacctttc

SEQ ID NO: 20039 - DNA, 25 bp, Mus musculus
aaatcacagtacaagacacctcaca

SEQ ID NO: 20040 - DNA, 25 bp, Mus musculus
aaatcacagtactagacacctcaca

SEQ ID NO: 20041 - DNA, 25 bp, Mus musculus
aaatcacagtgtattgtttcccaat

SEQ ID NO: 20042 - DNA, 25 bp, Mus musculus
aaatcacagtgttttgtttcccaat

SEQ ID NO: 20043 - DNA, 25 bp, Mus musculus
aaatcacagtttatctacaggcaga

SEQ ID NO: 20044 - DNA, 25 bp, Mus musculus
aaatcacagtttttctacaggcaga

SEQ ID NO: 20045 - DNA, 25 bp, Mus musculus
aaatcacatacccttttctggactt

SEQ ID NO: 20046 - DNA, 25 bp, Mus musculus
aaatcacataccgttttctggactt

SEQ ID NO: 20047 - DNA, 25 bp, Mus musculus
aaatcacatagactcccactgtctt

SEQ ID NO: 20048 - DNA, 25 bp, Mus musculus
aaatcacatagagtcccactgtctt

SEQ ID NO: 20049 - DNA, 25 bp, Mus musculus
aaatcacatcatcgtgctcctgcga

SEQ ID NO: 20050 - DNA, 25 bp, Mus musculus
aaatcacatcatggtgctcctgcga

SEQ ID NO: 20051 - DNA, 25 bp, Mus musculus
aaatcacatctgctattttcagcat

SEQ ID NO: 20052 - DNA, 25 bp, Mus musculus
aaatcacatctggtattttcagcat

SEQ ID NO: 20053 - DNA, 25 bp, Mus musculus
aaatcacattctccctgctgatagg

SEQ ID NO: 20054 - DNA, 25 bp, Mus musculus
aaatcacattctgcctgctgatagg

SEQ ID NO: 20055 - DNA, 25 bp, Mus musculus
aaatcaccaagactatcctttccac

SEQ ID NO: 20056 - DNA, 25 bp, Mus musculus
aaatcaccaagagtatcctttccac

SEQ ID NO: 20057 - DNA, 25 bp, Mus musculus
aaatcaccaaggcatctgcacgtgc

SEQ ID NO: 20058 - DNA, 25 bp, Mus musculus
aaatcaccaagggatctgcacgtgc

SEQ ID NO: 20059 - DNA, 25 bp, Mus musculus
aaatcaccacaacttttctgcctca

SEQ ID NO: 20060 - DNA, 25 bp, Mus musculus
aaatcaccacaagttttctgcctca

SEQ ID NO: 20061 - DNA, 25 bp, Mus musculus
aaatcaccacatacttttacttcca

SEQ ID NO: 20062 - DNA, 25 bp, Mus musculus
aaatcaccacattcttttacttcca

SEQ ID NO: 20063 - DNA, 25 bp, Mus musculus
aaatcaccacgacctcttggtgaaa

SEQ ID NO: 20064 - DNA, 25 bp, Mus musculus
aaatcaccacgagctcttggtgaaa

SEQ ID NO: 20065 - DNA, 25 bp, Mus musculus
aaatcaccacttcctatgcagtgcc

SEQ ID NO: 20066 - DNA, 25 bp, Mus musculus
aaatcaccacttgctatgcagtgcc

SEQ ID NO: 20067 - DNA, 25 bp, Mus musculus
aaatcaccagatcagggcctgcagg

SEQ ID NO: 20068 - DNA, 25 bp, Mus musculus
aaatcaccagatgagggcctgcagg

SEQ ID NO: 20069 - DNA, 25 bp, Mus musculus
aaatcaccagcacggctagctatac

SEQ ID NO: 20070 - DNA, 25 bp, Mus musculus
aaatcaccagcagggctagctatac

SEQ ID NO: 20071 - DNA, 25 bp, Mus musculus
aaatcaccagttacccagtgtcagg

SEQ ID NO: 20072 - DNA, 25 bp, Mus musculus
aaatcaccagtttcccagtgtcagg

SEQ ID NO: 20073 - DNA, 25 bp, Mus musculus
aaatcaccatctatggacaacccag

SEQ ID NO: 20074 - DNA, 25 bp, Mus musculus
aaatcaccatctttggacaacccag

SEQ ID NO: 20075 - DNA, 25 bp, Mus musculus
aaatcacccaccagttgtgagccac

SEQ ID NO: 20076 - DNA, 25 bp, Mus musculus
aaatcacccacctgttgtgagccac

SEQ ID NO: 20077 - DNA, 25 bp, Mus musculus
aaatcacccattccctgtgtctata

SEQ ID NO: 20078 - DNA, 25 bp, Mus musculus
aaatcacccattgcctgtgtctata

SEQ ID NO: 20079 - DNA, 25 bp, Mus musculus
aaatcacccgtgatcagtgaaacag

SEQ ID NO: 20080 - DNA, 25 bp, Mus musculus
aaatcacccgtgttcagtgaaacag

SEQ ID NO: 20081 - DNA, 25 bp, Mus musculus
aaatcaccgtgcaagcttcaaaggc

SEQ ID NO: 20082 - DNA, 25 bp, Mus musculus
aaatcaccgtgctagcttcaaaggc

SEQ ID NO: 20083 - DNA, 25 bp, Mus musculus
aaatcacctcaacagccctgtgaag

SEQ ID NO: 20084 - DNA, 25 bp, Mus musculus
aaatcacctcaagagccctgtgaag

SEQ ID NO: 20085 - DNA, 25 bp, Mus musculus
aaatcacctgaaagaacgggagtag

SEQ ID NO: 20086 - DNA, 25 bp, Mus musculus
aaatcacctgaatgaacgggagtag

SEQ ID NO: 20087 - DNA, 25 bp, Mus musculus
aaatcacctggtaccaaggatgtgg

SEQ ID NO: 20088 - DNA, 25 bp, Mus musculus
aaatcacctggttccaaggatgtgg

SEQ ID NO: 20089 - DNA, 25 bp, Mus musculus
aaatcacctgtaagttgatcttggg

SEQ ID NO: 20090 - DNA, 25 bp, Mus musculus
aaatcacctgtatgttgatcttggg

SEQ ID NO: 20091 - DNA, 25 bp, Mus musculus
aaatcacctgtcagctttactgaag

SEQ ID NO: 20092 - DNA, 25 bp, Mus musculus
aaatcacctgtctgctttactgaag

SEQ ID NO: 20093 - DNA, 25 bp, Mus musculus
aaatcacctgtgacatgcatttcag

SEQ ID NO: 20094 - DNA, 25 bp, Mus musculus
aaatcacctgtgtcatgcatttcag

SEQ ID NO: 20095 - DNA, 25 bp, Mus musculus
aaatcaccttaaacttccatcgata

SEQ ID NO: 20096 - DNA, 25 bp, Mus musculus
aaatcaccttaatcttccatcgata

SEQ ID NO: 20097 - DNA, 25 bp, Mus musculus
aaatcacgacagcagcctcctgagg

SEQ ID NO: 20098 - DNA, 25 bp, Mus musculus
aaatcacgacaggagcctcctgagg

SEQ ID NO: 20099 - DNA, 25 bp, Mus musculus
aaatcacgcttgcaattctcatgtc

SEQ ID NO: 20100 - DNA, 25 bp, Mus musculus
aaatcacgcttggaattctcatgtc

SEQ ID NO: 20101 - DNA, 25 bp, Mus musculus
aaatcacggagccagccatggcaca

SEQ ID NO: 20102 - DNA, 25 bp, Mus musculus
aaatcacggagcgagccatggcaca

SEQ ID NO: 20103 - DNA, 25 bp, Mus musculus
aaatcacggatgcatgctgtctcca

SEQ ID NO: 20104 - DNA, 25 bp, Mus musculus
aaatcacggatggatgctgtctcca

SEQ ID NO: 20105 - DNA, 25 bp, Mus musculus
aaatcacgttggatagagctggaaa

SEQ ID NO: 20106 - DNA, 25 bp, Mus musculus
aaatcacgttggttagagctggaaa

SEQ ID NO: 20107 - DNA, 25 bp, Mus musculus
aaatcactacggagctggaggtggc

SEQ ID NO: 20108 - DNA, 25 bp, Mus musculus
aaatcactacggtgctggaggtggc

SEQ ID NO: 20109 - DNA, 25 bp, Mus musculus
aaatcactagagaatttctgggaca

SEQ ID NO: 20110 - DNA, 25 bp, Mus musculus
aaatcactagagtatttctgggaca

SEQ ID NO: 20111 - DNA, 25 bp, Mus musculus
aaatcactccttcggtttaagtatg

SEQ ID NO: 20112 - DNA, 25 bp, Mus musculus
aaatcactccttgggtttaagtatg

SEQ ID NO: 20113 - DNA, 25 bp, Mus musculus
aaatcactctgtcaagatgtggaat

SEQ ID NO: 20114 - DNA, 25 bp, Mus musculus
aaatcactctgtgaagatgtggaat

SEQ ID NO: 20115 - DNA, 25 bp, Mus musculus
aaatcactctttaagaccagcctcc

SEQ ID NO: 20116 - DNA, 25 bp, Mus musculus
aaatcactcttttagaccagcctcc

SEQ ID NO: 20117 - DNA, 25 bp, Mus musculus
aaatcactgaacactaactggtaat

SEQ ID NO: 20118 - DNA, 25 bp, Mus musculus
aaatcactgaactctaactggtaat

SEQ ID NO: 20119 - DNA, 25 bp, Mus musculus
aaatcactgcaacagcacacgtcat

SEQ ID NO: 20120 - DNA, 25 bp, Mus musculus
aaatcactgcaagagcacacgtcat

SEQ ID NO: 20121 - DNA, 25 bp, Mus musculus
aaatcactgccaattgaaactgtgt

SEQ ID NO: 20122 - DNA, 25 bp, Mus musculus
aaatcactgccatttgaaactgtgt

SEQ ID NO: 20123 - DNA, 25 bp, Mus musculus
aaatcactggcaagctgttggagat

SEQ ID NO: 20124 - DNA, 25 bp, Mus musculus
aaatcactggcatgctgttggagat

SEQ ID NO: 20125 - DNA, 25 bp, Mus musculus
aaatcactggctatggatgcaatcc

SEQ ID NO: 20126 - DNA, 25 bp, Mus musculus
aaatcactggctttggatgcaatcc

SEQ ID NO: 20127 - DNA, 25 bp, Mus musculus
aaatcactggttaattcaaagcttt

SEQ ID NO: 20128 - DNA, 25 bp, Mus musculus
aaatcactggtttattcaaagcttt

SEQ ID NO: 20129 - DNA, 25 bp, Mus musculus
aaatcactgtaacctctttactaat

SEQ ID NO: 20130 - DNA, 25 bp, Mus musculus
aaatcactgtaagctctttactaat

SEQ ID NO: 20131 - DNA, 25 bp, Mus musculus
aaatcactgtagacacggatagaga

SEQ ID NO: 20132 - DNA, 25 bp, Mus musculus
aaatcactgtagtcacggatagaga

SEQ ID NO: 20133 - DNA, 25 bp, Mus musculus
aaatcactgtctacattcggcactt

SEQ ID NO: 20134 - DNA, 25 bp, Mus musculus
aaatcactgtcttcattcggcactt

SEQ ID NO: 20135 - DNA, 25 bp, Mus musculus
aaatcactgtggaccatggtaccac

SEQ ID NO: 20136 - DNA, 25 bp, Mus musculus
aaatcactgtggtccatggtaccac

SEQ ID NO: 20137 - DNA, 25 bp, Mus musculus
aaatcactgtgtagcacttcaaaca

SEQ ID NO: 20138 - DNA, 25 bp, Mus musculus
aaatcactgtgttgcacttcaaaca

SEQ ID NO: 20139 - DNA, 25 bp, Mus musculus
aaatcactgttaaaagtcctgtcag

SEQ ID NO: 20140 - DNA, 25 bp, Mus musculus
aaatcactgttataagtcctgtcag

SEQ ID NO: 20141 - DNA, 25 bp, Mus musculus
aaatcactgtttccttacttgagaa

SEQ ID NO: 20142 - DNA, 25 bp, Mus musculus
aaatcactgtttgcttacttgagaa

SEQ ID NO: 20143 - DNA, 25 bp, Mus musculus
aaatcacttattactctggattgaa

SEQ ID NO: 20144 - DNA, 25 bp, Mus musculus
aaatcacttatttctctggattgaa

SEQ ID NO: 20145 - DNA, 25 bp, Mus musculus
aaatcacttccactgagacttcctt

SEQ ID NO: 20146 - DNA, 25 bp, Mus musculus
aaatcacttccagtgagacttcctt

SEQ ID NO: 20147 - DNA, 25 bp, Mus musculus
aaatcacttcccagcttggcttcat

SEQ ID NO: 20148 - DNA, 25 bp, Mus musculus
aaatcacttccctgcttggcttcat

SEQ ID NO: 20149 - DNA, 25 bp, Mus musculus
aaatcacttcctctggaattcctcc

SEQ ID NO: 20150 - DNA, 25 bp, Mus musculus
aaatcacttcctgtggaattcctcc

SEQ ID NO: 20151 - DNA, 25 bp, Mus musculus
aaatcacttctaactttgcccacaa

SEQ ID NO: 20152 - DNA, 25 bp, Mus musculus
aaatcacttctatctttgcccacaa

SEQ ID NO: 20153 - DNA, 25 bp, Mus musculus
aaatcacttgctctttaattgctgt

SEQ ID NO: 20154 - DNA, 25 bp, Mus musculus
aaatcacttgctgtttaattgctgt

SEQ ID NO: 20155 - DNA, 25 bp, Mus musculus
aaatcactttacacttcaatggccc

SEQ ID NO: 20156 - DNA, 25 bp, Mus musculus
aaatcactttactcttcaatggccc

SEQ ID NO: 20157 - DNA, 25 bp, Mus musculus
aaatcactttcacatcactctttat

SEQ ID NO: 20158 - DNA, 25 bp, Mus musculus
aaatcactttcagatcactctttat

SEQ ID NO: 20159 - DNA, 25 bp, Mus musculus
aaatcactttctagctaggcaggta

SEQ ID NO: 20160 - DNA, 25 bp, Mus musculus
aaatcactttcttgctaggcaggta

SEQ ID NO: 20161 - DNA, 25 bp, Mus musculus
aaatcagaactacttcatggaggtg

SEQ ID NO: 20162 - DNA, 25 bp, Mus musculus
aaatcagaactagttcatggaggtg

SEQ ID NO: 20163 - DNA, 25 bp, Mus musculus
aaatcagaactcaggtgtgctgtgc

SEQ ID NO: 20164 - DNA, 25 bp, Mus musculus
aaatcagaactctggtgtgctgtgc

SEQ ID NO: 20165 - DNA, 25 bp, Mus musculus
aaatcagaagccaccatccctggca

SEQ ID NO: 20166 - DNA, 25 bp, Mus musculus
aaatcagaagccctaagctgctctc

SEQ ID NO: 20167 - DNA, 25 bp, Mus musculus
aaatcagaagccgtaagctgctctc

SEQ ID NO: 20168 - DNA, 25 bp, Mus musculus
aaatcagaagcctccatccctggca

SEQ ID NO: 20169 - DNA, 25 bp, Mus musculus
aaatcagacaatagagcgcctcacc

SEQ ID NO: 20170 - DNA, 25 bp, Mus musculus
aaatcagacaatcccctggcttaga

SEQ ID NO: 20171 - DNA, 25 bp, Mus musculus
aaatcagacaatgccctggcttaga

SEQ ID NO: 20172 - DNA, 25 bp, Mus musculus
aaatcagacaattgagcgcctcacc

SEQ ID NO: 20173 - DNA, 25 bp, Mus musculus
aaatcagacatgcagctggcgacag

SEQ ID NO: 20174 - DNA, 25 bp, Mus musculus
aaatcagacatggagctggcgacag

SEQ ID NO: 20175 - DNA, 25 bp, Mus musculus
aaatcagacctgacacaacgcggac

SEQ ID NO: 20176 - DNA, 25 bp, Mus musculus
aaatcagacctgtcacaacgcggac

SEQ ID NO: 20177 - DNA, 25 bp, Mus musculus
aaatcagacggcattaaacacacac

SEQ ID NO: 20178 - DNA, 25 bp, Mus musculus
aaatcagacggctttaaacacacac

SEQ ID NO: 20179 - DNA, 25 bp, Mus musculus
aaatcagagcctcgcattcattgaa

SEQ ID NO: 20180 - DNA, 25 bp, Mus musculus
aaatcagagcctggcattcattgaa

SEQ ID NO: 20181 - DNA, 25 bp, Mus musculus
aaatcagagcttagaccaaaataaa

SEQ ID NO: 20182 - DNA, 25 bp, Mus musculus
aaatcagagctttgaccaaaataaa

SEQ ID NO: 20183 - DNA, 25 bp, Mus musculus
aaatcagaggtaatggctcctccca

SEQ ID NO: 20184 - DNA, 25 bp, Mus musculus
aaatcagaggtattggctcctccca

SEQ ID NO: 20185 - DNA, 25 bp, Mus musculus
aaatcagagtgcacctggcaaccat

SEQ ID NO: 20186 - DNA, 25 bp, Mus musculus
aaatcagagtgctcctggcaaccat

SEQ ID NO: 20187 - DNA, 25 bp, Mus musculus
aaatcagagttaaccatatcccttt

SEQ ID NO: 20188 - DNA, 25 bp, Mus musculus
aaatcagagttatccatatcccttt

SEQ ID NO: 20189 - DNA, 25 bp, Mus musculus
aaatcagatacacagggctatgcaa

SEQ ID NO: 20190 - DNA, 25 bp, Mus musculus
aaatcagatacagagggctatgcaa

SEQ ID NO: 20191 - DNA, 25 bp, Mus musculus
aaatcagatcaacagctttggcaag

SEQ ID NO: 20192 - DNA, 25 bp, Mus musculus
aaatcagatcaagagctttggcaag

SEQ ID NO: 20193 - DNA, 25 bp, Mus musculus
aaatcagatcttatcatcgtcccca

SEQ ID NO: 20194 - DNA, 25 bp, Mus musculus
aaatcagatcttttcatcgtcccca

SEQ ID NO: 20195 - DNA, 25 bp, Mus musculus
aaatcagatgctaacggcaacccct

SEQ ID NO: 20196 - DNA, 25 bp, Mus musculus
aaatcagatgcttacggcaacccct

SEQ ID NO: 20197 - DNA, 25 bp, Mus musculus
aaatcagcaaaccacgtagcagcta

SEQ ID NO: 20198 - DNA, 25 bp, Mus musculus
aaatcagcaaacgacgtagcagcta

SEQ ID NO: 20199 - DNA, 25 bp, Mus musculus
aaatcagcacagaagacctcctttt

SEQ ID NO: 20200 - DNA, 25 bp, Mus musculus
aaatcagcacagtagacctcctttt

SEQ ID NO: 20201 - DNA, 25 bp, Mus musculus
aaatcagcactcagtgaaggagcat

SEQ ID NO: 20202 - DNA, 25 bp, Mus musculus
aaatcagcactccaatatccttggg

SEQ ID NO: 20203 - DNA, 25 bp, Mus musculus
aaatcagcactcgaatatccttggg

SEQ ID NO: 20204 - DNA, 25 bp, Mus musculus
aaatcagcactctgtgaaggagcat

SEQ ID NO: 20205 - DNA, 25 bp, Mus musculus
aaatcagcagccacctggaggagca

SEQ ID NO: 20206 - DNA, 25 bp, Mus musculus
aaatcagcagcctcctggaggagca

SEQ ID NO: 20207 - DNA, 25 bp, Mus musculus
aaatcagcaggtattacagtggcat

SEQ ID NO: 20208 - DNA, 25 bp, Mus musculus
aaatcagcaggtctaatcccaccag

SEQ ID NO: 20209 - DNA, 25 bp, Mus musculus
aaatcagcaggtgtaatcccaccag

SEQ ID NO: 20210 - DNA, 25 bp, Mus musculus
aaatcagcaggttttacagtggcat

SEQ ID NO: 20211 - DNA, 25 bp, Mus musculus
aaatcagcatctcaatttcacctcc

SEQ ID NO: 20212 - DNA, 25 bp, Mus musculus
aaatcagcatctgaatttcacctcc

SEQ ID NO: 20213 - DNA, 25 bp, Mus musculus
aaatcagcatgcctgtgcgcttctt

SEQ ID NO: 20214 - DNA, 25 bp, Mus musculus
aaatcagcatgcgtgtgcgcttctt

SEQ ID NO: 20215 - DNA, 25 bp, Mus musculus
aaatcagcatgtcgttttgtgaata

SEQ ID NO: 20216 - DNA, 25 bp, Mus musculus
aaatcagcatgtggttttgtgaata

SEQ ID NO: 20217 - DNA, 25 bp, Mus musculus
aaatcagccagactggaaccacatc

SEQ ID NO: 20218 - DNA, 25 bp, Mus musculus
aaatcagccagagtggaaccacatc

SEQ ID NO: 20219 - DNA, 25 bp, Mus musculus
aaatcagccattacatgccaccaga

SEQ ID NO: 20220 - DNA, 25 bp, Mus musculus
aaatcagccatttcatgccaccaga

SEQ ID NO: 20221 - DNA, 25 bp, Mus musculus
aaatcagcccatagtgtttaaagac

SEQ ID NO: 20222 - DNA, 25 bp, Mus musculus
aaatcagcccattgtgtttaaagac

SEQ ID NO: 20223 - DNA, 25 bp, Mus musculus
aaatcagcgctgagtgtctgtggcc

SEQ ID NO: 20224 - DNA, 25 bp, Mus musculus
aaatcagcgctgtgtgtctgtggcc

SEQ ID NO: 20225 - DNA, 25 bp, Mus musculus
aaatcagcggtcaggtaagatactg

SEQ ID NO: 20226 - DNA, 25 bp, Mus musculus
aaatcagcggtctggtaagatactg

SEQ ID NO: 20227 - DNA, 25 bp, Mus musculus
aaatcagctctaagggcgtttggtt

SEQ ID NO: 20228 - DNA, 25 bp, Mus musculus
aaatcagctctatgggcgtttggtt

SEQ ID NO: 20229 - DNA, 25 bp, Mus musculus
aaatcagctctgagtgactatggca

SEQ ID NO: 20230 - DNA, 25 bp, Mus musculus
aaatcagctctgtgtgactatggca

SEQ ID NO: 20231 - DNA, 25 bp, Mus musculus
aaatcagctgagaggcccggaagaa

SEQ ID NO: 20232 - DNA, 25 bp, Mus musculus
aaatcagctgagtggcccggaagaa

SEQ ID NO: 20233 - DNA, 25 bp, Mus musculus
aaatcagctggcatcctgttgataa

SEQ ID NO: 20234 - DNA, 25 bp, Mus musculus
aaatcagctggcttcctgttgataa

SEQ ID NO: 20235 - DNA, 25 bp, Mus musculus
aaatcagcttgcatctgctaacagc

SEQ ID NO: 20236 - DNA, 25 bp, Mus musculus
aaatcagcttgcttctgctaacagc

SEQ ID NO: 20237 - DNA, 25 bp, Mus musculus
aaatcagctttaattgcatccagcg

SEQ ID NO: 20238 - DNA, 25 bp, Mus musculus
aaatcagctttatttgcatccagcg

SEQ ID NO: 20239 - DNA, 25 bp, Mus musculus
aaatcaggacaaagacttgcatcaa

SEQ ID NO: 20240 - DNA, 25 bp, Mus musculus
aaatcaggacaatgacttgcatcaa

SEQ ID NO: 20241 - DNA, 25 bp, Mus musculus
aaatcaggacacacaactcggaagt

SEQ ID NO: 20242 - DNA, 25 bp, Mus musculus
aaatcaggacactcaactcggaagt

SEQ ID NO: 20243 - DNA, 25 bp, Mus musculus
aaatcaggactgactcttcactggc

SEQ ID NO: 20244 - DNA, 25 bp, Mus musculus
aaatcaggactgtctcttcactggc

SEQ ID NO: 20245 - DNA, 25 bp, Mus musculus
aaatcaggatttacctagaagcaga

SEQ ID NO: 20246 - DNA, 25 bp, Mus musculus
aaatcaggattttcctagaagcaga

SEQ ID NO: 20247 - DNA, 25 bp, Mus musculus
aaatcaggcacactttgggtggtat

SEQ ID NO: 20248 - DNA, 25 bp, Mus musculus
aaatcaggcacagtttgggtggtat

SEQ ID NO: 20249 - DNA, 25 bp, Mus musculus
aaatcaggcaggatggttcagcact

SEQ ID NO: 20250 - DNA, 25 bp, Mus musculus
aaatcaggcaggttggttcagcact

SEQ ID NO: 20251 - DNA, 25 bp, Mus musculus
aaatcaggctgtaacaacaaaggaa

SEQ ID NO: 20252 - DNA, 25 bp, Mus musculus
aaatcaggctgttacaacaaaggaa

SEQ ID NO: 20253 - DNA, 25 bp, Mus musculus
aaatcaggctttacatcccactgtc

SEQ ID NO: 20254 - DNA, 25 bp, Mus musculus
aaatcaggcttttcatcccactgtc

SEQ ID NO: 20255 - DNA, 25 bp, Mus musculus
aaatcagggcgcaggattctggcga

SEQ ID NO: 20256 - DNA, 25 bp, Mus musculus
aaatcagggcgctggattctggcga

SEQ ID NO: 20257 - DNA, 25 bp, Mus musculus
aaatcagggctcagtgctggcaaga

SEQ ID NO: 20258 - DNA, 25 bp, Mus musculus
aaatcagggctctgtgctggcaaga

SEQ ID NO: 20259 - DNA, 25 bp, Mus musculus
aaatcagggctgagggccatggcca

SEQ ID NO: 20260 - DNA, 25 bp, Mus musculus
aaatcagggctgtgggccatggcca

SEQ ID NO: 20261 - DNA, 25 bp, Mus musculus
aaatcagggtcaactccactgttgg

SEQ ID NO: 20262 - DNA, 25 bp, Mus musculus
aaatcagggtcatctccactgttgg

SEQ ID NO: 20263 - DNA, 25 bp, Mus musculus
aaatcaggtataaactgtttgtact

SEQ ID NO: 20264 - DNA, 25 bp, Mus musculus
aaatcaggtatatactgtttgtact

SEQ ID NO: 20265 - DNA, 25 bp, Mus musculus
aaatcaggtcacatgtcctacaaaa

SEQ ID NO: 20266 - DNA, 25 bp, Mus musculus
aaatcaggtcacttgtcctacaaaa

SEQ ID NO: 20267 - DNA, 25 bp, Mus musculus
aaatcaggtccacgccttgttgttg

SEQ ID NO: 20268 - DNA, 25 bp, Mus musculus
aaatcaggtccaggccttgttgttg

SEQ ID NO: 20269 - DNA, 25 bp, Mus musculus
aaatcaggtctcctgttggatgtcc

SEQ ID NO: 20270 - DNA, 25 bp, Mus musculus
aaatcaggtctcgtgttggatgtcc

SEQ ID NO: 20271 - DNA, 25 bp, Mus musculus
aaatcaggtgcactactgggaccat

SEQ ID NO: 20272 - DNA, 25 bp, Mus musculus
aaatcaggtgcagtactgggaccat

SEQ ID NO: 20273 - DNA, 25 bp, Mus musculus
aaatcaggtgtcaccaatgctgtct

SEQ ID NO: 20274 - DNA, 25 bp, Mus musculus
aaatcaggtgtctccaatgctgtct

SEQ ID NO: 20275 - DNA, 25 bp, Mus musculus
aaatcaggtgtgattactttctctg

SEQ ID NO: 20276 - DNA, 25 bp, Mus musculus
aaatcaggtgtgtttactttctctg

SEQ ID NO: 20277 - DNA, 25 bp, Mus musculus
aaatcaggttctatttggcttcctt

SEQ ID NO: 20278 - DNA, 25 bp, Mus musculus
aaatcaggttctttttggcttcctt

SEQ ID NO: 20279 - DNA, 25 bp, Mus musculus
aaatcagtaagccatgtctcctcag

SEQ ID NO: 20280 - DNA, 25 bp, Mus musculus
aaatcagtaagcgatgtctcctcag

SEQ ID NO: 20281 - DNA, 25 bp, Mus musculus
aaatcagtacaaacatgggtgcatg

SEQ ID NO: 20282 - DNA, 25 bp, Mus musculus
aaatcagtacaatcatgggtgcatg

SEQ ID NO: 20283 - DNA, 25 bp, Mus musculus
aaatcagtagccagggtagacccaa

SEQ ID NO: 20284 - DNA, 25 bp, Mus musculus
aaatcagtagcctgggtagacccaa

SEQ ID NO: 20285 - DNA, 25 bp, Mus musculus
aaatcagtcagccagaaacacctca

SEQ ID NO: 20286 - DNA, 25 bp, Mus musculus
aaatcagtcagcgagaaacacctca

SEQ ID NO: 20287 - DNA, 25 bp, Mus musculus
aaatcagtccacacccaatcttagg

SEQ ID NO: 20288 - DNA, 25 bp, Mus musculus
aaatcagtccactcccaatcttagg

SEQ ID NO: 20289 - DNA, 25 bp, Mus musculus
aaatcagtccccagacttagcggct

SEQ ID NO: 20290 - DNA, 25 bp, Mus musculus
aaatcagtcccctgacttagcggct

SEQ ID NO: 20291 - DNA, 25 bp, Mus musculus
aaatcagtcttcaacatagttcagg

SEQ ID NO: 20292 - DNA, 25 bp, Mus musculus
aaatcagtcttctacatagttcagg

SEQ ID NO: 20293 - DNA, 25 bp, Mus musculus
aaatcagtcttgctcagttcagata

SEQ ID NO: 20294 - DNA, 25 bp, Mus musculus
aaatcagtcttggtcagttcagata

SEQ ID NO: 20295 - DNA, 25 bp, Mus musculus
aaatcagtgaacacggattcagcga

SEQ ID NO: 20296 - DNA, 25 bp, Mus musculus
aaatcagtgaactcggattcagcga

SEQ ID NO: 20297 - DNA, 25 bp, Mus musculus
aaatcagtgaggattctgggacgct

SEQ ID NO: 20298 - DNA, 25 bp, Mus musculus
aaatcagtgaggtttctgggacgct

SEQ ID NO: 20299 - DNA, 25 bp, Mus musculus
aaatcagtgcagaagtttcggctaa

SEQ ID NO: 20300 - DNA, 25 bp, Mus musculus
aaatcagtgcagtagtttcggctaa

SEQ ID NO: 20301 - DNA, 25 bp, Mus musculus
aaatcagtgcttcagagttcaagac

SEQ ID NO: 20302 - DNA, 25 bp, Mus musculus
aaatcagtgcttgagagttcaagac

SEQ ID NO: 20303 - DNA, 25 bp, Mus musculus
aaatcagtggctacgggcacttcta

SEQ ID NO: 20304 - DNA, 25 bp, Mus musculus
aaatcagtggcttcgggcacttcta

SEQ ID NO: 20305 - DNA, 25 bp, Mus musculus
aaatcagtgggcatctttctctttc

SEQ ID NO: 20306 - DNA, 25 bp, Mus musculus
aaatcagtgggcttctttctctttc

SEQ ID NO: 20307 - DNA, 25 bp, Mus musculus
aaatcagtgtttcagcctcctcgtt

SEQ ID NO: 20308 - DNA, 25 bp, Mus musculus
aaatcagtgtttgagcctcctcgtt

SEQ ID NO: 20309 - DNA, 25 bp, Mus musculus
aaatcagttacacaggcagccggcc

SEQ ID NO: 20310 - DNA, 25 bp, Mus musculus
aaatcagttacagaggcagccggcc

SEQ ID NO: 20311 - DNA, 25 bp, Mus musculus
aaatcagttagtccatgctgctcta

SEQ ID NO: 20312 - DNA, 25 bp, Mus musculus
aaatcagttagtgcatgctgctcta

SEQ ID NO: 20313 - DNA, 25 bp, Mus musculus
aaatcagttatacatggccatctat

SEQ ID NO: 20314 - DNA, 25 bp, Mus musculus
aaatcagttatagatggccatctat

SEQ ID NO: 20315 - DNA, 25 bp, Mus musculus
aaatcagttctcagggacttgtggg

SEQ ID NO: 20316 - DNA, 25 bp, Mus musculus
aaatcagttctctgggacttgtggg

SEQ ID NO: 20317 - DNA, 25 bp, Mus musculus
aaatcagttctgcttcccaaagagt

SEQ ID NO: 20318 - DNA, 25 bp, Mus musculus
aaatcagttctggttcccaaagagt

SEQ ID NO: 20319 - DNA, 25 bp, Mus musculus
aaatcagtttgtctaccaagatggg

SEQ ID NO: 20320 - DNA, 25 bp, Mus musculus
aaatcagtttgtgtaccaagatggg

SEQ ID NO: 20321 - DNA, 25 bp, Mus musculus
aaatcagttttgagtttgatctgtt

SEQ ID NO: 20322 - DNA, 25 bp, Mus musculus
aaatcagttttgtgtttgatctgtt

SEQ ID NO: 20323 - DNA, 25 bp, Mus musculus
aaatcataatacacacctggctgga

SEQ ID NO: 20324 - DNA, 25 bp, Mus musculus
aaatcataatactcacctggctgga

SEQ ID NO: 20325 - DNA, 25 bp, Mus musculus
aaatcataatcccatcacgcctcat

SEQ ID NO: 20326 - DNA, 25 bp, Mus musculus
aaatcataatccgatcacgcctcat

SEQ ID NO: 20327 - DNA, 25 bp, Mus musculus
aaatcataccctcggattcacttcc

SEQ ID NO: 20328 - DNA, 25 bp, Mus musculus
aaatcataccctgggattcacttcc

SEQ ID NO: 20329 - DNA, 25 bp, Mus musculus
aaatcatacctcctgagcttgctat

SEQ ID NO: 20330 - DNA, 25 bp, Mus musculus
aaatcatacctcgtgagcttgctat

SEQ ID NO: 20331 - DNA, 25 bp, Mus musculus
aaatcatactctctgctaagctctg

SEQ ID NO: 20332 - DNA, 25 bp, Mus musculus
aaatcatactctgtgctaagctctg

SEQ ID NO: 20333 - DNA, 25 bp, Mus musculus
aaatcatacttgacaatttttgcaa

SEQ ID NO: 20334 - DNA, 25 bp, Mus musculus
aaatcatacttgtcaatttttgcaa

SEQ ID NO: 20335 - DNA, 25 bp, Mus musculus
aaatcatagccccattaccaaaggg

SEQ ID NO: 20336 - DNA, 25 bp, Mus musculus
aaatcatagcccgattaccaaaggg

SEQ ID NO: 20337 - DNA, 25 bp, Mus musculus
aaatcatagtatcagagccatggat

SEQ ID NO: 20338 - DNA, 25 bp, Mus musculus
aaatcatagtatgagagccatggat

SEQ ID NO: 20339 - DNA, 25 bp, Mus musculus
aaatcatagtggatcctcaggcgga

SEQ ID NO: 20340 - DNA, 25 bp, Mus musculus
aaatcatagtggttcctcaggcgga

SEQ ID NO: 20341 - DNA, 25 bp, Mus musculus
aaatcatataccactagtctccaag

SEQ ID NO: 20342 - DNA, 25 bp, Mus musculus
aaatcatatacctctagtctccaag

SEQ ID NO: 20343 - DNA, 25 bp, Mus musculus
aaatcatattcccagtgttgtgtag

SEQ ID NO: 20344 - DNA, 25 bp, Mus musculus
aaatcatattccgagtgttgtgtag

SEQ ID NO: 20345 - DNA, 25 bp, Mus musculus
aaatcatcaaccacccaaactgttt

SEQ ID NO: 20346 - DNA, 25 bp, Mus musculus
aaatcatcaacctcccaaactgttt

SEQ ID NO: 20347 - DNA, 25 bp, Mus musculus
aaatcatcacagagtaggatacaga

SEQ ID NO: 20348 - DNA, 25 bp, Mus musculus
aaatcatcacagtgtaggatacaga

SEQ ID NO: 20349 - DNA, 25 bp, Mus musculus
aaatcatcagcaacccacgtcagtg

SEQ ID NO: 20350 - DNA, 25 bp, Mus musculus
aaatcatcagcatcccacgtcagtg

SEQ ID NO: 20351 - DNA, 25 bp, Mus musculus
aaatcatcatgtcagaaccgccctc

SEQ ID NO: 20352 - DNA, 25 bp, Mus musculus
aaatcatcatgtgagaaccgccctc

SEQ ID NO: 20353 - DNA, 25 bp, Mus musculus
aaatcatcatttatggaaaacttca

SEQ ID NO: 20354 - DNA, 25 bp, Mus musculus
aaatcatcatttttggaaaacttca

SEQ ID NO: 20355 - DNA, 25 bp, Mus musculus
aaatcatccacaattatctcaggtt

SEQ ID NO: 20356 - DNA, 25 bp, Mus musculus
aaatcatccacatttatctcaggtt

SEQ ID NO: 20357 - DNA, 25 bp, Mus musculus
aaatcatccattactttcagaacac

SEQ ID NO: 20358 - DNA, 25 bp, Mus musculus
aaatcatccatttctttcagaacac

SEQ ID NO: 20359 - DNA, 25 bp, Mus musculus
aaatcatcccggacacagcatgtga

SEQ ID NO: 20360 - DNA, 25 bp, Mus musculus
aaatcatcccggtcacagcatgtga

SEQ ID NO: 20361 - DNA, 25 bp, Mus musculus
aaatcatccgaacaatcctgacctt

SEQ ID NO: 20362 - DNA, 25 bp, Mus musculus
aaatcatccgaagaatcctgacctt

SEQ ID NO: 20363 - DNA, 25 bp, Mus musculus
aaatcatcctgacgctgggacaggc

SEQ ID NO: 20364 - DNA, 25 bp, Mus musculus
aaatcatcctgaggctgggacaggc

SEQ ID NO: 20365 - DNA, 25 bp, Mus musculus
aaatcatcctgtcaggatgctgcca

SEQ ID NO: 20366 - DNA, 25 bp, Mus musculus
aaatcatcctgtgaggatgctgcca

SEQ ID NO: 20367 - DNA, 25 bp, Mus musculus
aaatcatctctgaagtgaccacata

SEQ ID NO: 20368 - DNA, 25 bp, Mus musculus
aaatcatctctgacaacttttcaca

SEQ ID NO: 20369 - DNA, 25 bp, Mus musculus
aaatcatctctgtagtgaccacata

SEQ ID NO: 20370 - DNA, 25 bp, Mus musculus
aaatcatctctgtcaacttttcaca

SEQ ID NO: 20371 - DNA, 25 bp, Mus musculus
aaatcatctgagatttgccccaccc

SEQ ID NO: 20372 - DNA, 25 bp, Mus musculus
aaatcatctgagttttgccccaccc

SEQ ID NO: 20373 - DNA, 25 bp, Mus musculus
aaatcatctgcaatttgcctatccg

SEQ ID NO: 20374 - DNA, 25 bp, Mus musculus
aaatcatctgcattttgcctatccg

SEQ ID NO: 20375 - DNA, 25 bp, Mus musculus
aaatcatctggccatagtcttcatg

SEQ ID NO: 20376 - DNA, 25 bp, Mus musculus
aaatcatctggcgatagtcttcatg

SEQ ID NO: 20377 - DNA, 25 bp, Mus musculus
aaatcatgatctattcctgtgataa

SEQ ID NO: 20378 - DNA, 25 bp, Mus musculus
aaatcatgatcttttcctgtgataa

SEQ ID NO: 20379 - DNA, 25 bp, Mus musculus
aaatcatgattacatgtggcgtcat

SEQ ID NO: 20380 - DNA, 25 bp, Mus musculus
aaatcatgattagatgtggcgtcat

SEQ ID NO: 20381 - DNA, 25 bp, Mus musculus
aaatcatgatttcccttgaccctgt

SEQ ID NO: 20382 - DNA, 25 bp, Mus musculus
aaatcatgatttgccttgaccctgt

SEQ ID NO: 20383 - DNA, 25 bp, Mus musculus
aaatcatgccgtcgctcagaatgag

SEQ ID NO: 20384 - DNA, 25 bp, Mus musculus
aaatcatgccgtggctcagaatgag

SEQ ID NO: 20385 - DNA, 25 bp, Mus musculus
aaatcatgcttaattgcactcttta

SEQ ID NO: 20386 - DNA, 25 bp, Mus musculus
aaatcatgcttatttgcactcttta

SEQ ID NO: 20387 - DNA, 25 bp, Mus musculus
aaatcatggttgattgctggccaaa

SEQ ID NO: 20388 - DNA, 25 bp, Mus musculus
aaatcatggttgtttgctggccaaa

SEQ ID NO: 20389 - DNA, 25 bp, Mus musculus
aaatcatgtacaactccaagcggag

SEQ ID NO: 20390 - DNA, 25 bp, Mus musculus
aaatcatgtacatctccaagcggag

SEQ ID NO: 20391 - DNA, 25 bp, Mus musculus
aaatcatgtatcattctggctgccc

SEQ ID NO: 20392 - DNA, 25 bp, Mus musculus
aaatcatgtatctttctggctgccc

SEQ ID NO: 20393 - DNA, 25 bp, Mus musculus
aaatcatgtattcctttctcagaag

SEQ ID NO: 20394 - DNA, 25 bp, Mus musculus
aaatcatgtattgctttctcagaag

SEQ ID NO: 20395 - DNA, 25 bp, Mus musculus
aaatcatgtcaacatgcacttcatt

SEQ ID NO: 20396 - DNA, 25 bp, Mus musculus
aaatcatgtcaagatgcacttcatt

SEQ ID NO: 20397 - DNA, 25 bp, Mus musculus
aaatcatgtcgaagcattggaagtc

SEQ ID NO: 20398 - DNA, 25 bp, Mus musculus
aaatcatgtcgatgcattggaagtc

SEQ ID NO: 20399 - DNA, 25 bp, Mus musculus
aaatcatgttgcattccactggtta

SEQ ID NO: 20400 - DNA, 25 bp, Mus musculus
aaatcatgttgctttccactggtta

SEQ ID NO: 20401 - DNA, 25 bp, Mus musculus
aaatcatgtttcctgttggcacaaa

SEQ ID NO: 20402 - DNA, 25 bp, Mus musculus
aaatcatgtttcgtgttggcacaaa

SEQ ID NO: 20403 - DNA, 25 bp, Mus musculus
aaatcattaaccctgagctttgtaa

SEQ ID NO: 20404 - DNA, 25 bp, Mus musculus
aaatcattaaccgtgagctttgtaa

SEQ ID NO: 20405 - DNA, 25 bp, Mus musculus
aaatcattatcaatccctttgaaag

SEQ ID NO: 20406 - DNA, 25 bp, Mus musculus
aaatcattatcattccctttgaaag

SEQ ID NO: 20407 - DNA, 25 bp, Mus musculus
aaatcattcaagactttgtgttgga

SEQ ID NO: 20408 - DNA, 25 bp, Mus musculus
aaatcattcaagtctttgtgttgga

SEQ ID NO: 20409 - DNA, 25 bp, Mus musculus
aaatcattccctcccgtattcactt

SEQ ID NO: 20410 - DNA, 25 bp, Mus musculus
aaatcattccctgccgtattcactt

SEQ ID NO: 20411 - DNA, 25 bp, Mus musculus
aaatcattcctacgtgttgctgttc

SEQ ID NO: 20412 - DNA, 25 bp, Mus musculus
aaatcattcctaggtgttgctgttc

SEQ ID NO: 20413 - DNA, 25 bp, Mus musculus
aaatcattcttgcacagggttttgt

SEQ ID NO: 20414 - DNA, 25 bp, Mus musculus
aaatcattcttggacagggttttgt

SEQ ID NO: 20415 - DNA, 25 bp, Mus musculus
aaatcattgatgctgcattgcgagc

SEQ ID NO: 20416 - DNA, 25 bp, Mus musculus
aaatcattgatggtgcattgcgagc

SEQ ID NO: 20417 - DNA, 25 bp, Mus musculus
aaatcattgcctagactgtcaggat

SEQ ID NO: 20418 - DNA, 25 bp, Mus musculus
aaatcattgccttgactgtcaggat

SEQ ID NO: 20419 - DNA, 25 bp, Mus musculus
aaatcattgcttatgttcagatggc

SEQ ID NO: 20420 - DNA, 25 bp, Mus musculus
aaatcattgcttttgttcagatggc

SEQ ID NO: 20421 - DNA, 25 bp, Mus musculus
aaatcattgtaacctttgtcgcaga

SEQ ID NO: 20422 - DNA, 25 bp, Mus musculus
aaatcattgtaagctttgtcgcaga

SEQ ID NO: 20423 - DNA, 25 bp, Mus musculus
aaatcattgtcacattctcctacca

SEQ ID NO: 20424 - DNA, 25 bp, Mus musculus
aaatcattgtcagattctcctacca

SEQ ID NO: 20425 - DNA, 25 bp, Mus musculus
aaatcattgtgtcattgtctactat

SEQ ID NO: 20426 - DNA, 25 bp, Mus musculus
aaatcattgtgtgattgtctactat

SEQ ID NO: 20427 - DNA, 25 bp, Mus musculus
aaatcatttaagacccagtgccaga

SEQ ID NO: 20428 - DNA, 25 bp, Mus musculus
aaatcatttaagtcccagtgccaga

SEQ ID NO: 20429 - DNA, 25 bp, Mus musculus
aaatcatttacccaggcctcacaac

SEQ ID NO: 20430 - DNA, 25 bp, Mus musculus
aaatcatttaccgaggcctcacaac

SEQ ID NO: 20431 - DNA, 25 bp, Mus musculus
aaatcatttagccactctcagactc

SEQ ID NO: 20432 - DNA, 25 bp, Mus musculus
aaatcatttagcgactctcagactc

SEQ ID NO: 20433 - DNA, 25 bp, Mus musculus
aaatcatttattcttggcctatcca

SEQ ID NO: 20434 - DNA, 25 bp, Mus musculus
aaatcatttattgttggcctatcca

SEQ ID NO: 20435 - DNA, 25 bp, Mus musculus
aaatcatttcaccatttctcaccag

SEQ ID NO: 20436 - DNA, 25 bp, Mus musculus
aaatcatttcacgatttctcaccag

SEQ ID NO: 20437 - DNA, 25 bp, Mus musculus
aaatcatttcagatgcgtgggaaca

SEQ ID NO: 20438 - DNA, 25 bp, Mus musculus
aaatcatttcagttgcgtgggaaca

SEQ ID NO: 20439 - DNA, 25 bp, Mus musculus
aaatcatttcccaaaatgtcttggt

SEQ ID NO: 20440 - DNA, 25 bp, Mus musculus
aaatcatttccctaaatgtcttggt

SEQ ID NO: 20441 - DNA, 25 bp, Mus musculus
aaatcatttccgatatcccgaggca

SEQ ID NO: 20442 - DNA, 25 bp, Mus musculus
aaatcatttccgttatcccgaggca

SEQ ID NO: 20443 - DNA, 25 bp, Mus musculus
aaatcatttctactttaccacccag

SEQ ID NO: 20444 - DNA, 25 bp, Mus musculus
aaatcatttctagtttaccacccag

SEQ ID NO: 20445 - DNA, 25 bp, Mus musculus
aaatcatttttgacactataccact

SEQ ID NO: 20446 - DNA, 25 bp, Mus musculus
aaatcatttttgtcactataccact

SEQ ID NO: 20447 - DNA, 25 bp, Mus musculus
aaatccaaaccaaaggagctcttca

SEQ ID NO: 20448 - DNA, 25 bp, Mus musculus
aaatccaaaccataggagctcttca

SEQ ID NO: 20449 - DNA, 25 bp, Mus musculus
aaatccaaagctagatcagcctccc

SEQ ID NO: 20450 - DNA, 25 bp, Mus musculus
aaatccaaagcttgatcagcctccc

SEQ ID NO: 20451 - DNA, 25 bp, Mus musculus
aaatccaacaacacaatggcacaag

SEQ ID NO: 20452 - DNA, 25 bp, Mus musculus
aaatccaacaaccaatgccctactg

SEQ ID NO: 20453 - DNA, 25 bp, Mus musculus
aaatccaacaacgaatgccctactg

SEQ ID NO: 20454 - DNA, 25 bp, Mus musculus
aaatccaacaactcaatggcacaag

SEQ ID NO: 20455 - DNA, 25 bp, Mus musculus
aaatccaaccaacacggctgctaag

SEQ ID NO: 20456 - DNA, 25 bp, Mus musculus
aaatccaaccaagacggctgctaag

SEQ ID NO: 20457 - DNA, 25 bp, Mus musculus
aaatccaaccatcacttcagtgcct

SEQ ID NO: 20458 - DNA, 25 bp, Mus musculus
aaatccaaccatgacttcagtgcct

SEQ ID NO: 20459 - DNA, 25 bp, Mus musculus
aaatccaacgaaagcctggtgagcg

SEQ ID NO: 20460 - DNA, 25 bp, Mus musculus
aaatccaacgaatgcctggtgagcg

SEQ ID NO: 20461 - DNA, 25 bp, Mus musculus
aaatccaacggaaccggctccgaat

SEQ ID NO: 20462 - DNA, 25 bp, Mus musculus
aaatccaacggatccggctccgaat

SEQ ID NO: 20463 - DNA, 25 bp, Mus musculus
aaatccaacttaccagaggcaatta

SEQ ID NO: 20464 - DNA, 25 bp, Mus musculus
aaatccaacttagcagaggcaatta

SEQ ID NO: 20465 - DNA, 25 bp, Mus musculus
aaatccaacttgctggaaaccataa

SEQ ID NO: 20466 - DNA, 25 bp, Mus musculus
aaatccaacttggtggaaaccataa

SEQ ID NO: 20467 - DNA, 25 bp, Mus musculus
aaatccaagatcatgccctgtaacc

SEQ ID NO: 20468 - DNA, 25 bp, Mus musculus
aaatccaagatcttgccctgtaacc

SEQ ID NO: 20469 - DNA, 25 bp, Mus musculus
aaatccaagccacagtcacagcctg

SEQ ID NO: 20470 - DNA, 25 bp, Mus musculus
aaatccaagccagagtcacagcctg

SEQ ID NO: 20471 - DNA, 25 bp, Mus musculus
aaatccaagctcagtccaacctgtt

SEQ ID NO: 20472 - DNA, 25 bp, Mus musculus
aaatccaagctctgtccaacctgtt

SEQ ID NO: 20473 - DNA, 25 bp, Mus musculus
aaatccaaggccagaacatcattgt

SEQ ID NO: 20474 - DNA, 25 bp, Mus musculus
aaatccaaggcctgaacatcattgt

SEQ ID NO: 20475 - DNA, 25 bp, Mus musculus
aaatccaaggtcactacggaatcaa

SEQ ID NO: 20476 - DNA, 25 bp, Mus musculus
aaatccaaggtctctacggaatcaa

SEQ ID NO: 20477 - DNA, 25 bp, Mus musculus
aaatccaagtgcctttagagttatt

SEQ ID NO: 20478 - DNA, 25 bp, Mus musculus
aaatccaagtgcgtttagagttatt

SEQ ID NO: 20479 - DNA, 25 bp, Mus musculus
aaatccaagtggcttctgcccttga

SEQ ID NO: 20480 - DNA, 25 bp, Mus musculus
aaatccaagtggcttgtgcagtgac

SEQ ID NO: 20481 - DNA, 25 bp, Mus musculus
aaatccaagtgggttctgcccttga

SEQ ID NO: 20482 - DNA, 25 bp, Mus musculus
aaatccaagtgggttgtgcagtgac

SEQ ID NO: 20483 - DNA, 25 bp, Mus musculus
aaatccaagtgtatggccctgcgcc

SEQ ID NO: 20484 - DNA, 25 bp, Mus musculus
aaatccaagtgtttggccctgcgcc

SEQ ID NO: 20485 - DNA, 25 bp, Mus musculus
aaatccaagttacgctggctgaggc

SEQ ID NO: 20486 - DNA, 25 bp, Mus musculus
aaatccaagttaggctggctgaggc

SEQ ID NO: 20487 - DNA, 25 bp, Mus musculus
aaatccaatccaatgtgggcagtac

SEQ ID NO: 20488 - DNA, 25 bp, Mus musculus
aaatccaatccattgtgggcagtac

SEQ ID NO: 20489 - DNA, 25 bp, Mus musculus
aaatccaatctcagtgccctgtgta

SEQ ID NO: 20490 - DNA, 25 bp, Mus musculus
aaatccaatctctgtgccctgtgta

SEQ ID NO: 20491 - DNA, 25 bp, Mus musculus
aaatccaatgcaatactaagagctg

SEQ ID NO: 20492 - DNA, 25 bp, Mus musculus
aaatccaatgcattactaagagctg

SEQ ID NO: 20493 - DNA, 25 bp, Mus musculus
aaatccaatgtaatcgtttccctga

SEQ ID NO: 20494 - DNA, 25 bp, Mus musculus
aaatccaatgtattcgtttccctga

SEQ ID NO: 20495 - DNA, 25 bp, Mus musculus
aaatccacagcaatatttttcaagg

SEQ ID NO: 20496 - DNA, 25 bp, Mus musculus
aaatccacagcattatttttcaagg

SEQ ID NO: 20497 - DNA, 25 bp, Mus musculus
aaatccacagcccaatagcgggacc

SEQ ID NO: 20498 - DNA, 25 bp, Mus musculus
aaatccacagccgaatagcgggacc

SEQ ID NO: 20499 - DNA, 25 bp, Mus musculus
aaatccacagctcgacacaatgcag

SEQ ID NO: 20500 - DNA, 25 bp, Mus musculus
aaatccacagctggacacaatgcag

SEQ ID NO: 20501 - DNA, 25 bp, Mus musculus
aaatccacatctatcaaccagacaa

SEQ ID NO: 20502 - DNA, 25 bp, Mus musculus
aaatccacatctcgctgttcacatg

SEQ ID NO: 20503 - DNA, 25 bp, Mus musculus
aaatccacatctggctgttcacatg

SEQ ID NO: 20504 - DNA, 25 bp, Mus musculus
aaatccacatctttcaaccagacaa

SEQ ID NO: 20505 - DNA, 25 bp, Mus musculus
aaatccacatggagggtcaacgtga

SEQ ID NO: 20506 - DNA, 25 bp, Mus musculus
aaatccacatggtgggtcaacgtga

SEQ ID NO: 20507 - DNA, 25 bp, Mus musculus
aaatccacatgtattcttgactaaa

SEQ ID NO: 20508 - DNA, 25 bp, Mus musculus
aaatccacatgttttcttgactaaa

SEQ ID NO: 20509 - DNA, 25 bp, Mus musculus
aaatccaccctgatagatgccctct

SEQ ID NO: 20510 - DNA, 25 bp, Mus musculus
aaatccaccctgttagatgccctct

SEQ ID NO: 20511 - DNA, 25 bp, Mus musculus
aaatccaccgttactatgtagcttg

SEQ ID NO: 20512 - DNA, 25 bp, Mus musculus
aaatccaccgtttctatgtagcttg

SEQ ID NO: 20513 - DNA, 25 bp, Mus musculus
aaatccacctgtcgtctaagaccgg

SEQ ID NO: 20514 - DNA, 25 bp, Mus musculus
aaatccacctgtggtctaagaccgg

SEQ ID NO: 20515 - DNA, 25 bp, Mus musculus
aaatccacggccagggcaacttagg

SEQ ID NO: 20516 - DNA, 25 bp, Mus musculus
aaatccacggcctgggcaacttagg

SEQ ID NO: 20517 - DNA, 25 bp, Mus musculus
aaatccactaccatgtttcgaggca

SEQ ID NO: 20518 - DNA, 25 bp, Mus musculus
aaatccactaccttgtttcgaggca

SEQ ID NO: 20519 - DNA, 25 bp, Mus musculus
aaatccactattatttgctcctgta

SEQ ID NO: 20520 - DNA, 25 bp, Mus musculus
aaatccactattttttgctcctgta

SEQ ID NO: 20521 - DNA, 25 bp, Mus musculus
aaatccactgtcctgttgcagcaga

SEQ ID NO: 20522 - DNA, 25 bp, Mus musculus
aaatccactgtcgtgttgcagcaga

SEQ ID NO: 20523 - DNA, 25 bp, Mus musculus
aaatccacttccagctatagacatt

SEQ ID NO: 20524 - DNA, 25 bp, Mus musculus
aaatccacttccagcttacttcttc

SEQ ID NO: 20525 - DNA, 25 bp, Mus musculus
aaatccacttcctgctatagacatt

SEQ ID NO: 20526 - DNA, 25 bp, Mus musculus
aaatccacttcctgcttacttcttc

SEQ ID NO: 20527 - DNA, 25 bp, Mus musculus
aaatccagaaagacactctctggct

SEQ ID NO: 20528 - DNA, 25 bp, Mus musculus
aaatccagaaagtcactctctggct

SEQ ID NO: 20529 - DNA, 25 bp, Mus musculus
aaatccagaacaactgcctggtcct

SEQ ID NO: 20530 - DNA, 25 bp, Mus musculus
aaatccagaacatctgcctggtcct

SEQ ID NO: 20531 - DNA, 25 bp, Mus musculus
aaatccagaagcctgtgtccacaag

SEQ ID NO: 20532 - DNA, 25 bp, Mus musculus
aaatccagaagcgtgtgtccacaag

SEQ ID NO: 20533 - DNA, 25 bp, Mus musculus
aaatccagatcccacgcccagatga

SEQ ID NO: 20534 - DNA, 25 bp, Mus musculus
aaatccagatccgacgcccagatga

SEQ ID NO: 20535 - DNA, 25 bp, Mus musculus
aaatccagatctaacacctagtttc

SEQ ID NO: 20536 - DNA, 25 bp, Mus musculus
aaatccagatcttacacctagtttc

SEQ ID NO: 20537 - DNA, 25 bp, Mus musculus
aaatccagcgagattgccggccctt

SEQ ID NO: 20538 - DNA, 25 bp, Mus musculus
aaatccagcgagtttgccggccctt

SEQ ID NO: 20539 - DNA, 25 bp, Mus musculus
aaatccagctagaggaattcttacc

SEQ ID NO: 20540 - DNA, 25 bp, Mus musculus
aaatccagctagtggaattcttacc

SEQ ID NO: 20541 - DNA, 25 bp, Mus musculus
aaatccaggactatgccatgaaaaa

SEQ ID NO: 20542 - DNA, 25 bp, Mus musculus
aaatccaggactttgccatgaaaaa

SEQ ID NO: 20543 - DNA, 25 bp, Mus musculus
aaatccaggcatattcggaattcca

SEQ ID NO: 20544 - DNA, 25 bp, Mus musculus
aaatccaggcattttcggaattcca

SEQ ID NO: 20545 - DNA, 25 bp, Mus musculus
aaatccaggctgacttgtggtaggt

SEQ ID NO: 20546 - DNA, 25 bp, Mus musculus
aaatccaggctgatgtaaggcccag

SEQ ID NO: 20547 - DNA, 25 bp, Mus musculus
aaatccaggctgtcttgtggtaggt

SEQ ID NO: 20548 - DNA, 25 bp, Mus musculus
aaatccaggctgttgtaaggcccag

SEQ ID NO: 20549 - DNA, 25 bp, Mus musculus
aaatccaggcttccctgagccggat

SEQ ID NO: 20550 - DNA, 25 bp, Mus musculus
aaatccaggcttgcctgagccggat

SEQ ID NO: 20551 - DNA, 25 bp, Mus musculus
aaatccagggccacctgtaggagtt

SEQ ID NO: 20552 - DNA, 25 bp, Mus musculus
aaatccagggccatacataccaggg

SEQ ID NO: 20553 - DNA, 25 bp, Mus musculus
aaatccagggcctcctgtaggagtt

SEQ ID NO: 20554 - DNA, 25 bp, Mus musculus
aaatccagggccttacataccaggg

SEQ ID NO: 20555 - DNA, 25 bp, Mus musculus
aaatccaggtcaagagcctactcag

SEQ ID NO: 20556 - DNA, 25 bp, Mus musculus
aaatccaggtcaccagtgtcgcggc

SEQ ID NO: 20557 - DNA, 25 bp, Mus musculus
aaatccaggtcagcagtgtcgcggc

SEQ ID NO: 20558 - DNA, 25 bp, Mus musculus
aaatccaggtcatgagcctactcag

SEQ ID NO: 20559 - DNA, 25 bp, Mus musculus
aaatccagtaggacattttccatta

SEQ ID NO: 20560 - DNA, 25 bp, Mus musculus
aaatccagtaggtcattttccatta

SEQ ID NO: 20561 - DNA, 25 bp, Mus musculus
aaatccagtatcagaaatgctccag

SEQ ID NO: 20562 - DNA, 25 bp, Mus musculus
aaatccagtatctgaaatgctccag

SEQ ID NO: 20563 - DNA, 25 bp, Mus musculus
aaatccagtcagaacgtagcaccat

SEQ ID NO: 20564 - DNA, 25 bp, Mus musculus
aaatccagtcagtacgtagcaccat

SEQ ID NO: 20565 - DNA, 25 bp, Mus musculus
aaatccagtgaaccataacagcaaa

SEQ ID NO: 20566 - DNA, 25 bp, Mus musculus
aaatccagtgaagcataacagcaaa

SEQ ID NO: 20567 - DNA, 25 bp, Mus musculus
aaatccagtgaccatgcttgggtaa

SEQ ID NO: 20568 - DNA, 25 bp, Mus musculus
aaatccagtgacgatgcttgggtaa

SEQ ID NO: 20569 - DNA, 25 bp, Mus musculus
aaatccagtgagcacaaagaagtca

SEQ ID NO: 20570 - DNA, 25 bp, Mus musculus
aaatccagtgaggacaaagaagtca

SEQ ID NO: 20571 - DNA, 25 bp, Mus musculus
aaatccagtggacaacctcacccat

SEQ ID NO: 20572 - DNA, 25 bp, Mus musculus
aaatccagtggagaacctcacccat

SEQ ID NO: 20573 - DNA, 25 bp, Mus musculus
aaatccagtgtcatactgagtggtg

SEQ ID NO: 20574 - DNA, 25 bp, Mus musculus
aaatccagtgtcttactgagtggtg

SEQ ID NO: 20575 - DNA, 25 bp, Mus musculus
aaatccagttctatggtcatctccc

SEQ ID NO: 20576 - DNA, 25 bp, Mus musculus
aaatccagttctttggtcatctccc

SEQ ID NO: 20577 - DNA, 25 bp, Mus musculus
aaatccagttgtagtggctgaaaaa

SEQ ID NO: 20578 - DNA, 25 bp, Mus musculus
aaatccagttgttgtggctgaaaaa

SEQ ID NO: 20579 - DNA, 25 bp, Mus musculus
aaatccagtttcaaatatgctatac

SEQ ID NO: 20580 - DNA, 25 bp, Mus musculus
aaatccagtttctaatatgctatac

SEQ ID NO: 20581 - DNA, 25 bp, Mus musculus
aaatccatactcattaaacgccctg

SEQ ID NO: 20582 - DNA, 25 bp, Mus musculus
aaatccatactctttaaacgccctg

SEQ ID NO: 20583 - DNA, 25 bp, Mus musculus
aaatccatactgacagcagccagct

SEQ ID NO: 20584 - DNA, 25 bp, Mus musculus
aaatccatactgcaactgggtcctg

SEQ ID NO: 20585 - DNA, 25 bp, Mus musculus
aaatccatactggaactgggtcctg

SEQ ID NO: 20586 - DNA, 25 bp, Mus musculus
aaatccatactgtcagcagccagct

SEQ ID NO: 20587 - DNA, 25 bp, Mus musculus
aaatccatattgaacgctattttgc

SEQ ID NO: 20588 - DNA, 25 bp, Mus musculus
aaatccatattgtacgctattttgc

SEQ ID NO: 20589 - DNA, 25 bp, Mus musculus
aaatccatccccaagatcagcgtag

SEQ ID NO: 20590 - DNA, 25 bp, Mus musculus
aaatccatcccctagatcagcgtag

SEQ ID NO: 20591 - DNA, 25 bp, Mus musculus
aaatccatcgcgactttgaaagcct

SEQ ID NO: 20592 - DNA, 25 bp, Mus musculus
aaatccatcgcgtctttgaaagcct

SEQ ID NO: 20593 - DNA, 25 bp, Mus musculus
aaatccatctagacagttgagactg

SEQ ID NO: 20594 - DNA, 25 bp, Mus musculus
aaatccatctagtcagttgagactg

SEQ ID NO: 20595 - DNA, 25 bp, Mus musculus
aaatccatcttgaagacgttgggca

SEQ ID NO: 20596 - DNA, 25 bp, Mus musculus
aaatccatcttgtagacgttgggca

SEQ ID NO: 20597 - DNA, 25 bp, Mus musculus
aaatccatgagtctcatgcattaga

SEQ ID NO: 20598 - DNA, 25 bp, Mus musculus
aaatccatgagtgtcatgcattaga

SEQ ID NO: 20599 - DNA, 25 bp, Mus musculus
aaatccatgctacgcttctatcctg

SEQ ID NO: 20600 - DNA, 25 bp, Mus musculus
aaatccatgctaggcttctatcctg

SEQ ID NO: 20601 - DNA, 25 bp, Mus musculus
aaatccatggctatggcgtgggcca

SEQ ID NO: 20602 - DNA, 25 bp, Mus musculus
aaatccatggctttggcgtgggcca

SEQ ID NO: 20603 - DNA, 25 bp, Mus musculus
aaatccatggttaggttcttagcaa

SEQ ID NO: 20604 - DNA, 25 bp, Mus musculus
aaatccatggtttggttcttagcaa

SEQ ID NO: 20605 - DNA, 25 bp, Mus musculus
aaatccatgtccatgtcagtaggag

SEQ ID NO: 20606 - DNA, 25 bp, Mus musculus
aaatccatgtccttgtcagtaggag

SEQ ID NO: 20607 - DNA, 25 bp, Mus musculus
aaatccatgttactatagccactaa

SEQ ID NO: 20608 - DNA, 25 bp, Mus musculus
aaatccatgttagtatagccactaa

SEQ ID NO: 20609 - DNA, 25 bp, Mus musculus
aaatccattcacagcatgtgcattt

SEQ ID NO: 20610 - DNA, 25 bp, Mus musculus
aaatccattcactgcatgtgcattt

SEQ ID NO: 20611 - DNA, 25 bp, Mus musculus
aaatccattcttagcaagtcccagc

SEQ ID NO: 20612 - DNA, 25 bp, Mus musculus
aaatccattctttgcaagtcccagc

SEQ ID NO: 20613 - DNA, 25 bp, Mus musculus
aaatccattgccaatcttggtctct

SEQ ID NO: 20614 - DNA, 25 bp, Mus musculus
aaatccattgcctatcttggtctct

SEQ ID NO: 20615 - DNA, 25 bp, Mus musculus
aaatccattgtccttgtcgtggtgt

SEQ ID NO: 20616 - DNA, 25 bp, Mus musculus
aaatccattgtcgttgtcgtggtgt

SEQ ID NO: 20617 - DNA, 25 bp, Mus musculus
aaatcccaaccactaactctgagca

SEQ ID NO: 20618 - DNA, 25 bp, Mus musculus
aaatcccaaccagtaactctgagca

SEQ ID NO: 20619 - DNA, 25 bp, Mus musculus
aaatcccaaccgacagctcgagcgg

SEQ ID NO: 20620 - DNA, 25 bp, Mus musculus
aaatcccaaccgtcagctcgagcgg

SEQ ID NO: 20621 - DNA, 25 bp, Mus musculus
aaatcccaactcaaggaatgactgg

SEQ ID NO: 20622 - DNA, 25 bp, Mus musculus
aaatcccaactctaggaatgactgg

SEQ ID NO: 20623 - DNA, 25 bp, Mus musculus
aaatcccaagtgaccctgaggaaag

SEQ ID NO: 20624 - DNA, 25 bp, Mus musculus
aaatcccaagtgtccctgaggaaag

SEQ ID NO: 20625 - DNA, 25 bp, Mus musculus
aaatcccaatggaataatagaggcc

SEQ ID NO: 20626 - DNA, 25 bp, Mus musculus
aaatcccaatggtataatagaggcc

SEQ ID NO: 20627 - DNA, 25 bp, Mus musculus
aaatcccacaccaatcagacaaaga

SEQ ID NO: 20628 - DNA, 25 bp, Mus musculus
aaatcccacacctatcagacaaaga

SEQ ID NO: 20629 - DNA, 25 bp, Mus musculus
aaatcccacagacgacttcgtccag

SEQ ID NO: 20630 - DNA, 25 bp, Mus musculus
aaatcccacagaggacttcgtccag

SEQ ID NO: 20631 - DNA, 25 bp, Mus musculus
aaatcccacgtgctggtgtggacac

SEQ ID NO: 20632 - DNA, 25 bp, Mus musculus
aaatcccacgtggtggtgtggacac

SEQ ID NO: 20633 - DNA, 25 bp, Mus musculus
aaatcccactccagtggtgagcagc

SEQ ID NO: 20634 - DNA, 25 bp, Mus musculus
aaatcccactcctgtggtgagcagc

SEQ ID NO: 20635 - DNA, 25 bp, Mus musculus
aaatcccactgcctgctgaagaaga

SEQ ID NO: 20636 - DNA, 25 bp, Mus musculus
aaatcccactgcgtgctgaagaaga

SEQ ID NO: 20637 - DNA, 25 bp, Mus musculus
aaatcccactgtctctagatctaaa

SEQ ID NO: 20638 - DNA, 25 bp, Mus musculus
aaatcccactgtgtctagatctaaa

SEQ ID NO: 20639 - DNA, 25 bp, Mus musculus
aaatcccagcaacatgtggaagttc

SEQ ID NO: 20640 - DNA, 25 bp, Mus musculus
aaatcccagcaaccacatggtggct

SEQ ID NO: 20641 - DNA, 25 bp, Mus musculus
aaatcccagcaagatgtggaagttc

SEQ ID NO: 20642 - DNA, 25 bp, Mus musculus
aaatcccagcaagcacatggtggct

SEQ ID NO: 20643 - DNA, 25 bp, Mus musculus
aaatcccagcgtaaggtatatatct

SEQ ID NO: 20644 - DNA, 25 bp, Mus musculus
aaatcccagcgttaggtatatatct

SEQ ID NO: 20645 - DNA, 25 bp, Mus musculus
aaatcccagctaattcttgatcacc

SEQ ID NO: 20646 - DNA, 25 bp, Mus musculus
aaatcccagctatttcttgatcacc

SEQ ID NO: 20647 - DNA, 25 bp, Mus musculus
aaatcccagggcactgatatgtagg

SEQ ID NO: 20648 - DNA, 25 bp, Mus musculus
aaatcccagggctctgatatgtagg

SEQ ID NO: 20649 - DNA, 25 bp, Mus musculus
aaatcccatcatataagctgattgt

SEQ ID NO: 20650 - DNA, 25 bp, Mus musculus
aaatcccatcatttaagctgattgt

SEQ ID NO: 20651 - DNA, 25 bp, Mus musculus
aaatcccatcgacttcctagcatct

SEQ ID NO: 20652 - DNA, 25 bp, Mus musculus
aaatcccatcgagttcctagcatct

SEQ ID NO: 20653 - DNA, 25 bp, Mus musculus
aaatcccatgagcattacgcttgcc

SEQ ID NO: 20654 - DNA, 25 bp, Mus musculus
aaatcccatgaggattacgcttgcc

SEQ ID NO: 20655 - DNA, 25 bp, Mus musculus
aaatcccatgcccaccatagggcat

SEQ ID NO: 20656 - DNA, 25 bp, Mus musculus
aaatcccatgccgaccatagggcat

SEQ ID NO: 20657 - DNA, 25 bp, Mus musculus
aaatcccatttcagggaataccaat

SEQ ID NO: 20658 - DNA, 25 bp, Mus musculus
aaatcccatttctgggaataccaat

SEQ ID NO: 20659 - DNA, 25 bp, Mus musculus
aaatccccaaagctgatactttata

SEQ ID NO: 20660 - DNA, 25 bp, Mus musculus
aaatccccaaaggtgatactttata

SEQ ID NO: 20661 - DNA, 25 bp, Mus musculus
aaatccccaatcctgtgctgtatgt

SEQ ID NO: 20662 - DNA, 25 bp, Mus musculus
aaatccccaatcgtgtgctgtatgt

SEQ ID NO: 20663 - DNA, 25 bp, Mus musculus
aaatccccagatcgcactagggtcc

SEQ ID NO: 20664 - DNA, 25 bp, Mus musculus
aaatccccagatggcactagggtcc

SEQ ID NO: 20665 - DNA, 25 bp, Mus musculus
aaatccccaggaagacttctcattg

SEQ ID NO: 20666 - DNA, 25 bp, Mus musculus
aaatccccaggatgacttctcattg

SEQ ID NO: 20667 - DNA, 25 bp, Mus musculus
aaatccccataaagctcttcctggg

SEQ ID NO: 20668 - DNA, 25 bp, Mus musculus
aaatccccataatgctcttcctggg

SEQ ID NO: 20669 - DNA, 25 bp, Mus musculus
aaatccccattaaacttgagtgtca

SEQ ID NO: 20670 - DNA, 25 bp, Mus musculus
aaatccccattatacttgagtgtca

SEQ ID NO: 20671 - DNA, 25 bp, Mus musculus
aaatccccgagcagacaaggtacaa

SEQ ID NO: 20672 - DNA, 25 bp, Mus musculus
aaatccccgagctgacaaggtacaa

SEQ ID NO: 20673 - DNA, 25 bp, Mus musculus
aaatccccgcttaccactgatgttt

SEQ ID NO: 20674 - DNA, 25 bp, Mus musculus
aaatccccgctttccactgatgttt

SEQ ID NO: 20675 - DNA, 25 bp, Mus musculus
aaatccccgtcaactattctggaat

SEQ ID NO: 20676 - DNA, 25 bp, Mus musculus
aaatccccgtcatctattctggaat

SEQ ID NO: 20677 - DNA, 25 bp, Mus musculus
aaatcccctggaaaggtctgaaaat

SEQ ID NO: 20678 - DNA, 25 bp, Mus musculus
aaatcccctggataggtctgaaaat

SEQ ID NO: 20679 - DNA, 25 bp, Mus musculus
aaatccccttggaatatggtatata

SEQ ID NO: 20680 - DNA, 25 bp, Mus musculus
aaatccccttggtatatggtatata

SEQ ID NO: 20681 - DNA, 25 bp, Mus musculus
aaatcccgcaacacatgggtggctc

SEQ ID NO: 20682 - DNA, 25 bp, Mus musculus
aaatcccgcaactcatgggtggctc

SEQ ID NO: 20683 - DNA, 25 bp, Mus musculus
aaatcccgctacatttgtcattgcc

SEQ ID NO: 20684 - DNA, 25 bp, Mus musculus
aaatcccgctacttttgtcattgcc

SEQ ID NO: 20685 - DNA, 25 bp, Mus musculus
aaatcccgtgacctggtggttgagt

SEQ ID NO: 20686 - DNA, 25 bp, Mus musculus
aaatcccgtgacgtggtggttgagt

SEQ ID NO: 20687 - DNA, 25 bp, Mus musculus
aaatcccgtgctaagcttacagcga

SEQ ID NO: 20688 - DNA, 25 bp, Mus musculus
aaatcccgtgcttagcttacagcga

SEQ ID NO: 20689 - DNA, 25 bp, Mus musculus
aaatccctaagtccctcaactgccc

SEQ ID NO: 20690 - DNA, 25 bp, Mus musculus
aaatccctaagtgcctcaactgccc

SEQ ID NO: 20691 - DNA, 25 bp, Mus musculus
aaatccctcacaagtttattcaaac

SEQ ID NO: 20692 - DNA, 25 bp, Mus musculus
aaatccctcacatgtttattcaaac

SEQ ID NO: 20693 - DNA, 25 bp, Mus musculus
aaatccctcaccactgtctgtatct

SEQ ID NO: 20694 - DNA, 25 bp, Mus musculus
aaatccctcacctctgtctgtatct

SEQ ID NO: 20695 - DNA, 25 bp, Mus musculus
aaatccctcagacacacatttgcct

SEQ ID NO: 20696 - DNA, 25 bp, Mus musculus
aaatccctcagagacacatttgcct

SEQ ID NO: 20697 - DNA, 25 bp, Mus musculus
aaatccctccttcatcactgctgtt

SEQ ID NO: 20698 - DNA, 25 bp, Mus musculus
aaatccctccttgatcactgctgtt

SEQ ID NO: 20699 - DNA, 25 bp, Mus musculus
aaatccctcggcaatgtatggcaag

SEQ ID NO: 20700 - DNA, 25 bp, Mus musculus
aaatccctcggctatgtatggcaag

SEQ ID NO: 20701 - DNA, 25 bp, Mus musculus
aaatccctctgtcatggctcgcgag

SEQ ID NO: 20702 - DNA, 25 bp, Mus musculus
aaatccctctgtgatggctcgcgag

SEQ ID NO: 20703 - DNA, 25 bp, Mus musculus
aaatccctcttaaacattggctctc

SEQ ID NO: 20704 - DNA, 25 bp, Mus musculus
aaatccctcttatacattggctctc

SEQ ID NO: 20705 - DNA, 25 bp, Mus musculus
aaatccctgaccacttgctatctgt

SEQ ID NO: 20706 - DNA, 25 bp, Mus musculus
aaatccctgacctcttgctatctgt

SEQ ID NO: 20707 - DNA, 25 bp, Mus musculus
aaatccctgatcaaaccgatgtgaa

SEQ ID NO: 20708 - DNA, 25 bp, Mus musculus
aaatccctgatctaaccgatgtgaa

SEQ ID NO: 20709 - DNA, 25 bp, Mus musculus
aaatccctgcccctgaacatgagat

SEQ ID NO: 20710 - DNA, 25 bp, Mus musculus
aaatccctgcccgtgaacatgagat

SEQ ID NO: 20711 - DNA, 25 bp, Mus musculus
aaatccctgctgatcatggtgactc

SEQ ID NO: 20712 - DNA, 25 bp, Mus musculus
aaatccctgctgttcatggtgactc

SEQ ID NO: 20713 - DNA, 25 bp, Mus musculus
aaatccctggcaattcttcctgata

SEQ ID NO: 20714 - DNA, 25 bp, Mus musculus
aaatccctggcatttcttcctgata

SEQ ID NO: 20715 - DNA, 25 bp, Mus musculus
aaatcccttcttacacaaagcctag

SEQ ID NO: 20716 - DNA, 25 bp, Mus musculus
aaatcccttctttcacaaagcctag

SEQ ID NO: 20717 - DNA, 25 bp, Mus musculus
aaatcccttgaaatacaagtctcta

SEQ ID NO: 20718 - DNA, 25 bp, Mus musculus
aaatcccttgaattacaagtctcta

SEQ ID NO: 20719 - DNA, 25 bp, Mus musculus
aaatcccttgcactactacctggtt

SEQ ID NO: 20720 - DNA, 25 bp, Mus musculus
aaatcccttgcagtactacctggtt

SEQ ID NO: 20721 - DNA, 25 bp, Mus musculus
aaatcccttggcagataagatctga

SEQ ID NO: 20722 - DNA, 25 bp, Mus musculus
aaatcccttggctgataagatctga

SEQ ID NO: 20723 - DNA, 25 bp, Mus musculus
aaatccctttacatttgacttcagg

SEQ ID NO: 20724 - DNA, 25 bp, Mus musculus
aaatccctttacttttgacttcagg

SEQ ID NO: 20725 - DNA, 25 bp, Mus musculus
aaatccctttgtcttctctctgtcc

SEQ ID NO: 20726 - DNA, 25 bp, Mus musculus
aaatccctttgtgttctctctgtcc

SEQ ID NO: 20727 - DNA, 25 bp, Mus musculus
aaatccgacctgaaacgtgcagtgg

SEQ ID NO: 20728 - DNA, 25 bp, Mus musculus
aaatccgacctgtaacgtgcagtgg

SEQ ID NO: 20729 - DNA, 25 bp, Mus musculus
aaatccgatttacaagagtcctatt

SEQ ID NO: 20730 - DNA, 25 bp, Mus musculus
aaatccgatttagaagagtcctatt

SEQ ID NO: 20731 - DNA, 25 bp, Mus musculus
aaatccgccaccagtgactccgagg

SEQ ID NO: 20732 - DNA, 25 bp, Mus musculus
aaatccgccacctgtgactccgagg

SEQ ID NO: 20733 - DNA, 25 bp, Mus musculus
aaatccgcgcttcgctctgcggtgg

SEQ ID NO: 20734 - DNA, 25 bp, Mus musculus
aaatccgcgcttggctctgcggtgg

SEQ ID NO: 20735 - DNA, 25 bp, Mus musculus
aaatccgctactatcttccaagctt

SEQ ID NO: 20736 - DNA, 25 bp, Mus musculus
aaatccgctactttcttccaagctt

SEQ ID NO: 20737 - DNA, 25 bp, Mus musculus
aaatccgctatgagtgtcttgctgg

SEQ ID NO: 20738 - DNA, 25 bp, Mus musculus
aaatccgctatgtgtgtcttgctgg

SEQ ID NO: 20739 - DNA, 25 bp, Mus musculus
aaatccggacggctgcagacacagg

SEQ ID NO: 20740 - DNA, 25 bp, Mus musculus
aaatccggacgggtgcagacacagg

SEQ ID NO: 20741 - DNA, 25 bp, Mus musculus
aaatccgggctcctgtaaatgctag

SEQ ID NO: 20742 - DNA, 25 bp, Mus musculus
aaatccgggctcgtgtaaatgctag

SEQ ID NO: 20743 - DNA, 25 bp, Mus musculus
aaatccggtcagaccagggcctaga

SEQ ID NO: 20744 - DNA, 25 bp, Mus musculus
aaatccggtcagtccagggcctaga

SEQ ID NO: 20745 - DNA, 25 bp, Mus musculus
aaatccggtgggagagcgcctatgt

SEQ ID NO: 20746 - DNA, 25 bp, Mus musculus
aaatccggtgggtgagcgcctatgt

SEQ ID NO: 20747 - DNA, 25 bp, Mus musculus
aaatccggttgtacgataactggcg

SEQ ID NO: 20748 - DNA, 25 bp, Mus musculus
aaatccggttgttcgataactggcg

SEQ ID NO: 20749 - DNA, 25 bp, Mus musculus
aaatccgtacttcgtcatctgtcct

SEQ ID NO: 20750 - DNA, 25 bp, Mus musculus
aaatccgtacttggtcatctgtcct

SEQ ID NO: 20751 - DNA, 25 bp, Mus musculus
aaatccgtagcgatgtaggctccct

SEQ ID NO: 20752 - DNA, 25 bp, Mus musculus
aaatccgtagcgttgtaggctccct

SEQ ID NO: 20753 - DNA, 25 bp, Mus musculus
aaatccgtagctctgctgcaatgtg

SEQ ID NO: 20754 - DNA, 25 bp, Mus musculus
aaatccgtagctgtgctgcaatgtg

SEQ ID NO: 20755 - DNA, 25 bp, Mus musculus
aaatccgtcaagctatgtgcagcag

SEQ ID NO: 20756 - DNA, 25 bp, Mus musculus
aaatccgtcaaggtatgtgcagcag

SEQ ID NO: 20757 - DNA, 25 bp, Mus musculus
aaatccgtgtgtatgtgttgccatg

SEQ ID NO: 20758 - DNA, 25 bp, Mus musculus
aaatccgtgtgtttgtgttgccatg

SEQ ID NO: 20759 - DNA, 25 bp, Mus musculus
aaatccgtgttcaagtcgggcgtgg

SEQ ID NO: 20760 - DNA, 25 bp, Mus musculus
aaatccgtgttctagtcgggcgtgg

SEQ ID NO: 20761 - DNA, 25 bp, Mus musculus
aaatccgttttcaccatgaactgtc

SEQ ID NO: 20762 - DNA, 25 bp, Mus musculus
aaatccgttttctccatgaactgtc

SEQ ID NO: 20763 - DNA, 25 bp, Mus musculus
aaatcctaacatactggtgtaagag

SEQ ID NO: 20764 - DNA, 25 bp, Mus musculus
aaatcctaacattctggtgtaagag

SEQ ID NO: 20765 - DNA, 25 bp, Mus musculus
aaatcctaagaaagtctgccctcac

SEQ ID NO: 20766 - DNA, 25 bp, Mus musculus
aaatcctaagaatgtctgccctcac

SEQ ID NO: 20767 - DNA, 25 bp, Mus musculus
aaatcctaagtgactggcttgaaca

SEQ ID NO: 20768 - DNA, 25 bp, Mus musculus
aaatcctaagtgtctggcttgaaca

SEQ ID NO: 20769 - DNA, 25 bp, Mus musculus
aaatcctaatcccatctgtgctggc

SEQ ID NO: 20770 - DNA, 25 bp, Mus musculus
aaatcctaatccgatctgtgctggc

SEQ ID NO: 20771 - DNA, 25 bp, Mus musculus
aaatcctaatgacatgttgcagtag

SEQ ID NO: 20772 - DNA, 25 bp, Mus musculus
aaatcctaatgagatgttgcagtag

SEQ ID NO: 20773 - DNA, 25 bp, Mus musculus
aaatcctacataattgcctcaaccc

SEQ ID NO: 20774 - DNA, 25 bp, Mus musculus
aaatcctacatatttgcctcaaccc

SEQ ID NO: 20775 - DNA, 25 bp, Mus musculus
aaatcctactaacttgcaaccagtg

SEQ ID NO: 20776 - DNA, 25 bp, Mus musculus
aaatcctactaagttgcaaccagtg

SEQ ID NO: 20777 - DNA, 25 bp, Mus musculus
aaatcctagaggaactgtcgggtgg

SEQ ID NO: 20778 - DNA, 25 bp, Mus musculus
aaatcctagaggtactgtcgggtgg

SEQ ID NO: 20779 - DNA, 25 bp, Mus musculus
aaatcctagtccaggtggccgcccg

SEQ ID NO: 20780 - DNA, 25 bp, Mus musculus
aaatcctagtcctggtggccgcccg

SEQ ID NO: 20781 - DNA, 25 bp, Mus musculus
aaatcctagtgaccggtgagccccg

SEQ ID NO: 20782 - DNA, 25 bp, Mus musculus
aaatcctagtgagcggtgagccccg

SEQ ID NO: 20783 - DNA, 25 bp, Mus musculus
aaatcctatacaagacagtccagtt

SEQ ID NO: 20784 - DNA, 25 bp, Mus musculus
aaatcctatacatgacagtccagtt

SEQ ID NO: 20785 - DNA, 25 bp, Mus musculus
aaatcctatttactcagaatccttg

SEQ ID NO: 20786 - DNA, 25 bp, Mus musculus
aaatcctatttagtcagaatccttg

SEQ ID NO: 20787 - DNA, 25 bp, Mus musculus
aaatcctattttatggccgtaactg

SEQ ID NO: 20788 - DNA, 25 bp, Mus musculus
aaatcctattttttggccgtaactg

SEQ ID NO: 20789 - DNA, 25 bp, Mus musculus
aaatcctcaaatacaagaccatcga

SEQ ID NO: 20790 - DNA, 25 bp, Mus musculus
aaatcctcaaattcaagaccatcga

SEQ ID NO: 20791 - DNA, 25 bp, Mus musculus
aaatcctcacaacaccatgtttggc

SEQ ID NO: 20792 - DNA, 25 bp, Mus musculus
aaatcctcacaagaccatgtttggc

SEQ ID NO: 20793 - DNA, 25 bp, Mus musculus
aaatcctcacgcaggtcaacgtagt

SEQ ID NO: 20794 - DNA, 25 bp, Mus musculus
aaatcctcacgctggtcaacgtagt

SEQ ID NO: 20795 - DNA, 25 bp, Mus musculus
aaatcctcacttacctgcaagtatc

SEQ ID NO: 20796 - DNA, 25 bp, Mus musculus
aaatcctcactttcctgcaagtatc

SEQ ID NO: 20797 - DNA, 25 bp, Mus musculus
aaatcctcagagcacttactgcaat

SEQ ID NO: 20798 - DNA, 25 bp, Mus musculus
aaatcctcagaggacttactgcaat

SEQ ID NO: 20799 - DNA, 25 bp, Mus musculus
aaatcctcagatacttgcagctctt

SEQ ID NO: 20800 - DNA, 25 bp, Mus musculus
aaatcctcagattcttgcagctctt

SEQ ID NO: 20801 - DNA, 25 bp, Mus musculus
aaatcctcagcgatcttttcattgt

SEQ ID NO: 20802 - DNA, 25 bp, Mus musculus
aaatcctcagcgttcttttcattgt

SEQ ID NO: 20803 - DNA, 25 bp, Mus musculus
aaatcctcaggaaacttgcaagcta

SEQ ID NO: 20804 - DNA, 25 bp, Mus musculus
aaatcctcaggacgactacagctat

SEQ ID NO: 20805 - DNA, 25 bp, Mus musculus
aaatcctcaggaggactacagctat

SEQ ID NO: 20806 - DNA, 25 bp, Mus musculus
aaatcctcaggatacttgcaagcta

SEQ ID NO: 20807 - DNA, 25 bp, Mus musculus
aaatcctcagtcaactgcctttcaa

SEQ ID NO: 20808 - DNA, 25 bp, Mus musculus
aaatcctcagtctactgcctttcaa

SEQ ID NO: 20809 - DNA, 25 bp, Mus musculus
aaatcctcagtgaggcacttacctg

SEQ ID NO: 20810 - DNA, 25 bp, Mus musculus
aaatcctcagtgtggcacttacctg

SEQ ID NO: 20811 - DNA, 25 bp, Mus musculus
aaatcctccatgaagatgagctggt

SEQ ID NO: 20812 - DNA, 25 bp, Mus musculus
aaatcctccatgtagatgagctggt

SEQ ID NO: 20813 - DNA, 25 bp, Mus musculus
aaatcctccctaaagtgcctgagcg

SEQ ID NO: 20814 - DNA, 25 bp, Mus musculus
aaatcctccctatagtgcctgagcg

SEQ ID NO: 20815 - DNA, 25 bp, Mus musculus
aaatcctcctagatccacctatgag

SEQ ID NO: 20816 - DNA, 25 bp, Mus musculus
aaatcctcctagttccacctatgag

SEQ ID NO: 20817 - DNA, 25 bp, Mus musculus
aaatcctcctcacttatcagtgact

SEQ ID NO: 20818 - DNA, 25 bp, Mus musculus
aaatcctcctcagttatcagtgact

SEQ ID NO: 20819 - DNA, 25 bp, Mus musculus
aaatcctcgatgaagacggcctgtt

SEQ ID NO: 20820 - DNA, 25 bp, Mus musculus
aaatcctcgatgtagacggcctgtt

SEQ ID NO: 20821 - DNA, 25 bp, Mus musculus
aaatcctcgattcagtttcactcct

SEQ ID NO: 20822 - DNA, 25 bp, Mus musculus
aaatcctcgattgagtttcactcct

SEQ ID NO: 20823 - DNA, 25 bp, Mus musculus
aaatcctcgcttctgggacttggtg

SEQ ID NO: 20824 - DNA, 25 bp, Mus musculus
aaatcctcgcttgtgggacttggtg

SEQ ID NO: 20825 - DNA, 25 bp, Mus musculus
aaatcctctcgcatgtcattggctc

SEQ ID NO: 20826 - DNA, 25 bp, Mus musculus
aaatcctctcgcttgtcattggctc

SEQ ID NO: 20827 - DNA, 25 bp, Mus musculus
aaatcctctctaacacaggtgtaat

SEQ ID NO: 20828 - DNA, 25 bp, Mus musculus
aaatcctctctatcacaggtgtaat

SEQ ID NO: 20829 - DNA, 25 bp, Mus musculus
aaatcctctgataaggtgagactct

SEQ ID NO: 20830 - DNA, 25 bp, Mus musculus
aaatcctctgattaggtgagactct

SEQ ID NO: 20831 - DNA, 25 bp, Mus musculus
aaatcctctgctcgcgtacatatta

SEQ ID NO: 20832 - DNA, 25 bp, Mus musculus
aaatcctctgctggcgtacatatta

SEQ ID NO: 20833 - DNA, 25 bp, Mus musculus
aaatcctgacctagaaatgctttta

SEQ ID NO: 20834 - DNA, 25 bp, Mus musculus
aaatcctgaccttgaaatgctttta

SEQ ID NO: 20835 - DNA, 25 bp, Mus musculus
aaatcctgagcaatcatgtctccac

SEQ ID NO: 20836 - DNA, 25 bp, Mus musculus
aaatcctgagcattcatgtctccac

SEQ ID NO: 20837 - DNA, 25 bp, Mus musculus
aaatcctgagctcgagcgatgccca

SEQ ID NO: 20838 - DNA, 25 bp, Mus musculus
aaatcctgagctggagcgatgccca

SEQ ID NO: 20839 - DNA, 25 bp, Mus musculus
aaatcctgaggaaattttccgcgag

SEQ ID NO: 20840 - DNA, 25 bp, Mus musculus
aaatcctgaggatattttccgcgag

SEQ ID NO: 20841 - DNA, 25 bp, Mus musculus
aaatcctgagttaatgctgcatgct

SEQ ID NO: 20842 - DNA, 25 bp, Mus musculus
aaatcctgagtttatgctgcatgct

SEQ ID NO: 20843 - DNA, 25 bp, Mus musculus
aaatcctgcagtaaagttcttatat

SEQ ID NO: 20844 - DNA, 25 bp, Mus musculus
aaatcctgcagttaagttcttatat

SEQ ID NO: 20845 - DNA, 25 bp, Mus musculus
aaatcctgccaccagaagattaaac

SEQ ID NO: 20846 - DNA, 25 bp, Mus musculus
aaatcctgccacgagaagattaaac

SEQ ID NO: 20847 - DNA, 25 bp, Mus musculus
aaatcctgccagaaataatccgaat

SEQ ID NO: 20848 - DNA, 25 bp, Mus musculus
aaatcctgccagtaataatccgaat

SEQ ID NO: 20849 - DNA, 25 bp, Mus musculus
aaatcctgcctgagggacgtcattt

SEQ ID NO: 20850 - DNA, 25 bp, Mus musculus
aaatcctgcctgtgggacgtcattt

SEQ ID NO: 20851 - DNA, 25 bp, Mus musculus
aaatcctgctacaattcggtttggc

SEQ ID NO: 20852 - DNA, 25 bp, Mus musculus
aaatcctgctactattcggtttggc

SEQ ID NO: 20853 - DNA, 25 bp, Mus musculus
aaatcctgctcaactactcattaag

SEQ ID NO: 20854 - DNA, 25 bp, Mus musculus
aaatcctgctcatctactcattaag

SEQ ID NO: 20855 - DNA, 25 bp, Mus musculus
aaatcctgctgcactgagtctgagt

SEQ ID NO: 20856 - DNA, 25 bp, Mus musculus
aaatcctgctgctctgagtctgagt

SEQ ID NO: 20857 - DNA, 25 bp, Mus musculus
aaatcctgcttgaattcagtttcaa

SEQ ID NO: 20858 - DNA, 25 bp, Mus musculus
aaatcctgcttgcagtctacacgac

SEQ ID NO: 20859 - DNA, 25 bp, Mus musculus
aaatcctgcttggagtctacacgac

SEQ ID NO: 20860 - DNA, 25 bp, Mus musculus
aaatcctgcttgtattcagtttcaa

SEQ ID NO: 20861 - DNA, 25 bp, Mus musculus
aaatcctggaatatctgctgctgaa

SEQ ID NO: 20862 - DNA, 25 bp, Mus musculus
aaatcctggaatttctgctgctgaa

SEQ ID NO: 20863 - DNA, 25 bp, Mus musculus
aaatcctggaggcagcctcacctgc

SEQ ID NO: 20864 - DNA, 25 bp, Mus musculus
aaatcctggagggagcctcacctgc

SEQ ID NO: 20865 - DNA, 25 bp, Mus musculus
aaatcctggcataagcttctcctta

SEQ ID NO: 20866 - DNA, 25 bp, Mus musculus
aaatcctggcattagcttctcctta

SEQ ID NO: 20867 - DNA, 25 bp, Mus musculus
aaatcctggccgcacttgagaaggg

SEQ ID NO: 20868 - DNA, 25 bp, Mus musculus
aaatcctggccggacttgagaaggg

SEQ ID NO: 20869 - DNA, 25 bp, Mus musculus
aaatcctgggtcaccactagcgatg

SEQ ID NO: 20870 - DNA, 25 bp, Mus musculus
aaatcctgggtcatttgctcggcta

SEQ ID NO: 20871 - DNA, 25 bp, Mus musculus
aaatcctgggtctccactagcgatg

SEQ ID NO: 20872 - DNA, 25 bp, Mus musculus
aaatcctgggtcttttgctcggcta

SEQ ID NO: 20873 - DNA, 25 bp, Mus musculus
aaatcctgggtgacaaagcctctag

SEQ ID NO: 20874 - DNA, 25 bp, Mus musculus
aaatcctgggtgtcaaagcctctag

SEQ ID NO: 20875 - DNA, 25 bp, Mus musculus
aaatcctgggttattcatattcctt

SEQ ID NO: 20876 - DNA, 25 bp, Mus musculus
aaatcctgggtttttcatattcctt

SEQ ID NO: 20877 - DNA, 25 bp, Mus musculus
aaatcctggtacatgaatccacacc

SEQ ID NO: 20878 - DNA, 25 bp, Mus musculus
aaatcctggtacttgaatccacacc

SEQ ID NO: 20879 - DNA, 25 bp, Mus musculus
aaatcctgtattcatctgttcccct

SEQ ID NO: 20880 - DNA, 25 bp, Mus musculus
aaatcctgtattgatctgttcccct

SEQ ID NO: 20881 - DNA, 25 bp, Mus musculus
aaatcctgtcaacagcgtagaacct

SEQ ID NO: 20882 - DNA, 25 bp, Mus musculus
aaatcctgtcaagagcgtagaacct

SEQ ID NO: 20883 - DNA, 25 bp, Mus musculus
aaatcctgtcagatccctatgctga

SEQ ID NO: 20884 - DNA, 25 bp, Mus musculus
aaatcctgtcagttccctatgctga

SEQ ID NO: 20885 - DNA, 25 bp, Mus musculus
aaatcctgtcgtaagttctcagtgt

SEQ ID NO: 20886 - DNA, 25 bp, Mus musculus
aaatcctgtcgttagttctcagtgt

SEQ ID NO: 20887 - DNA, 25 bp, Mus musculus
aaatcctgtgaactggcgtatgtga

SEQ ID NO: 20888 - DNA, 25 bp, Mus musculus
aaatcctgtgaagtggcgtatgtga

SEQ ID NO: 20889 - DNA, 25 bp, Mus musculus
aaatcctgtggaccagacagctaaa

SEQ ID NO: 20890 - DNA, 25 bp, Mus musculus
aaatcctgtggactccttcattgcc

SEQ ID NO: 20891 - DNA, 25 bp, Mus musculus
aaatcctgtggagcagacagctaaa

SEQ ID NO: 20892 - DNA, 25 bp, Mus musculus
aaatcctgtggagtccttcattgcc

SEQ ID NO: 20893 - DNA, 25 bp, Mus musculus
aaatcctgttacagctctttttcat

SEQ ID NO: 20894 - DNA, 25 bp, Mus musculus
aaatcctgttactgctctttttcat

SEQ ID NO: 20895 - DNA, 25 bp, Mus musculus
aaatcctgtttgatggccacagctg

SEQ ID NO: 20896 - DNA, 25 bp, Mus musculus
aaatcctgtttgttggccacagctg

SEQ ID NO: 20897 - DNA, 25 bp, Mus musculus
aaatccttagttctgtatactgcct

SEQ ID NO: 20898 - DNA, 25 bp, Mus musculus
aaatccttagttgtgtatactgcct

SEQ ID NO: 20899 - DNA, 25 bp, Mus musculus
aaatccttatttcccacagattgag

SEQ ID NO: 20900 - DNA, 25 bp, Mus musculus
aaatccttatttgccacagattgag

SEQ ID NO: 20901 - DNA, 25 bp, Mus musculus
aaatccttcagccaccagtgaaatg

SEQ ID NO: 20902 - DNA, 25 bp, Mus musculus
aaatccttcagcgaccagtgaaatg

SEQ ID NO: 20903 - DNA, 25 bp, Mus musculus
aaatccttccagactgaaggcctcc

SEQ ID NO: 20904 - DNA, 25 bp, Mus musculus
aaatccttccagtctgaaggcctcc

SEQ ID NO: 20905 - DNA, 25 bp, Mus musculus
aaatccttcctcatagacctagttg

SEQ ID NO: 20906 - DNA, 25 bp, Mus musculus
aaatccttcctcttagacctagttg

SEQ ID NO: 20907 - DNA, 25 bp, Mus musculus
aaatccttctatcccagccagggtg

SEQ ID NO: 20908 - DNA, 25 bp, Mus musculus
aaatccttctatgccagccagggtg

SEQ ID NO: 20909 - DNA, 25 bp, Mus musculus
aaatccttctttccaagccacaagg

SEQ ID NO: 20910 - DNA, 25 bp, Mus musculus
aaatccttctttgcaagccacaagg

SEQ ID NO: 20911 - DNA, 25 bp, Mus musculus
aaatccttgaataggagggcatctc

SEQ ID NO: 20912 - DNA, 25 bp, Mus musculus
aaatccttgaattggagggcatctc

SEQ ID NO: 20913 - DNA, 25 bp, Mus musculus
aaatccttgacccatttacacaaag

SEQ ID NO: 20914 - DNA, 25 bp, Mus musculus
aaatccttgaccgatttacacaaag

SEQ ID NO: 20915 - DNA, 25 bp, Mus musculus
aaatccttgagaacatgcactcccc

SEQ ID NO: 20916 - DNA, 25 bp, Mus musculus
aaatccttgagatcatgcactcccc

SEQ ID NO: 20917 - DNA, 25 bp, Mus musculus
aaatccttgagccagagtgaaacaa

SEQ ID NO: 20918 - DNA, 25 bp, Mus musculus
aaatccttgagcgagagtgaaacaa

SEQ ID NO: 20919 - DNA, 25 bp, Mus musculus
aaatccttgataatatagcttgcca

SEQ ID NO: 20920 - DNA, 25 bp, Mus musculus
aaatccttgatattatagcttgcca

SEQ ID NO: 20921 - DNA, 25 bp, Mus musculus
aaatccttgccgactgcatgatgaa

SEQ ID NO: 20922 - DNA, 25 bp, Mus musculus
aaatccttgccgtctgcatgatgaa

SEQ ID NO: 20923 - DNA, 25 bp, Mus musculus
aaatccttgcttcaatcatctccag

SEQ ID NO: 20924 - DNA, 25 bp, Mus musculus
aaatccttgcttgaatcatctccag

SEQ ID NO: 20925 - DNA, 25 bp, Mus musculus
aaatccttggctcacttgacggcag

SEQ ID NO: 20926 - DNA, 25 bp, Mus musculus
aaatccttggctgacttgacggcag

SEQ ID NO: 20927 - DNA, 25 bp, Mus musculus
aaatccttgtatagtgacgtgttgt

SEQ ID NO: 20928 - DNA, 25 bp, Mus musculus
aaatccttgtattgtgacgtgttgt

SEQ ID NO: 20929 - DNA, 25 bp, Mus musculus
aaatcctttaatccatgtacttccc

SEQ ID NO: 20930 - DNA, 25 bp, Mus musculus
aaatcctttaatgcatgtacttccc

SEQ ID NO: 20931 - DNA, 25 bp, Mus musculus
aaatcctttatccttcttctatagc

SEQ ID NO: 20932 - DNA, 25 bp, Mus musculus
aaatcctttatcgttcttctatagc

SEQ ID NO: 20933 - DNA, 25 bp, Mus musculus
aaatcctttatgagagaaacaactt

SEQ ID NO: 20934 - DNA, 25 bp, Mus musculus
aaatcctttatgtgagaaacaactt

SEQ ID NO: 20935 - DNA, 25 bp, Mus musculus
aaatcctttcatatctttagagcag

SEQ ID NO: 20936 - DNA, 25 bp, Mus musculus
aaatcctttcatttctttagagcag

SEQ ID NO: 20937 - DNA, 25 bp, Mus musculus
aaatcctttctgctaagggctcagt

SEQ ID NO: 20938 - DNA, 25 bp, Mus musculus
aaatcctttctggtaagggctcagt

SEQ ID NO: 20939 - DNA, 25 bp, Mus musculus
aaatcctttggcatgcagtatctgt

SEQ ID NO: 20940 - DNA, 25 bp, Mus musculus
aaatcctttggcttgcagtatctgt

SEQ ID NO: 20941 - DNA, 25 bp, Mus musculus
aaatcctttgtcagtcacgtgttgc

SEQ ID NO: 20942 - DNA, 25 bp, Mus musculus
aaatcctttgtctgtcacgtgttgc

SEQ ID NO: 20943 - DNA, 25 bp, Mus musculus
aaatcctttgttactcatgctatac

SEQ ID NO: 20944 - DNA, 25 bp, Mus musculus
aaatcctttgtttctcatgctatac

SEQ ID NO: 20945 - DNA, 25 bp, Mus musculus
aaatccttttcaacctaagcttgag

SEQ ID NO: 20946 - DNA, 25 bp, Mus musculus
aaatccttttcatcctaagcttgag

SEQ ID NO: 20947 - DNA, 25 bp, Mus musculus
aaatccttttgtcaagcggtctcaa

SEQ ID NO: 20948 - DNA, 25 bp, Mus musculus
aaatccttttgtgaagcggtctcaa

SEQ ID NO: 20949 - DNA, 25 bp, Mus musculus
aaatcctttttgctgaggctacccg

SEQ ID NO: 20950 - DNA, 25 bp, Mus musculus
aaatcctttttggtgaggctacccg

SEQ ID NO: 20951 - DNA, 25 bp, Mus musculus
aaatcgaacaagcatatctcctatt

SEQ ID NO: 20952 - DNA, 25 bp, Mus musculus
aaatcgaacaaggatatctcctatt

SEQ ID NO: 20953 - DNA, 25 bp, Mus musculus
aaatcgaaccaaccctgcaattcca

SEQ ID NO: 20954 - DNA, 25 bp, Mus musculus
aaatcgaaccaagcctgcaattcca

SEQ ID NO: 20955 - DNA, 25 bp, Mus musculus
aaatcgaagcaaacgctgtccaggg

SEQ ID NO: 20956 - DNA, 25 bp, Mus musculus
aaatcgaagcaatcgctgtccaggg

SEQ ID NO: 20957 - DNA, 25 bp, Mus musculus
aaatcgacttgtaggaatcctgttt

SEQ ID NO: 20958 - DNA, 25 bp, Mus musculus
aaatcgacttgttggaatcctgttt

SEQ ID NO: 20959 - DNA, 25 bp, Mus musculus
aaatcgagagtgacgccccgatgaa

SEQ ID NO: 20960 - DNA, 25 bp, Mus musculus
aaatcgagagtgtcgccccgatgaa

SEQ ID NO: 20961 - DNA, 25 bp, Mus musculus
aaatcgagtcacctaaactggagag

SEQ ID NO: 20962 - DNA, 25 bp, Mus musculus
aaatcgagtcacgtaaactggagag

SEQ ID NO: 20963 - DNA, 25 bp, Mus musculus
aaatcgagtcgcctggcccgttgct

SEQ ID NO: 20964 - DNA, 25 bp, Mus musculus
aaatcgagtcgcgtggcccgttgct

SEQ ID NO: 20965 - DNA, 25 bp, Mus musculus
aaatcgagtcttaaatgtcctttga

SEQ ID NO: 20966 - DNA, 25 bp, Mus musculus
aaatcgagtctttaatgtcctttga

SEQ ID NO: 20967 - DNA, 25 bp, Mus musculus
aaatcgatatgtccctggatgatat

SEQ ID NO: 20968 - DNA, 25 bp, Mus musculus
aaatcgatatgtgcctggatgatat

SEQ ID NO: 20969 - DNA, 25 bp, Mus musculus
aaatcgatcataattttggcgaaat

SEQ ID NO: 20970 - DNA, 25 bp, Mus musculus
aaatcgatcatatttttggcgaaat

SEQ ID NO: 20971 - DNA, 25 bp, Mus musculus
aaatcgatctcaattttggtggagc

SEQ ID NO: 20972 - DNA, 25 bp, Mus musculus
aaatcgatctcatttttggtggagc

SEQ ID NO: 20973 - DNA, 25 bp, Mus musculus
aaatcgatgaggagtgggcagtaac

SEQ ID NO: 20974 - DNA, 25 bp, Mus musculus
aaatcgatgaggtgtgggcagtaac

SEQ ID NO: 20975 - DNA, 25 bp, Mus musculus
aaatcgattggaagcgcccttgtga

SEQ ID NO: 20976 - DNA, 25 bp, Mus musculus
aaatcgattggatgcgcccttgtga

SEQ ID NO: 20977 - DNA, 25 bp, Mus musculus
aaatcgatttgcaaccctttggatg

SEQ ID NO: 20978 - DNA, 25 bp, Mus musculus
aaatcgatttgctaccctttggatg

SEQ ID NO: 20979 - DNA, 25 bp, Mus musculus
aaatcgcacaagacaagtacagttt

SEQ ID NO: 20980 - DNA, 25 bp, Mus musculus
aaatcgcacaagtcaagtacagttt

SEQ ID NO: 20981 - DNA, 25 bp, Mus musculus
aaatcgcacaccacagacacagtgg

SEQ ID NO: 20982 - DNA, 25 bp, Mus musculus
aaatcgcacacctcagacacagtgg

SEQ ID NO: 20983 - DNA, 25 bp, Mus musculus
aaatcgcagggacggtcatttgaca

SEQ ID NO: 20984 - DNA, 25 bp, Mus musculus
aaatcgcagggagggtcatttgaca

SEQ ID NO: 20985 - DNA, 25 bp, Mus musculus
aaatcgcagttaatagctcgcctaa

SEQ ID NO: 20986 - DNA, 25 bp, Mus musculus
aaatcgcagttattagctcgcctaa

SEQ ID NO: 20987 - DNA, 25 bp, Mus musculus
aaatcgcataatctcactttcacag

SEQ ID NO: 20988 - DNA, 25 bp, Mus musculus
aaatcgcataatgtcactttcacag

SEQ ID NO: 20989 - DNA, 25 bp, Mus musculus
aaatcgcattctcctgtacgcgtgc

SEQ ID NO: 20990 - DNA, 25 bp, Mus musculus
aaatcgcattctgctgtacgcgtgc

SEQ ID NO: 20991 - DNA, 25 bp, Mus musculus
aaatcgcctgggaagctgtttgaca

SEQ ID NO: 20992 - DNA, 25 bp, Mus musculus
aaatcgcctgggtagctgtttgaca

SEQ ID NO: 20993 - DNA, 25 bp, Mus musculus
aaatcgccttttcaaagcgccaccg

SEQ ID NO: 20994 - DNA, 25 bp, Mus musculus
aaatcgccttttgaaagcgccaccg

SEQ ID NO: 20995 - DNA, 25 bp, Mus musculus
aaatcgctccaccaactaagaacgg

SEQ ID NO: 20996 - DNA, 25 bp, Mus musculus
aaatcgctccacgaactaagaacgg

SEQ ID NO: 20997 - DNA, 25 bp, Mus musculus
aaatcgctccatcattgcaggctat

SEQ ID NO: 20998 - DNA, 25 bp, Mus musculus
aaatcgctccatgattgcaggctat

SEQ ID NO: 20999 - DNA, 25 bp, Mus musculus
aaatcgctctgtatagtgacgagtt

SEQ ID NO: 21000 - DNA, 25 bp, Mus musculus
aaatcgctctgtttagtgacgagtt

SEQ ID NO: 21001 - DNA, 25 bp, Mus musculus
aaatcgctgacaagtgtgaacccgt

SEQ ID NO: 21002 - DNA, 25 bp, Mus musculus
aaatcgctgacatgtgtgaacccgt

SEQ ID NO: 21003 - DNA, 25 bp, Mus musculus
aaatcgctggacctgcattggagac

SEQ ID NO: 21004 - DNA, 25 bp, Mus musculus
aaatcgctggacgtgcattggagac

SEQ ID NO: 21005 - DNA, 25 bp, Mus musculus
aaatcgcttgtcaatgttacaccaa

SEQ ID NO: 21006 - DNA, 25 bp, Mus musculus
aaatcgcttgtctatgttacaccaa

SEQ ID NO: 21007 - DNA, 25 bp, Mus musculus
aaatcgctttatagtctctggcttt

SEQ ID NO: 21008 - DNA, 25 bp, Mus musculus
aaatcgctttattgtctctggcttt

SEQ ID NO: 21009 - DNA, 25 bp, Mus musculus
aaatcgcttttcattttgttgctaa

SEQ ID NO: 21010 - DNA, 25 bp, Mus musculus
aaatcgcttttctttttgttgctaa

SEQ ID NO: 21011 - DNA, 25 bp, Mus musculus
aaatcggaacacaggcatcacaaag

SEQ ID NO: 21012 - DNA, 25 bp, Mus musculus
aaatcggaacactggcatcacaaag

SEQ ID NO: 21013 - DNA, 25 bp, Mus musculus
aaatcggacagtctggcaacaccag

SEQ ID NO: 21014 - DNA, 25 bp, Mus musculus
aaatcggacagtgtggcaacaccag

SEQ ID NO: 21015 - DNA, 25 bp, Mus musculus
aaatcggagacaccagtatcccgca

SEQ ID NO: 21016 - DNA, 25 bp, Mus musculus
aaatcggagacagcagtatcccgca

SEQ ID NO: 21017 - DNA, 25 bp, Mus musculus
aaatcggatgatcggctgtgctcct

SEQ ID NO: 21018 - DNA, 25 bp, Mus musculus
aaatcggatgatgggctgtgctcct

SEQ ID NO: 21019 - DNA, 25 bp, Mus musculus
aaatcggattccaggactagcggtc

SEQ ID NO: 21020 - DNA, 25 bp, Mus musculus
aaatcggattcctggactagcggtc

SEQ ID NO: 21021 - DNA, 25 bp, Mus musculus
aaatcggccagcagtttcgaacatt

SEQ ID NO: 21022 - DNA, 25 bp, Mus musculus
aaatcggccagctgtttcgaacatt

SEQ ID NO: 21023 - DNA, 25 bp, Mus musculus
aaatcggcttcgctttcagttggag

SEQ ID NO: 21024 - DNA, 25 bp, Mus musculus
aaatcggcttcggtttcagttggag

SEQ ID NO: 21025 - DNA, 25 bp, Mus musculus
aaatcggcttggatttgcgacacaa

SEQ ID NO: 21026 - DNA, 25 bp, Mus musculus
aaatcggcttggttttgcgacacaa

SEQ ID NO: 21027 - DNA, 25 bp, Mus musculus
aaatcgggaaccactatactagtga

SEQ ID NO: 21028 - DNA, 25 bp, Mus musculus
aaatcgggaacctctatactagtga

SEQ ID NO: 21029 - DNA, 25 bp, Mus musculus
aaatcgggatttagactgaatggga

SEQ ID NO: 21030 - DNA, 25 bp, Mus musculus
aaatcgggattttgactgaatggga

SEQ ID NO: 21031 - DNA, 25 bp, Mus musculus
aaatcgggtcagaatttttcacctg

SEQ ID NO: 21032 - DNA, 25 bp, Mus musculus
aaatcgggtcagtatttttcacctg

SEQ ID NO: 21033 - DNA, 25 bp, Mus musculus
aaatcgggtctacgaagcctctctc

SEQ ID NO: 21034 - DNA, 25 bp, Mus musculus
aaatcgggtctaggaagcctctctc

SEQ ID NO: 21035 - DNA, 25 bp, Mus musculus
aaatcgggtgtactgttgttacatt

SEQ ID NO: 21036 - DNA, 25 bp, Mus musculus
aaatcgggtgtagtgttgttacatt

SEQ ID NO: 21037 - DNA, 25 bp, Mus musculus
aaatcggtagctatgcatctcagaa

SEQ ID NO: 21038 - DNA, 25 bp, Mus musculus
aaatcggtagctttgcatctcagaa

SEQ ID NO: 21039 - DNA, 25 bp, Mus musculus
aaatcggtcactccgtacgttgtga

SEQ ID NO: 21040 - DNA, 25 bp, Mus musculus
aaatcggtcactgcgtacgttgtga

SEQ ID NO: 21041 - DNA, 25 bp, Mus musculus
aaatcgtcatcaatgccaggcaggg

SEQ ID NO: 21042 - DNA, 25 bp, Mus musculus
aaatcgtcatcattgccaggcaggg

SEQ ID NO: 21043 - DNA, 25 bp, Mus musculus
aaatcgtgaatccatttctctgctc

SEQ ID NO: 21044 - DNA, 25 bp, Mus musculus
aaatcgtgaatcgatttctctgctc

SEQ ID NO: 21045 - DNA, 25 bp, Mus musculus
aaatcgtgccttagcttcagtcttg

SEQ ID NO: 21046 - DNA, 25 bp, Mus musculus
aaatcgtgcctttgcttcagtcttg

SEQ ID NO: 21047 - DNA, 25 bp, Mus musculus
aaatcgtggcgaatttacaccaagg

SEQ ID NO: 21048 - DNA, 25 bp, Mus musculus
aaatcgtggcgattttacaccaagg

SEQ ID NO: 21049 - DNA, 25 bp, Mus musculus
aaatcgtggttcactggtcacttta

SEQ ID NO: 21050 - DNA, 25 bp, Mus musculus
aaatcgtggttctctggtcacttta

SEQ ID NO: 21051 - DNA, 25 bp, Mus musculus
aaatcgtgtctactgcgctcgaggc

SEQ ID NO: 21052 - DNA, 25 bp, Mus musculus
aaatcgtgtctagtgcgctcgaggc

SEQ ID NO: 21053 - DNA, 25 bp, Mus musculus
aaatcgttcatgatttccaagagta

SEQ ID NO: 21054 - DNA, 25 bp, Mus musculus
aaatcgttcatgttttccaagagta

SEQ ID NO: 21055 - DNA, 25 bp, Mus musculus
aaatcgttggagatacacgggagat

SEQ ID NO: 21056 - DNA, 25 bp, Mus musculus
aaatcgttggagttacacgggagat

SEQ ID NO: 21057 - DNA, 25 bp, Mus musculus
aaatcgttgtgtactctgttttcct

SEQ ID NO: 21058 - DNA, 25 bp, Mus musculus
aaatcgttgtgttctctgttttcct

SEQ ID NO: 21059 - DNA, 25 bp, Mus musculus
aaatcgtttactcttccagtcttgc

SEQ ID NO: 21060 - DNA, 25 bp, Mus musculus
aaatcgtttactgttccagtcttgc

SEQ ID NO: 21061 - DNA, 25 bp, Mus musculus
aaatcgttttccagtttcaggagtg

SEQ ID NO: 21062 - DNA, 25 bp, Mus musculus
aaatcgttttcctgtttcaggagtg

SEQ ID NO: 21063 - DNA, 25 bp, Mus musculus
aaatctaaaatgcaaggctactagg

SEQ ID NO: 21064 - DNA, 25 bp, Mus musculus
aaatctaaaatggaaggctactagg

SEQ ID NO: 21065 - DNA, 25 bp, Mus musculus
aaatctaaccaaaaactgcaacatt

SEQ ID NO: 21066 - DNA, 25 bp, Mus musculus
aaatctaaccaataactgcaacatt

SEQ ID NO: 21067 - DNA, 25 bp, Mus musculus
aaatctaaggatcgctactgtgaca

SEQ ID NO: 21068 - DNA, 25 bp, Mus musculus
aaatctaaggatggctactgtgaca

SEQ ID NO: 21069 - DNA, 25 bp, Mus musculus
aaatctaaggcaaaactcatggaag

SEQ ID NO: 21070 - DNA, 25 bp, Mus musculus
aaatctaaggcataactcatggaag

SEQ ID NO: 21071 - DNA, 25 bp, Mus musculus
aaatctaatccgcatatttcccatc

SEQ ID NO: 21072 - DNA, 25 bp, Mus musculus
aaatctaatccggatatttcccatc

SEQ ID NO: 21073 - DNA, 25 bp, Mus musculus
aaatctaattctaactggcccagag

SEQ ID NO: 21074 - DNA, 25 bp, Mus musculus
aaatctaattcttactggcccagag

SEQ ID NO: 21075 - DNA, 25 bp, Mus musculus
aaatctacaaatcctttcctctcag

SEQ ID NO: 21076 - DNA, 25 bp, Mus musculus
aaatctacaaatgctttcctctcag

SEQ ID NO: 21077 - DNA, 25 bp, Mus musculus
aaatctacactgatctcgggctagt

SEQ ID NO: 21078 - DNA, 25 bp, Mus musculus
aaatctacactgttctcgggctagt

SEQ ID NO: 21079 - DNA, 25 bp, Mus musculus
aaatctaccatcatgtggtcttcca

SEQ ID NO: 21080 - DNA, 25 bp, Mus musculus
aaatctaccatcttgtggtcttcca

SEQ ID NO: 21081 - DNA, 25 bp, Mus musculus
aaatctacccttcatgaaatatgat

SEQ ID NO: 21082 - DNA, 25 bp, Mus musculus
aaatctacccttccctagattcttt

SEQ ID NO: 21083 - DNA, 25 bp, Mus musculus
aaatctacccttgatgaaatatgat

SEQ ID NO: 21084 - DNA, 25 bp, Mus musculus
aaatctacccttgcctagattcttt

SEQ ID NO: 21085 - DNA, 25 bp, Mus musculus
aaatctacctagagtccgattccta

SEQ ID NO: 21086 - DNA, 25 bp, Mus musculus
aaatctacctagtgtccgattccta

SEQ ID NO: 21087 - DNA, 25 bp, Mus musculus
aaatctacgactcgattatcaggac

SEQ ID NO: 21088 - DNA, 25 bp, Mus musculus
aaatctacgactggattatcaggac

SEQ ID NO: 21089 - DNA, 25 bp, Mus musculus
aaatctacggtgatctgggaccgca

SEQ ID NO: 21090 - DNA, 25 bp, Mus musculus
aaatctacggtgttctgggaccgca

SEQ ID NO: 21091 - DNA, 25 bp, Mus musculus
aaatctactaacacgttcacctgta

SEQ ID NO: 21092 - DNA, 25 bp, Mus musculus
aaatctactaactcgttcacctgta

SEQ ID NO: 21093 - DNA, 25 bp, Mus musculus
aaatctactgagagccaacatggac

SEQ ID NO: 21094 - DNA, 25 bp, Mus musculus
aaatctactgagtgccaacatggac

SEQ ID NO: 21095 - DNA, 25 bp, Mus musculus
aaatctacttgaagccaaaggagac

SEQ ID NO: 21096 - DNA, 25 bp, Mus musculus
aaatctacttgatgccaaaggagac

SEQ ID NO: 21097 - DNA, 25 bp, Mus musculus
aaatctactttaaggtgctggcgag

SEQ ID NO: 21098 - DNA, 25 bp, Mus musculus
aaatctactttatggtgctggcgag

SEQ ID NO: 21099 - DNA, 25 bp, Mus musculus
aaatctagactaatggttcttccca

SEQ ID NO: 21100 - DNA, 25 bp, Mus musculus
aaatctagactattggttcttccca

SEQ ID NO: 21101 - DNA, 25 bp, Mus musculus
aaatctagatctactgcaacagcaa

SEQ ID NO: 21102 - DNA, 25 bp, Mus musculus
aaatctagatcttctgcaacagcaa

SEQ ID NO: 21103 - DNA, 25 bp, Mus musculus
aaatctagatgaagtgctcagtcta

SEQ ID NO: 21104 - DNA, 25 bp, Mus musculus
aaatctagatgatgtgctcagtcta

SEQ ID NO: 21105 - DNA, 25 bp, Mus musculus
aaatctagccaaagcgaatccccag

SEQ ID NO: 21106 - DNA, 25 bp, Mus musculus
aaatctagccaatgcgaatccccag

SEQ ID NO: 21107 - DNA, 25 bp, Mus musculus
aaatctagctcaaaagtaggcccag

SEQ ID NO: 21108 - DNA, 25 bp, Mus musculus
aaatctagctcataagtaggcccag

SEQ ID NO: 21109 - DNA, 25 bp, Mus musculus
aaatctagctgtctagctgtgcctt

SEQ ID NO: 21110 - DNA, 25 bp, Mus musculus
aaatctagctgtgtagctgtgcctt

SEQ ID NO: 21111 - DNA, 25 bp, Mus musculus
aaatctaggcatcttttgtataatg

SEQ ID NO: 21112 - DNA, 25 bp, Mus musculus
aaatctaggcatgttttgtataatg

SEQ ID NO: 21113 - DNA, 25 bp, Mus musculus
aaatctagggcaatcaggatgtctt

SEQ ID NO: 21114 - DNA, 25 bp, Mus musculus
aaatctagggcattcaggatgtctt

SEQ ID NO: 21115 - DNA, 25 bp, Mus musculus
aaatctagtcttatgcttcttgctg

SEQ ID NO: 21116 - DNA, 25 bp, Mus musculus
aaatctagtcttttgcttcttgctg

SEQ ID NO: 21117 - DNA, 25 bp, Mus musculus
aaatctagtgggatgacgctgccct

SEQ ID NO: 21118 - DNA, 25 bp, Mus musculus
aaatctagtgggttgacgctgccct

SEQ ID NO: 21119 - DNA, 25 bp, Mus musculus
aaatctatcagtctacaagtgtatt

SEQ ID NO: 21120 - DNA, 25 bp, Mus musculus
aaatctatcagtgtacaagtgtatt

SEQ ID NO: 21121 - DNA, 25 bp, Mus musculus
aaatctatcctgcaccagtccattt

SEQ ID NO: 21122 - DNA, 25 bp, Mus musculus
aaatctatcctggaccagtccattt

SEQ ID NO: 21123 - DNA, 25 bp, Mus musculus
aaatctatcgaaccctcttttaacg

SEQ ID NO: 21124 - DNA, 25 bp, Mus musculus
aaatctatcgaagcctcttttaacg

SEQ ID NO: 21125 - DNA, 25 bp, Mus musculus
aaatctatgaagatcgatctcagct

SEQ ID NO: 21126 - DNA, 25 bp, Mus musculus
aaatctatgaagttcgatctcagct

SEQ ID NO: 21127 - DNA, 25 bp, Mus musculus
aaatctatgacactgggctcactgc

SEQ ID NO: 21128 - DNA, 25 bp, Mus musculus
aaatctatgacagtgggctcactgc

SEQ ID NO: 21129 - DNA, 25 bp, Mus musculus
aaatctatggctaagtacagacccc

SEQ ID NO: 21130 - DNA, 25 bp, Mus musculus
aaatctatggcttagtacagacccc

SEQ ID NO: 21131 - DNA, 25 bp, Mus musculus
aaatctatggtcaggcttactagca

SEQ ID NO: 21132 - DNA, 25 bp, Mus musculus
aaatctatggtctggcttactagca

SEQ ID NO: 21133 - DNA, 25 bp, Mus musculus
aaatctatgtgtactgtggcttcga

SEQ ID NO: 21134 - DNA, 25 bp, Mus musculus
aaatctatgtgttctgtggcttcga

SEQ ID NO: 21135 - DNA, 25 bp, Mus musculus
aaatctattaggctcacagtgaaaa

SEQ ID NO: 21136 - DNA, 25 bp, Mus musculus
aaatctattagggtcacagtgaaaa

SEQ ID NO: 21137 - DNA, 25 bp, Mus musculus
aaatctattctaatgtggcttttta

SEQ ID NO: 21138 - DNA, 25 bp, Mus musculus
aaatctattctattgtggcttttta

SEQ ID NO: 21139 - DNA, 25 bp, Mus musculus
aaatctattgtcaagggctctctta

SEQ ID NO: 21140 - DNA, 25 bp, Mus musculus
aaatctattgtctagggctctctta

SEQ ID NO: 21141 - DNA, 25 bp, Mus musculus
aaatctcaacccaagctctctgaac

SEQ ID NO: 21142 - DNA, 25 bp, Mus musculus
aaatctcaaccctagctctctgaac

SEQ ID NO: 21143 - DNA, 25 bp, Mus musculus
aaatctcaaggtcctcttttcattt

SEQ ID NO: 21144 - DNA, 25 bp, Mus musculus
aaatctcaaggtgctcttttcattt

SEQ ID NO: 21145 - DNA, 25 bp, Mus musculus
aaatctcaccttagatcagatgatc

SEQ ID NO: 21146 - DNA, 25 bp, Mus musculus
aaatctcacctttgatcagatgatc

SEQ ID NO: 21147 - DNA, 25 bp, Mus musculus
aaatctcacgctatgtaactcttgc

SEQ ID NO: 21148 - DNA, 25 bp, Mus musculus
aaatctcacgctttgtaactcttgc

SEQ ID NO: 21149 - DNA, 25 bp, Mus musculus
aaatctcagactccatattcggcat

SEQ ID NO: 21150 - DNA, 25 bp, Mus musculus
aaatctcagactgcatattcggcat

SEQ ID NO: 21151 - DNA, 25 bp, Mus musculus
aaatctcagatcatgcactcacagt

SEQ ID NO: 21152 - DNA, 25 bp, Mus musculus
aaatctcagatcttgcactcacagt

SEQ ID NO: 21153 - DNA, 25 bp, Mus musculus
aaatctcagccgacactaaggtgaa

SEQ ID NO: 21154 - DNA, 25 bp, Mus musculus
aaatctcagccgtcactaaggtgaa

SEQ ID NO: 21155 - DNA, 25 bp, Mus musculus
aaatctcagcttccattagacttga

SEQ ID NO: 21156 - DNA, 25 bp, Mus musculus
aaatctcagcttgcattagacttga

SEQ ID NO: 21157 - DNA, 25 bp, Mus musculus
aaatctcaggctatggcaacatccc

SEQ ID NO: 21158 - DNA, 25 bp, Mus musculus
aaatctcaggctttggcaacatccc

SEQ ID NO: 21159 - DNA, 25 bp, Mus musculus
aaatctcagggtaccattccagagg

SEQ ID NO: 21160 - DNA, 25 bp, Mus musculus
aaatctcagggttccattccagagg

SEQ ID NO: 21161 - DNA, 25 bp, Mus musculus
aaatctcaggtcatccgagccttag

SEQ ID NO: 21162 - DNA, 25 bp, Mus musculus
aaatctcaggtcttccgagccttag

SEQ ID NO: 21163 - DNA, 25 bp, Mus musculus
aaatctcagtacatccaacacagca

SEQ ID NO: 21164 - DNA, 25 bp, Mus musculus
aaatctcagtacttccaacacagca

SEQ ID NO: 21165 - DNA, 25 bp, Mus musculus
aaatctcagttgagtgcctgggcac

SEQ ID NO: 21166 - DNA, 25 bp, Mus musculus
aaatctcagttgtgtgcctgggcac

SEQ ID NO: 21167 - DNA, 25 bp, Mus musculus
aaatctcagtttacctcggatgttt

SEQ ID NO: 21168 - DNA, 25 bp, Mus musculus
aaatctcagttttcctcggatgttt

SEQ ID NO: 21169 - DNA, 25 bp, Mus musculus
aaatctcataatagtactacacaga

SEQ ID NO: 21170 - DNA, 25 bp, Mus musculus
aaatctcataattgtactacacaga

SEQ ID NO: 21171 - DNA, 25 bp, Mus musculus
aaatctcatccacgcgtatctgtta

SEQ ID NO: 21172 - DNA, 25 bp, Mus musculus
aaatctcatccaggcgtatctgtta

SEQ ID NO: 21173 - DNA, 25 bp, Mus musculus
aaatctcatcttatcatgttatcac

SEQ ID NO: 21174 - DNA, 25 bp, Mus musculus
aaatctcatcttttcatgttatcac

SEQ ID NO: 21175 - DNA, 25 bp, Mus musculus
aaatctcatgaactgaaagcaaggt

SEQ ID NO: 21176 - DNA, 25 bp, Mus musculus
aaatctcatgaagtgaaagcaaggt

SEQ ID NO: 21177 - DNA, 25 bp, Mus musculus
aaatctcatgatagtgcccgagaac

SEQ ID NO: 21178 - DNA, 25 bp, Mus musculus
aaatctcatgattgtgcccgagaac

SEQ ID NO: 21179 - DNA, 25 bp, Mus musculus
aaatctcatgcacgtgaaagctcac

SEQ ID NO: 21180 - DNA, 25 bp, Mus musculus
aaatctcatgcaggtgaaagctcac

SEQ ID NO: 21181 - DNA, 25 bp, Mus musculus
aaatctcatggcatttgttgcagcc

SEQ ID NO: 21182 - DNA, 25 bp, Mus musculus
aaatctcatggcttttgttgcagcc

SEQ ID NO: 21183 - DNA, 25 bp, Mus musculus
aaatctcattccagtctgtgttcag

SEQ ID NO: 21184 - DNA, 25 bp, Mus musculus
aaatctcattcctgtctgtgttcag

SEQ ID NO: 21185 - DNA, 25 bp, Mus musculus
aaatctcattctactacccacctgg

SEQ ID NO: 21186 - DNA, 25 bp, Mus musculus
aaatctcattcttctacccacctgg

SEQ ID NO: 21187 - DNA, 25 bp, Mus musculus
aaatctcatttcagtagcctacccc

SEQ ID NO: 21188 - DNA, 25 bp, Mus musculus
aaatctcatttctgtagcctacccc

SEQ ID NO: 21189 - DNA, 25 bp, Mus musculus
aaatctccacatcaaataccactct

SEQ ID NO: 21190 - DNA, 25 bp, Mus musculus
aaatctccacatgaaataccactct

SEQ ID NO: 21191 - DNA, 25 bp, Mus musculus
aaatctccacttcaaccctgatgaa

SEQ ID NO: 21192 - DNA, 25 bp, Mus musculus
aaatctccacttgaaccctgatgaa

SEQ ID NO: 21193 - DNA, 25 bp, Mus musculus
aaatctccagctcgtttcttactca

SEQ ID NO: 21194 - DNA, 25 bp, Mus musculus
aaatctccagctggtttcttactca

SEQ ID NO: 21195 - DNA, 25 bp, Mus musculus
aaatctccaggaattgtatcccacc

SEQ ID NO: 21196 - DNA, 25 bp, Mus musculus
aaatctccaggatttgtatcccacc

SEQ ID NO: 21197 - DNA, 25 bp, Mus musculus
aaatctccagtcagcttgcacagga

SEQ ID NO: 21198 - DNA, 25 bp, Mus musculus
aaatctccagtctgcttgcacagga

SEQ ID NO: 21199 - DNA, 25 bp, Mus musculus
aaatctccatgaatgtggtaggctt

SEQ ID NO: 21200 - DNA, 25 bp, Mus musculus
aaatctccatgattgtggtaggctt

SEQ ID NO: 21201 - DNA, 25 bp, Mus musculus
aaatctcccagacttctcagtggtg

SEQ ID NO: 21202 - DNA, 25 bp, Mus musculus
aaatctcccagagttctcagtggtg

SEQ ID NO: 21203 - DNA, 25 bp, Mus musculus
aaatctccccatcaggtttctgttt

SEQ ID NO: 21204 - DNA, 25 bp, Mus musculus
aaatctccccatccctgtacattaa

SEQ ID NO: 21205 - DNA, 25 bp, Mus musculus
aaatctccccatgaggtttctgttt

SEQ ID NO: 21206 - DNA, 25 bp, Mus musculus
aaatctccccatgcctgtacattaa

SEQ ID NO: 21207 - DNA, 25 bp, Mus musculus
aaatctccctcaatcacatttggta

SEQ ID NO: 21208 - DNA, 25 bp, Mus musculus
aaatctccctcattcacatttggta

SEQ ID NO: 21209 - DNA, 25 bp, Mus musculus
aaatctcctagtccttgcgttttca

SEQ ID NO: 21210 - DNA, 25 bp, Mus musculus
aaatctcctagtgcttgcgttttca

SEQ ID NO: 21211 - DNA, 25 bp, Mus musculus
aaatctcctctccatgatctttctt

SEQ ID NO: 21212 - DNA, 25 bp, Mus musculus
aaatctcctctcgatgatctttctt

SEQ ID NO: 21213 - DNA, 25 bp, Mus musculus
aaatctccttatacttgctttggtt

SEQ ID NO: 21214 - DNA, 25 bp, Mus musculus
aaatctccttattcttgctttggtt

SEQ ID NO: 21215 - DNA, 25 bp, Mus musculus
aaatctccttccattagatcaaaag

SEQ ID NO: 21216 - DNA, 25 bp, Mus musculus
aaatctccttcctttagatcaaaag

SEQ ID NO: 21217 - DNA, 25 bp, Mus musculus
aaatctcctttcaaaagctgaacag

SEQ ID NO: 21218 - DNA, 25 bp, Mus musculus
aaatctcctttctaaagctgaacag

SEQ ID NO: 21219 - DNA, 25 bp, Mus musculus
aaatctcctttgaagactaatgtaa

SEQ ID NO: 21220 - DNA, 25 bp, Mus musculus
aaatctcctttgtagactaatgtaa

SEQ ID NO: 21221 - DNA, 25 bp, Mus musculus
aaatctcgggatcccaagctagttt

SEQ ID NO: 21222 - DNA, 25 bp, Mus musculus
aaatctcgggatgccaagctagttt

SEQ ID NO: 21223 - DNA, 25 bp, Mus musculus
aaatctcggtggagtgggtcccatc

SEQ ID NO: 21224 - DNA, 25 bp, Mus musculus
aaatctcggtggtgtgggtcccatc

SEQ ID NO: 21225 - DNA, 25 bp, Mus musculus
aaatctctaacacagatcattggag

SEQ ID NO: 21226 - DNA, 25 bp, Mus musculus
aaatctctaacagagatcattggag

SEQ ID NO: 21227 - DNA, 25 bp, Mus musculus
aaatctctactgcacttgagcatga

SEQ ID NO: 21228 - DNA, 25 bp, Mus musculus
aaatctctactggacttgagcatga

SEQ ID NO: 21229 - DNA, 25 bp, Mus musculus
aaatctctcattcctcttggtttcc

SEQ ID NO: 21230 - DNA, 25 bp, Mus musculus
aaatctctcattgctcttggtttcc

SEQ ID NO: 21231 - DNA, 25 bp, Mus musculus
aaatctctccaaaaccagtgtgtgg

SEQ ID NO: 21232 - DNA, 25 bp, Mus musculus
aaatctctccaacacatctcctgtg

SEQ ID NO: 21233 - DNA, 25 bp, Mus musculus
aaatctctccaagacatctcctgtg

SEQ ID NO: 21234 - DNA, 25 bp, Mus musculus
aaatctctccaataccagtgtgtgg

SEQ ID NO: 21235 - DNA, 25 bp, Mus musculus
aaatctctctatactgtagtggcag

SEQ ID NO: 21236 - DNA, 25 bp, Mus musculus
aaatctctctattctgtagtggcag

SEQ ID NO: 21237 - DNA, 25 bp, Mus musculus
aaatctctctctcctagcaaactgc

SEQ ID NO: 21238 - DNA, 25 bp, Mus musculus
aaatctctctctgctagcaaactgc

SEQ ID NO: 21239 - DNA, 25 bp, Mus musculus
aaatctctctgacagtttctttttt

SEQ ID NO: 21240 - DNA, 25 bp, Mus musculus
aaatctctctgagagtttctttttt

SEQ ID NO: 21241 - DNA, 25 bp, Mus musculus
aaatctctctggcatttgcaacaga

SEQ ID NO: 21242 - DNA, 25 bp, Mus musculus
aaatctctctgggatttgcaacaga

SEQ ID NO: 21243 - DNA, 25 bp, Mus musculus
aaatctctctttccttatgattcat

SEQ ID NO: 21244 - DNA, 25 bp, Mus musculus
aaatctctctttgcttatgattcat

SEQ ID NO: 21245 - DNA, 25 bp, Mus musculus
aaatctctgaatactctcttacatt

SEQ ID NO: 21246 - DNA, 25 bp, Mus musculus
aaatctctgaattctctcttacatt

SEQ ID NO: 21247 - DNA, 25 bp, Mus musculus
aaatctctgaggaatccgacgtgca

SEQ ID NO: 21248 - DNA, 25 bp, Mus musculus
aaatctctgaggtatccgacgtgca

SEQ ID NO: 21249 - DNA, 25 bp, Mus musculus
aaatctctgataatggcatcacttg

SEQ ID NO: 21250 - DNA, 25 bp, Mus musculus
aaatctctgatattggcatcacttg

SEQ ID NO: 21251 - DNA, 25 bp, Mus musculus
aaatctctgcagacttaaaggatac

SEQ ID NO: 21252 - DNA, 25 bp, Mus musculus
aaatctctgcagtcttaaaggatac

SEQ ID NO: 21253 - DNA, 25 bp, Mus musculus
aaatctctgccccaaaatgtggact

SEQ ID NO: 21254 - DNA, 25 bp, Mus musculus
aaatctctgcccgaaaatgtggact

SEQ ID NO: 21255 - DNA, 25 bp, Mus musculus
aaatctctgctaacagggaccttac

SEQ ID NO: 21256 - DNA, 25 bp, Mus musculus
aaatctctgctatcagggaccttac

SEQ ID NO: 21257 - DNA, 25 bp, Mus musculus
aaatctctgggaagcagtgatttga

SEQ ID NO: 21258 - DNA, 25 bp, Mus musculus
aaatctctgggatgcagtgatttga

SEQ ID NO: 21259 - DNA, 25 bp, Mus musculus
aaatctctgggcataggcaatgtga

SEQ ID NO: 21260 - DNA, 25 bp, Mus musculus
aaatctctgggcttaggcaatgtga

SEQ ID NO: 21261 - DNA, 25 bp, Mus musculus
aaatctctgtacagttttgtcacgt

SEQ ID NO: 21262 - DNA, 25 bp, Mus musculus
aaatctctgtactgttttgtcacgt

SEQ ID NO: 21263 - DNA, 25 bp, Mus musculus
aaatctctgtgcctctgtcgctgag

SEQ ID NO: 21264 - DNA, 25 bp, Mus musculus
aaatctctgtgcgtctgtcgctgag

SEQ ID NO: 21265 - DNA, 25 bp, Mus musculus
aaatctctgtttactggtcattata

SEQ ID NO: 21266 - DNA, 25 bp, Mus musculus
aaatctctgttttctggtcattata

SEQ ID NO: 21267 - DNA, 25 bp, Mus musculus
aaatctcttaacatgacagtggaca

SEQ ID NO: 21268 - DNA, 25 bp, Mus musculus
aaatctcttaacttgacagtggaca

SEQ ID NO: 21269 - DNA, 25 bp, Mus musculus
aaatctcttcacataggccaaatcc

SEQ ID NO: 21270 - DNA, 25 bp, Mus musculus
aaatctcttcacttaggccaaatcc

SEQ ID NO: 21271 - DNA, 25 bp, Mus musculus
aaatctcttcatctgccacacgctg

SEQ ID NO: 21272 - DNA, 25 bp, Mus musculus
aaatctcttcatgtgccacacgctg

SEQ ID NO: 21273 - DNA, 25 bp, Mus musculus
aaatctcttctgaggagggaacact

SEQ ID NO: 21274 - DNA, 25 bp, Mus musculus
aaatctcttctgattcttgcataga

SEQ ID NO: 21275 - DNA, 25 bp, Mus musculus
aaatctcttctgtggagggaacact

SEQ ID NO: 21276 - DNA, 25 bp, Mus musculus
aaatctcttctgtttcttgcataga

SEQ ID NO: 21277 - DNA, 25 bp, Mus musculus
aaatctcttcttcgtttctgttcgt

SEQ ID NO: 21278 - DNA, 25 bp, Mus musculus
aaatctcttcttggtttctgttcgt

SEQ ID NO: 21279 - DNA, 25 bp, Mus musculus
aaatctctttatatacctcaggccc

SEQ ID NO: 21280 - DNA, 25 bp, Mus musculus
aaatctctttatttacctcaggccc

SEQ ID NO: 21281 - DNA, 25 bp, Mus musculus
aaatctgaaacgatgttcactccgt

SEQ ID NO: 21282 - DNA, 25 bp, Mus musculus
aaatctgaaacgttgttcactccgt

SEQ ID NO: 21283 - DNA, 25 bp, Mus musculus
aaatctgaacgaattcttggatggc

SEQ ID NO: 21284 - DNA, 25 bp, Mus musculus
aaatctgaacgatttcttggatggc

SEQ ID NO: 21285 - DNA, 25 bp, Mus musculus
aaatctgaagcaatgctgttctggg

SEQ ID NO: 21286 - DNA, 25 bp, Mus musculus
aaatctgaagcattgctgttctggg

SEQ ID NO: 21287 - DNA, 25 bp, Mus musculus
aaatctgaagcccacagtgattctt

SEQ ID NO: 21288 - DNA, 25 bp, Mus musculus
aaatctgaagccgacagtgattctt

SEQ ID NO: 21289 - DNA, 25 bp, Mus musculus
aaatctgaatctagtcctgagcggg

SEQ ID NO: 21290 - DNA, 25 bp, Mus musculus
aaatctgaatctctgtctacctact

SEQ ID NO: 21291 - DNA, 25 bp, Mus musculus
aaatctgaatctgtgtctacctact

SEQ ID NO: 21292 - DNA, 25 bp, Mus musculus
aaatctgaatcttgtcctgagcggg

SEQ ID NO: 21293 - DNA, 25 bp, Mus musculus
aaatctgacaaaaagcctttgcgag

SEQ ID NO: 21294 - DNA, 25 bp, Mus musculus
aaatctgacaaatagcctttgcgag

SEQ ID NO: 21295 - DNA, 25 bp, Mus musculus
aaatctgacagtattaggacggtgg

SEQ ID NO: 21296 - DNA, 25 bp, Mus musculus
aaatctgacagttttaggacggtgg

SEQ ID NO: 21297 - DNA, 25 bp, Mus musculus
aaatctgacctaacctcttttctgt

SEQ ID NO: 21298 - DNA, 25 bp, Mus musculus
aaatctgacctatcctcttttctgt

SEQ ID NO: 21299 - DNA, 25 bp, Mus musculus
aaatctgactgtaattttgggctca

SEQ ID NO: 21300 - DNA, 25 bp, Mus musculus
aaatctgactgttattttgggctca

SEQ ID NO: 21301 - DNA, 25 bp, Mus musculus
aaatctgactttcctcagggagccc

SEQ ID NO: 21302 - DNA, 25 bp, Mus musculus
aaatctgactttgctcagggagccc

SEQ ID NO: 21303 - DNA, 25 bp, Mus musculus
aaatctgagatccactgtgtcctct

SEQ ID NO: 21304 - DNA, 25 bp, Mus musculus
aaatctgagatcgactgtgtcctct

SEQ ID NO: 21305 - DNA, 25 bp, Mus musculus
aaatctgagcagaccatccttagta

SEQ ID NO: 21306 - DNA, 25 bp, Mus musculus
aaatctgagcagtccatccttagta

SEQ ID NO: 21307 - DNA, 25 bp, Mus musculus
aaatctgagcatccagttctaccat

SEQ ID NO: 21308 - DNA, 25 bp, Mus musculus
aaatctgagcatcctggcgtgcgtc

SEQ ID NO: 21309 - DNA, 25 bp, Mus musculus
aaatctgagcatgcagttctaccat

SEQ ID NO: 21310 - DNA, 25 bp, Mus musculus
aaatctgagcatgctggcgtgcgtc

SEQ ID NO: 21311 - DNA, 25 bp, Mus musculus
aaatctgagctgaactacttactat

SEQ ID NO: 21312 - DNA, 25 bp, Mus musculus
aaatctgagctgtactacttactat

SEQ ID NO: 21313 - DNA, 25 bp, Mus musculus
aaatctgaggacatccgtggctacc

SEQ ID NO: 21314 - DNA, 25 bp, Mus musculus
aaatctgaggacttccgtggctacc

SEQ ID NO: 21315 - DNA, 25 bp, Mus musculus
aaatctgagtcaatggccccaaagg

SEQ ID NO: 21316 - DNA, 25 bp, Mus musculus
aaatctgagtcattggccccaaagg

SEQ ID NO: 21317 - DNA, 25 bp, Mus musculus
aaatctgataaactacattctcaag

SEQ ID NO: 21318 - DNA, 25 bp, Mus musculus
aaatctgataaagtacattctcaag

SEQ ID NO: 21319 - DNA, 25 bp, Mus musculus
aaatctgatcttccagttagccatc

SEQ ID NO: 21320 - DNA, 25 bp, Mus musculus
aaatctgatcttgcagttagccatc

SEQ ID NO: 21321 - DNA, 25 bp, Mus musculus
aaatctgatgatcgcccttttttgt

SEQ ID NO: 21322 - DNA, 25 bp, Mus musculus
aaatctgatgatggcccttttttgt

SEQ ID NO: 21323 - DNA, 25 bp, Mus musculus
aaatctgattccacaattgcagtta

SEQ ID NO: 21324 - DNA, 25 bp, Mus musculus
aaatctgattcctcaattgcagtta

SEQ ID NO: 21325 - DNA, 25 bp, Mus musculus
aaatctgcaaaactctgctgcacct

SEQ ID NO: 21326 - DNA, 25 bp, Mus musculus
aaatctgcaaaagtctgctgcacct

SEQ ID NO: 21327 - DNA, 25 bp, Mus musculus
aaatctgcagagctacctctaccca

SEQ ID NO: 21328 - DNA, 25 bp, Mus musculus
aaatctgcagaggtacctctaccca

SEQ ID NO: 21329 - DNA, 25 bp, Mus musculus
aaatctgcagctcacaagaacaccc

SEQ ID NO: 21330 - DNA, 25 bp, Mus musculus
aaatctgcagctgacaagaacaccc

SEQ ID NO: 21331 - DNA, 25 bp, Mus musculus
aaatctgcagtcaacagcacttgag

SEQ ID NO: 21332 - DNA, 25 bp, Mus musculus
aaatctgcagtctacagcacttgag

SEQ ID NO: 21333 - DNA, 25 bp, Mus musculus
aaatctgcagttaggttgctttgta

SEQ ID NO: 21334 - DNA, 25 bp, Mus musculus
aaatctgcagtttggttgctttgta

SEQ ID NO: 21335 - DNA, 25 bp, Mus musculus
aaatctgcatccacagtatgggagt

SEQ ID NO: 21336 - DNA, 25 bp, Mus musculus
aaatctgcatcctcagtatgggagt

SEQ ID NO: 21337 - DNA, 25 bp, Mus musculus
aaatctgcatgtcctcactgtaatt

SEQ ID NO: 21338 - DNA, 25 bp, Mus musculus
aaatctgcatgtgctcactgtaatt

SEQ ID NO: 21339 - DNA, 25 bp, Mus musculus
aaatctgcattcagacctctgacag

SEQ ID NO: 21340 - DNA, 25 bp, Mus musculus
aaatctgcattctgacctctgacag

SEQ ID NO: 21341 - DNA, 25 bp, Mus musculus
aaatctgccatcagaaagctcacct

SEQ ID NO: 21342 - DNA, 25 bp, Mus musculus
aaatctgccatctgaaagctcacct

SEQ ID NO: 21343 - DNA, 25 bp, Mus musculus
aaatctgccatgagtgattccagca

SEQ ID NO: 21344 - DNA, 25 bp, Mus musculus
aaatctgccatgtgtgattccagca

SEQ ID NO: 21345 - DNA, 25 bp, Mus musculus
aaatctgcccagagacaggtgacga

SEQ ID NO: 21346 - DNA, 25 bp, Mus musculus
aaatctgcccagtgacaggtgacga

SEQ ID NO: 21347 - DNA, 25 bp, Mus musculus
aaatctgcccataaactaacttagc

SEQ ID NO: 21348 - DNA, 25 bp, Mus musculus
aaatctgcccattaactaacttagc

SEQ ID NO: 21349 - DNA, 25 bp, Mus musculus
aaatctgccctgctatctcctgttt

SEQ ID NO: 21350 - DNA, 25 bp, Mus musculus
aaatctgccctggtatctcctgttt

SEQ ID NO: 21351 - DNA, 25 bp, Mus musculus
aaatctgcctgactgaccttgaaaa

SEQ ID NO: 21352 - DNA, 25 bp, Mus musculus
aaatctgcctgagtgaccttgaaaa

SEQ ID NO: 21353 - DNA, 25 bp, Mus musculus
aaatctgccttcaagtatttttgca

SEQ ID NO: 21354 - DNA, 25 bp, Mus musculus
aaatctgccttctagtatttttgca

SEQ ID NO: 21355 - DNA, 25 bp, Mus musculus
aaatctgcgagactttgagctgaca

SEQ ID NO: 21356 - DNA, 25 bp, Mus musculus
aaatctgcgagagtttgagctgaca

SEQ ID NO: 21357 - DNA, 25 bp, Mus musculus
aaatctgcgcctaggacgataacgt

SEQ ID NO: 21358 - DNA, 25 bp, Mus musculus
aaatctgcgccttggacgataacgt

SEQ ID NO: 21359 - DNA, 25 bp, Mus musculus
aaatctgcggaaatccgagcgctgt

SEQ ID NO: 21360 - DNA, 25 bp, Mus musculus
aaatctgcggaattccgagcgctgt

SEQ ID NO: 21361 - DNA, 25 bp, Mus musculus
aaatctgcgtacatcctcttcaaag

SEQ ID NO: 21362 - DNA, 25 bp, Mus musculus
aaatctgcgtacttcctcttcaaag

SEQ ID NO: 21363 - DNA, 25 bp, Mus musculus
aaatctgcgtctaacttttgaaagt

SEQ ID NO: 21364 - DNA, 25 bp, Mus musculus
aaatctgcgtcttacttttgaaagt

SEQ ID NO: 21365 - DNA, 25 bp, Mus musculus
aaatctgctcagagtgcctctggtt

SEQ ID NO: 21366 - DNA, 25 bp, Mus musculus
aaatctgctcagtgtgcctctggtt

SEQ ID NO: 21367 - DNA, 25 bp, Mus musculus
aaatctgctctcactagggtttgat

SEQ ID NO: 21368 - DNA, 25 bp, Mus musculus
aaatctgctctctctagggtttgat

SEQ ID NO: 21369 - DNA, 25 bp, Mus musculus
aaatctgctgaaacaggcactggag

SEQ ID NO: 21370 - DNA, 25 bp, Mus musculus
aaatctgctgaatcaggcactggag

SEQ ID NO: 21371 - DNA, 25 bp, Mus musculus
aaatctgctgttctcattctcccat

SEQ ID NO: 21372 - DNA, 25 bp, Mus musculus
aaatctgctgttgtcattctcccat

SEQ ID NO: 21373 - DNA, 25 bp, Mus musculus
aaatctgcttgcagtactactcaag

SEQ ID NO: 21374 - DNA, 25 bp, Mus musculus
aaatctgcttgcagtctctactgtg

SEQ ID NO: 21375 - DNA, 25 bp, Mus musculus
aaatctgcttgcattttgctaactg

SEQ ID NO: 21376 - DNA, 25 bp, Mus musculus
aaatctgcttgctgtactactcaag

SEQ ID NO: 21377 - DNA, 25 bp, Mus musculus
aaatctgcttgctgtctctactgtg

SEQ ID NO: 21378 - DNA, 25 bp, Mus musculus
aaatctgcttgctttttgctaactg

SEQ ID NO: 21379 - DNA, 25 bp, Mus musculus
aaatctggaactcgtgctcacgggc

SEQ ID NO: 21380 - DNA, 25 bp, Mus musculus
aaatctggaactggtgctcacgggc

SEQ ID NO: 21381 - DNA, 25 bp, Mus musculus
aaatctggactgcagctgtggctga

SEQ ID NO: 21382 - DNA, 25 bp, Mus musculus
aaatctggactggagctgtggctga

SEQ ID NO: 21383 - DNA, 25 bp, Mus musculus
aaatctggagacaaaggacttgcac

SEQ ID NO: 21384 - DNA, 25 bp, Mus musculus
aaatctggagactaaggacttgcac

SEQ ID NO: 21385 - DNA, 25 bp, Mus musculus
aaatctggagcaatcatgctatggg

SEQ ID NO: 21386 - DNA, 25 bp, Mus musculus
aaatctggagcattcatgctatggg

SEQ ID NO: 21387 - DNA, 25 bp, Mus musculus
aaatctggaggtcttgagtcacccc

SEQ ID NO: 21388 - DNA, 25 bp, Mus musculus
aaatctggaggtgttgagtcacccc

SEQ ID NO: 21389 - DNA, 25 bp, Mus musculus
aaatctggatcacgtctatgaccgg

SEQ ID NO: 21390 - DNA, 25 bp, Mus musculus
aaatctggatcaggtctatgaccgg

SEQ ID NO: 21391 - DNA, 25 bp, Mus musculus
aaatctggccaaccgagtgccaaac

SEQ ID NO: 21392 - DNA, 25 bp, Mus musculus
aaatctggccaagcgagtgccaaac

SEQ ID NO: 21393 - DNA, 25 bp, Mus musculus
aaatctggccatatattttccaaga

SEQ ID NO: 21394 - DNA, 25 bp, Mus musculus
aaatctggccatttattttccaaga

SEQ ID NO: 21395 - DNA, 25 bp, Mus musculus
aaatctggcctgctttcaccctttt

SEQ ID NO: 21396 - DNA, 25 bp, Mus musculus
aaatctggcctggtttcaccctttt

SEQ ID NO: 21397 - DNA, 25 bp, Mus musculus
aaatctggccttaacctactggcag

SEQ ID NO: 21398 - DNA, 25 bp, Mus musculus
aaatctggcctttacctactggcag

SEQ ID NO: 21399 - DNA, 25 bp, Mus musculus
aaatctggctctctacagtaaacgt

SEQ ID NO: 21400 - DNA, 25 bp, Mus musculus
aaatctggctctctgtctagatgtc

SEQ ID NO: 21401 - DNA, 25 bp, Mus musculus
aaatctggctctgtacagtaaacgt

SEQ ID NO: 21402 - DNA, 25 bp, Mus musculus
aaatctggctctgtgtctagatgtc

SEQ ID NO: 21403 - DNA, 25 bp, Mus musculus
aaatctggctgaacccaaggtcaca

SEQ ID NO: 21404 - DNA, 25 bp, Mus musculus
aaatctggctgatcccaaggtcaca

SEQ ID NO: 21405 - DNA, 25 bp, Mus musculus
aaatctggctggctgacttttctgc

SEQ ID NO: 21406 - DNA, 25 bp, Mus musculus
aaatctggctgggtgacttttctgc

SEQ ID NO: 21407 - DNA, 25 bp, Mus musculus
aaatctggctgtccaaaccgctaca

SEQ ID NO: 21408 - DNA, 25 bp, Mus musculus
aaatctggctgtgcaaaccgctaca

SEQ ID NO: 21409 - DNA, 25 bp, Mus musculus
aaatctgggacacttggcaggctga

SEQ ID NO: 21410 - DNA, 25 bp, Mus musculus
aaatctgggacagttggcaggctga

SEQ ID NO: 21411 - DNA, 25 bp, Mus musculus
aaatctgggcatatggaagcttaca

SEQ ID NO: 21412 - DNA, 25 bp, Mus musculus
aaatctgggcatttggaagcttaca

SEQ ID NO: 21413 - DNA, 25 bp, Mus musculus
aaatctgggtacatctttgggtgaa

SEQ ID NO: 21414 - DNA, 25 bp, Mus musculus
aaatctgggtacttctttgggtgaa

SEQ ID NO: 21415 - DNA, 25 bp, Mus musculus
aaatctggtaatagagggaagctct

SEQ ID NO: 21416 - DNA, 25 bp, Mus musculus
aaatctggtaattgagggaagctct

SEQ ID NO: 21417 - DNA, 25 bp, Mus musculus
aaatctggtaccagaaggtctaggc

SEQ ID NO: 21418 - DNA, 25 bp, Mus musculus
aaatctggtacctgaaggtctaggc

SEQ ID NO: 21419 - DNA, 25 bp, Mus musculus
aaatctggtcccaatgaggaaatga

SEQ ID NO: 21420 - DNA, 25 bp, Mus musculus
aaatctggtccctatgaggaaatga

SEQ ID NO: 21421 - DNA, 25 bp, Mus musculus
aaatctggtctgctacgtagaatct

SEQ ID NO: 21422 - DNA, 25 bp, Mus musculus
aaatctggtctggtacgtagaatct

SEQ ID NO: 21423 - DNA, 25 bp, Mus musculus
aaatctggtcttatcatcggcgttc

SEQ ID NO: 21424 - DNA, 25 bp, Mus musculus
aaatctggtcttatctaatctgcaa

SEQ ID NO: 21425 - DNA, 25 bp, Mus musculus
aaatctggtcttatttctgactccc

SEQ ID NO: 21426 - DNA, 25 bp, Mus musculus
aaatctggtcttttcatcggcgttc

SEQ ID NO: 21427 - DNA, 25 bp, Mus musculus
aaatctggtcttttctaatctgcaa

SEQ ID NO: 21428 - DNA, 25 bp, Mus musculus
aaatctggtcttttttctgactccc

SEQ ID NO: 21429 - DNA, 25 bp, Mus musculus
aaatctggtggcaaggccaagaaga

SEQ ID NO: 21430 - DNA, 25 bp, Mus musculus
aaatctggtggctaggccaagaaga

SEQ ID NO: 21431 - DNA, 25 bp, Mus musculus
aaatctggtgttcctcatattccca

SEQ ID NO: 21432 - DNA, 25 bp, Mus musculus
aaatctggtgttgctcatattccca

SEQ ID NO: 21433 - DNA, 25 bp, Mus musculus
aaatctggtttgattattaatagct

SEQ ID NO: 21434 - DNA, 25 bp, Mus musculus
aaatctggtttgtttattaatagct

SEQ ID NO: 21435 - DNA, 25 bp, Mus musculus
aaatctgtaactcagtgctgactgg

SEQ ID NO: 21436 - DNA, 25 bp, Mus musculus
aaatctgtaactgagtgctgactgg

SEQ ID NO: 21437 - DNA, 25 bp, Mus musculus
aaatctgtaatcactctcaggaggt

SEQ ID NO: 21438 - DNA, 25 bp, Mus musculus
aaatctgtaatctctctcaggaggt

SEQ ID NO: 21439 - DNA, 25 bp, Mus musculus
aaatctgtaatgatcactctcacta

SEQ ID NO: 21440 - DNA, 25 bp, Mus musculus
aaatctgtaatgttcactctcacta

SEQ ID NO: 21441 - DNA, 25 bp, Mus musculus
aaatctgtacgacataccccagcca

SEQ ID NO: 21442 - DNA, 25 bp, Mus musculus
aaatctgtacgagataccccagcca

SEQ ID NO: 21443 - DNA, 25 bp, Mus musculus
aaatctgtacgtagatctcctaacc

SEQ ID NO: 21444 - DNA, 25 bp, Mus musculus
aaatctgtacgttgatctcctaacc

SEQ ID NO: 21445 - DNA, 25 bp, Mus musculus
aaatctgtactgacttactgtgtga

SEQ ID NO: 21446 - DNA, 25 bp, Mus musculus
aaatctgtactgtcttactgtgtga

SEQ ID NO: 21447 - DNA, 25 bp, Mus musculus
aaatctgtaggaagccgccactgag

SEQ ID NO: 21448 - DNA, 25 bp, Mus musculus
aaatctgtaggatgccgccactgag

SEQ ID NO: 21449 - DNA, 25 bp, Mus musculus
aaatctgtagtgcatcttgggatca

SEQ ID NO: 21450 - DNA, 25 bp, Mus musculus
aaatctgtagtggatcttgggatca

SEQ ID NO: 21451 - DNA, 25 bp, Mus musculus
aaatctgtatccagtccccagatga

SEQ ID NO: 21452 - DNA, 25 bp, Mus musculus
aaatctgtatcctgtccccagatga

SEQ ID NO: 21453 - DNA, 25 bp, Mus musculus
aaatctgtatctacaggatccctag

SEQ ID NO: 21454 - DNA, 25 bp, Mus musculus
aaatctgtatcttcaggatccctag

SEQ ID NO: 21455 - DNA, 25 bp, Mus musculus
aaatctgtcattagctaacttgttt

SEQ ID NO: 21456 - DNA, 25 bp, Mus musculus
aaatctgtcatttgctaacttgttt

SEQ ID NO: 21457 - DNA, 25 bp, Mus musculus
aaatctgtcgttacttcatctactc

SEQ ID NO: 21458 - DNA, 25 bp, Mus musculus
aaatctgtcgtttcttcatctactc

SEQ ID NO: 21459 - DNA, 25 bp, Mus musculus
aaatctgtcttgaggcctgagctgc

SEQ ID NO: 21460 - DNA, 25 bp, Mus musculus
aaatctgtcttgtggcctgagctgc

SEQ ID NO: 21461 - DNA, 25 bp, Mus musculus
aaatctgtgaccacaccatggaagc

SEQ ID NO: 21462 - DNA, 25 bp, Mus musculus
aaatctgtgacctcaccatggaagc

SEQ ID NO: 21463 - DNA, 25 bp, Mus musculus
aaatctgtgactctatagcccttgg

SEQ ID NO: 21464 - DNA, 25 bp, Mus musculus
aaatctgtgactgtatagcccttgg

SEQ ID NO: 21465 - DNA, 25 bp, Mus musculus
aaatctgtgcacataccgttgccac

SEQ ID NO: 21466 - DNA, 25 bp, Mus musculus
aaatctgtgcacttaccgttgccac

SEQ ID NO: 21467 - DNA, 25 bp, Mus musculus
aaatctgtgccacgctataagaaga

SEQ ID NO: 21468 - DNA, 25 bp, Mus musculus
aaatctgtgccaggctataagaaga

SEQ ID NO: 21469 - DNA, 25 bp, Mus musculus
aaatctgtgctaccaagtgcctatg

SEQ ID NO: 21470 - DNA, 25 bp, Mus musculus
aaatctgtgctagcaagtgcctatg

SEQ ID NO: 21471 - DNA, 25 bp, Mus musculus
aaatctgtgctcctggagctgccag

SEQ ID NO: 21472 - DNA, 25 bp, Mus musculus
aaatctgtgctcgtggagctgccag

SEQ ID NO: 21473 - DNA, 25 bp, Mus musculus
aaatctgtgctgagaaaatgccatc

SEQ ID NO: 21474 - DNA, 25 bp, Mus musculus
aaatctgtgctgtgaaaatgccatc

SEQ ID NO: 21475 - DNA, 25 bp, Mus musculus
aaatctgtggccaggagatggttca

SEQ ID NO: 21476 - DNA, 25 bp, Mus musculus
aaatctgtggccatagaacttttta

SEQ ID NO: 21477 - DNA, 25 bp, Mus musculus
aaatctgtggcctggagatggttca

SEQ ID NO: 21478 - DNA, 25 bp, Mus musculus
aaatctgtggccttagaacttttta

SEQ ID NO: 21479 - DNA, 25 bp, Mus musculus
aaatctgtggtgagcgcattcttca

SEQ ID NO: 21480 - DNA, 25 bp, Mus musculus
aaatctgtggtgtgcgcattcttca

SEQ ID NO: 21481 - DNA, 25 bp, Mus musculus
aaatctgtgtgtcagaccgtgctaa

SEQ ID NO: 21482 - DNA, 25 bp, Mus musculus
aaatctgtgtgtgagaccgtgctaa

SEQ ID NO: 21483 - DNA, 25 bp, Mus musculus
aaatctgtgttcaaagctgaaactg

SEQ ID NO: 21484 - DNA, 25 bp, Mus musculus
aaatctgtgttctaagctgaaactg

SEQ ID NO: 21485 - DNA, 25 bp, Mus musculus
aaatctgttacaccaaggtggctca

SEQ ID NO: 21486 - DNA, 25 bp, Mus musculus
aaatctgttacagcaaggtggctca

SEQ ID NO: 21487 - DNA, 25 bp, Mus musculus
aaatctgttctgatggattctgtat

SEQ ID NO: 21488 - DNA, 25 bp, Mus musculus
aaatctgttctgcttcttataccac

SEQ ID NO: 21489 - DNA, 25 bp, Mus musculus
aaatctgttctggttcttataccac

SEQ ID NO: 21490 - DNA, 25 bp, Mus musculus
aaatctgttctgttggattctgtat

SEQ ID NO: 21491 - DNA, 25 bp, Mus musculus
aaatctgttgcaccaaatgatccat

SEQ ID NO: 21492 - DNA, 25 bp, Mus musculus
aaatctgttgcagcaaatgatccat

SEQ ID NO: 21493 - DNA, 25 bp, Mus musculus
aaatctgttgccatttggactctac

SEQ ID NO: 21494 - DNA, 25 bp, Mus musculus
aaatctgttgccttttggactctac

SEQ ID NO: 21495 - DNA, 25 bp, Mus musculus
aaatctgttgttcgtgactttgcta

SEQ ID NO: 21496 - DNA, 25 bp, Mus musculus
aaatctgttgttggtgactttgcta

SEQ ID NO: 21497 - DNA, 25 bp, Mus musculus
aaatctgtttccagctctcaagtgg

SEQ ID NO: 21498 - DNA, 25 bp, Mus musculus
aaatctgtttcctgctctcaagtgg

SEQ ID NO: 21499 - DNA, 25 bp, Mus musculus
aaatctgtttgtcactccagtgatg

SEQ ID NO: 21500 - DNA, 25 bp, Mus musculus
aaatctgtttgtgactccagtgatg

SEQ ID NO: 21501 - DNA, 25 bp, Mus musculus
aaatcttaacagagttccttcattg

SEQ ID NO: 21502 - DNA, 25 bp, Mus musculus
aaatcttaacagtgttccttcattg

SEQ ID NO: 21503 - DNA, 25 bp, Mus musculus
aaatcttacccaattatgactaggc

SEQ ID NO: 21504 - DNA, 25 bp, Mus musculus
aaatcttacccatttatgactaggc

SEQ ID NO: 21505 - DNA, 25 bp, Mus musculus
aaatcttacctcagaaggtccctct

SEQ ID NO: 21506 - DNA, 25 bp, Mus musculus
aaatcttacctctgaaggtccctct

SEQ ID NO: 21507 - DNA, 25 bp, Mus musculus
aaatcttacggtcctacctcacagg

SEQ ID NO: 21508 - DNA, 25 bp, Mus musculus
aaatcttacggtgctacctcacagg

SEQ ID NO: 21509 - DNA, 25 bp, Mus musculus
aaatcttactttagtgacacagcca

SEQ ID NO: 21510 - DNA, 25 bp, Mus musculus
aaatcttacttttgtgacacagcca

SEQ ID NO: 21511 - DNA, 25 bp, Mus musculus
aaatcttagcttatccttggctgct

SEQ ID NO: 21512 - DNA, 25 bp, Mus musculus
aaatcttagcttttccttggctgct

SEQ ID NO: 21513 - DNA, 25 bp, Mus musculus
aaatcttaggcgactgctttgttaa

SEQ ID NO: 21514 - DNA, 25 bp, Mus musculus
aaatcttaggcgtctgctttgttaa

SEQ ID NO: 21515 - DNA, 25 bp, Mus musculus
aaatcttagttcatgcctgtgggat

SEQ ID NO: 21516 - DNA, 25 bp, Mus musculus
aaatcttagttcttgcctgtgggat

SEQ ID NO: 21517 - DNA, 25 bp, Mus musculus
aaatcttataatcctcttactgata

SEQ ID NO: 21518 - DNA, 25 bp, Mus musculus
aaatcttataatgctcttactgata

SEQ ID NO: 21519 - DNA, 25 bp, Mus musculus
aaatcttatactaacctgtgcccat

SEQ ID NO: 21520 - DNA, 25 bp, Mus musculus
aaatcttatacttacctgtgcccat

SEQ ID NO: 21521 - DNA, 25 bp, Mus musculus
aaatcttatcccagagcagggcgcc

SEQ ID NO: 21522 - DNA, 25 bp, Mus musculus
aaatcttatccctgagcagggcgcc

SEQ ID NO: 21523 - DNA, 25 bp, Mus musculus
aaatcttatcttcggcaaacacact

SEQ ID NO: 21524 - DNA, 25 bp, Mus musculus
aaatcttatcttgggcaaacacact

SEQ ID NO: 21525 - DNA, 25 bp, Mus musculus
aaatcttatggcctaattttgaagg

SEQ ID NO: 21526 - DNA, 25 bp, Mus musculus
aaatcttatggcgtaattttgaagg

SEQ ID NO: 21527 - DNA, 25 bp, Mus musculus
aaatcttatgttactcaccttggct

SEQ ID NO: 21528 - DNA, 25 bp, Mus musculus
aaatcttatgtttctcaccttggct

SEQ ID NO: 21529 - DNA, 25 bp, Mus musculus
aaatcttcagaaagcgttccgaatt

SEQ ID NO: 21530 - DNA, 25 bp, Mus musculus
aaatcttcagaatgcgttccgaatt

SEQ ID NO: 21531 - DNA, 25 bp, Mus musculus
aaatcttcagaccttatagttcatt

SEQ ID NO: 21532 - DNA, 25 bp, Mus musculus
aaatcttcagacgttatagttcatt

SEQ ID NO: 21533 - DNA, 25 bp, Mus musculus
aaatcttcagcgataatctttcaaa

SEQ ID NO: 21534 - DNA, 25 bp, Mus musculus
aaatcttcagcgttaatctttcaaa

SEQ ID NO: 21535 - DNA, 25 bp, Mus musculus
aaatcttcatgtaaggctcgcctca

SEQ ID NO: 21536 - DNA, 25 bp, Mus musculus
aaatcttcatgttaggctcgcctca

SEQ ID NO: 21537 - DNA, 25 bp, Mus musculus
aaatcttcattccttttggtatcaa

SEQ ID NO: 21538 - DNA, 25 bp, Mus musculus
aaatcttcattcgttttggtatcaa

SEQ ID NO: 21539 - DNA, 25 bp, Mus musculus
aaatcttcatttagtgctcagctat

SEQ ID NO: 21540 - DNA, 25 bp, Mus musculus
aaatcttcattttgtgctcagctat

SEQ ID NO: 21541 - DNA, 25 bp, Mus musculus
aaatcttccagaaccatttctcgaa

SEQ ID NO: 21542 - DNA, 25 bp, Mus musculus
aaatcttccagatccatttctcgaa

SEQ ID NO: 21543 - DNA, 25 bp, Mus musculus
aaatcttccatacttcttgttatct

SEQ ID NO: 21544 - DNA, 25 bp, Mus musculus
aaatcttccatagttcttgttatct

SEQ ID NO: 21545 - DNA, 25 bp, Mus musculus
aaatcttccctgaactatttctgga

SEQ ID NO: 21546 - DNA, 25 bp, Mus musculus
aaatcttccctgtactatttctgga

SEQ ID NO: 21547 - DNA, 25 bp, Mus musculus
aaatcttccgccataatacttcatt

SEQ ID NO: 21548 - DNA, 25 bp, Mus musculus
aaatcttccgccttaatacttcatt

SEQ ID NO: 21549 - DNA, 25 bp, Mus musculus
aaatcttccggcatgagaaactcaa

SEQ ID NO: 21550 - DNA, 25 bp, Mus musculus
aaatcttccggcttgagaaactcaa

SEQ ID NO: 21551 - DNA, 25 bp, Mus musculus
aaatcttcctgaaccagtccgtatc

SEQ ID NO: 21552 - DNA, 25 bp, Mus musculus
aaatcttcctgatccagtccgtatc

SEQ ID NO: 21553 - DNA, 25 bp, Mus musculus
aaatcttccttcctggcaagcttga

SEQ ID NO: 21554 - DNA, 25 bp, Mus musculus
aaatcttccttcgtggcaagcttga

SEQ ID NO: 21555 - DNA, 25 bp, Mus musculus
aaatcttcgaacatctgacctgggt

SEQ ID NO: 21556 - DNA, 25 bp, Mus musculus
aaatcttcgaacttctgacctgggt

SEQ ID NO: 21557 - DNA, 25 bp, Mus musculus
aaatcttcgattcctggttatttgg

SEQ ID NO: 21558 - DNA, 25 bp, Mus musculus
aaatcttcgattgctggttatttgg

SEQ ID NO: 21559 - DNA, 25 bp, Mus musculus
aaatcttcggtactttcctgctgat

SEQ ID NO: 21560 - DNA, 25 bp, Mus musculus
aaatcttcggtagtttcctgctgat

SEQ ID NO: 21561 - DNA, 25 bp, Mus musculus
aaatcttctaccacttgactgcatt

SEQ ID NO: 21562 - DNA, 25 bp, Mus musculus
aaatcttctacctcttgactgcatt

SEQ ID NO: 21563 - DNA, 25 bp, Mus musculus
aaatcttctacgctgaatttgcgac

SEQ ID NO: 21564 - DNA, 25 bp, Mus musculus
aaatcttctacggtgaatttgcgac

SEQ ID NO: 21565 - DNA, 25 bp, Mus musculus
aaatcttctcataacatctcctgtg

SEQ ID NO: 21566 - DNA, 25 bp, Mus musculus
aaatcttctcattacatctcctgtg

SEQ ID NO: 21567 - DNA, 25 bp, Mus musculus
aaatcttctggcattggactacaaa

SEQ ID NO: 21568 - DNA, 25 bp, Mus musculus
aaatcttctggctttggactacaaa

SEQ ID NO: 21569 - DNA, 25 bp, Mus musculus
aaatcttcttctaaggacattagac

SEQ ID NO: 21570 - DNA, 25 bp, Mus musculus
aaatcttcttcttaggacattagac

SEQ ID NO: 21571 - DNA, 25 bp, Mus musculus
aaatcttcttgactgcattatgtat

SEQ ID NO: 21572 - DNA, 25 bp, Mus musculus
aaatcttcttgagtgcattatgtat

SEQ ID NO: 21573 - DNA, 25 bp, Mus musculus
aaatcttcttgcacaaacctaggaa

SEQ ID NO: 21574 - DNA, 25 bp, Mus musculus
aaatcttcttgctcaaacctaggaa

SEQ ID NO: 21575 - DNA, 25 bp, Mus musculus
aaatcttgaatgactgagaagtacc

SEQ ID NO: 21576 - DNA, 25 bp, Mus musculus
aaatcttgaatgtctgagaagtacc

SEQ ID NO: 21577 - DNA, 25 bp, Mus musculus
aaatcttgacaaaacttctggaggt

SEQ ID NO: 21578 - DNA, 25 bp, Mus musculus
aaatcttgacaacagcttctcgctt

SEQ ID NO: 21579 - DNA, 25 bp, Mus musculus
aaatcttgacaagagcttctcgctt

SEQ ID NO: 21580 - DNA, 25 bp, Mus musculus
aaatcttgacaatacttctggaggt

SEQ ID NO: 21581 - DNA, 25 bp, Mus musculus
aaatcttgagaaacctcaagtccaa

SEQ ID NO: 21582 - DNA, 25 bp, Mus musculus
aaatcttgagaatcctcaagtccaa

SEQ ID NO: 21583 - DNA, 25 bp, Mus musculus
aaatcttgagggatgtggcttcctt

SEQ ID NO: 21584 - DNA, 25 bp, Mus musculus
aaatcttgagggttgtggcttcctt

SEQ ID NO: 21585 - DNA, 25 bp, Mus musculus
aaatcttgcagtaagtgtctataat

SEQ ID NO: 21586 - DNA, 25 bp, Mus musculus
aaatcttgcagttagtgtctataat

SEQ ID NO: 21587 - DNA, 25 bp, Mus musculus
aaatcttgccaacttctctacaact

SEQ ID NO: 21588 - DNA, 25 bp, Mus musculus
aaatcttgccaagttctctacaact

SEQ ID NO: 21589 - DNA, 25 bp, Mus musculus
aaatcttgccgtcggcagtggtgca

SEQ ID NO: 21590 - DNA, 25 bp, Mus musculus
aaatcttgccgtgggcagtggtgca

SEQ ID NO: 21591 - DNA, 25 bp, Mus musculus
aaatcttgcctcaggaacagaacca

SEQ ID NO: 21592 - DNA, 25 bp, Mus musculus
aaatcttgcctctggaacagaacca

SEQ ID NO: 21593 - DNA, 25 bp, Mus musculus
aaatcttgctgtccatgtgccaatg

SEQ ID NO: 21594 - DNA, 25 bp, Mus musculus
aaatcttgctgtgcatgtgccaatg

SEQ ID NO: 21595 - DNA, 25 bp, Mus musculus
aaatcttgctttactgatgtcccaa

SEQ ID NO: 21596 - DNA, 25 bp, Mus musculus
aaatcttgcttttctgatgtcccaa

SEQ ID NO: 21597 - DNA, 25 bp, Mus musculus
aaatcttggaccattgagccagcaa

SEQ ID NO: 21598 - DNA, 25 bp, Mus musculus
aaatcttggacctttgagccagcaa

SEQ ID NO: 21599 - DNA, 25 bp, Mus musculus
aaatcttggagacagggcttgtcca

SEQ ID NO: 21600 - DNA, 25 bp, Mus musculus
aaatcttggagagagggcttgtcca

SEQ ID NO: 21601 - DNA, 25 bp, Mus musculus
aaatcttggcgacaatagtgtattc

SEQ ID NO: 21602 - DNA, 25 bp, Mus musculus
aaatcttggcgagaatagtgtattc

SEQ ID NO: 21603 - DNA, 25 bp, Mus musculus
aaatcttgggtactcttgtcttctt

SEQ ID NO: 21604 - DNA, 25 bp, Mus musculus
aaatcttgggtagtcttgtcttctt

SEQ ID NO: 21605 - DNA, 25 bp, Mus musculus
aaatcttggtacacctgaaggcttg

SEQ ID NO: 21606 - DNA, 25 bp, Mus musculus
aaatcttggtactcctgaaggcttg

SEQ ID NO: 21607 - DNA, 25 bp, Mus musculus
aaatcttggttcatactgtggtata

SEQ ID NO: 21608 - DNA, 25 bp, Mus musculus
aaatcttggttcttactgtggtata

SEQ ID NO: 21609 - DNA, 25 bp, Mus musculus
aaatcttgtcatagaagctggagta

SEQ ID NO: 21610 - DNA, 25 bp, Mus musculus
aaatcttgtcattgaagctggagta

SEQ ID NO: 21611 - DNA, 25 bp, Mus musculus
aaatcttgtcgacggtgaaggcaca

SEQ ID NO: 21612 - DNA, 25 bp, Mus musculus
aaatcttgtcgagggtgaaggcaca

SEQ ID NO: 21613 - DNA, 25 bp, Mus musculus
aaatcttgtgccatgtgtcttctct

SEQ ID NO: 21614 - DNA, 25 bp, Mus musculus
aaatcttgtgccttgtgtcttctct

SEQ ID NO: 21615 - DNA, 25 bp, Mus musculus
aaatcttgtttactttagctctgag

SEQ ID NO: 21616 - DNA, 25 bp, Mus musculus
aaatcttgtttagtttagctctgag

SEQ ID NO: 21617 - DNA, 25 bp, Mus musculus
aaatctttacgtacctggagcctca

SEQ ID NO: 21618 - DNA, 25 bp, Mus musculus
aaatctttacgttcctggagcctca

SEQ ID NO: 21619 - DNA, 25 bp, Mus musculus
aaatctttagaactatctcagggaa

SEQ ID NO: 21620 - DNA, 25 bp, Mus musculus
aaatctttagaagtatctcagggaa

SEQ ID NO: 21621 - DNA, 25 bp, Mus musculus
aaatctttaggcctacatgccccaa

SEQ ID NO: 21622 - DNA, 25 bp, Mus musculus
aaatctttaggcgtacatgccccaa

SEQ ID NO: 21623 - DNA, 25 bp, Mus musculus
aaatctttcctcagtggtctttacg

SEQ ID NO: 21624 - DNA, 25 bp, Mus musculus
aaatctttcctctgtggtctttacg

SEQ ID NO: 21625 - DNA, 25 bp, Mus musculus
aaatctttgatcagggagtgcccta

SEQ ID NO: 21626 - DNA, 25 bp, Mus musculus
aaatctttgatctgggagtgcccta

SEQ ID NO: 21627 - DNA, 25 bp, Mus musculus
aaatctttgatgcaggtaccgccct

SEQ ID NO: 21628 - DNA, 25 bp, Mus musculus
aaatctttgatggaggtaccgccct

SEQ ID NO: 21629 - DNA, 25 bp, Mus musculus
aaatctttgcagatggcggtcacaa

SEQ ID NO: 21630 - DNA, 25 bp, Mus musculus
aaatctttgcagttggcggtcacaa

SEQ ID NO: 21631 - DNA, 25 bp, Mus musculus
aaatctttgccaaatccactggaga

SEQ ID NO: 21632 - DNA, 25 bp, Mus musculus
aaatctttgccatatccactggaga

SEQ ID NO: 21633 - DNA, 25 bp, Mus musculus
aaatctttgctactttcatatctga

SEQ ID NO: 21634 - DNA, 25 bp, Mus musculus
aaatctttgctagtttcatatctga

SEQ ID NO: 21635 - DNA, 25 bp, Mus musculus
aaatctttgctgattactacttgaa

SEQ ID NO: 21636 - DNA, 25 bp, Mus musculus
aaatctttgctgtttactacttgaa

SEQ ID NO: 21637 - DNA, 25 bp, Mus musculus
aaatctttgcttctgagtcagtttt

SEQ ID NO: 21638 - DNA, 25 bp, Mus musculus
aaatctttgcttgtgagtcagtttt

SEQ ID NO: 21639 - DNA, 25 bp, Mus musculus
aaatctttggctactgcagccaggt

SEQ ID NO: 21640 - DNA, 25 bp, Mus musculus
aaatctttggcttctgcagccaggt

SEQ ID NO: 21641 - DNA, 25 bp, Mus musculus
aaatctttgttaccttcgctgtgaa

SEQ ID NO: 21642 - DNA, 25 bp, Mus musculus
aaatctttgttagcttcgctgtgaa

SEQ ID NO: 21643 - DNA, 25 bp, Mus musculus
aaatctttgtttcagttttgtccag

SEQ ID NO: 21644 - DNA, 25 bp, Mus musculus
aaatctttgtttgagttttgtccag

SEQ ID NO: 21645 - DNA, 25 bp, Mus musculus
aaatcttttatacgagtgcagtgct

SEQ ID NO: 21646 - DNA, 25 bp, Mus musculus
aaatcttttataggagtgcagtgct

SEQ ID NO: 21647 - DNA, 25 bp, Mus musculus
aaatcttttatgctgaaagccaggc

SEQ ID NO: 21648 - DNA, 25 bp, Mus musculus
aaatcttttatggtgaaagccaggc

SEQ ID NO: 21649 - DNA, 25 bp, Mus musculus
aaatcttttctacctaaccatgtga

SEQ ID NO: 21650 - DNA, 25 bp, Mus musculus
aaatcttttctactagcttctttga

SEQ ID NO: 21651 - DNA, 25 bp, Mus musculus
aaatcttttctagctaaccatgtga

SEQ ID NO: 21652 - DNA, 25 bp, Mus musculus
aaatcttttctagtagcttctttga

SEQ ID NO: 21653 - DNA, 25 bp, Mus musculus
aaatcttttgttaatgctcctccgg

SEQ ID NO: 21654 - DNA, 25 bp, Mus musculus
aaatcttttgtttatgctcctccgg

SEQ ID NO: 21655 - DNA, 25 bp, Mus musculus
aaatctttttagactactcttctag

SEQ ID NO: 21656 - DNA, 25 bp, Mus musculus
aaatctttttagtctactcttctag

SEQ ID NO: 21657 - DNA, 25 bp, Mus musculus
aaatctttttctcattagctttgtt

SEQ ID NO: 21658 - DNA, 25 bp, Mus musculus
aaatctttttctgattagctttgtt

SEQ ID NO: 21659 - DNA, 25 bp, Mus musculus
aaatctttttgcctggatcactagc

SEQ ID NO: 21660 - DNA, 25 bp, Mus musculus
aaatctttttgcgtggatcactagc

SEQ ID NO: 21661 - DNA, 25 bp, Mus musculus
aaatgaaagcgcctctcattccttc

SEQ ID NO: 21662 - DNA, 25 bp, Mus musculus
aaatgaaagcgcgtctcattccttc

SEQ ID NO: 21663 - DNA, 25 bp, Mus musculus
aaatgaaagggacctggccgtgcct

SEQ ID NO: 21664 - DNA, 25 bp, Mus musculus
aaatgaaagggagctggccgtgcct

SEQ ID NO: 21665 - DNA, 25 bp, Mus musculus
aaatgaaatccaaattgtacgctat

SEQ ID NO: 21666 - DNA, 25 bp, Mus musculus
aaatgaaatccatattgtacgctat

SEQ ID NO: 21667 - DNA, 25 bp, Mus musculus
aaatgaaatctcaaccgcatccctt

SEQ ID NO: 21668 - DNA, 25 bp, Mus musculus
aaatgaaatctctaccgcatccctt

SEQ ID NO: 21669 - DNA, 25 bp, Mus musculus
aaatgaacaaaacgccccgtgtgag

SEQ ID NO: 21670 - DNA, 25 bp, Mus musculus
aaatgaacaaaaggccccgtgtgag

SEQ ID NO: 21671 - DNA, 25 bp, Mus musculus
aaatgaacaggacctctggcaccct

SEQ ID NO: 21672 - DNA, 25 bp, Mus musculus
aaatgaacaggagctctggcaccct

SEQ ID NO: 21673 - DNA, 25 bp, Mus musculus
aaatgaacatctatacatggagggt

SEQ ID NO: 21674 - DNA, 25 bp, Mus musculus
aaatgaacatctttacatggagggt

SEQ ID NO: 21675 - DNA, 25 bp, Mus musculus
aaatgaaccatgagcttaaactttg

SEQ ID NO: 21676 - DNA, 25 bp, Mus musculus
aaatgaaccatgtgcttaaactttg

SEQ ID NO: 21677 - DNA, 25 bp, Mus musculus
aaatgaaccattatgctttgtcata

SEQ ID NO: 21678 - DNA, 25 bp, Mus musculus
aaatgaaccattcccacctgttcta

SEQ ID NO: 21679 - DNA, 25 bp, Mus musculus
aaatgaaccattgccacctgttcta

SEQ ID NO: 21680 - DNA, 25 bp, Mus musculus
aaatgaaccattttgctttgtcata

SEQ ID NO: 21681 - DNA, 25 bp, Mus musculus
aaatgaacccatcatactcacagaa

SEQ ID NO: 21682 - DNA, 25 bp, Mus musculus
aaatgaacccatgatactcacagaa

SEQ ID NO: 21683 - DNA, 25 bp, Mus musculus
aaatgaacccctagtccccagtgtg

SEQ ID NO: 21684 - DNA, 25 bp, Mus musculus
aaatgaaccccttgtccccagtgtg

SEQ ID NO: 21685 - DNA, 25 bp, Mus musculus
aaatgaaccggacctgtgcctataa

SEQ ID NO: 21686 - DNA, 25 bp, Mus musculus
aaatgaaccggagctgtgcctataa

SEQ ID NO: 21687 - DNA, 25 bp, Mus musculus
aaatgaacctctcgcaagaagctta

SEQ ID NO: 21688 - DNA, 25 bp, Mus musculus
aaatgaacctctggcaagaagctta

SEQ ID NO: 21689 - DNA, 25 bp, Mus musculus
aaatgaacggctatgctcctggatt

SEQ ID NO: 21690 - DNA, 25 bp, Mus musculus
aaatgaacggctttgctcctggatt

SEQ ID NO: 21691 - DNA, 25 bp, Mus musculus
aaatgaactatgacttggctctctc

SEQ ID NO: 21692 - DNA, 25 bp, Mus musculus
aaatgaactatgtcttggctctctc

SEQ ID NO: 21693 - DNA, 25 bp, Mus musculus
aaatgaactctgcttcgatcccccc

SEQ ID NO: 21694 - DNA, 25 bp, Mus musculus
aaatgaactctggttcgatcccccc

SEQ ID NO: 21695 - DNA, 25 bp, Mus musculus
aaatgaactgctatcttacctcctc

SEQ ID NO: 21696 - DNA, 25 bp, Mus musculus
aaatgaactgctttcttacctcctc

SEQ ID NO: 21697 - DNA, 25 bp, Mus musculus
aaatgaacttccacaactggtccac

SEQ ID NO: 21698 - DNA, 25 bp, Mus musculus
aaatgaacttccagtttggcctgct

SEQ ID NO: 21699 - DNA, 25 bp, Mus musculus
aaatgaacttcctcaactggtccac

SEQ ID NO: 21700 - DNA, 25 bp, Mus musculus
aaatgaacttcctgtttggcctgct

SEQ ID NO: 21701 - DNA, 25 bp, Mus musculus
aaatgaacttttccccagtcaccct

SEQ ID NO: 21702 - DNA, 25 bp, Mus musculus
aaatgaacttttgcccagtcaccct

SEQ ID NO: 21703 - DNA, 25 bp, Mus musculus
aaatgaagacatagagctggctatc

SEQ ID NO: 21704 - DNA, 25 bp, Mus musculus
aaatgaagacatcacctctctgcca

SEQ ID NO: 21705 - DNA, 25 bp, Mus musculus
aaatgaagacatgacctctctgcca

SEQ ID NO: 21706 - DNA, 25 bp, Mus musculus
aaatgaagacattgagctggctatc

SEQ ID NO: 21707 - DNA, 25 bp, Mus musculus
aaatgaagacgaacctcagcctggt

SEQ ID NO: 21708 - DNA, 25 bp, Mus musculus
aaatgaagacgatcctcagcctggt

SEQ ID NO: 21709 - DNA, 25 bp, Mus musculus
aaatgaagcatcatgtgccacacat

SEQ ID NO: 21710 - DNA, 25 bp, Mus musculus
aaatgaagcatcttgtgccacacat

SEQ ID NO: 21711 - DNA, 25 bp, Mus musculus
aaatgaagccggctgtctgcacatg

SEQ ID NO: 21712 - DNA, 25 bp, Mus musculus
aaatgaagccgggtgtctgcacatg

SEQ ID NO: 21713 - DNA, 25 bp, Mus musculus
aaatgaagccttaatcctccaacac

SEQ ID NO: 21714 - DNA, 25 bp, Mus musculus
aaatgaagcctttatcctccaacac

SEQ ID NO: 21715 - DNA, 25 bp, Mus musculus
aaatgaaggactcctgctcatattt

SEQ ID NO: 21716 - DNA, 25 bp, Mus musculus
aaatgaaggactgctgctcatattt

SEQ ID NO: 21717 - DNA, 25 bp, Mus musculus
aaatgaaggccccttgtcacgactt

SEQ ID NO: 21718 - DNA, 25 bp, Mus musculus
aaatgaaggcccgttgtcacgactt

SEQ ID NO: 21719 - DNA, 25 bp, Mus musculus
aaatgaaggcctaggcccttccctg

SEQ ID NO: 21720 - DNA, 25 bp, Mus musculus
aaatgaaggccttggcccttccctg

SEQ ID NO: 21721 - DNA, 25 bp, Mus musculus
aaatgaaggctaaatgcgccgtggt

SEQ ID NO: 21722 - DNA, 25 bp, Mus musculus
aaatgaaggctatatgcgccgtggt

SEQ ID NO: 21723 - DNA, 25 bp, Mus musculus
aaatgaaggctcatcgggtccaaca

SEQ ID NO: 21724 - DNA, 25 bp, Mus musculus
aaatgaaggctcttcgggtccaaca

SEQ ID NO: 21725 - DNA, 25 bp, Mus musculus
aaatgaaggtgaccctcgcctaggc

SEQ ID NO: 21726 - DNA, 25 bp, Mus musculus
aaatgaaggtgagcctcgcctaggc

SEQ ID NO: 21727 - DNA, 25 bp, Mus musculus
aaatgaaggttcagtttcagacaat

SEQ ID NO: 21728 - DNA, 25 bp, Mus musculus
aaatgaaggttctgtttcagacaat

SEQ ID NO: 21729 - DNA, 25 bp, Mus musculus
aaatgaagtacaagtactgggccaa

SEQ ID NO: 21730 - DNA, 25 bp, Mus musculus
aaatgaagtacatgtactgggccaa

SEQ ID NO: 21731 - DNA, 25 bp, Mus musculus
aaatgaagtcttcgctgcaggcaga

SEQ ID NO: 21732 - DNA, 25 bp, Mus musculus
aaatgaagtcttggctgcaggcaga

SEQ ID NO: 21733 - DNA, 25 bp, Mus musculus
aaatgaagttggaggactccgcctt

SEQ ID NO: 21734 - DNA, 25 bp, Mus musculus
aaatgaagttggtggactccgcctt

SEQ ID NO: 21735 - DNA, 25 bp, Mus musculus
aaatgaatattgattcctcccctgc

SEQ ID NO: 21736 - DNA, 25 bp, Mus musculus
aaatgaatattgtttcctcccctgc

SEQ ID NO: 21737 - DNA, 25 bp, Mus musculus
aaatgaatcatcacggcagttttga

SEQ ID NO: 21738 - DNA, 25 bp, Mus musculus
aaatgaatcatcctcaccaaactcg

SEQ ID NO: 21739 - DNA, 25 bp, Mus musculus
aaatgaatcatcgtcaccaaactcg

SEQ ID NO: 21740 - DNA, 25 bp, Mus musculus
aaatgaatcatctcggcagttttga

SEQ ID NO: 21741 - DNA, 25 bp, Mus musculus
aaatgaatcccacttttgtgttaat

SEQ ID NO: 21742 - DNA, 25 bp, Mus musculus
aaatgaatcccagttttgtgttaat

SEQ ID NO: 21743 - DNA, 25 bp, Mus musculus
aaatgaatcctcataaaactccaga

SEQ ID NO: 21744 - DNA, 25 bp, Mus musculus
aaatgaatcctcttaaaactccaga

SEQ ID NO: 21745 - DNA, 25 bp, Mus musculus
aaatgaatcgctcactcacagcact

SEQ ID NO: 21746 - DNA, 25 bp, Mus musculus
aaatgaatcgctgactcacagcact

SEQ ID NO: 21747 - DNA, 25 bp, Mus musculus
aaatgaatctgcagaagtaagcccc

SEQ ID NO: 21748 - DNA, 25 bp, Mus musculus
aaatgaatctgctgaagtaagcccc

SEQ ID NO: 21749 - DNA, 25 bp, Mus musculus
aaatgaatctgtcacactaagaggt

SEQ ID NO: 21750 - DNA, 25 bp, Mus musculus
aaatgaatctgtgacactaagaggt

SEQ ID NO: 21751 - DNA, 25 bp, Mus musculus
aaatgaatgattccggagcccgtgt

SEQ ID NO: 21752 - DNA, 25 bp, Mus musculus
aaatgaatgattgcggagcccgtgt

SEQ ID NO: 21753 - DNA, 25 bp, Mus musculus
aaatgaatgcacagggcggcccagt

SEQ ID NO: 21754 - DNA, 25 bp, Mus musculus
aaatgaatgcactgggcggcccagt

SEQ ID NO: 21755 - DNA, 25 bp, Mus musculus
aaatgaatggacagttggctgggac

SEQ ID NO: 21756 - DNA, 25 bp, Mus musculus
aaatgaatggactgttggctgggac

SEQ ID NO: 21757 - DNA, 25 bp, Mus musculus
aaatgaattctcaggtgctacacac

SEQ ID NO: 21758 - DNA, 25 bp, Mus musculus
aaatgaattctctggtgctacacac

SEQ ID NO: 21759 - DNA, 25 bp, Mus musculus
aaatgacaaactctcctggcagcat

SEQ ID NO: 21760 - DNA, 25 bp, Mus musculus
aaatgacaaactgtcctggcagcat

SEQ ID NO: 21761 - DNA, 25 bp, Mus musculus
aaatgacaaagtcagcttgtgtggt

SEQ ID NO: 21762 - DNA, 25 bp, Mus musculus
aaatgacaaagtgagcttgtgtggt

SEQ ID NO: 21763 - DNA, 25 bp, Mus musculus
aaatgacaataacaaggcttggact

SEQ ID NO: 21764 - DNA, 25 bp, Mus musculus
aaatgacaataagaaggcttggact

SEQ ID NO: 21765 - DNA, 25 bp, Mus musculus
aaatgacacaccaagttactcttat

SEQ ID NO: 21766 - DNA, 25 bp, Mus musculus
aaatgacacacctagttactcttat

SEQ ID NO: 21767 - DNA, 25 bp, Mus musculus
aaatgacacccaaatgagagcttgt

SEQ ID NO: 21768 - DNA, 25 bp, Mus musculus
aaatgacacccacagcttgggctag

SEQ ID NO: 21769 - DNA, 25 bp, Mus musculus
aaatgacacccagagcttgggctag

SEQ ID NO: 21770 - DNA, 25 bp, Mus musculus
aaatgacacccatatgagagcttgt

SEQ ID NO: 21771 - DNA, 25 bp, Mus musculus
aaatgacacctgacattggcttcct

SEQ ID NO: 21772 - DNA, 25 bp, Mus musculus
aaatgacacctgtcattggcttcct

SEQ ID NO: 21773 - DNA, 25 bp, Mus musculus
aaatgacactagctacttccttact

SEQ ID NO: 21774 - DNA, 25 bp, Mus musculus
aaatgacactaggtacttccttact

SEQ ID NO: 21775 - DNA, 25 bp, Mus musculus
aaatgacactgtctagtaatgtaat

SEQ ID NO: 21776 - DNA, 25 bp, Mus musculus
aaatgacactgtgtagtaatgtaat

SEQ ID NO: 21777 - DNA, 25 bp, Mus musculus
aaatgacagcccctatcagggtgga

SEQ ID NO: 21778 - DNA, 25 bp, Mus musculus
aaatgacagcccgtatcagggtgga

SEQ ID NO: 21779 - DNA, 25 bp, Mus musculus
aaatgacaggtcagtgcctctatgc

SEQ ID NO: 21780 - DNA, 25 bp, Mus musculus
aaatgacaggtctgtgcctctatgc

SEQ ID NO: 21781 - DNA, 25 bp, Mus musculus
aaatgacaggttagctgctgttccg

SEQ ID NO: 21782 - DNA, 25 bp, Mus musculus
aaatgacaggtttgctgctgttccg

SEQ ID NO: 21783 - DNA, 25 bp, Mus musculus
aaatgacagtcacggctccctgcag

SEQ ID NO: 21784 - DNA, 25 bp, Mus musculus
aaatgacagtcagggctccctgcag

SEQ ID NO: 21785 - DNA, 25 bp, Mus musculus
aaatgacagtctatctctcagctac

SEQ ID NO: 21786 - DNA, 25 bp, Mus musculus
aaatgacagtctttctctcagctac

SEQ ID NO: 21787 - DNA, 25 bp, Mus musculus
aaatgacatactcgctgcttacctg

SEQ ID NO: 21788 - DNA, 25 bp, Mus musculus
aaatgacatactggctgcttacctg

SEQ ID NO: 21789 - DNA, 25 bp, Mus musculus
aaatgacatcagcttatgcagccac

SEQ ID NO: 21790 - DNA, 25 bp, Mus musculus
aaatgacatcaggttatgcagccac

SEQ ID NO: 21791 - DNA, 25 bp, Mus musculus
aaatgacatctaacttggcagaaag

SEQ ID NO: 21792 - DNA, 25 bp, Mus musculus
aaatgacatctatcttggcagaaag

SEQ ID NO: 21793 - DNA, 25 bp, Mus musculus
aaatgacatctgctgaccgcgcagc

SEQ ID NO: 21794 - DNA, 25 bp, Mus musculus
aaatgacatctggtgaccgcgcagc

SEQ ID NO: 21795 - DNA, 25 bp, Mus musculus
aaatgacatgctcccattcctggtt

SEQ ID NO: 21796 - DNA, 25 bp, Mus musculus
aaatgacatgctgccattcctggtt

SEQ ID NO: 21797 - DNA, 25 bp, Mus musculus
aaatgacatttaatgcctagacgca

SEQ ID NO: 21798 - DNA, 25 bp, Mus musculus
aaatgacatttattgcctagacgca

SEQ ID NO: 21799 - DNA, 25 bp, Mus musculus
aaatgaccaaatcggcctttcactt

SEQ ID NO: 21800 - DNA, 25 bp, Mus musculus
aaatgaccaaatgggcctttcactt

SEQ ID NO: 21801 - DNA, 25 bp, Mus musculus
aaatgaccaactcctgattacagct

SEQ ID NO: 21802 - DNA, 25 bp, Mus musculus
aaatgaccaactgctgattacagct

SEQ ID NO: 21803 - DNA, 25 bp, Mus musculus
aaatgaccacgtctgggaggccctc

SEQ ID NO: 21804 - DNA, 25 bp, Mus musculus
aaatgaccacgtgtgggaggccctc

SEQ ID NO: 21805 - DNA, 25 bp, Mus musculus
aaatgaccaggcagtctactgacaa

SEQ ID NO: 21806 - DNA, 25 bp, Mus musculus
aaatgaccaggctgtctactgacaa

SEQ ID NO: 21807 - DNA, 25 bp, Mus musculus
aaatgaccagtgagtgacacttcac

SEQ ID NO: 21808 - DNA, 25 bp, Mus musculus
aaatgaccagtgtgtgacacttcac

SEQ ID NO: 21809 - DNA, 25 bp, Mus musculus
aaatgaccatctccactggcacaca

SEQ ID NO: 21810 - DNA, 25 bp, Mus musculus
aaatgaccatctgcactggcacaca

SEQ ID NO: 21811 - DNA, 25 bp, Mus musculus
aaatgacccattatactaagcgagt

SEQ ID NO: 21812 - DNA, 25 bp, Mus musculus
aaatgacccattttactaagcgagt

SEQ ID NO: 21813 - DNA, 25 bp, Mus musculus
aaatgacccctgacatgtactcgca

SEQ ID NO: 21814 - DNA, 25 bp, Mus musculus
aaatgacccctgtcatgtactcgca

SEQ ID NO: 21815 - DNA, 25 bp, Mus musculus
aaatgaccctcaccgaatggacaag

SEQ ID NO: 21816 - DNA, 25 bp, Mus musculus
aaatgaccctcagcgaatggacaag

SEQ ID NO: 21817 - DNA, 25 bp, Mus musculus
aaatgaccgagtaaggaacctgcag

SEQ ID NO: 21818 - DNA, 25 bp, Mus musculus
aaatgaccgagttaggaacctgcag

SEQ ID NO: 21819 - DNA, 25 bp, Mus musculus
aaatgaccgcagcagtacttattaa

SEQ ID NO: 21820 - DNA, 25 bp, Mus musculus
aaatgaccgcaggagtacttattaa

SEQ ID NO: 21821 - DNA, 25 bp, Mus musculus
aaatgaccgtcgcagacatgtccct

SEQ ID NO: 21822 - DNA, 25 bp, Mus musculus
aaatgaccgtcggagacatgtccct

SEQ ID NO: 21823 - DNA, 25 bp, Mus musculus
aaatgacctaaccatccctagaatt

SEQ ID NO: 21824 - DNA, 25 bp, Mus musculus
aaatgacctaacgatccctagaatt

SEQ ID NO: 21825 - DNA, 25 bp, Mus musculus
aaatgacctagtaatcactacgagt

SEQ ID NO: 21826 - DNA, 25 bp, Mus musculus
aaatgacctagttatcactacgagt

SEQ ID NO: 21827 - DNA, 25 bp, Mus musculus
aaatgacctcatccttcattatttt

SEQ ID NO: 21828 - DNA, 25 bp, Mus musculus
aaatgacctcatgcttcattatttt

SEQ ID NO: 21829 - DNA, 25 bp, Mus musculus
aaatgacctgaacggttaccatcac

SEQ ID NO: 21830 - DNA, 25 bp, Mus musculus
aaatgacctgaagggttaccatcac

SEQ ID NO: 21831 - DNA, 25 bp, Mus musculus
aaatgacctgtcatggcatgcttct

SEQ ID NO: 21832 - DNA, 25 bp, Mus musculus
aaatgacctgtcttggcatgcttct

SEQ ID NO: 21833 - DNA, 25 bp, Mus musculus
aaatgaccttaactcagctctgcta

SEQ ID NO: 21834 - DNA, 25 bp, Mus musculus
aaatgaccttaagtcagctctgcta

SEQ ID NO: 21835 - DNA, 25 bp, Mus musculus
aaatgaccttccacctgtttattgc

SEQ ID NO: 21836 - DNA, 25 bp, Mus musculus
aaatgaccttccctgtaggatgctg

SEQ ID NO: 21837 - DNA, 25 bp, Mus musculus
aaatgaccttccgtgtaggatgctg

SEQ ID NO: 21838 - DNA, 25 bp, Mus musculus
aaatgaccttcctcctgtttattgc

SEQ ID NO: 21839 - DNA, 25 bp, Mus musculus
aaatgaccttcgcacttagactggg

SEQ ID NO: 21840 - DNA, 25 bp, Mus musculus
aaatgaccttcggacttagactggg

SEQ ID NO: 21841 - DNA, 25 bp, Mus musculus
aaatgaccttgtcctgattttcagt

SEQ ID NO: 21842 - DNA, 25 bp, Mus musculus
aaatgaccttgtgctgattttcagt

SEQ ID NO: 21843 - DNA, 25 bp, Mus musculus
aaatgacgatgcactgttgtaggat

SEQ ID NO: 21844 - DNA, 25 bp, Mus musculus
aaatgacgatgctctgttgtaggat

SEQ ID NO: 21845 - DNA, 25 bp, Mus musculus
aaatgacgggtgacggtgttgactt

SEQ ID NO: 21846 - DNA, 25 bp, Mus musculus
aaatgacgggtgtcggtgttgactt

SEQ ID NO: 21847 - DNA, 25 bp, Mus musculus
aaatgacgttccactgcaggccagc

SEQ ID NO: 21848 - DNA, 25 bp, Mus musculus
aaatgacgttcctctgcaggccagc

SEQ ID NO: 21849 - DNA, 25 bp, Mus musculus
aaatgacgttgtacctgtgttctct

SEQ ID NO: 21850 - DNA, 25 bp, Mus musculus
aaatgacgttgttcctgtgttctct

SEQ ID NO: 21851 - DNA, 25 bp, Mus musculus
aaatgactaaacatctctgctaaac

SEQ ID NO: 21852 - DNA, 25 bp, Mus musculus
aaatgactaaacttctctgctaaac

SEQ ID NO: 21853 - DNA, 25 bp, Mus musculus
aaatgactaccgagtcttcaatccc

SEQ ID NO: 21854 - DNA, 25 bp, Mus musculus
aaatgactaccgtgtcttcaatccc

SEQ ID NO: 21855 - DNA, 25 bp, Mus musculus
aaatgactactacccagatcctgga

SEQ ID NO: 21856 - DNA, 25 bp, Mus musculus
aaatgactactagccagatcctgga

SEQ ID NO: 21857 - DNA, 25 bp, Mus musculus
aaatgactcactatggaaacccact

SEQ ID NO: 21858 - DNA, 25 bp, Mus musculus
aaatgactcactttggaaacccact

SEQ ID NO: 21859 - DNA, 25 bp, Mus musculus
aaatgactcagaatctcttcccctc

SEQ ID NO: 21860 - DNA, 25 bp, Mus musculus
aaatgactcagattctcttcccctc

SEQ ID NO: 21861 - DNA, 25 bp, Mus musculus
aaatgactcattatagacatgtggg

SEQ ID NO: 21862 - DNA, 25 bp, Mus musculus
aaatgactcattttagacatgtggg

SEQ ID NO: 21863 - DNA, 25 bp, Mus musculus
aaatgactccacaagcctactgaag

SEQ ID NO: 21864 - DNA, 25 bp, Mus musculus
aaatgactccacatctggcggtctg

SEQ ID NO: 21865 - DNA, 25 bp, Mus musculus
aaatgactccactagcctactgaag

SEQ ID NO: 21866 - DNA, 25 bp, Mus musculus
aaatgactccacttctggcggtctg

SEQ ID NO: 21867 - DNA, 25 bp, Mus musculus
aaatgactccgtaggtaaaggcact

SEQ ID NO: 21868 - DNA, 25 bp, Mus musculus
aaatgactccgttggtaaaggcact

SEQ ID NO: 21869 - DNA, 25 bp, Mus musculus
aaatgactcctgaaacgttgattgt

SEQ ID NO: 21870 - DNA, 25 bp, Mus musculus
aaatgactcctgatccgtgagctag

SEQ ID NO: 21871 - DNA, 25 bp, Mus musculus
aaatgactcctgtaacgttgattgt

SEQ ID NO: 21872 - DNA, 25 bp, Mus musculus
aaatgactcctgttccgtgagctag

SEQ ID NO: 21873 - DNA, 25 bp, Mus musculus
aaatgactccttctttgctaatgct

SEQ ID NO: 21874 - DNA, 25 bp, Mus musculus
aaatgactccttgtttgctaatgct

SEQ ID NO: 21875 - DNA, 25 bp, Mus musculus
aaatgactcgcacaaatgcaatttg

SEQ ID NO: 21876 - DNA, 25 bp, Mus musculus
aaatgactcgcagaaatgcaatttg

SEQ ID NO: 21877 - DNA, 25 bp, Mus musculus
aaatgactctaaccacaacacggaa

SEQ ID NO: 21878 - DNA, 25 bp, Mus musculus
aaatgactctaagcacaacacggaa

SEQ ID NO: 21879 - DNA, 25 bp, Mus musculus
aaatgactgacaaccactgacgcca

SEQ ID NO: 21880 - DNA, 25 bp, Mus musculus
aaatgactgacatccactgacgcca

SEQ ID NO: 21881 - DNA, 25 bp, Mus musculus
aaatgactgattaacctggaagggt

SEQ ID NO: 21882 - DNA, 25 bp, Mus musculus
aaatgactgatttacctggaagggt

SEQ ID NO: 21883 - DNA, 25 bp, Mus musculus
aaatgactggcacgcctcgtgtaag

SEQ ID NO: 21884 - DNA, 25 bp, Mus musculus
aaatgactggcaggcctcgtgtaag

SEQ ID NO: 21885 - DNA, 25 bp, Mus musculus
aaatgactgtatctgatatgaggat

SEQ ID NO: 21886 - DNA, 25 bp, Mus musculus
aaatgactgtatgtgatatgaggat

SEQ ID NO: 21887 - DNA, 25 bp, Mus musculus
aaatgactgtcactccctgtgcatg

SEQ ID NO: 21888 - DNA, 25 bp, Mus musculus
aaatgactgtcagtccctgtgcatg

SEQ ID NO: 21889 - DNA, 25 bp, Mus musculus
aaatgactgtgaaccttccaggaat

SEQ ID NO: 21890 - DNA, 25 bp, Mus musculus
aaatgactgtgatccttccaggaat

SEQ ID NO: 21891 - DNA, 25 bp, Mus musculus
aaatgactgtttacgctctttctgg

SEQ ID NO: 21892 - DNA, 25 bp, Mus musculus
aaatgactgttttcgctctttctgg

SEQ ID NO: 21893 - DNA, 25 bp, Mus musculus
aaatgacttattactgctctggaat

SEQ ID NO: 21894 - DNA, 25 bp, Mus musculus
aaatgacttatttctgctctggaat

SEQ ID NO: 21895 - DNA, 25 bp, Mus musculus
aaatgacttcatccgcctgactaga

SEQ ID NO: 21896 - DNA, 25 bp, Mus musculus
aaatgacttcatgcgcctgactaga

SEQ ID NO: 21897 - DNA, 25 bp, Mus musculus
aaatgacttccgctggccacaggac

SEQ ID NO: 21898 - DNA, 25 bp, Mus musculus
aaatgacttccggtggccacaggac

SEQ ID NO: 21899 - DNA, 25 bp, Mus musculus
aaatgacttcgtcttcctgactaaa

SEQ ID NO: 21900 - DNA, 25 bp, Mus musculus
aaatgacttcgtgttcctgactaaa

SEQ ID NO: 21901 - DNA, 25 bp, Mus musculus
aaatgacttctcattccatgccatg

SEQ ID NO: 21902 - DNA, 25 bp, Mus musculus
aaatgacttctctttccatgccatg

SEQ ID NO: 21903 - DNA, 25 bp, Mus musculus
aaatgacttgccacagattctggat

SEQ ID NO: 21904 - DNA, 25 bp, Mus musculus
aaatgacttgccctgatgtagttaa

SEQ ID NO: 21905 - DNA, 25 bp, Mus musculus
aaatgacttgccgtgatgtagttaa

SEQ ID NO: 21906 - DNA, 25 bp, Mus musculus
aaatgacttgcctcagattctggat

SEQ ID NO: 21907 - DNA, 25 bp, Mus musculus
aaatgacttgctcttctttgctttc

SEQ ID NO: 21908 - DNA, 25 bp, Mus musculus
aaatgacttgctgttctttgctttc

SEQ ID NO: 21909 - DNA, 25 bp, Mus musculus
aaatgacttgttcgatgcctttgct

SEQ ID NO: 21910 - DNA, 25 bp, Mus musculus
aaatgacttgttggatgcctttgct

SEQ ID NO: 21911 - DNA, 25 bp, Mus musculus
aaatgactttctcccggcataataa

SEQ ID NO: 21912 - DNA, 25 bp, Mus musculus
aaatgactttctgccggcataataa

SEQ ID NO: 21913 - DNA, 25 bp, Mus musculus
aaatgagaaacgatgcccacagact

SEQ ID NO: 21914 - DNA, 25 bp, Mus musculus
aaatgagaaacgttgcccacagact

SEQ ID NO: 21915 - DNA, 25 bp, Mus musculus
aaatgagaaaggagccaggccttgc

SEQ ID NO: 21916 - DNA, 25 bp, Mus musculus
aaatgagaaaggtgccaggccttgc

SEQ ID NO: 21917 - DNA, 25 bp, Mus musculus
aaatgagaaattaggacttcctcca

SEQ ID NO: 21918 - DNA, 25 bp, Mus musculus
aaatgagaaatttggacttcctcca

SEQ ID NO: 21919 - DNA, 25 bp, Mus musculus
aaatgagaacggaccctgtgtattt

SEQ ID NO: 21920 - DNA, 25 bp, Mus musculus
aaatgagaacggtccctgtgtattt

SEQ ID NO: 21921 - DNA, 25 bp, Mus musculus
aaatgagaatgtattgtgttattat

SEQ ID NO: 21922 - DNA, 25 bp, Mus musculus
aaatgagaatgttttgtgttattat

SEQ ID NO: 21923 - DNA, 25 bp, Mus musculus
aaatgagacattcgcctggtttcct

SEQ ID NO: 21924 - DNA, 25 bp, Mus musculus
aaatgagacattggcctggtttcct

SEQ ID NO: 21925 - DNA, 25 bp, Mus musculus
aaatgagacccacctgcagatgcct

SEQ ID NO: 21926 - DNA, 25 bp, Mus musculus
aaatgagacccagctgcagatgcct

SEQ ID NO: 21927 - DNA, 25 bp, Mus musculus
aaatgagacggtccccagtcgtttt

SEQ ID NO: 21928 - DNA, 25 bp, Mus musculus
aaatgagacggtgcccagtcgtttt

SEQ ID NO: 21929 - DNA, 25 bp, Mus musculus
aaatgagactctacacggctgagcc

SEQ ID NO: 21930 - DNA, 25 bp, Mus musculus
aaatgagactcttcacggctgagcc

SEQ ID NO: 21931 - DNA, 25 bp, Mus musculus
aaatgagagaggaccgttggacaac

SEQ ID NO: 21932 - DNA, 25 bp, Mus musculus
aaatgagagaggtccgttggacaac

SEQ ID NO: 21933 - DNA, 25 bp, Mus musculus
aaatgagagcagaacttccccaacc

SEQ ID NO: 21934 - DNA, 25 bp, Mus musculus
aaatgagagcagtacttccccaacc

SEQ ID NO: 21935 - DNA, 25 bp, Mus musculus
aaatgagagccacccaggacagcga

SEQ ID NO: 21936 - DNA, 25 bp, Mus musculus
aaatgagagccagccaggacagcga

SEQ ID NO: 21937 - DNA, 25 bp, Mus musculus
aaatgagaggaaccccaggccacct

SEQ ID NO: 21938 - DNA, 25 bp, Mus musculus
aaatgagaggaagcccaggccacct

SEQ ID NO: 21939 - DNA, 25 bp, Mus musculus
aaatgagagtccctccgatgttggc

SEQ ID NO: 21940 - DNA, 25 bp, Mus musculus
aaatgagagtccgtccgatgttggc

SEQ ID NO: 21941 - DNA, 25 bp, Mus musculus
aaatgagatcccctgtgttctggac

SEQ ID NO: 21942 - DNA, 25 bp, Mus musculus
aaatgagatcccgtgtgttctggac

SEQ ID NO: 21943 - DNA, 25 bp, Mus musculus
aaatgagatctgcacatgagctggg

SEQ ID NO: 21944 - DNA, 25 bp, Mus musculus
aaatgagatctggacatgagctggg

SEQ ID NO: 21945 - DNA, 25 bp, Mus musculus
aaatgagattgtcccttgcctgagt

SEQ ID NO: 21946 - DNA, 25 bp, Mus musculus
aaatgagattgtgccttgcctgagt

SEQ ID NO: 21947 - DNA, 25 bp, Mus musculus
aaatgagcaatgagcctgcagtgtc

SEQ ID NO: 21948 - DNA, 25 bp, Mus musculus
aaatgagcaatgtgcctgcagtgtc

SEQ ID NO: 21949 - DNA, 25 bp, Mus musculus
aaatgagcaccacgagctgcagacc

SEQ ID NO: 21950 - DNA, 25 bp, Mus musculus
aaatgagcaccaggagctgcagacc

SEQ ID NO: 21951 - DNA, 25 bp, Mus musculus
aaatgagcagtaatttgtctcttta

SEQ ID NO: 21952 - DNA, 25 bp, Mus musculus
aaatgagcagtattttgtctcttta

SEQ ID NO: 21953 - DNA, 25 bp, Mus musculus
aaatgagcatcacaacgtgtacgtc

SEQ ID NO: 21954 - DNA, 25 bp, Mus musculus
aaatgagcatcagaacgtgtacgtc

SEQ ID NO: 21955 - DNA, 25 bp, Mus musculus
aaatgagccaacagagcctttgtaa

SEQ ID NO: 21956 - DNA, 25 bp, Mus musculus
aaatgagccaactgagcctttgtaa

SEQ ID NO: 21957 - DNA, 25 bp, Mus musculus
aaatgagccagcagacaacacccat

SEQ ID NO: 21958 - DNA, 25 bp, Mus musculus
aaatgagccagctgacaacacccat

SEQ ID NO: 21959 - DNA, 25 bp, Mus musculus
aaatgagcccaaatgcctgctcact

SEQ ID NO: 21960 - DNA, 25 bp, Mus musculus
aaatgagcccaattgcctgctcact

SEQ ID NO: 21961 - DNA, 25 bp, Mus musculus
aaatgagcccctcatgtccttgatc

SEQ ID NO: 21962 - DNA, 25 bp, Mus musculus
aaatgagcccctgatgtccttgatc

SEQ ID NO: 21963 - DNA, 25 bp, Mus musculus
aaatgagcctacactctagaccctg

SEQ ID NO: 21964 - DNA, 25 bp, Mus musculus
aaatgagcctactctctagaccctg

SEQ ID NO: 21965 - DNA, 25 bp, Mus musculus
aaatgagcctgaaacctgtgtttca

SEQ ID NO: 21966 - DNA, 25 bp, Mus musculus
aaatgagcctgatacctgtgtttca

SEQ ID NO: 21967 - DNA, 25 bp, Mus musculus
aaatgagcctggcaaagaagataca

SEQ ID NO: 21968 - DNA, 25 bp, Mus musculus
aaatgagcctgggaaagaagataca

SEQ ID NO: 21969 - DNA, 25 bp, Mus musculus
aaatgagcgcacacctgagacacag

SEQ ID NO: 21970 - DNA, 25 bp, Mus musculus
aaatgagcgcactcctgagacacag

SEQ ID NO: 21971 - DNA, 25 bp, Mus musculus
aaatgagcgccgacttcctattcca

SEQ ID NO: 21972 - DNA, 25 bp, Mus musculus
aaatgagcgccgtcttcctattcca

SEQ ID NO: 21973 - DNA, 25 bp, Mus musculus
aaatgagctcacctctttgtcttga

SEQ ID NO: 21974 - DNA, 25 bp, Mus musculus
aaatgagctcacctgacaccttacc

SEQ ID NO: 21975 - DNA, 25 bp, Mus musculus
aaatgagctcacgtctttgtcttga

SEQ ID NO: 21976 - DNA, 25 bp, Mus musculus
aaatgagctcacgtgacaccttacc

SEQ ID NO: 21977 - DNA, 25 bp, Mus musculus
aaatgagctctgaggccacagccgc

SEQ ID NO: 21978 - DNA, 25 bp, Mus musculus
aaatgagctctgctttgggtgtcca

SEQ ID NO: 21979 - DNA, 25 bp, Mus musculus
aaatgagctctggtttgggtgtcca

SEQ ID NO: 21980 - DNA, 25 bp, Mus musculus
aaatgagctctgtggccacagccgc

SEQ ID NO: 21981 - DNA, 25 bp, Mus musculus
aaatgagctgataagctgtctccat

SEQ ID NO: 21982 - DNA, 25 bp, Mus musculus
aaatgagctgattagctgtctccat

SEQ ID NO: 21983 - DNA, 25 bp, Mus musculus
aaatgaggaactccacctccgtggc

SEQ ID NO: 21984 - DNA, 25 bp, Mus musculus
aaatgaggaactgcacctccgtggc

SEQ ID NO: 21985 - DNA, 25 bp, Mus musculus
aaatgaggaagacccagacgaggat

SEQ ID NO: 21986 - DNA, 25 bp, Mus musculus
aaatgaggaagagccagacgaggat

SEQ ID NO: 21987 - DNA, 25 bp, Mus musculus
aaatgaggcatcagaccaccggacg

SEQ ID NO: 21988 - DNA, 25 bp, Mus musculus
aaatgaggcatctgaccaccggacg

SEQ ID NO: 21989 - DNA, 25 bp, Mus musculus
aaatgaggccgacccacggttcgct

SEQ ID NO: 21990 - DNA, 25 bp, Mus musculus
aaatgaggccgagccacggttcgct

SEQ ID NO: 21991 - DNA, 25 bp, Mus musculus
aaatgaggctaaagaaccacttttt

SEQ ID NO: 21992 - DNA, 25 bp, Mus musculus
aaatgaggctaatgaaccacttttt

SEQ ID NO: 21993 - DNA, 25 bp, Mus musculus
aaatgaggctgacccctcactaggt

SEQ ID NO: 21994 - DNA, 25 bp, Mus musculus
aaatgaggctgagccctcactaggt

SEQ ID NO: 21995 - DNA, 25 bp, Mus musculus
aaatgaggctttagttggcgtttgc

SEQ ID NO: 21996 - DNA, 25 bp, Mus musculus
aaatgaggctttctgaaactggctg

SEQ ID NO: 21997 - DNA, 25 bp, Mus musculus
aaatgaggctttgtgaaactggctg

SEQ ID NO: 21998 - DNA, 25 bp, Mus musculus
aaatgaggcttttgttggcgtttgc

SEQ ID NO: 21999 - DNA, 25 bp, Mus musculus
aaatgagggcacaggctttcgaaaa

SEQ ID NO: 22000 - DNA, 25 bp, Mus musculus
aaatgagggcactggctttcgaaaa

SEQ ID NO: 22001 - DNA, 25 bp, Mus musculus
aaatgagggcccatgaaccatgcca

SEQ ID NO: 22002 - DNA, 25 bp, Mus musculus
aaatgagggcccttgaaccatgcca

SEQ ID NO: 22003 - DNA, 25 bp, Mus musculus
aaatgagggccgacaaggtggctca

SEQ ID NO: 22004 - DNA, 25 bp, Mus musculus
aaatgagggccgtcaaggtggctca

SEQ ID NO: 22005 - DNA, 25 bp, Mus musculus
aaatgaggtcacactcttttttcag

SEQ ID NO: 22006 - DNA, 25 bp, Mus musculus
aaatgaggtcactctcttttttcag

SEQ ID NO: 22007 - DNA, 25 bp, Mus musculus
aaatgaggtctgcatcactaggaag

SEQ ID NO: 22008 - DNA, 25 bp, Mus musculus
aaatgaggtctggatcactaggaag

SEQ ID NO: 22009 - DNA, 25 bp, Mus musculus
aaatgaggtgcgagatgccttccta

SEQ ID NO: 22010 - DNA, 25 bp, Mus musculus
aaatgaggtgcgtgatgccttccta

SEQ ID NO: 22011 - DNA, 25 bp, Mus musculus
aaatgaggtggaatctccgccagtt

SEQ ID NO: 22012 - DNA, 25 bp, Mus musculus
aaatgaggtggattctccgccagtt

SEQ ID NO: 22013 - DNA, 25 bp, Mus musculus
aaatgaggtgttccactgtgtccac

SEQ ID NO: 22014 - DNA, 25 bp, Mus musculus
aaatgaggtgttgcactgtgtccac

SEQ ID NO: 22015 - DNA, 25 bp, Mus musculus
aaatgaggttggacctcaacatgac

SEQ ID NO: 22016 - DNA, 25 bp, Mus musculus
aaatgaggttggtcctcaacatgac

SEQ ID NO: 22017 - DNA, 25 bp, Mus musculus
aaatgagtagagaacccagaagtga

SEQ ID NO: 22018 - DNA, 25 bp, Mus musculus
aaatgagtagagtacccagaagtga

SEQ ID NO: 22019 - DNA, 25 bp, Mus musculus
aaatgagtagatacactgtgccact

SEQ ID NO: 22020 - DNA, 25 bp, Mus musculus
aaatgagtagattcactgtgccact

SEQ ID NO: 22021 - DNA, 25 bp, Mus musculus
aaatgagtagtcacagcccaccagt

SEQ ID NO: 22022 - DNA, 25 bp, Mus musculus
aaatgagtagtctcagcccaccagt

SEQ ID NO: 22023 - DNA, 25 bp, Mus musculus
aaatgagtccaaactttctgctaga

SEQ ID NO: 22024 - DNA, 25 bp, Mus musculus
aaatgagtccaatctttctgctaga

SEQ ID NO: 22025 - DNA, 25 bp, Mus musculus
aaatgagtccaccagtttacagagt

SEQ ID NO: 22026 - DNA, 25 bp, Mus musculus
aaatgagtccacgagtttacagagt

SEQ ID NO: 22027 - DNA, 25 bp, Mus musculus
aaatgagtccttagagacctagcag

SEQ ID NO: 22028 - DNA, 25 bp, Mus musculus
aaatgagtcctttgagacctagcag

SEQ ID NO: 22029 - DNA, 25 bp, Mus musculus
aaatgagtcgcaaggctacgtctaa

SEQ ID NO: 22030 - DNA, 25 bp, Mus musculus
aaatgagtcgcatggctacgtctaa

SEQ ID NO: 22031 - DNA, 25 bp, Mus musculus
aaatgagtctcaagacttcccacct

SEQ ID NO: 22032 - DNA, 25 bp, Mus musculus
aaatgagtctcatgacttcccacct

SEQ ID NO: 22033 - DNA, 25 bp, Mus musculus
aaatgagtctctacgggtgacttga

SEQ ID NO: 22034 - DNA, 25 bp, Mus musculus
aaatgagtctcttcgggtgacttga

SEQ ID NO: 22035 - DNA, 25 bp, Mus musculus
aaatgagtctgactgtaagagccca

SEQ ID NO: 22036 - DNA, 25 bp, Mus musculus
aaatgagtctgagtgtaagagccca

SEQ ID NO: 22037 - DNA, 25 bp, Mus musculus
aaatgagtgaccagaggctttaaaa

SEQ ID NO: 22038 - DNA, 25 bp, Mus musculus
aaatgagtgacctgaggctttaaaa

SEQ ID NO: 22039 - DNA, 25 bp, Mus musculus
aaatgagtggtcacctttccctgtt

SEQ ID NO: 22040 - DNA, 25 bp, Mus musculus
aaatgagtggtctcctttccctgtt

SEQ ID NO: 22041 - DNA, 25 bp, Mus musculus
aaatgagtggttcggagtctccaga

SEQ ID NO: 22042 - DNA, 25 bp, Mus musculus
aaatgagtggttgggagtctccaga

SEQ ID NO: 22043 - DNA, 25 bp, Mus musculus
aaatgagttctcaggtcttcagaaa

SEQ ID NO: 22044 - DNA, 25 bp, Mus musculus
aaatgagttctctggtcttcagaaa

SEQ ID NO: 22045 - DNA, 25 bp, Mus musculus
aaatgagttctgagtgcaaaggcaa

SEQ ID NO: 22046 - DNA, 25 bp, Mus musculus
aaatgagttctgtgtgcaaaggcaa

SEQ ID NO: 22047 - DNA, 25 bp, Mus musculus
aaatgagtttggctgacctcgtcac

SEQ ID NO: 22048 - DNA, 25 bp, Mus musculus
aaatgagtttgggtgacctcgtcac

SEQ ID NO: 22049 - DNA, 25 bp, Mus musculus
aaatgatacataactgccggtaggg

SEQ ID NO: 22050 - DNA, 25 bp, Mus musculus
aaatgatacatatctgccggtaggg

SEQ ID NO: 22051 - DNA, 25 bp, Mus musculus
aaatgatacgctcactcatctgtcc

SEQ ID NO: 22052 - DNA, 25 bp, Mus musculus
aaatgatacgctgactcatctgtcc

SEQ ID NO: 22053 - DNA, 25 bp, Mus musculus
aaatgatcaacaacctcttgggccc

SEQ ID NO: 22054 - DNA, 25 bp, Mus musculus
aaatgatcaacatcctcttgggccc

SEQ ID NO: 22055 - DNA, 25 bp, Mus musculus
aaatgatcaaccataacctcccatg

SEQ ID NO: 22056 - DNA, 25 bp, Mus musculus
aaatgatcaaccttaacctcccatg

SEQ ID NO: 22057 - DNA, 25 bp, Mus musculus
aaatgatcaactctttaacccctgt

SEQ ID NO: 22058 - DNA, 25 bp, Mus musculus
aaatgatcaactgtttaacccctgt

SEQ ID NO: 22059 - DNA, 25 bp, Mus musculus
aaatgatcacttcatttcactgaca

SEQ ID NO: 22060 - DNA, 25 bp, Mus musculus
aaatgatcacttgatttcactgaca

SEQ ID NO: 22061 - DNA, 25 bp, Mus musculus
aaatgatcagccacagtccgataaa

SEQ ID NO: 22062 - DNA, 25 bp, Mus musculus
aaatgatcagcctcagtccgataaa

SEQ ID NO: 22063 - DNA, 25 bp, Mus musculus
aaatgatccagaattcgcttgcctc

SEQ ID NO: 22064 - DNA, 25 bp, Mus musculus
aaatgatccagatttcgcttgcctc

SEQ ID NO: 22065 - DNA, 25 bp, Mus musculus
aaatgatccagcctgttgtcattag

SEQ ID NO: 22066 - DNA, 25 bp, Mus musculus
aaatgatccagcgtgttgtcattag

SEQ ID NO: 22067 - DNA, 25 bp, Mus musculus
aaatgatccatgcaagacggttatt

SEQ ID NO: 22068 - DNA, 25 bp, Mus musculus
aaatgatccatggaagacggttatt

SEQ ID NO: 22069 - DNA, 25 bp, Mus musculus
aaatgatcccagagtccttggagcc

SEQ ID NO: 22070 - DNA, 25 bp, Mus musculus
aaatgatcccagtgtccttggagcc

SEQ ID NO: 22071 - DNA, 25 bp, Mus musculus
aaatgatcccgacagctagctggag

SEQ ID NO: 22072 - DNA, 25 bp, Mus musculus
aaatgatcccgagagctagctggag

SEQ ID NO: 22073 - DNA, 25 bp, Mus musculus
aaatgatccgttcattcccaagcaa

SEQ ID NO: 22074 - DNA, 25 bp, Mus musculus
aaatgatccgttgattcccaagcaa

SEQ ID NO: 22075 - DNA, 25 bp, Mus musculus
aaatgatcctagatagttttccctt

SEQ ID NO: 22076 - DNA, 25 bp, Mus musculus
aaatgatcctagcaggtgactgggt

SEQ ID NO: 22077 - DNA, 25 bp, Mus musculus
aaatgatcctaggaggtgactgggt

SEQ ID NO: 22078 - DNA, 25 bp, Mus musculus
aaatgatcctagttagttttccctt

SEQ ID NO: 22079 - DNA, 25 bp, Mus musculus
aaatgatcctggctgtcatcccggg

SEQ ID NO: 22080 - DNA, 25 bp, Mus musculus
aaatgatcctgggtgtcatcccggg

SEQ ID NO: 22081 - DNA, 25 bp, Mus musculus
aaatgatcgaataacctttaggcta

SEQ ID NO: 22082 - DNA, 25 bp, Mus musculus
aaatgatcgaattacctttaggcta

SEQ ID NO: 22083 - DNA, 25 bp, Mus musculus
aaatgatctactctggagctacccc

SEQ ID NO: 22084 - DNA, 25 bp, Mus musculus
aaatgatctactgtggagctacccc

SEQ ID NO: 22085 - DNA, 25 bp, Mus musculus
aaatgatctcatacaagttgttacc

SEQ ID NO: 22086 - DNA, 25 bp, Mus musculus
aaatgatctcattcaagttgttacc

SEQ ID NO: 22087 - DNA, 25 bp, Mus musculus
aaatgatctctaactgctattacag

SEQ ID NO: 22088 - DNA, 25 bp, Mus musculus
aaatgatctctatctgctattacag

SEQ ID NO: 22089 - DNA, 25 bp, Mus musculus
aaatgatctgcactggttctaacct

SEQ ID NO: 22090 - DNA, 25 bp, Mus musculus
aaatgatctgcagtggttctaacct

SEQ ID NO: 22091 - DNA, 25 bp, Mus musculus
aaatgatgaatgctccagaaactgg

SEQ ID NO: 22092 - DNA, 25 bp, Mus musculus
aaatgatgaatggtccagaaactgg

SEQ ID NO: 22093 - DNA, 25 bp, Mus musculus
aaatgatgagctccatatgggtgct

SEQ ID NO: 22094 - DNA, 25 bp, Mus musculus
aaatgatgagctgcatatgggtgct

SEQ ID NO: 22095 - DNA, 25 bp, Mus musculus
aaatgatgagttcttccgacccagg

SEQ ID NO: 22096 - DNA, 25 bp, Mus musculus
aaatgatgagttgttccgacccagg

SEQ ID NO: 22097 - DNA, 25 bp, Mus musculus
aaatgatgatggaaactgttgctgt

SEQ ID NO: 22098 - DNA, 25 bp, Mus musculus
aaatgatgatggtaactgttgctgt

SEQ ID NO: 22099 - DNA, 25 bp, Mus musculus
aaatgatgccaacgagagactccaa

SEQ ID NO: 22100 - DNA, 25 bp, Mus musculus
aaatgatgccaaggagagactccaa

SEQ ID NO: 22101 - DNA, 25 bp, Mus musculus
aaatgatgccccattgcccatagat

SEQ ID NO: 22102 - DNA, 25 bp, Mus musculus
aaatgatgcccctttgcccatagat

SEQ ID NO: 22103 - DNA, 25 bp, Mus musculus
aaatgatgcgtcaatgtgcccaatg

SEQ ID NO: 22104 - DNA, 25 bp, Mus musculus
aaatgatgcgtctatgtgcccaatg

SEQ ID NO: 22105 - DNA, 25 bp, Mus musculus
aaatgatgctttcttaaacctgaat

SEQ ID NO: 22106 - DNA, 25 bp, Mus musculus
aaatgatgctttgttaaacctgaat

SEQ ID NO: 22107 - DNA, 25 bp, Mus musculus
aaatgatggagcagtctctgtacaa

SEQ ID NO: 22108 - DNA, 25 bp, Mus musculus
aaatgatggagctgtctctgtacaa

SEQ ID NO: 22109 - DNA, 25 bp, Mus musculus
aaatgatggatcagggttcaggcaa

SEQ ID NO: 22110 - DNA, 25 bp, Mus musculus
aaatgatggatctgggttcaggcaa

SEQ ID NO: 22111 - DNA, 25 bp, Mus musculus
aaatgatgtaccacactggtcataa

SEQ ID NO: 22112 - DNA, 25 bp, Mus musculus
aaatgatgtacctcactggtcataa

SEQ ID NO: 22113 - DNA, 25 bp, Mus musculus
aaatgatgttgccatgccacgggaa

SEQ ID NO: 22114 - DNA, 25 bp, Mus musculus
aaatgatgttgcgatgccacgggaa

SEQ ID NO: 22115 - DNA, 25 bp, Mus musculus
aaatgattaaacaactccaccacaa

SEQ ID NO: 22116 - DNA, 25 bp, Mus musculus
aaatgattaaactactccaccacaa

SEQ ID NO: 22117 - DNA, 25 bp, Mus musculus
aaatgattagggagcttgaaacaaa

SEQ ID NO: 22118 - DNA, 25 bp, Mus musculus
aaatgattagggtgcttgaaacaaa

SEQ ID NO: 22119 - DNA, 25 bp, Mus musculus
aaatgattagtgaactgtctgaaac

SEQ ID NO: 22120 - DNA, 25 bp, Mus musculus
aaatgattagtgtactgtctgaaac

SEQ ID NO: 22121 - DNA, 25 bp, Mus musculus
aaatgattcaccaggcactggcatg

SEQ ID NO: 22122 - DNA, 25 bp, Mus musculus
aaatgattcacctggcactggcatg

SEQ ID NO: 22123 - DNA, 25 bp, Mus musculus
aaatgattcccaaaatgtgccggtg

SEQ ID NO: 22124 - DNA, 25 bp, Mus musculus
aaatgattcccacactctggcccac

SEQ ID NO: 22125 - DNA, 25 bp, Mus musculus
aaatgattcccagactctggcccac

SEQ ID NO: 22126 - DNA, 25 bp, Mus musculus
aaatgattcccataatgtgccggtg

SEQ ID NO: 22127 - DNA, 25 bp, Mus musculus
aaatgattctcaactgcaggtcaaa

SEQ ID NO: 22128 - DNA, 25 bp, Mus musculus
aaatgattctcatctgcaggtcaaa

SEQ ID NO: 22129 - DNA, 25 bp, Mus musculus
aaatgattctggacacccaggttca

SEQ ID NO: 22130 - DNA, 25 bp, Mus musculus
aaatgattctggtcacccaggttca

SEQ ID NO: 22131 - DNA, 25 bp, Mus musculus
aaatgattctgtagtaattccttaa

SEQ ID NO: 22132 - DNA, 25 bp, Mus musculus
aaatgattctgttgtaattccttaa

SEQ ID NO: 22133 - DNA, 25 bp, Mus musculus
aaatgattctttaggcagacagaga

SEQ ID NO: 22134 - DNA, 25 bp, Mus musculus
aaatgattcttttggcagacagaga

SEQ ID NO: 22135 - DNA, 25 bp, Mus musculus
aaatgattgatcacagccgggcgtg

SEQ ID NO: 22136 - DNA, 25 bp, Mus musculus
aaatgattgatctcagccgggcgtg

SEQ ID NO: 22137 - DNA, 25 bp, Mus musculus
aaatgattgccgaggctatccctga

SEQ ID NO: 22138 - DNA, 25 bp, Mus musculus
aaatgattgccgtggctatccctga

SEQ ID NO: 22139 - DNA, 25 bp, Mus musculus
aaatgattgctcatgtctgtggtct

SEQ ID NO: 22140 - DNA, 25 bp, Mus musculus
aaatgattgctcttgtctgtggtct

SEQ ID NO: 22141 - DNA, 25 bp, Mus musculus
aaatgattggttctattcgagcttt

SEQ ID NO: 22142 - DNA, 25 bp, Mus musculus
aaatgattggttgtattcgagcttt

SEQ ID NO: 22143 - DNA, 25 bp, Mus musculus
aaatgattgtccctataacgccctg

SEQ ID NO: 22144 - DNA, 25 bp, Mus musculus
aaatgattgtccgtataacgccctg

SEQ ID NO: 22145 - DNA, 25 bp, Mus musculus
aaatgattgtgccactacacgtccg

SEQ ID NO: 22146 - DNA, 25 bp, Mus musculus
aaatgattgtgcgactacacgtccg

SEQ ID NO: 22147 - DNA, 25 bp, Mus musculus
aaatgatttccaagtgttcggctct

SEQ ID NO: 22148 - DNA, 25 bp, Mus musculus
aaatgatttccatgtgttcggctct

SEQ ID NO: 22149 - DNA, 25 bp, Mus musculus
aaatgatttcccatatcaaccttgg

SEQ ID NO: 22150 - DNA, 25 bp, Mus musculus
aaatgatttcccttatcaaccttgg

SEQ ID NO: 22151 - DNA, 25 bp, Mus musculus
aaatgatttggcagtgtctcttggg

SEQ ID NO: 22152 - DNA, 25 bp, Mus musculus
aaatgatttggctgtgtctcttggg

SEQ ID NO: 22153 - DNA, 25 bp, Mus musculus
aaatgatttttgcactgtctggaaa

SEQ ID NO: 22154 - DNA, 25 bp, Mus musculus
aaatgatttttggactgtctggaaa

SEQ ID NO: 22155 - DNA, 25 bp, Mus musculus
aaatgcaaaagtcagggtctctaca

SEQ ID NO: 22156 - DNA, 25 bp, Mus musculus
aaatgcaaaagtgagggtctctaca

SEQ ID NO: 22157 - DNA, 25 bp, Mus musculus
aaatgcaaaccccttgcctcttggg

SEQ ID NO: 22158 - DNA, 25 bp, Mus musculus
aaatgcaaacccgttgcctcttggg

SEQ ID NO: 22159 - DNA, 25 bp, Mus musculus
aaatgcaaactcctcagttccacaa

SEQ ID NO: 22160 - DNA, 25 bp, Mus musculus
aaatgcaaactcgtcagttccacaa

SEQ ID NO: 22161 - DNA, 25 bp, Mus musculus
aaatgcaacagaagctgggtttggt

SEQ ID NO: 22162 - DNA, 25 bp, Mus musculus
aaatgcaacagatgctgggtttggt

SEQ ID NO: 22163 - DNA, 25 bp, Mus musculus
aaatgcaacatgatgctctgggtta

SEQ ID NO: 22164 - DNA, 25 bp, Mus musculus
aaatgcaacatgttgctctgggtta

SEQ ID NO: 22165 - DNA, 25 bp, Mus musculus
aaatgcaaccctacaacgtggacaa

SEQ ID NO: 22166 - DNA, 25 bp, Mus musculus
aaatgcaacccttcaacgtggacaa

SEQ ID NO: 22167 - DNA, 25 bp, Mus musculus
aaatgcaacgctcgcagcctgtgca

SEQ ID NO: 22168 - DNA, 25 bp, Mus musculus
aaatgcaacgctggcagcctgtgca

SEQ ID NO: 22169 - DNA, 25 bp, Mus musculus
aaatgcaactgcacacgatgctaaa

SEQ ID NO: 22170 - DNA, 25 bp, Mus musculus
aaatgcaactgctcacgatgctaaa

SEQ ID NO: 22171 - DNA, 25 bp, Mus musculus
aaatgcaagaaccttgtgcccctct

SEQ ID NO: 22172 - DNA, 25 bp, Mus musculus
aaatgcaagaacgttgtgcccctct

SEQ ID NO: 22173 - DNA, 25 bp, Mus musculus
aaatgcaagcatactcctaaaagag

SEQ ID NO: 22174 - DNA, 25 bp, Mus musculus
aaatgcaagcattctcctaaaagag

SEQ ID NO: 22175 - DNA, 25 bp, Mus musculus
aaatgcaagggacgctgccagcaat

SEQ ID NO: 22176 - DNA, 25 bp, Mus musculus
aaatgcaagggaggctgccagcaat

SEQ ID NO: 22177 - DNA, 25 bp, Mus musculus
aaatgcaagtgtcctgcatggcagc

SEQ ID NO: 22178 - DNA, 25 bp, Mus musculus
aaatgcaagtgtgctgcatggcagc

SEQ ID NO: 22179 - DNA, 25 bp, Mus musculus
aaatgcaataagagtttgtggccat

SEQ ID NO: 22180 - DNA, 25 bp, Mus musculus
aaatgcaataagtgtttgtggccat

SEQ ID NO: 22181 - DNA, 25 bp, Mus musculus
aaatgcaatactctgtctcctgtca

SEQ ID NO: 22182 - DNA, 25 bp, Mus musculus
aaatgcaatactgtgtctcctgtca

SEQ ID NO: 22183 - DNA, 25 bp, Mus musculus
aaatgcacaacactgacccatcata

SEQ ID NO: 22184 - DNA, 25 bp, Mus musculus
aaatgcacaacagtgacccatcata

SEQ ID NO: 22185 - DNA, 25 bp, Mus musculus
aaatgcacaaggcatttgagctcag

SEQ ID NO: 22186 - DNA, 25 bp, Mus musculus
aaatgcacaagggatttgagctcag

SEQ ID NO: 22187 - DNA, 25 bp, Mus musculus
aaatgcacacggatctcttaataaa

SEQ ID NO: 22188 - DNA, 25 bp, Mus musculus
aaatgcacacggttctcttaataaa

SEQ ID NO: 22189 - DNA, 25 bp, Mus musculus
aaatgcacaggcatcgtgttatgaa

SEQ ID NO: 22190 - DNA, 25 bp, Mus musculus
aaatgcacaggcttcgtgttatgaa

SEQ ID NO: 22191 - DNA, 25 bp, Mus musculus
aaatgcacagtaatacacagccatc

SEQ ID NO: 22192 - DNA, 25 bp, Mus musculus
aaatgcacagtattacacagccatc

SEQ ID NO: 22193 - DNA, 25 bp, Mus musculus
aaatgcacatagaaaagggcagtgt

SEQ ID NO: 22194 - DNA, 25 bp, Mus musculus
aaatgcacatagtaaagggcagtgt

SEQ ID NO: 22195 - DNA, 25 bp, Mus musculus
aaatgcaccagccttgtggcccgtc

SEQ ID NO: 22196 - DNA, 25 bp, Mus musculus
aaatgcaccagcgttgtggcccgtc

SEQ ID NO: 22197 - DNA, 25 bp, Mus musculus
aaatgcaccatgaccaaccgtacgg

SEQ ID NO: 22198 - DNA, 25 bp, Mus musculus
aaatgcaccatgtccaaccgtacgg

SEQ ID NO: 22199 - DNA, 25 bp, Mus musculus
aaatgcaccattactgttgagcttc

SEQ ID NO: 22200 - DNA, 25 bp, Mus musculus
aaatgcaccatttctgttgagcttc

SEQ ID NO: 22201 - DNA, 25 bp, Mus musculus
aaatgcacctcgcagaaattactgt

SEQ ID NO: 22202 - DNA, 25 bp, Mus musculus
aaatgcacctcggagaaattactgt

SEQ ID NO: 22203 - DNA, 25 bp, Mus musculus
aaatgcactcttaaaccgtggttat

SEQ ID NO: 22204 - DNA, 25 bp, Mus musculus
aaatgcactctttaaccgtggttat

SEQ ID NO: 22205 - DNA, 25 bp, Mus musculus
aaatgcactgccactagggaacctg

SEQ ID NO: 22206 - DNA, 25 bp, Mus musculus
aaatgcactgcctctagggaacctg

SEQ ID NO: 22207 - DNA, 25 bp, Mus musculus
aaatgcagaattacaggaccccagt

SEQ ID NO: 22208 - DNA, 25 bp, Mus musculus
aaatgcagaatttcaggaccccagt

SEQ ID NO: 22209 - DNA, 25 bp, Mus musculus
aaatgcagactaatgcagtcaaatt

SEQ ID NO: 22210 - DNA, 25 bp, Mus musculus
aaatgcagactattgcagtcaaatt

SEQ ID NO: 22211 - DNA, 25 bp, Mus musculus
aaatgcagaggtcagcccttcgaag

SEQ ID NO: 22212 - DNA, 25 bp, Mus musculus
aaatgcagaggtgagcccttcgaag

SEQ ID NO: 22213 - DNA, 25 bp, Mus musculus
aaatgcagatccacacacttgctgt

SEQ ID NO: 22214 - DNA, 25 bp, Mus musculus
aaatgcagatcctcacacttgctgt

SEQ ID NO: 22215 - DNA, 25 bp, Mus musculus
aaatgcagcaagaaccctctatgca

SEQ ID NO: 22216 - DNA, 25 bp, Mus musculus
aaatgcagcaagtaccctctatgca

SEQ ID NO: 22217 - DNA, 25 bp, Mus musculus
aaatgcagccttacagccaaatcag

SEQ ID NO: 22218 - DNA, 25 bp, Mus musculus
aaatgcagcctttcagccaaatcag

SEQ ID NO: 22219 - DNA, 25 bp, Mus musculus
aaatgcagcgccactaaagctctgt

SEQ ID NO: 22220 - DNA, 25 bp, Mus musculus
aaatgcagcgcctctaaagctctgt

SEQ ID NO: 22221 - DNA, 25 bp, Mus musculus
aaatgcagcggaccacctgcttgaa

SEQ ID NO: 22222 - DNA, 25 bp, Mus musculus
aaatgcagcggagcacctgcttgaa

SEQ ID NO: 22223 - DNA, 25 bp, Mus musculus
aaatgcagctacattccgagataga

SEQ ID NO: 22224 - DNA, 25 bp, Mus musculus
aaatgcagctactttccgagataga

SEQ ID NO: 22225 - DNA, 25 bp, Mus musculus
aaatgcagctgactgctgccgtcag

SEQ ID NO: 22226 - DNA, 25 bp, Mus musculus
aaatgcagctgagtgctgccgtcag

SEQ ID NO: 22227 - DNA, 25 bp, Mus musculus
aaatgcagcttcactttccaggtac

SEQ ID NO: 22228 - DNA, 25 bp, Mus musculus
aaatgcagcttctctttccaggtac

SEQ ID NO: 22229 - DNA, 25 bp, Mus musculus
aaatgcagctttagacttctccaaa

SEQ ID NO: 22230 - DNA, 25 bp, Mus musculus
aaatgcagcttttgacttctccaaa

SEQ ID NO: 22231 - DNA, 25 bp, Mus musculus
aaatgcaggagtatacccacgtggg

SEQ ID NO: 22232 - DNA, 25 bp, Mus musculus
aaatgcaggagtttacccacgtggg

SEQ ID NO: 22233 - DNA, 25 bp, Mus musculus
aaatgcaggcatctgctgccttcaa

SEQ ID NO: 22234 - DNA, 25 bp, Mus musculus
aaatgcaggcatgtgctgccttcaa

SEQ ID NO: 22235 - DNA, 25 bp, Mus musculus
aaatgcaggctgcaggattaagcca

SEQ ID NO: 22236 - DNA, 25 bp, Mus musculus
aaatgcaggctggaggattaagcca

SEQ ID NO: 22237 - DNA, 25 bp, Mus musculus
aaatgcagggtacagcccgtgtcta

SEQ ID NO: 22238 - DNA, 25 bp, Mus musculus
aaatgcagggtagagcccgtgtcta

SEQ ID NO: 22239 - DNA, 25 bp, Mus musculus
aaatgcaggtctcggcacctaacac

SEQ ID NO: 22240 - DNA, 25 bp, Mus musculus
aaatgcaggtctgggcacctaacac

SEQ ID NO: 22241 - DNA, 25 bp, Mus musculus
aaatgcagtatgacgttctgggcct

SEQ ID NO: 22242 - DNA, 25 bp, Mus musculus
aaatgcagtatgtcgttctgggcct

SEQ ID NO: 22243 - DNA, 25 bp, Mus musculus
aaatgcagtccacctctgtaagcct

SEQ ID NO: 22244 - DNA, 25 bp, Mus musculus
aaatgcagtccagctctgtaagcct

SEQ ID NO: 22245 - DNA, 25 bp, Mus musculus
aaatgcagtggccatctggcattcc

SEQ ID NO: 22246 - DNA, 25 bp, Mus musculus
aaatgcagtggcgatctggcattcc

SEQ ID NO: 22247 - DNA, 25 bp, Mus musculus
aaatgcagttgcataccacagttaa

SEQ ID NO: 22248 - DNA, 25 bp, Mus musculus
aaatgcagttgcttaccacagttaa

SEQ ID NO: 22249 - DNA, 25 bp, Mus musculus
aaatgcagttttaggtctcagagga

SEQ ID NO: 22250 - DNA, 25 bp, Mus musculus
aaatgcagtttttggtctcagagga

SEQ ID NO: 22251 - DNA, 25 bp, Mus musculus
aaatgcataaaacagcctaggctat

SEQ ID NO: 22252 - DNA, 25 bp, Mus musculus
aaatgcataaaagagcctaggctat

SEQ ID NO: 22253 - DNA, 25 bp, Mus musculus
aaatgcataattctgcttcctgtct

SEQ ID NO: 22254 - DNA, 25 bp, Mus musculus
aaatgcataattgtgcttcctgtct

SEQ ID NO: 22255 - DNA, 25 bp, Mus musculus
aaatgcatacatcctttgatccccc

SEQ ID NO: 22256 - DNA, 25 bp, Mus musculus
aaatgcatacatgctttgatccccc

SEQ ID NO: 22257 - DNA, 25 bp, Mus musculus
aaatgcatagtaactgacaacccag

SEQ ID NO: 22258 - DNA, 25 bp, Mus musculus
aaatgcatagtatctgacaacccag

SEQ ID NO: 22259 - DNA, 25 bp, Mus musculus
aaatgcatcaatagctcagtctaag

SEQ ID NO: 22260 - DNA, 25 bp, Mus musculus
aaatgcatcaattgctcagtctaag

SEQ ID NO: 22261 - DNA, 25 bp, Mus musculus
aaatgcatccatactaacctttccc

SEQ ID NO: 22262 - DNA, 25 bp, Mus musculus
aaatgcatccatagccaggccagaa

SEQ ID NO: 22263 - DNA, 25 bp, Mus musculus
aaatgcatccattctaacctttccc

SEQ ID NO: 22264 - DNA, 25 bp, Mus musculus
aaatgcatccattgccaggccagaa

SEQ ID NO: 22265 - DNA, 25 bp, Mus musculus
aaatgcatcccaagccgcaggaggc

SEQ ID NO: 22266 - DNA, 25 bp, Mus musculus
aaatgcatcccatgccgcaggaggc

SEQ ID NO: 22267 - DNA, 25 bp, Mus musculus
aaatgcatcccgaccttcaattttt

SEQ ID NO: 22268 - DNA, 25 bp, Mus musculus
aaatgcatcccgtccttcaattttt

SEQ ID NO: 22269 - DNA, 25 bp, Mus musculus
aaatgcatccctcatctcattcatt

SEQ ID NO: 22270 - DNA, 25 bp, Mus musculus
aaatgcatccctgatctcattcatt

SEQ ID NO: 22271 - DNA, 25 bp, Mus musculus
aaatgcatccggattcctcagaaat

SEQ ID NO: 22272 - DNA, 25 bp, Mus musculus
aaatgcatccggtttcctcagaaat

SEQ ID NO: 22273 - DNA, 25 bp, Mus musculus
aaatgcatcgcaaccttggacaaac

SEQ ID NO: 22274 - DNA, 25 bp, Mus musculus
aaatgcatcgcatccttggacaaac

SEQ ID NO: 22275 - DNA, 25 bp, Mus musculus
aaatgcatctccagtgaatgttcca

SEQ ID NO: 22276 - DNA, 25 bp, Mus musculus
aaatgcatctcctgtgaatgttcca

SEQ ID NO: 22277 - DNA, 25 bp, Mus musculus
aaatgcatctctacctatgaataag

SEQ ID NO: 22278 - DNA, 25 bp, Mus musculus
aaatgcatctctcctctctatgttc

SEQ ID NO: 22279 - DNA, 25 bp, Mus musculus
aaatgcatctctgctctctatgttc

SEQ ID NO: 22280 - DNA, 25 bp, Mus musculus
aaatgcatctcttcctatgaataag

SEQ ID NO: 22281 - DNA, 25 bp, Mus musculus
aaatgcatctttagacttcatgcta

SEQ ID NO: 22282 - DNA, 25 bp, Mus musculus
aaatgcatcttttgacttcatgcta

SEQ ID NO: 22283 - DNA, 25 bp, Mus musculus
aaatgcatgcggctgtgctgactca

SEQ ID NO: 22284 - DNA, 25 bp, Mus musculus
aaatgcatgcgggtgtgctgactca

SEQ ID NO: 22285 - DNA, 25 bp, Mus musculus
aaatgcatggccattgttccaggtc

SEQ ID NO: 22286 - DNA, 25 bp, Mus musculus
aaatgcatggccctgccgttagaca

SEQ ID NO: 22287 - DNA, 25 bp, Mus musculus
aaatgcatggccgtgccgttagaca

SEQ ID NO: 22288 - DNA, 25 bp, Mus musculus
aaatgcatggcctttgttccaggtc

SEQ ID NO: 22289 - DNA, 25 bp, Mus musculus
aaatgcatggttcatctctgggaga

SEQ ID NO: 22290 - DNA, 25 bp, Mus musculus
aaatgcatggttgatctctgggaga

SEQ ID NO: 22291 - DNA, 25 bp, Mus musculus
aaatgcatgtgcctacctgttcacg

SEQ ID NO: 22292 - DNA, 25 bp, Mus musculus
aaatgcatgtgcgtacctgttcacg

SEQ ID NO: 22293 - DNA, 25 bp, Mus musculus
aaatgcattgagagattggccctga

SEQ ID NO: 22294 - DNA, 25 bp, Mus musculus
aaatgcattgagtgattggccctga

SEQ ID NO: 22295 - DNA, 25 bp, Mus musculus
aaatgcatttgtagatcatttctag

SEQ ID NO: 22296 - DNA, 25 bp, Mus musculus
aaatgcatttgttgatcatttctag

SEQ ID NO: 22297 - DNA, 25 bp, Mus musculus
aaatgcattttcatgttctacatct

SEQ ID NO: 22298 - DNA, 25 bp, Mus musculus
aaatgcattttcattgtcctagaac

SEQ ID NO: 22299 - DNA, 25 bp, Mus musculus
aaatgcattttcttgttctacatct

SEQ ID NO: 22300 - DNA, 25 bp, Mus musculus
aaatgcattttctttgtcctagaac

SEQ ID NO: 22301 - DNA, 25 bp, Mus musculus
aaatgccaaaaccatgaccacgtcc

SEQ ID NO: 22302 - DNA, 25 bp, Mus musculus
aaatgccaaaacgatgaccacgtcc

SEQ ID NO: 22303 - DNA, 25 bp, Mus musculus
aaatgccaaattactaggtgctaat

SEQ ID NO: 22304 - DNA, 25 bp, Mus musculus
aaatgccaaatttctaggtgctaat

SEQ ID NO: 22305 - DNA, 25 bp, Mus musculus
aaatgccaagtacgctcctgtaatg

SEQ ID NO: 22306 - DNA, 25 bp, Mus musculus
aaatgccaagtaggctcctgtaatg

SEQ ID NO: 22307 - DNA, 25 bp, Mus musculus
aaatgccaagtgcaactaatttctt

SEQ ID NO: 22308 - DNA, 25 bp, Mus musculus
aaatgccaagtggaactaatttctt

SEQ ID NO: 22309 - DNA, 25 bp, Mus musculus
aaatgccaatcactggtcacgggat

SEQ ID NO: 22310 - DNA, 25 bp, Mus musculus
aaatgccaatcagtggtcacgggat

SEQ ID NO: 22311 - DNA, 25 bp, Mus musculus
aaatgccaatcccactttaactatg

SEQ ID NO: 22312 - DNA, 25 bp, Mus musculus
aaatgccaatccgactttaactatg

SEQ ID NO: 22313 - DNA, 25 bp, Mus musculus
aaatgccaatctaccatattagttg

SEQ ID NO: 22314 - DNA, 25 bp, Mus musculus
aaatgccaatcttccatattagttg

SEQ ID NO: 22315 - DNA, 25 bp, Mus musculus
aaatgccacatacctgtagtttcag

SEQ ID NO: 22316 - DNA, 25 bp, Mus musculus
aaatgccacatagctgtagtttcag

SEQ ID NO: 22317 - DNA, 25 bp, Mus musculus
aaatgccacctcagaatggtgccat

SEQ ID NO: 22318 - DNA, 25 bp, Mus musculus
aaatgccacctcaggacaggatact

SEQ ID NO: 22319 - DNA, 25 bp, Mus musculus
aaatgccacctctgaatggtgccat

SEQ ID NO: 22320 - DNA, 25 bp, Mus musculus
aaatgccacctctggacaggatact

SEQ ID NO: 22321 - DNA, 25 bp, Mus musculus
aaatgccacggtccgcttgcggagc

SEQ ID NO: 22322 - DNA, 25 bp, Mus musculus
aaatgccacggtgcgcttgcggagc

SEQ ID NO: 22323 - DNA, 25 bp, Mus musculus
aaatgccagcctaggaattccatga

SEQ ID NO: 22324 - DNA, 25 bp, Mus musculus
aaatgccagccttggaattccatga

SEQ ID NO: 22325 - DNA, 25 bp, Mus musculus
aaatgccaggagagggctgtttact

SEQ ID NO: 22326 - DNA, 25 bp, Mus musculus
aaatgccaggagtgggctgtttact

SEQ ID NO: 22327 - DNA, 25 bp, Mus musculus
aaatgccagggaacgactccatctt

SEQ ID NO: 22328 - DNA, 25 bp, Mus musculus
aaatgccagggaattctgacgtcaa

SEQ ID NO: 22329 - DNA, 25 bp, Mus musculus
aaatgccagggatcgactccatctt

SEQ ID NO: 22330 - DNA, 25 bp, Mus musculus
aaatgccagggatttctgacgtcaa

SEQ ID NO: 22331 - DNA, 25 bp, Mus musculus
aaatgccagggcaattcttgggttc

SEQ ID NO: 22332 - DNA, 25 bp, Mus musculus
aaatgccagggctattcttgggttc

SEQ ID NO: 22333 - DNA, 25 bp, Mus musculus
aaatgccagggtaggctaggcctgc

SEQ ID NO: 22334 - DNA, 25 bp, Mus musculus
aaatgccagggttggctaggcctgc

SEQ ID NO: 22335 - DNA, 25 bp, Mus musculus
aaatgccaggttacctgtgcctccc

SEQ ID NO: 22336 - DNA, 25 bp, Mus musculus
aaatgccaggtttcctgtgcctccc

SEQ ID NO: 22337 - DNA, 25 bp, Mus musculus
aaatgccagtagctctaaggatcac

SEQ ID NO: 22338 - DNA, 25 bp, Mus musculus
aaatgccagtaggtctaaggatcac

SEQ ID NO: 22339 - DNA, 25 bp, Mus musculus
aaatgccagtgactgtctccatagc

SEQ ID NO: 22340 - DNA, 25 bp, Mus musculus
aaatgccagtgagtgtctccatagc

SEQ ID NO: 22341 - DNA, 25 bp, Mus musculus
aaatgccagttcacgttccctaaag

SEQ ID NO: 22342 - DNA, 25 bp, Mus musculus
aaatgccagttctcgttccctaaag

SEQ ID NO: 22343 - DNA, 25 bp, Mus musculus
aaatgccagtttcggatgcagtcca

SEQ ID NO: 22344 - DNA, 25 bp, Mus musculus
aaatgccagtttgggatgcagtcca

SEQ ID NO: 22345 - DNA, 25 bp, Mus musculus
aaatgccatcccctgtcaggatgtt

SEQ ID NO: 22346 - DNA, 25 bp, Mus musculus
aaatgccatcccgtgtcaggatgtt

SEQ ID NO: 22347 - DNA, 25 bp, Mus musculus
aaatgccatcgcagtttgcagttca

SEQ ID NO: 22348 - DNA, 25 bp, Mus musculus
aaatgccatcgcataccacaatgat

SEQ ID NO: 22349 - DNA, 25 bp, Mus musculus
aaatgccatcgctgtttgcagttca

SEQ ID NO: 22350 - DNA, 25 bp, Mus musculus
aaatgccatcgcttaccacaatgat

SEQ ID NO: 22351 - DNA, 25 bp, Mus musculus
aaatgccatgcactcagacccagtg

SEQ ID NO: 22352 - DNA, 25 bp, Mus musculus
aaatgccatgcagtcagacccagtg

SEQ ID NO: 22353 - DNA, 25 bp, Mus musculus
aaatgccatggcctctgttattttg

SEQ ID NO: 22354 - DNA, 25 bp, Mus musculus
aaatgccatggcgtctgttattttg

SEQ ID NO: 22355 - DNA, 25 bp, Mus musculus
aaatgccatgtcacactccaggtaa

SEQ ID NO: 22356 - DNA, 25 bp, Mus musculus
aaatgccatgtctcactccaggtaa

SEQ ID NO: 22357 - DNA, 25 bp, Mus musculus
aaatgccattctactatacttttag

SEQ ID NO: 22358 - DNA, 25 bp, Mus musculus
aaatgccattcttctatacttttag

SEQ ID NO: 22359 - DNA, 25 bp, Mus musculus
aaatgccatttaatgatgcctctta

SEQ ID NO: 22360 - DNA, 25 bp, Mus musculus
aaatgccatttattgatgcctctta

SEQ ID NO: 22361 - DNA, 25 bp, Mus musculus
aaatgcccaaagctaagtctgcccc

SEQ ID NO: 22362 - DNA, 25 bp, Mus musculus
aaatgcccaaaggtaagtctgcccc

SEQ ID NO: 22363 - DNA, 25 bp, Mus musculus
aaatgcccaattcctccctgaagga

SEQ ID NO: 22364 - DNA, 25 bp, Mus musculus
aaatgcccaattgctccctgaagga

SEQ ID NO: 22365 - DNA, 25 bp, Mus musculus
aaatgcccaccgagtacgggtatct

SEQ ID NO: 22366 - DNA, 25 bp, Mus musculus
aaatgcccaccgtgtacgggtatct

SEQ ID NO: 22367 - DNA, 25 bp, Mus musculus
aaatgcccacgaccaagtcctggaa

SEQ ID NO: 22368 - DNA, 25 bp, Mus musculus
aaatgcccacgagcaagtcctggaa

SEQ ID NO: 22369 - DNA, 25 bp, Mus musculus
aaatgcccagcccttctatgttatc

SEQ ID NO: 22370 - DNA, 25 bp, Mus musculus
aaatgcccagccgttctatgttatc

SEQ ID NO: 22371 - DNA, 25 bp, Mus musculus
aaatgcccagttagggatggctcag

SEQ ID NO: 22372 - DNA, 25 bp, Mus musculus
aaatgcccagtttgggatggctcag

SEQ ID NO: 22373 - DNA, 25 bp, Mus musculus
aaatgcccatggaggcctgaagagt

SEQ ID NO: 22374 - DNA, 25 bp, Mus musculus
aaatgcccatggtggcctgaagagt

SEQ ID NO: 22375 - DNA, 25 bp, Mus musculus
aaatgccccaataaatgtcctaagt

SEQ ID NO: 22376 - DNA, 25 bp, Mus musculus
aaatgccccaattaatgtcctaagt

SEQ ID NO: 22377 - DNA, 25 bp, Mus musculus
aaatgccccattaccaagtgatcag

SEQ ID NO: 22378 - DNA, 25 bp, Mus musculus
aaatgccccatttccaagtgatcag

SEQ ID NO: 22379 - DNA, 25 bp, Mus musculus
aaatgcccctgtaccataagtcatt

SEQ ID NO: 22380 - DNA, 25 bp, Mus musculus
aaatgcccctgttccataagtcatt

SEQ ID NO: 22381 - DNA, 25 bp, Mus musculus
aaatgcccgtccaatagagtgtctg

SEQ ID NO: 22382 - DNA, 25 bp, Mus musculus
aaatgcccgtcctatagagtgtctg

SEQ ID NO: 22383 - DNA, 25 bp, Mus musculus
aaatgccctcccaaggcttggctgg

SEQ ID NO: 22384 - DNA, 25 bp, Mus musculus
aaatgccctccctaggcttggctgg

SEQ ID NO: 22385 - DNA, 25 bp, Mus musculus
aaatgccctctgacccagggatggg

SEQ ID NO: 22386 - DNA, 25 bp, Mus musculus
aaatgccctctgtcccagggatggg

SEQ ID NO: 22387 - DNA, 25 bp, Mus musculus
aaatgccctgaactcctggaatgag

SEQ ID NO: 22388 - DNA, 25 bp, Mus musculus
aaatgccctgaagtcctggaatgag

SEQ ID NO: 22389 - DNA, 25 bp, Mus musculus
aaatgccctgcacacgtgccatagt

SEQ ID NO: 22390 - DNA, 25 bp, Mus musculus
aaatgccctgcagacgtgccatagt

SEQ ID NO: 22391 - DNA, 25 bp, Mus musculus
aaatgccctggtcaagttagagatt

SEQ ID NO: 22392 - DNA, 25 bp, Mus musculus
aaatgccctggtgaagttagagatt

SEQ ID NO: 22393 - DNA, 25 bp, Mus musculus
aaatgccctgtcattcacacagaca

SEQ ID NO: 22394 - DNA, 25 bp, Mus musculus
aaatgccctgtctttcacacagaca

SEQ ID NO: 22395 - DNA, 25 bp, Mus musculus
aaatgccctgtgatacaaattggac

SEQ ID NO: 22396 - DNA, 25 bp, Mus musculus
aaatgccctgtgttacaaattggac

SEQ ID NO: 22397 - DNA, 25 bp, Mus musculus
aaatgcccttagaccacgcaggaag

SEQ ID NO: 22398 - DNA, 25 bp, Mus musculus
aaatgcccttagtccacgcaggaag

SEQ ID NO: 22399 - DNA, 25 bp, Mus musculus
aaatgcccttgcagggaccagtggt

SEQ ID NO: 22400 - DNA, 25 bp, Mus musculus
aaatgcccttgcctgaacccagatc

SEQ ID NO: 22401 - DNA, 25 bp, Mus musculus
aaatgcccttgcgtgaacccagatc

SEQ ID NO: 22402 - DNA, 25 bp, Mus musculus
aaatgcccttgctgggaccagtggt

SEQ ID NO: 22403 - DNA, 25 bp, Mus musculus
aaatgccgcagaaatccggtacgcc

SEQ ID NO: 22404 - DNA, 25 bp, Mus musculus
aaatgccgcagatatccggtacgcc

SEQ ID NO: 22405 - DNA, 25 bp, Mus musculus
aaatgccgcagcagactgccagcgc

SEQ ID NO: 22406 - DNA, 25 bp, Mus musculus
aaatgccgcagctgactgccagcgc

SEQ ID NO: 22407 - DNA, 25 bp, Mus musculus
aaatgccgccaacgtatctgtctct

SEQ ID NO: 22408 - DNA, 25 bp, Mus musculus
aaatgccgccaaggtatctgtctct

SEQ ID NO: 22409 - DNA, 25 bp, Mus musculus
aaatgccgccccagtgctagataga

SEQ ID NO: 22410 - DNA, 25 bp, Mus musculus
aaatgccgcccctgtgctagataga

SEQ ID NO: 22411 - DNA, 25 bp, Mus musculus
aaatgccggagtcacgaaagcctgc

SEQ ID NO: 22412 - DNA, 25 bp, Mus musculus
aaatgccggagtgacgaaagcctgc

SEQ ID NO: 22413 - DNA, 25 bp, Mus musculus
aaatgccggcagagtctgagcccaa

SEQ ID NO: 22414 - DNA, 25 bp, Mus musculus
aaatgccggcagtgtctgagcccaa

SEQ ID NO: 22415 - DNA, 25 bp, Mus musculus
aaatgccggtgaaccagcacgacaa

SEQ ID NO: 22416 - DNA, 25 bp, Mus musculus
aaatgccggtgatccagcacgacaa

SEQ ID NO: 22417 - DNA, 25 bp, Mus musculus
aaatgccggttgacatgctgaggta

SEQ ID NO: 22418 - DNA, 25 bp, Mus musculus
aaatgccggttgtcatgctgaggta

SEQ ID NO: 22419 - DNA, 25 bp, Mus musculus
aaatgccgtgagctggttattccaa

SEQ ID NO: 22420 - DNA, 25 bp, Mus musculus
aaatgccgtgaggtggttattccaa

SEQ ID NO: 22421 - DNA, 25 bp, Mus musculus
aaatgcctaagaacagtcacacaat

SEQ ID NO: 22422 - DNA, 25 bp, Mus musculus
aaatgcctaagatcagtcacacaat

SEQ ID NO: 22423 - DNA, 25 bp, Mus musculus
aaatgcctaattctactatgtgtac

SEQ ID NO: 22424 - DNA, 25 bp, Mus musculus
aaatgcctaattgtactatgtgtac

SEQ ID NO: 22425 - DNA, 25 bp, Mus musculus
aaatgcctaccacctttcaaactag

SEQ ID NO: 22426 - DNA, 25 bp, Mus musculus
aaatgcctaccagctttcaaactag

SEQ ID NO: 22427 - DNA, 25 bp, Mus musculus
aaatgcctacccagtcagacgaaga

SEQ ID NO: 22428 - DNA, 25 bp, Mus musculus
aaatgcctaccctgtcagacgaaga

SEQ ID NO: 22429 - DNA, 25 bp, Mus musculus
aaatgcctacttccaagtcttgctt

SEQ ID NO: 22430 - DNA, 25 bp, Mus musculus
aaatgcctacttgcaagtcttgctt

SEQ ID NO: 22431 - DNA, 25 bp, Mus musculus
aaatgcctaggccttcaatggcaat

SEQ ID NO: 22432 - DNA, 25 bp, Mus musculus
aaatgcctaggcgttcaatggcaat

SEQ ID NO: 22433 - DNA, 25 bp, Mus musculus
aaatgcctatgccatcaacgtgtct

SEQ ID NO: 22434 - DNA, 25 bp, Mus musculus
aaatgcctatgcgatcaacgtgtct

SEQ ID NO: 22435 - DNA, 25 bp, Mus musculus
aaatgcctatggactagtcttcaaa

SEQ ID NO: 22436 - DNA, 25 bp, Mus musculus
aaatgcctatggattactgagttgc

SEQ ID NO: 22437 - DNA, 25 bp, Mus musculus
aaatgcctatggtctagtcttcaaa

SEQ ID NO: 22438 - DNA, 25 bp, Mus musculus
aaatgcctatggtttactgagttgc

SEQ ID NO: 22439 - DNA, 25 bp, Mus musculus
aaatgcctattcctcgtccctatta

SEQ ID NO: 22440 - DNA, 25 bp, Mus musculus
aaatgcctattcgtcgtccctatta

SEQ ID NO: 22441 - DNA, 25 bp, Mus musculus
aaatgcctcattcctgagaccagta

SEQ ID NO: 22442 - DNA, 25 bp, Mus musculus
aaatgcctcattgctgagaccagta

SEQ ID NO: 22443 - DNA, 25 bp, Mus musculus
aaatgcctccacaaatatgcccatg

SEQ ID NO: 22444 - DNA, 25 bp, Mus musculus
aaatgcctccactaatatgcccatg

SEQ ID NO: 22445 - DNA, 25 bp, Mus musculus
aaatgcctccctctaattcgaatgc

SEQ ID NO: 22446 - DNA, 25 bp, Mus musculus
aaatgcctccctgtaattcgaatgc

SEQ ID NO: 22447 - DNA, 25 bp, Mus musculus
aaatgcctcctgaccatgtgaaggt

SEQ ID NO: 22448 - DNA, 25 bp, Mus musculus
aaatgcctcctgtccatgtgaaggt

SEQ ID NO: 22449 - DNA, 25 bp, Mus musculus
aaatgcctctacatgttcacacttg

SEQ ID NO: 22450 - DNA, 25 bp, Mus musculus
aaatgcctctacttgttcacacttg

SEQ ID NO: 22451 - DNA, 25 bp, Mus musculus
aaatgcctcttgagatgttttgtac

SEQ ID NO: 22452 - DNA, 25 bp, Mus musculus
aaatgcctcttgtgatgttttgtac

SEQ ID NO: 22453 - DNA, 25 bp, Mus musculus
aaatgcctctttaaggacccttgcg

SEQ ID NO: 22454 - DNA, 25 bp, Mus musculus
aaatgcctcttttaggacccttgcg

SEQ ID NO: 22455 - DNA, 25 bp, Mus musculus
aaatgcctgaacacttctacgcctg

SEQ ID NO: 22456 - DNA, 25 bp, Mus musculus
aaatgcctgaactcttctacgcctg

SEQ ID NO: 22457 - DNA, 25 bp, Mus musculus
aaatgcctgcagatgctgtgggcgc

SEQ ID NO: 22458 - DNA, 25 bp, Mus musculus
aaatgcctgcagttgctgtgggcgc

SEQ ID NO: 22459 - DNA, 25 bp, Mus musculus
aaatgcctgcataagcaaaatttga

SEQ ID NO: 22460 - DNA, 25 bp, Mus musculus
aaatgcctgcatatgagttcaccag

SEQ ID NO: 22461 - DNA, 25 bp, Mus musculus
aaatgcctgcatctcttatttattg

SEQ ID NO: 22462 - DNA, 25 bp, Mus musculus
aaatgcctgcatgtcttatttattg

SEQ ID NO: 22463 - DNA, 25 bp, Mus musculus
aaatgcctgcattagcaaaatttga

SEQ ID NO: 22464 - DNA, 25 bp, Mus musculus
aaatgcctgcatttgagttcaccag

SEQ ID NO: 22465 - DNA, 25 bp, Mus musculus
aaatgcctgcgcaatgctggtccta

SEQ ID NO: 22466 - DNA, 25 bp, Mus musculus
aaatgcctgcgctatgctggtccta

SEQ ID NO: 22467 - DNA, 25 bp, Mus musculus
aaatgcctgcggagggctacagttt

SEQ ID NO: 22468 - DNA, 25 bp, Mus musculus
aaatgcctgcggtgggctacagttt

SEQ ID NO: 22469 - DNA, 25 bp, Mus musculus
aaatgcctggagactatgcgtcaag

SEQ ID NO: 22470 - DNA, 25 bp, Mus musculus
aaatgcctggagtctatgcgtcaag

SEQ ID NO: 22471 - DNA, 25 bp, Mus musculus
aaatgcctggctccactgctttcca

SEQ ID NO: 22472 - DNA, 25 bp, Mus musculus
aaatgcctggctgcactgctttcca

SEQ ID NO: 22473 - DNA, 25 bp, Mus musculus
aaatgcctgggactgttttagctgg

SEQ ID NO: 22474 - DNA, 25 bp, Mus musculus
aaatgcctgggagtgttttagctgg

SEQ ID NO: 22475 - DNA, 25 bp, Mus musculus
aaatgcctgggtaactagggctaca

SEQ ID NO: 22476 - DNA, 25 bp, Mus musculus
aaatgcctgggttactagggctaca

SEQ ID NO: 22477 - DNA, 25 bp, Mus musculus
aaatgcctgtagacatgcagtccct

SEQ ID NO: 22478 - DNA, 25 bp, Mus musculus
aaatgcctgtagtcatgcagtccct

SEQ ID NO: 22479 - DNA, 25 bp, Mus musculus
aaatgccttacacattccttacaaa

SEQ ID NO: 22480 - DNA, 25 bp, Mus musculus
aaatgccttacagattccttacaaa

SEQ ID NO: 22481 - DNA, 25 bp, Mus musculus
aaatgccttagcaactacgttgtca

SEQ ID NO: 22482 - DNA, 25 bp, Mus musculus
aaatgccttagctactacgttgtca

SEQ ID NO: 22483 - DNA, 25 bp, Mus musculus
aaatgccttatgcaaagcgaacaga

SEQ ID NO: 22484 - DNA, 25 bp, Mus musculus
aaatgccttatgctggatcccacgg

SEQ ID NO: 22485 - DNA, 25 bp, Mus musculus
aaatgccttatggaaagcgaacaga

SEQ ID NO: 22486 - DNA, 25 bp, Mus musculus
aaatgccttatggtggatcccacgg

SEQ ID NO: 22487 - DNA, 25 bp, Mus musculus
aaatgccttcagattgtgtctcacc

SEQ ID NO: 22488 - DNA, 25 bp, Mus musculus
aaatgccttcagtttgtgtctcacc

SEQ ID NO: 22489 - DNA, 25 bp, Mus musculus
aaatgccttcccagcaaaccaattg

SEQ ID NO: 22490 - DNA, 25 bp, Mus musculus
aaatgccttccctgcaaaccaattg

SEQ ID NO: 22491 - DNA, 25 bp, Mus musculus
aaatgccttccgagttctgtcagaa

SEQ ID NO: 22492 - DNA, 25 bp, Mus musculus
aaatgccttccgtgttctgtcagaa

SEQ ID NO: 22493 - DNA, 25 bp, Mus musculus
aaatgccttctaaggtgctgcttcc

SEQ ID NO: 22494 - DNA, 25 bp, Mus musculus
aaatgccttctatggtgctgcttcc

SEQ ID NO: 22495 - DNA, 25 bp, Mus musculus
aaatgccttctccagagtgtgacaa

SEQ ID NO: 22496 - DNA, 25 bp, Mus musculus
aaatgccttctcgagagtgtgacaa

SEQ ID NO: 22497 - DNA, 25 bp, Mus musculus
aaatgccttcttatgcggtgagaga

SEQ ID NO: 22498 - DNA, 25 bp, Mus musculus
aaatgccttcttttgcggtgagaga

SEQ ID NO: 22499 - DNA, 25 bp, Mus musculus
aaatgccttgatcgcgtctcggatg

SEQ ID NO: 22500 - DNA, 25 bp, Mus musculus
aaatgccttgatggcgtctcggatg

SEQ ID NO: 22501 - DNA, 25 bp, Mus musculus
aaatgccttggcacttgcactacag

SEQ ID NO: 22502 - DNA, 25 bp, Mus musculus
aaatgccttggctcttgcactacag

SEQ ID NO: 22503 - DNA, 25 bp, Mus musculus
aaatgccttgtcagttcctgaggtc

SEQ ID NO: 22504 - DNA, 25 bp, Mus musculus
aaatgccttgtctgttcctgaggtc

SEQ ID NO: 22505 - DNA, 25 bp, Mus musculus
aaatgcctttctcaaactaagcagg

SEQ ID NO: 22506 - DNA, 25 bp, Mus musculus
aaatgcctttctctgtttctgaatc

SEQ ID NO: 22507 - DNA, 25 bp, Mus musculus
aaatgcctttctgaaactaagcagg

SEQ ID NO: 22508 - DNA, 25 bp, Mus musculus
aaatgcctttctgtgtttctgaatc

SEQ ID NO: 22509 - DNA, 25 bp, Mus musculus
aaatgcctttgaaccattctccact

SEQ ID NO: 22510 - DNA, 25 bp, Mus musculus
aaatgcctttgacatcatctacccc

SEQ ID NO: 22511 - DNA, 25 bp, Mus musculus
aaatgcctttgagatcatctacccc

SEQ ID NO: 22512 - DNA, 25 bp, Mus musculus
aaatgcctttgatccattctccact

SEQ ID NO: 22513 - DNA, 25 bp, Mus musculus
aaatgccttttcacacatcttcctt

SEQ ID NO: 22514 - DNA, 25 bp, Mus musculus
aaatgccttttcctaaatctcccag

SEQ ID NO: 22515 - DNA, 25 bp, Mus musculus
aaatgccttttcgtaaatctcccag

SEQ ID NO: 22516 - DNA, 25 bp, Mus musculus
aaatgccttttctcacatcttcctt

SEQ ID NO: 22517 - DNA, 25 bp, Mus musculus
aaatgcgactgccttctgagaatgg

SEQ ID NO: 22518 - DNA, 25 bp, Mus musculus
aaatgcgactgcgttctgagaatgg

SEQ ID NO: 22519 - DNA, 25 bp, Mus musculus
aaatgcgagggactattaccttcaa

SEQ ID NO: 22520 - DNA, 25 bp, Mus musculus
aaatgcgagggagtattaccttcaa

SEQ ID NO: 22521 - DNA, 25 bp, Mus musculus
aaatgcgattctataggctcttggg

SEQ ID NO: 22522 - DNA, 25 bp, Mus musculus
aaatgcgattctttaggctcttggg

SEQ ID NO: 22523 - DNA, 25 bp, Mus musculus
aaatgcgcaatcaatactcccacga

SEQ ID NO: 22524 - DNA, 25 bp, Mus musculus
aaatgcgcaatctatactcccacga

SEQ ID NO: 22525 - DNA, 25 bp, Mus musculus
aaatgcgcactcattgcctccaatt

SEQ ID NO: 22526 - DNA, 25 bp, Mus musculus
aaatgcgcactctttgcctccaatt

SEQ ID NO: 22527 - DNA, 25 bp, Mus musculus
aaatgcgcagcacagactttggaga

SEQ ID NO: 22528 - DNA, 25 bp, Mus musculus
aaatgcgcagcagagactttggaga

SEQ ID NO: 22529 - DNA, 25 bp, Mus musculus
aaatgcgcaggcatcttctgtgtac

SEQ ID NO: 22530 - DNA, 25 bp, Mus musculus
aaatgcgcaggcttcttctgtgtac

SEQ ID NO: 22531 - DNA, 25 bp, Mus musculus
aaatgcgccctgaattttctttgtc

SEQ ID NO: 22532 - DNA, 25 bp, Mus musculus
aaatgcgccctgtattttctttgtc

SEQ ID NO: 22533 - DNA, 25 bp, Mus musculus
aaatgcgcgcatctgtatttgcagc

SEQ ID NO: 22534 - DNA, 25 bp, Mus musculus
aaatgcgcgcatgtgtatttgcagc

SEQ ID NO: 22535 - DNA, 25 bp, Mus musculus
aaatgcgctggtccgtcaagaacac

SEQ ID NO: 22536 - DNA, 25 bp, Mus musculus
aaatgcgctggtgcgtcaagaacac

SEQ ID NO: 22537 - DNA, 25 bp, Mus musculus
aaatgcgctgtgatctgcctctcag

SEQ ID NO: 22538 - DNA, 25 bp, Mus musculus
aaatgcgctgtgttctgcctctcag

SEQ ID NO: 22539 - DNA, 25 bp, Mus musculus
aaatgcggcaagcagagctcagtaa

SEQ ID NO: 22540 - DNA, 25 bp, Mus musculus
aaatgcggcaaggagagctcagtaa

SEQ ID NO: 22541 - DNA, 25 bp, Mus musculus
aaatgcggcataatcagatgtattg

SEQ ID NO: 22542 - DNA, 25 bp, Mus musculus
aaatgcggcatattcagatgtattg

SEQ ID NO: 22543 - DNA, 25 bp, Mus musculus
aaatgcggtggcattatgggtttgc

SEQ ID NO: 22544 - DNA, 25 bp, Mus musculus
aaatgcggtggctttatgggtttgc

SEQ ID NO: 22545 - DNA, 25 bp, Mus musculus
aaatgcgtacaaagtttccagatat

SEQ ID NO: 22546 - DNA, 25 bp, Mus musculus
aaatgcgtacaatgtttccagatat

SEQ ID NO: 22547 - DNA, 25 bp, Mus musculus
aaatgcgtccacagctgtttaaagc

SEQ ID NO: 22548 - DNA, 25 bp, Mus musculus
aaatgcgtccactgctgtttaaagc

SEQ ID NO: 22549 - DNA, 25 bp, Mus musculus
aaatgcgtccggagacgatgtccca

SEQ ID NO: 22550 - DNA, 25 bp, Mus musculus
aaatgcgtccggtgacgatgtccca

SEQ ID NO: 22551 - DNA, 25 bp, Mus musculus
aaatgctaacccatggattctgctc

SEQ ID NO: 22552 - DNA, 25 bp, Mus musculus
aaatgctaacccttggattctgctc

SEQ ID NO: 22553 - DNA, 25 bp, Mus musculus
aaatgctaacctctcctactctcta

SEQ ID NO: 22554 - DNA, 25 bp, Mus musculus
aaatgctaacctgtcctactctcta

SEQ ID NO: 22555 - DNA, 25 bp, Mus musculus
aaatgctaactccttatttctagaa

SEQ ID NO: 22556 - DNA, 25 bp, Mus musculus
aaatgctaactcgttatttctagaa

SEQ ID NO: 22557 - DNA, 25 bp, Mus musculus
aaatgctaagcaagtcctttgtaat

SEQ ID NO: 22558 - DNA, 25 bp, Mus musculus
aaatgctaagcacttgaggccactt

SEQ ID NO: 22559 - DNA, 25 bp, Mus musculus
aaatgctaagcagttgaggccactt

SEQ ID NO: 22560 - DNA, 25 bp, Mus musculus
aaatgctaagcatgtcctttgtaat

SEQ ID NO: 22561 - DNA, 25 bp, Mus musculus
aaatgctaattcaacgctaccaggt

SEQ ID NO: 22562 - DNA, 25 bp, Mus musculus
aaatgctaattctacgctaccaggt

SEQ ID NO: 22563 - DNA, 25 bp, Mus musculus
aaatgctaccatcgagccccagttg

SEQ ID NO: 22564 - DNA, 25 bp, Mus musculus
aaatgctaccatggagccccagttg

SEQ ID NO: 22565 - DNA, 25 bp, Mus musculus
aaatgctaccctaagcgatccaggt

SEQ ID NO: 22566 - DNA, 25 bp, Mus musculus
aaatgctacccttagcgatccaggt

SEQ ID NO: 22567 - DNA, 25 bp, Mus musculus
aaatgctacctccagaggccaaata

SEQ ID NO: 22568 - DNA, 25 bp, Mus musculus
aaatgctacctcgagaggccaaata

SEQ ID NO: 22569 - DNA, 25 bp, Mus musculus
aaatgctacctgactcacatctgta

SEQ ID NO: 22570 - DNA, 25 bp, Mus musculus
aaatgctacctgtctcacatctgta

SEQ ID NO: 22571 - DNA, 25 bp, Mus musculus
aaatgctactctcttgttgtcctgc

SEQ ID NO: 22572 - DNA, 25 bp, Mus musculus
aaatgctactctgttgttgtcctgc

SEQ ID NO: 22573 - DNA, 25 bp, Mus musculus
aaatgctactgaaacttgcctgaga

SEQ ID NO: 22574 - DNA, 25 bp, Mus musculus
aaatgctactgatacttgcctgaga

SEQ ID NO: 22575 - DNA, 25 bp, Mus musculus
aaatgctactgcagagtgccgggat

SEQ ID NO: 22576 - DNA, 25 bp, Mus musculus
aaatgctactgctgagtgccgggat

SEQ ID NO: 22577 - DNA, 25 bp, Mus musculus
aaatgctagacgaggcccaggcaga

SEQ ID NO: 22578 - DNA, 25 bp, Mus musculus
aaatgctagacgtggcccaggcaga

SEQ ID NO: 22579 - DNA, 25 bp, Mus musculus
aaatgctagcccagtaagctcattc

SEQ ID NO: 22580 - DNA, 25 bp, Mus musculus
aaatgctagccctgtaagctcattc

SEQ ID NO: 22581 - DNA, 25 bp, Mus musculus
aaatgctagcttcaaaccgtggcct

SEQ ID NO: 22582 - DNA, 25 bp, Mus musculus
aaatgctagcttgaaaccgtggcct

SEQ ID NO: 22583 - DNA, 25 bp, Mus musculus
aaatgctaggaaattataaggcaag

SEQ ID NO: 22584 - DNA, 25 bp, Mus musculus
aaatgctaggaatttataaggcaag

SEQ ID NO: 22585 - DNA, 25 bp, Mus musculus
aaatgctaggatccaaagccttgaa

SEQ ID NO: 22586 - DNA, 25 bp, Mus musculus
aaatgctaggatgcaaagccttgaa

SEQ ID NO: 22587 - DNA, 25 bp, Mus musculus
aaatgctaggcacgtgcagtctcac

SEQ ID NO: 22588 - DNA, 25 bp, Mus musculus
aaatgctaggcaggtgcagtctcac

SEQ ID NO: 22589 - DNA, 25 bp, Mus musculus
aaatgctaggccaccttgtggttct

SEQ ID NO: 22590 - DNA, 25 bp, Mus musculus
aaatgctaggcctccttgtggttct

SEQ ID NO: 22591 - DNA, 25 bp, Mus musculus
aaatgctagggaaccgaggacagtt

SEQ ID NO: 22592 - DNA, 25 bp, Mus musculus
aaatgctagggaattgtgtgtcctg

SEQ ID NO: 22593 - DNA, 25 bp, Mus musculus
aaatgctagggatccgaggacagtt

SEQ ID NO: 22594 - DNA, 25 bp, Mus musculus
aaatgctagggatttgtgtgtcctg

SEQ ID NO: 22595 - DNA, 25 bp, Mus musculus
aaatgctatacgattacccttttat

SEQ ID NO: 22596 - DNA, 25 bp, Mus musculus
aaatgctatacgtttacccttttat

SEQ ID NO: 22597 - DNA, 25 bp, Mus musculus
aaatgctatagcatccagttggaca

SEQ ID NO: 22598 - DNA, 25 bp, Mus musculus
aaatgctatagcttccagttggaca

SEQ ID NO: 22599 - DNA, 25 bp, Mus musculus
aaatgctatcagaggcctcatgacc

SEQ ID NO: 22600 - DNA, 25 bp, Mus musculus
aaatgctatcagtggcctcatgacc

SEQ ID NO: 22601 - DNA, 25 bp, Mus musculus
aaatgctatccacgcactgcagaaa

SEQ ID NO: 22602 - DNA, 25 bp, Mus musculus
aaatgctatccaggcactgcagaaa

SEQ ID NO: 22603 - DNA, 25 bp, Mus musculus
aaatgctatgcgaattaaaccttgc

SEQ ID NO: 22604 - DNA, 25 bp, Mus musculus
aaatgctatgcgtattaaaccttgc

SEQ ID NO: 22605 - DNA, 25 bp, Mus musculus
aaatgctatgtcagtccttacaccg

SEQ ID NO: 22606 - DNA, 25 bp, Mus musculus
aaatgctatgtctgtccttacaccg

SEQ ID NO: 22607 - DNA, 25 bp, Mus musculus
aaatgctattccacttgctgctagt

SEQ ID NO: 22608 - DNA, 25 bp, Mus musculus
aaatgctattcctcttgctgctagt

SEQ ID NO: 22609 - DNA, 25 bp, Mus musculus
aaatgctatttgagacactgtgtca

SEQ ID NO: 22610 - DNA, 25 bp, Mus musculus
aaatgctatttgtgacactgtgtca

SEQ ID NO: 22611 - DNA, 25 bp, Mus musculus
aaatgctcaagacgaattttccaga

SEQ ID NO: 22612 - DNA, 25 bp, Mus musculus
aaatgctcaagaggaattttccaga

SEQ ID NO: 22613 - DNA, 25 bp, Mus musculus
aaatgctcacatcctgtgtcactga

SEQ ID NO: 22614 - DNA, 25 bp, Mus musculus
aaatgctcacatgctgtgtcactga

SEQ ID NO: 22615 - DNA, 25 bp, Mus musculus
aaatgctcacctagtggcagccttc

SEQ ID NO: 22616 - DNA, 25 bp, Mus musculus
aaatgctcaccttgtggcagccttc

SEQ ID NO: 22617 - DNA, 25 bp, Mus musculus
aaatgctcagcaaagttcacacttc

SEQ ID NO: 22618 - DNA, 25 bp, Mus musculus
aaatgctcagcatagttcacacttc

SEQ ID NO: 22619 - DNA, 25 bp, Mus musculus
aaatgctcagtcctttacccaactg

SEQ ID NO: 22620 - DNA, 25 bp, Mus musculus
aaatgctcagtcgtttacccaactg

SEQ ID NO: 22621 - DNA, 25 bp, Mus musculus
aaatgctcatacctgcagtgttgac

SEQ ID NO: 22622 - DNA, 25 bp, Mus musculus
aaatgctcatacgtgcagtgttgac

SEQ ID NO: 22623 - DNA, 25 bp, Mus musculus
aaatgctccaagatctgatgggtgg

SEQ ID NO: 22624 - DNA, 25 bp, Mus musculus
aaatgctccaagttctgatgggtgg

SEQ ID NO: 22625 - DNA, 25 bp, Mus musculus
aaatgctcccaccacttggctgtgt

SEQ ID NO: 22626 - DNA, 25 bp, Mus musculus
aaatgctcccacgacttggctgtgt

SEQ ID NO: 22627 - DNA, 25 bp, Mus musculus
aaatgctccccacaggttcatgtat

SEQ ID NO: 22628 - DNA, 25 bp, Mus musculus
aaatgctccccagaggttcatgtat

SEQ ID NO: 22629 - DNA, 25 bp, Mus musculus
aaatgctccgacatggacagctggg

SEQ ID NO: 22630 - DNA, 25 bp, Mus musculus
aaatgctccgacttggacagctggg

SEQ ID NO: 22631 - DNA, 25 bp, Mus musculus
aaatgctctacgcatcctcagagga

SEQ ID NO: 22632 - DNA, 25 bp, Mus musculus
aaatgctctacggatcctcagagga

SEQ ID NO: 22633 - DNA, 25 bp, Mus musculus
aaatgctctactatgtagctgtaca

SEQ ID NO: 22634 - DNA, 25 bp, Mus musculus
aaatgctctactttgtagctgtaca

SEQ ID NO: 22635 - DNA, 25 bp, Mus musculus
aaatgctctcccaaagctctggtat

SEQ ID NO: 22636 - DNA, 25 bp, Mus musculus
aaatgctctccctaagctctggtat

SEQ ID NO: 22637 - DNA, 25 bp, Mus musculus
aaatgctctgataacactcaggaag

SEQ ID NO: 22638 - DNA, 25 bp, Mus musculus
aaatgctctgattacactcaggaag

SEQ ID NO: 22639 - DNA, 25 bp, Mus musculus
aaatgctctgcaattcttccagtgc

SEQ ID NO: 22640 - DNA, 25 bp, Mus musculus
aaatgctctgcatttcttccagtgc

SEQ ID NO: 22641 - DNA, 25 bp, Mus musculus
aaatgctctgctaagacttcctgaa

SEQ ID NO: 22642 - DNA, 25 bp, Mus musculus
aaatgctctgctcatgtcttgttca

SEQ ID NO: 22643 - DNA, 25 bp, Mus musculus
aaatgctctgctgatgtcttgttca

SEQ ID NO: 22644 - DNA, 25 bp, Mus musculus
aaatgctctgcttagacttcctgaa

SEQ ID NO: 22645 - DNA, 25 bp, Mus musculus
aaatgctctggcagctgagaacaat

SEQ ID NO: 22646 - DNA, 25 bp, Mus musculus
aaatgctctggctgctgagaacaat

SEQ ID NO: 22647 - DNA, 25 bp, Mus musculus
aaatgctctgtaagtgggcaaacta

SEQ ID NO: 22648 - DNA, 25 bp, Mus musculus
aaatgctctgtatgtgggcaaacta

SEQ ID NO: 22649 - DNA, 25 bp, Mus musculus
aaatgctctgttcacattcaagaac

SEQ ID NO: 22650 - DNA, 25 bp, Mus musculus
aaatgctctgttgacattcaagaac

SEQ ID NO: 22651 - DNA, 25 bp, Mus musculus
aaatgctcttacatggaaaacaaca

SEQ ID NO: 22652 - DNA, 25 bp, Mus musculus
aaatgctcttacttggaaaacaaca

SEQ ID NO: 22653 - DNA, 25 bp, Mus musculus
aaatgctcttcaccggctatatgaa

SEQ ID NO: 22654 - DNA, 25 bp, Mus musculus
aaatgctcttcagcggctatatgaa

SEQ ID NO: 22655 - DNA, 25 bp, Mus musculus
aaatgctgaaaacggccacaaaatc

SEQ ID NO: 22656 - DNA, 25 bp, Mus musculus
aaatgctgaaaagggccacaaaatc

SEQ ID NO: 22657 - DNA, 25 bp, Mus musculus
aaatgctgaaatctgtgttatccca

SEQ ID NO: 22658 - DNA, 25 bp, Mus musculus
aaatgctgaaatgtgtgttatccca

SEQ ID NO: 22659 - DNA, 25 bp, Mus musculus
aaatgctgaacccagtgctgaattg

SEQ ID NO: 22660 - DNA, 25 bp, Mus musculus
aaatgctgaaccgagtgctgaattg

SEQ ID NO: 22661 - DNA, 25 bp, Mus musculus
aaatgctgaaggctgcaatctcaag

SEQ ID NO: 22662 - DNA, 25 bp, Mus musculus
aaatgctgaagggtgcaatctcaag

SEQ ID NO: 22663 - DNA, 25 bp, Mus musculus
aaatgctgaagtccctcgcatgact

SEQ ID NO: 22664 - DNA, 25 bp, Mus musculus
aaatgctgaagtgcctcgcatgact

SEQ ID NO: 22665 - DNA, 25 bp, Mus musculus
aaatgctgactgatcctcatctttg

SEQ ID NO: 22666 - DNA, 25 bp, Mus musculus
aaatgctgactgttcctcatctttg

SEQ ID NO: 22667 - DNA, 25 bp, Mus musculus
aaatgctgagaacccacaggctgac

SEQ ID NO: 22668 - DNA, 25 bp, Mus musculus
aaatgctgagaagccacaggctgac

SEQ ID NO: 22669 - DNA, 25 bp, Mus musculus
aaatgctgaggcacagtgtgtcagt

SEQ ID NO: 22670 - DNA, 25 bp, Mus musculus
aaatgctgaggctcagtgtgtcagt

SEQ ID NO: 22671 - DNA, 25 bp, Mus musculus
aaatgctgagtcatagccgggtggt

SEQ ID NO: 22672 - DNA, 25 bp, Mus musculus
aaatgctgagtcttagccgggtggt

SEQ ID NO: 22673 - DNA, 25 bp, Mus musculus
aaatgctgatggaagtttagccctt

SEQ ID NO: 22674 - DNA, 25 bp, Mus musculus
aaatgctgatggacttcctattttt

SEQ ID NO: 22675 - DNA, 25 bp, Mus musculus
aaatgctgatggtagtttagccctt

SEQ ID NO: 22676 - DNA, 25 bp, Mus musculus
aaatgctgatggtcttcctattttt

SEQ ID NO: 22677 - DNA, 25 bp, Mus musculus
aaatgctgattgacttcgtttaaat

SEQ ID NO: 22678 - DNA, 25 bp, Mus musculus
aaatgctgattgtcttcgtttaaat

SEQ ID NO: 22679 - DNA, 25 bp, Mus musculus
aaatgctgcaacctcgactgtgtca

SEQ ID NO: 22680 - DNA, 25 bp, Mus musculus
aaatgctgcaacgtcgactgtgtca

SEQ ID NO: 22681 - DNA, 25 bp, Mus musculus
aaatgctgcacaatgtcaccctagc

SEQ ID NO: 22682 - DNA, 25 bp, Mus musculus
aaatgctgcacattgtcaccctagc

SEQ ID NO: 22683 - DNA, 25 bp, Mus musculus
aaatgctgcactcttgattctttca

SEQ ID NO: 22684 - DNA, 25 bp, Mus musculus
aaatgctgcactgttgattctttca

SEQ ID NO: 22685 - DNA, 25 bp, Mus musculus
aaatgctgcagacgctgagtggtcc

SEQ ID NO: 22686 - DNA, 25 bp, Mus musculus
aaatgctgcagaggctgagtggtcc

SEQ ID NO: 22687 - DNA, 25 bp, Mus musculus
aaatgctgcatcagagggccgttga

SEQ ID NO: 22688 - DNA, 25 bp, Mus musculus
aaatgctgcatctgagggccgttga

SEQ ID NO: 22689 - DNA, 25 bp, Mus musculus
aaatgctgccaaaccaggtcctttt

SEQ ID NO: 22690 - DNA, 25 bp, Mus musculus
aaatgctgccaatccaggtcctttt

SEQ ID NO: 22691 - DNA, 25 bp, Mus musculus
aaatgctgccacatctatgcctgtt

SEQ ID NO: 22692 - DNA, 25 bp, Mus musculus
aaatgctgccacttctatgcctgtt

SEQ ID NO: 22693 - DNA, 25 bp, Mus musculus
aaatgctgcccacgacgcggatgca

SEQ ID NO: 22694 - DNA, 25 bp, Mus musculus
aaatgctgcccaggacgcggatgca

SEQ ID NO: 22695 - DNA, 25 bp, Mus musculus
aaatgctgccgcattcatctgttta

SEQ ID NO: 22696 - DNA, 25 bp, Mus musculus
aaatgctgccgcctttctgaaggag

SEQ ID NO: 22697 - DNA, 25 bp, Mus musculus
aaatgctgccgcgtttctgaaggag

SEQ ID NO: 22698 - DNA, 25 bp, Mus musculus
aaatgctgccgctttcatctgttta

SEQ ID NO: 22699 - DNA, 25 bp, Mus musculus
aaatgctgcgatattgcactatttt

SEQ ID NO: 22700 - DNA, 25 bp, Mus musculus
aaatgctgcgattttgcactatttt

SEQ ID NO: 22701 - DNA, 25 bp, Mus musculus
aaatgctgctcaagtggcgccacca

SEQ ID NO: 22702 - DNA, 25 bp, Mus musculus
aaatgctgctcatgtggcgccacca

SEQ ID NO: 22703 - DNA, 25 bp, Mus musculus
aaatgctgctccaagaatcgctctt

SEQ ID NO: 22704 - DNA, 25 bp, Mus musculus
aaatgctgctcctagaatcgctctt

SEQ ID NO: 22705 - DNA, 25 bp, Mus musculus
aaatgctgctggcaatctcagagct

SEQ ID NO: 22706 - DNA, 25 bp, Mus musculus
aaatgctgctgggaatctcagagct

SEQ ID NO: 22707 - DNA, 25 bp, Mus musculus
aaatgctgctgtaggcatgcctgac

SEQ ID NO: 22708 - DNA, 25 bp, Mus musculus
aaatgctgctgttggcatgcctgac

SEQ ID NO: 22709 - DNA, 25 bp, Mus musculus
aaatgctgcttcacagcgggaactt

SEQ ID NO: 22710 - DNA, 25 bp, Mus musculus
aaatgctgcttccacttctggttca

SEQ ID NO: 22711 - DNA, 25 bp, Mus musculus
aaatgctgcttcgacttctggttca

SEQ ID NO: 22712 - DNA, 25 bp, Mus musculus
aaatgctgcttctcagcgggaactt

SEQ ID NO: 22713 - DNA, 25 bp, Mus musculus
aaatgctgcttgacaaagacccctc

SEQ ID NO: 22714 - DNA, 25 bp, Mus musculus
aaatgctgcttgtcaaagacccctc

SEQ ID NO: 22715 - DNA, 25 bp, Mus musculus
aaatgctggactactagctgtccac

SEQ ID NO: 22716 - DNA, 25 bp, Mus musculus
aaatgctggacttctagctgtccac

SEQ ID NO: 22717 - DNA, 25 bp, Mus musculus
aaatgctgggctcgaagccgtcctg

SEQ ID NO: 22718 - DNA, 25 bp, Mus musculus
aaatgctgggctggaagccgtcctg

SEQ ID NO: 22719 - DNA, 25 bp, Mus musculus
aaatgctggtaaatttagccttcgg

SEQ ID NO: 22720 - DNA, 25 bp, Mus musculus
aaatgctggtaattttagccttcgg

SEQ ID NO: 22721 - DNA, 25 bp, Mus musculus
aaatgctggtagctaattgaagtca

SEQ ID NO: 22722 - DNA, 25 bp, Mus musculus
aaatgctggtaggtaattgaagtca

SEQ ID NO: 22723 - DNA, 25 bp, Mus musculus
aaatgctggtctactgtgtttacat

SEQ ID NO: 22724 - DNA, 25 bp, Mus musculus
aaatgctggtcttctgtgtttacat

SEQ ID NO: 22725 - DNA, 25 bp, Mus musculus
aaatgctggtgtatgatttcctgtg

SEQ ID NO: 22726 - DNA, 25 bp, Mus musculus
aaatgctggtgtttgatttcctgtg

SEQ ID NO: 22727 - DNA, 25 bp, Mus musculus
aaatgctgtatcacggaaggtccca

SEQ ID NO: 22728 - DNA, 25 bp, Mus musculus
aaatgctgtatctcggaaggtccca

SEQ ID NO: 22729 - DNA, 25 bp, Mus musculus
aaatgctgtcatctctgtggaaggt

SEQ ID NO: 22730 - DNA, 25 bp, Mus musculus
aaatgctgtcatgtctgtggaaggt

SEQ ID NO: 22731 - DNA, 25 bp, Mus musculus
aaatgctgtcccaccttaagcagag

SEQ ID NO: 22732 - DNA, 25 bp, Mus musculus
aaatgctgtccctccttaagcagag

SEQ ID NO: 22733 - DNA, 25 bp, Mus musculus
aaatgctgtgcactcattcagtgga

SEQ ID NO: 22734 - DNA, 25 bp, Mus musculus
aaatgctgtgcagtcattcagtgga

SEQ ID NO: 22735 - DNA, 25 bp, Mus musculus
aaatgctgtgcccttgggtactgga

SEQ ID NO: 22736 - DNA, 25 bp, Mus musculus
aaatgctgtgccgttgggtactgga

SEQ ID NO: 22737 - DNA, 25 bp, Mus musculus
aaatgctgtgcgataggagccgctc

SEQ ID NO: 22738 - DNA, 25 bp, Mus musculus
aaatgctgtgcgttaggagccgctc

SEQ ID NO: 22739 - DNA, 25 bp, Mus musculus
aaatgctgtgctctgtctcttcgac

SEQ ID NO: 22740 - DNA, 25 bp, Mus musculus
aaatgctgtgctgtgtctcttcgac

SEQ ID NO: 22741 - DNA, 25 bp, Mus musculus
aaatgctgtgtcacttcagtatgga

SEQ ID NO: 22742 - DNA, 25 bp, Mus musculus
aaatgctgtgtcatccctcttacat

SEQ ID NO: 22743 - DNA, 25 bp, Mus musculus
aaatgctgtgtccatgtgtatcatg

SEQ ID NO: 22744 - DNA, 25 bp, Mus musculus
aaatgctgtgtcgatgtgtatcatg

SEQ ID NO: 22745 - DNA, 25 bp, Mus musculus
aaatgctgtgtctcttcagtatgga

SEQ ID NO: 22746 - DNA, 25 bp, Mus musculus
aaatgctgtgtcttccctcttacat

SEQ ID NO: 22747 - DNA, 25 bp, Mus musculus
aaatgctgttggactgtaccttgga

SEQ ID NO: 22748 - DNA, 25 bp, Mus musculus
aaatgctgttggagtgcaccactgc

SEQ ID NO: 22749 - DNA, 25 bp, Mus musculus
aaatgctgttggtctgtaccttgga

SEQ ID NO: 22750 - DNA, 25 bp, Mus musculus
aaatgctgttggtgtgcaccactgc

SEQ ID NO: 22751 - DNA, 25 bp, Mus musculus
aaatgctgttgtccgcaatagcgtt

SEQ ID NO: 22752 - DNA, 25 bp, Mus musculus
aaatgctgttgtgcgcaatagcgtt

SEQ ID NO: 22753 - DNA, 25 bp, Mus musculus
aaatgctgttttcttttgacaacac

SEQ ID NO: 22754 - DNA, 25 bp, Mus musculus
aaatgctgttttgttttgacaacac

SEQ ID NO: 22755 - DNA, 25 bp, Mus musculus
aaatgcttaaatccatctccaggta

SEQ ID NO: 22756 - DNA, 25 bp, Mus musculus
aaatgcttaaatgcatctccaggta

SEQ ID NO: 22757 - DNA, 25 bp, Mus musculus
aaatgcttaactcatgagctccatg

SEQ ID NO: 22758 - DNA, 25 bp, Mus musculus
aaatgcttaactgatgagctccatg

SEQ ID NO: 22759 - DNA, 25 bp, Mus musculus
aaatgcttacagcttttggctcgcc

SEQ ID NO: 22760 - DNA, 25 bp, Mus musculus
aaatgcttacaggttttggctcgcc

SEQ ID NO: 22761 - DNA, 25 bp, Mus musculus
aaatgcttagatacactttgggtgg

SEQ ID NO: 22762 - DNA, 25 bp, Mus musculus
aaatgcttagattcactttgggtgg

SEQ ID NO: 22763 - DNA, 25 bp, Mus musculus
aaatgcttagccatcttcaattttt

SEQ ID NO: 22764 - DNA, 25 bp, Mus musculus
aaatgcttagccttcttcaattttt

SEQ ID NO: 22765 - DNA, 25 bp, Mus musculus
aaatgcttaggacccatctctcaag

SEQ ID NO: 22766 - DNA, 25 bp, Mus musculus
aaatgcttaggagccatctctcaag

SEQ ID NO: 22767 - DNA, 25 bp, Mus musculus
aaatgcttagtgctgagtcggaaca

SEQ ID NO: 22768 - DNA, 25 bp, Mus musculus
aaatgcttagtggtgagtcggaaca

SEQ ID NO: 22769 - DNA, 25 bp, Mus musculus
aaatgcttagttaagctgccccttg

SEQ ID NO: 22770 - DNA, 25 bp, Mus musculus
aaatgcttagtttagctgccccttg

SEQ ID NO: 22771 - DNA, 25 bp, Mus musculus
aaatgcttatccacatgtgtcctcc

SEQ ID NO: 22772 - DNA, 25 bp, Mus musculus
aaatgcttatcctcatgtgtcctcc

SEQ ID NO: 22773 - DNA, 25 bp, Mus musculus
aaatgcttatttctgtgtctaccca

SEQ ID NO: 22774 - DNA, 25 bp, Mus musculus
aaatgcttatttgtgtgtctaccca

SEQ ID NO: 22775 - DNA, 25 bp, Mus musculus
aaatgcttcagcaatccaggaggaa

SEQ ID NO: 22776 - DNA, 25 bp, Mus musculus
aaatgcttcagcatctttttgtaat

SEQ ID NO: 22777 - DNA, 25 bp, Mus musculus
aaatgcttcagctatccaggaggaa

SEQ ID NO: 22778 - DNA, 25 bp, Mus musculus
aaatgcttcagcttctttttgtaat

SEQ ID NO: 22779 - DNA, 25 bp, Mus musculus
aaatgcttcaggcatgatctattga

SEQ ID NO: 22780 - DNA, 25 bp, Mus musculus
aaatgcttcagggatgatctattga

SEQ ID NO: 22781 - DNA, 25 bp, Mus musculus
aaatgcttcagtctcaaatttaggg

SEQ ID NO: 22782 - DNA, 25 bp, Mus musculus
aaatgcttcagtgtcaaatttaggg

SEQ ID NO: 22783 - DNA, 25 bp, Mus musculus
aaatgcttcatactgtactgcttca

SEQ ID NO: 22784 - DNA, 25 bp, Mus musculus
aaatgcttcatagtgtactgcttca

SEQ ID NO: 22785 - DNA, 25 bp, Mus musculus
aaatgcttccttatgagccgggctt

SEQ ID NO: 22786 - DNA, 25 bp, Mus musculus
aaatgcttccttttgagccgggctt

SEQ ID NO: 22787 - DNA, 25 bp, Mus musculus
aaatgcttctcgaggattttctcct

SEQ ID NO: 22788 - DNA, 25 bp, Mus musculus
aaatgcttctcgtggattttctcct

SEQ ID NO: 22789 - DNA, 25 bp, Mus musculus
aaatgcttctctcggtgaggactgc

SEQ ID NO: 22790 - DNA, 25 bp, Mus musculus
aaatgcttctctgggtgaggactgc

SEQ ID NO: 22791 - DNA, 25 bp, Mus musculus
aaatgcttctggatggccatgccca

SEQ ID NO: 22792 - DNA, 25 bp, Mus musculus
aaatgcttctggttggccatgccca

SEQ ID NO: 22793 - DNA, 25 bp, Mus musculus
aaatgcttgcacacttcactcgatg

SEQ ID NO: 22794 - DNA, 25 bp, Mus musculus
aaatgcttgcactcttcactcgatg

SEQ ID NO: 22795 - DNA, 25 bp, Mus musculus
aaatgcttgcctaggcagctgctta

SEQ ID NO: 22796 - DNA, 25 bp, Mus musculus
aaatgcttgcctaggctgggtctta

SEQ ID NO: 22797 - DNA, 25 bp, Mus musculus
aaatgcttgccttggcagctgctta

SEQ ID NO: 22798 - DNA, 25 bp, Mus musculus
aaatgcttgccttggctgggtctta

SEQ ID NO: 22799 - DNA, 25 bp, Mus musculus
aaatgcttgctgctttgctggaaac

SEQ ID NO: 22800 - DNA, 25 bp, Mus musculus
aaatgcttgctggtttgctggaaac

SEQ ID NO: 22801 - DNA, 25 bp, Mus musculus
aaatgcttgcttaaggttgcagctg

SEQ ID NO: 22802 - DNA, 25 bp, Mus musculus
aaatgcttgcttcgaggaagatgtt

SEQ ID NO: 22803 - DNA, 25 bp, Mus musculus
aaatgcttgcttggaggaagatgtt

SEQ ID NO: 22804 - DNA, 25 bp, Mus musculus
aaatgcttgctttaggttgcagctg

SEQ ID NO: 22805 - DNA, 25 bp, Mus musculus
aaatgcttggacagtcacttgcact

SEQ ID NO: 22806 - DNA, 25 bp, Mus musculus
aaatgcttggactgtcacttgcact

SEQ ID NO: 22807 - DNA, 25 bp, Mus musculus
aaatgcttggatcacttctttctga

SEQ ID NO: 22808 - DNA, 25 bp, Mus musculus
aaatgcttggatgacttctttctga

SEQ ID NO: 22809 - DNA, 25 bp, Mus musculus
aaatgcttgtatcagtattgcctaa

SEQ ID NO: 22810 - DNA, 25 bp, Mus musculus
aaatgcttgtatgagtattgcctaa

SEQ ID NO: 22811 - DNA, 25 bp, Mus musculus
aaatgcttgttcagttgcctaataa

SEQ ID NO: 22812 - DNA, 25 bp, Mus musculus
aaatgcttgttctgttgcctaataa

SEQ ID NO: 22813 - DNA, 25 bp, Mus musculus
aaatgcttgtttacttcttgtcctg

SEQ ID NO: 22814 - DNA, 25 bp, Mus musculus
aaatgcttgttttcttcttgtcctg

SEQ ID NO: 22815 - DNA, 25 bp, Mus musculus
aaatgctttactcacaaatattgtc

SEQ ID NO: 22816 - DNA, 25 bp, Mus musculus
aaatgctttactgacaaatattgtc

SEQ ID NO: 22817 - DNA, 25 bp, Mus musculus
aaatgctttcatccggtgggttctt

SEQ ID NO: 22818 - DNA, 25 bp, Mus musculus
aaatgctttcatgcggtgggttctt

SEQ ID NO: 22819 - DNA, 25 bp, Mus musculus
aaatgctttcctataattgtatcct

SEQ ID NO: 22820 - DNA, 25 bp, Mus musculus
aaatgctttcctttaattgtatcct

SEQ ID NO: 22821 - DNA, 25 bp, Mus musculus
aaatgctttcgtatcagttcctagt

SEQ ID NO: 22822 - DNA, 25 bp, Mus musculus
aaatgctttcgtttcagttcctagt

SEQ ID NO: 22823 - DNA, 25 bp, Mus musculus
aaatgctttcttactgttgttcgct

SEQ ID NO: 22824 - DNA, 25 bp, Mus musculus
aaatgctttcttagtacatcataga

SEQ ID NO: 22825 - DNA, 25 bp, Mus musculus
aaatgctttcttcccaaatggtcag

SEQ ID NO: 22826 - DNA, 25 bp, Mus musculus
aaatgctttcttgccaaatggtcag

SEQ ID NO: 22827 - DNA, 25 bp, Mus musculus
aaatgctttctttctgttgttcgct

SEQ ID NO: 22828 - DNA, 25 bp, Mus musculus
aaatgctttctttgtacatcataga

SEQ ID NO: 22829 - DNA, 25 bp, Mus musculus
aaatgcttttaaaggtgcttctctt

SEQ ID NO: 22830 - DNA, 25 bp, Mus musculus
aaatgcttttaatggtgcttctctt

SEQ ID NO: 22831 - DNA, 25 bp, Mus musculus
aaatgcttttatactgggctgcttt

SEQ ID NO: 22832 - DNA, 25 bp, Mus musculus
aaatgcttttatcttgctatagaat

SEQ ID NO: 22833 - DNA, 25 bp, Mus musculus
aaatgcttttatgttgctatagaat

SEQ ID NO: 22834 - DNA, 25 bp, Mus musculus
aaatgcttttattctgggctgcttt

SEQ ID NO: 22835 - DNA, 25 bp, Mus musculus
aaatgcttttctcggcttagcaggg

SEQ ID NO: 22836 - DNA, 25 bp, Mus musculus
aaatgcttttctgggcttagcaggg

SEQ ID NO: 22837 - DNA, 25 bp, Mus musculus
aaatgcttttggctggtgtccagag

SEQ ID NO: 22838 - DNA, 25 bp, Mus musculus
aaatgcttttggcttggctattaag

SEQ ID NO: 22839 - DNA, 25 bp, Mus musculus
aaatgcttttgggtggtgtccagag

SEQ ID NO: 22840 - DNA, 25 bp, Mus musculus
aaatgcttttgggttggctattaag

SEQ ID NO: 22841 - DNA, 25 bp, Mus musculus
aaatggaaaccacccaatctaaaag

SEQ ID NO: 22842 - DNA, 25 bp, Mus musculus
aaatggaaaccagccaatctaaaag

SEQ ID NO: 22843 - DNA, 25 bp, Mus musculus
aaatggaaagtgactcttctggaat

SEQ ID NO: 22844 - DNA, 25 bp, Mus musculus
aaatggaaagtgtctcttctggaat

SEQ ID NO: 22845 - DNA, 25 bp, Mus musculus
aaatggaacaccctccttgctagag

SEQ ID NO: 22846 - DNA, 25 bp, Mus musculus
aaatggaacaccgtccttgctagag

SEQ ID NO: 22847 - DNA, 25 bp, Mus musculus
aaatggaacctgagttacttgagaa

SEQ ID NO: 22848 - DNA, 25 bp, Mus musculus
aaatggaacctgtgttacttgagaa

SEQ ID NO: 22849 - DNA, 25 bp, Mus musculus
aaatggaaccttagctgggcaggct

SEQ ID NO: 22850 - DNA, 25 bp, Mus musculus
aaatggaacctttgctgggcaggct

SEQ ID NO: 22851 - DNA, 25 bp, Mus musculus
aaatggaactgcacatgcagaaagc

SEQ ID NO: 22852 - DNA, 25 bp, Mus musculus
aaatggaactgctcatgcagaaagc

SEQ ID NO: 22853 - DNA, 25 bp, Mus musculus
aaatggaactggatcccaggatgaa

SEQ ID NO: 22854 - DNA, 25 bp, Mus musculus
aaatggaactggttcccaggatgaa

SEQ ID NO: 22855 - DNA, 25 bp, Mus musculus
aaatggaacttgctttttgctcaga

SEQ ID NO: 22856 - DNA, 25 bp, Mus musculus
aaatggaacttggtttttgctcaga

SEQ ID NO: 22857 - DNA, 25 bp, Mus musculus
aaatggaagcagctctgatggccag

SEQ ID NO: 22858 - DNA, 25 bp, Mus musculus
aaatggaagcaggtctgatggccag

SEQ ID NO: 22859 - DNA, 25 bp, Mus musculus
aaatggaagctgctgctcactccac

SEQ ID NO: 22860 - DNA, 25 bp, Mus musculus
aaatggaagctggtgctcactccac

SEQ ID NO: 22861 - DNA, 25 bp, Mus musculus
aaatggaaggacacaagctactaca

SEQ ID NO: 22862 - DNA, 25 bp, Mus musculus
aaatggaaggacacactaactaatg

SEQ ID NO: 22863 - DNA, 25 bp, Mus musculus
aaatggaaggactcaagctactaca

SEQ ID NO: 22864 - DNA, 25 bp, Mus musculus
aaatggaaggactcactaactaatg

SEQ ID NO: 22865 - DNA, 25 bp, Mus musculus
aaatggaaggccctgtacaccgatc

SEQ ID NO: 22866 - DNA, 25 bp, Mus musculus
aaatggaaggccgtgtacaccgatc

SEQ ID NO: 22867 - DNA, 25 bp, Mus musculus
aaatggaatcacacctagaggcctc

SEQ ID NO: 22868 - DNA, 25 bp, Mus musculus
aaatggaatcactcctagaggcctc

SEQ ID NO: 22869 - DNA, 25 bp, Mus musculus
aaatggaatggaccttccagtttct

SEQ ID NO: 22870 - DNA, 25 bp, Mus musculus
aaatggaatggagcttccagtttct

SEQ ID NO: 22871 - DNA, 25 bp, Mus musculus
aaatggaatggccagccttcctcca

SEQ ID NO: 22872 - DNA, 25 bp, Mus musculus
aaatggaatggcgagccttcctcca

SEQ ID NO: 22873 - DNA, 25 bp, Mus musculus
aaatggaattctagggccggcacct

SEQ ID NO: 22874 - DNA, 25 bp, Mus musculus
aaatggaattcttgggccggcacct

SEQ ID NO: 22875 - DNA, 25 bp, Mus musculus
aaatggacacagacgtctgctctcc

SEQ ID NO: 22876 - DNA, 25 bp, Mus musculus
aaatggacacagtcgtctgctctcc

SEQ ID NO: 22877 - DNA, 25 bp, Mus musculus
aaatggacaccaactctctgtatca

SEQ ID NO: 22878 - DNA, 25 bp, Mus musculus
aaatggacaccatctctctgtatca

SEQ ID NO: 22879 - DNA, 25 bp, Mus musculus
aaatggacacttcgaggcagccagg

SEQ ID NO: 22880 - DNA, 25 bp, Mus musculus
aaatggacacttggaggcagccagg

SEQ ID NO: 22881 - DNA, 25 bp, Mus musculus
aaatggacagccattggtgggactg

SEQ ID NO: 22882 - DNA, 25 bp, Mus musculus
aaatggacagcctttggtgggactg

SEQ ID NO: 22883 - DNA, 25 bp, Mus musculus
aaatggacagtcaccagcgccagat

SEQ ID NO: 22884 - DNA, 25 bp, Mus musculus
aaatggacagtcctggtgaagaacc

SEQ ID NO: 22885 - DNA, 25 bp, Mus musculus
aaatggacagtcgtggtgaagaacc

SEQ ID NO: 22886 - DNA, 25 bp, Mus musculus
aaatggacagtctccagcgccagat

SEQ ID NO: 22887 - DNA, 25 bp, Mus musculus
aaatggaccaaaactcacgctcagt

SEQ ID NO: 22888 - DNA, 25 bp, Mus musculus
aaatggaccaaatctcacgctcagt

SEQ ID NO: 22889 - DNA, 25 bp, Mus musculus
aaatggaccacacccgtgcagggac

SEQ ID NO: 22890 - DNA, 25 bp, Mus musculus
aaatggaccacagccgtgcagggac

SEQ ID NO: 22891 - DNA, 25 bp, Mus musculus
aaatggaccaggacgcggagagcac

SEQ ID NO: 22892 - DNA, 25 bp, Mus musculus
aaatggaccaggtcgcggagagcac

SEQ ID NO: 22893 - DNA, 25 bp, Mus musculus
aaatggaccattaagcagaaaactg

SEQ ID NO: 22894 - DNA, 25 bp, Mus musculus
aaatggaccatttagcagaaaactg

SEQ ID NO: 22895 - DNA, 25 bp, Mus musculus
aaatggacccctagaccagaggagt

SEQ ID NO: 22896 - DNA, 25 bp, Mus musculus
aaatggaccccttgaccagaggagt

SEQ ID NO: 22897 - DNA, 25 bp, Mus musculus
aaatggacccgacggctcctttctg

SEQ ID NO: 22898 - DNA, 25 bp, Mus musculus
aaatggacccgagggctcctttctg

SEQ ID NO: 22899 - DNA, 25 bp, Mus musculus
aaatggacctccacagcacacggaa

SEQ ID NO: 22900 - DNA, 25 bp, Mus musculus
aaatggacctcctcagcacacggaa

SEQ ID NO: 22901 - DNA, 25 bp, Mus musculus
aaatggactaacacaggcactatga

SEQ ID NO: 22902 - DNA, 25 bp, Mus musculus
aaatggactaactcaggcactatga

SEQ ID NO: 22903 - DNA, 25 bp, Mus musculus
aaatggactccgcaccctattgtat

SEQ ID NO: 22904 - DNA, 25 bp, Mus musculus
aaatggactccggaccctattgtat

SEQ ID NO: 22905 - DNA, 25 bp, Mus musculus
aaatggactcctatgctcggatctt

SEQ ID NO: 22906 - DNA, 25 bp, Mus musculus
aaatggactcctttgctcggatctt

SEQ ID NO: 22907 - DNA, 25 bp, Mus musculus
aaatggactctgctttttacttcaa

SEQ ID NO: 22908 - DNA, 25 bp, Mus musculus
aaatggactctggtttttacttcaa

SEQ ID NO: 22909 - DNA, 25 bp, Mus musculus
aaatggacttgacaggttatataca

SEQ ID NO: 22910 - DNA, 25 bp, Mus musculus
aaatggacttgagaggttatataca

SEQ ID NO: 22911 - DNA, 25 bp, Mus musculus
aaatggagaaaccacttgctctaga

SEQ ID NO: 22912 - DNA, 25 bp, Mus musculus
aaatggagaaacgacttgctctaga

SEQ ID NO: 22913 - DNA, 25 bp, Mus musculus
aaatggagacacacaggccccagga

SEQ ID NO: 22914 - DNA, 25 bp, Mus musculus
aaatggagacactcaggccccagga

SEQ ID NO: 22915 - DNA, 25 bp, Mus musculus
aaatggagaccaatgctaacagcac

SEQ ID NO: 22916 - DNA, 25 bp, Mus musculus
aaatggagaccattgctaacagcac

SEQ ID NO: 22917 - DNA, 25 bp, Mus musculus
aaatggagagtcaggagttagctag

SEQ ID NO: 22918 - DNA, 25 bp, Mus musculus
aaatggagagtctggagttagctag

SEQ ID NO: 22919 - DNA, 25 bp, Mus musculus
aaatggagatagctgtttagagagc

SEQ ID NO: 22920 - DNA, 25 bp, Mus musculus
aaatggagataggtgtttagagagc

SEQ ID NO: 22921 - DNA, 25 bp, Mus musculus
aaatggagcactccgcagctggagt

SEQ ID NO: 22922 - DNA, 25 bp, Mus musculus
aaatggagcactgcgcagctggagt

SEQ ID NO: 22923 - DNA, 25 bp, Mus musculus
aaatggagcattcgcctttgggaga

SEQ ID NO: 22924 - DNA, 25 bp, Mus musculus
aaatggagcattggcctttgggaga

SEQ ID NO: 22925 - DNA, 25 bp, Mus musculus
aaatggagccatagccagccgtacc

SEQ ID NO: 22926 - DNA, 25 bp, Mus musculus
aaatggagccattgccagccgtacc

SEQ ID NO: 22927 - DNA, 25 bp, Mus musculus
aaatggagccccaatcaacacagag

SEQ ID NO: 22928 - DNA, 25 bp, Mus musculus
aaatggagcccctatcaacacagag

SEQ ID NO: 22929 - DNA, 25 bp, Mus musculus
aaatggagcctgatttgttccaagt

SEQ ID NO: 22930 - DNA, 25 bp, Mus musculus
aaatggagcctgttttgttccaagt

SEQ ID NO: 22931 - DNA, 25 bp, Mus musculus
aaatggagccttaggtgggacaagt

SEQ ID NO: 22932 - DNA, 25 bp, Mus musculus
aaatggagccttatgccacagctga

SEQ ID NO: 22933 - DNA, 25 bp, Mus musculus
aaatggagcctttggtgggacaagt

SEQ ID NO: 22934 - DNA, 25 bp, Mus musculus
aaatggagccttttgccacagctga

SEQ ID NO: 22935 - DNA, 25 bp, Mus musculus
aaatggagctctcagctcaaccttc

SEQ ID NO: 22936 - DNA, 25 bp, Mus musculus
aaatggagctctgagctcaaccttc

SEQ ID NO: 22937 - DNA, 25 bp, Mus musculus
aaatggagctgcatatgtctgccct

SEQ ID NO: 22938 - DNA, 25 bp, Mus musculus
aaatggagctgcttatgtctgccct

SEQ ID NO: 22939 - DNA, 25 bp, Mus musculus
aaatggagcttcctctggatgttgt

SEQ ID NO: 22940 - DNA, 25 bp, Mus musculus
aaatggagcttcgtctggatgttgt

SEQ ID NO: 22941 - DNA, 25 bp, Mus musculus
aaatggaggcatacttctgccttgc

SEQ ID NO: 22942 - DNA, 25 bp, Mus musculus
aaatggaggcattcttctgccttgc

SEQ ID NO: 22943 - DNA, 25 bp, Mus musculus
aaatggaggccaagtctcccttcta

SEQ ID NO: 22944 - DNA, 25 bp, Mus musculus
aaatggaggccatgtctcccttcta

SEQ ID NO: 22945 - DNA, 25 bp, Mus musculus
aaatggaggcccaggcttggtatgc

SEQ ID NO: 22946 - DNA, 25 bp, Mus musculus
aaatggaggccctggcttggtatgc

SEQ ID NO: 22947 - DNA, 25 bp, Mus musculus
aaatggaggctgagtcgctttgaca

SEQ ID NO: 22948 - DNA, 25 bp, Mus musculus
aaatggaggctgtgtcgctttgaca

SEQ ID NO: 22949 - DNA, 25 bp, Mus musculus
aaatggagtcaaactgggtgtcgct

SEQ ID NO: 22950 - DNA, 25 bp, Mus musculus
aaatggagtcaatctgggtgtcgct

SEQ ID NO: 22951 - DNA, 25 bp, Mus musculus
aaatggagtcctcagcacctggttt

SEQ ID NO: 22952 - DNA, 25 bp, Mus musculus
aaatggagtcctgagcacctggttt

SEQ ID NO: 22953 - DNA, 25 bp, Mus musculus
aaatggagtgacagcagccggctga

SEQ ID NO: 22954 - DNA, 25 bp, Mus musculus
aaatggagtgactgcagccggctga

SEQ ID NO: 22955 - DNA, 25 bp, Mus musculus
aaatggagtgctcccaagcatgtca

SEQ ID NO: 22956 - DNA, 25 bp, Mus musculus
aaatggagtgctgccaagcatgtca

SEQ ID NO: 22957 - DNA, 25 bp, Mus musculus
aaatggagtggcaactgctagggaa

SEQ ID NO: 22958 - DNA, 25 bp, Mus musculus
aaatggagtggctactgctagggaa

SEQ ID NO: 22959 - DNA, 25 bp, Mus musculus
aaatggagttagcagagtgctctgc

SEQ ID NO: 22960 - DNA, 25 bp, Mus musculus
aaatggagttaggagagtgctctgc

SEQ ID NO: 22961 - DNA, 25 bp, Mus musculus
aaatggagttcacgctttcaagaca

SEQ ID NO: 22962 - DNA, 25 bp, Mus musculus
aaatggagttcaggctttcaagaca

SEQ ID NO: 22963 - DNA, 25 bp, Mus musculus
aaatggatacccagttcctccctca

SEQ ID NO: 22964 - DNA, 25 bp, Mus musculus
aaatggataccctgttcctccctca

SEQ ID NO: 22965 - DNA, 25 bp, Mus musculus
aaatggatacgtagtcagtgctctt

SEQ ID NO: 22966 - DNA, 25 bp, Mus musculus
aaatggatacgttgtcagtgctctt

SEQ ID NO: 22967 - DNA, 25 bp, Mus musculus
aaatggatactcaggacagcccaag

SEQ ID NO: 22968 - DNA, 25 bp, Mus musculus
aaatggatactctggacagcccaag

SEQ ID NO: 22969 - DNA, 25 bp, Mus musculus
aaatggatccaaaaattcagctaga

SEQ ID NO: 22970 - DNA, 25 bp, Mus musculus
aaatggatccaataattcagctaga

SEQ ID NO: 22971 - DNA, 25 bp, Mus musculus
aaatggatccataagctgcagcagc

SEQ ID NO: 22972 - DNA, 25 bp, Mus musculus
aaatggatccattagctgcagcagc

SEQ ID NO: 22973 - DNA, 25 bp, Mus musculus
aaatggatccccatagtgctctgaa

SEQ ID NO: 22974 - DNA, 25 bp, Mus musculus
aaatggatccccttagtgctctgaa

SEQ ID NO: 22975 - DNA, 25 bp, Mus musculus
aaatggatcgaaaccagctgtaact

SEQ ID NO: 22976 - DNA, 25 bp, Mus musculus
aaatggatcgaatccagctgtaact

SEQ ID NO: 22977 - DNA, 25 bp, Mus musculus
aaatggatcgacaggtctcgcttcc

SEQ ID NO: 22978 - DNA, 25 bp, Mus musculus
aaatggatcgactggtctcgcttcc

SEQ ID NO: 22979 - DNA, 25 bp, Mus musculus
aaatggatcggaagtcagacaggaa

SEQ ID NO: 22980 - DNA, 25 bp, Mus musculus
aaatggatcggatgtcagacaggaa

SEQ ID NO: 22981 - DNA, 25 bp, Mus musculus
aaatggatctagaacagcacagcac

SEQ ID NO: 22982 - DNA, 25 bp, Mus musculus
aaatggatctagtacagcacagcac

SEQ ID NO: 22983 - DNA, 25 bp, Mus musculus
aaatggatgattacagtgttctgac

SEQ ID NO: 22984 - DNA, 25 bp, Mus musculus
aaatggatgatttcagtgttctgac

SEQ ID NO: 22985 - DNA, 25 bp, Mus musculus
aaatggatggacagtttgtttatat

SEQ ID NO: 22986 - DNA, 25 bp, Mus musculus
aaatggatggactgtttgtttatat

SEQ ID NO: 22987 - DNA, 25 bp, Mus musculus
aaatggatgggaatgaacagctaaa

SEQ ID NO: 22988 - DNA, 25 bp, Mus musculus
aaatggatgggattgaacagctaaa

SEQ ID NO: 22989 - DNA, 25 bp, Mus musculus
aaatggatgtgccaaccgccaacac

SEQ ID NO: 22990 - DNA, 25 bp, Mus musculus
aaatggatgtgcgaaccgccaacac

SEQ ID NO: 22991 - DNA, 25 bp, Mus musculus
aaatggattactacagcctgaactg

SEQ ID NO: 22992 - DNA, 25 bp, Mus musculus
aaatggattacttcagcctgaactg

SEQ ID NO: 22993 - DNA, 25 bp, Mus musculus
aaatggattcttaggcaggacactt

SEQ ID NO: 22994 - DNA, 25 bp, Mus musculus
aaatggattctttggcaggacactt

SEQ ID NO: 22995 - DNA, 25 bp, Mus musculus
aaatggattgacattgtagctctaa

SEQ ID NO: 22996 - DNA, 25 bp, Mus musculus
aaatggattgactttgtagctctaa

SEQ ID NO: 22997 - DNA, 25 bp, Mus musculus
aaatggattgtcattcatgtactga

SEQ ID NO: 22998 - DNA, 25 bp, Mus musculus
aaatggattgtctttcatgtactga

SEQ ID NO: 22999 - DNA, 25 bp, Mus musculus
aaatggattgttcttgcctcgtggt

SEQ ID NO: 23000 - DNA, 25 bp, Mus musculus
aaatggattgttgttgcctcgtggt

SEQ ID NO: 23001 - DNA, 25 bp, Mus musculus
aaatggatttcacccaagaatttct

SEQ ID NO: 23002 - DNA, 25 bp, Mus musculus
aaatggatttcagccaagaatttct

SEQ ID NO: 23003 - DNA, 25 bp, Mus musculus
aaatggcaagatagccccagggtag

SEQ ID NO: 23004 - DNA, 25 bp, Mus musculus
aaatggcaagattgccccagggtag

SEQ ID NO: 23005 - DNA, 25 bp, Mus musculus
aaatggcaaggtaccaggctggtct

SEQ ID NO: 23006 - DNA, 25 bp, Mus musculus
aaatggcaaggttccaggctggtct

SEQ ID NO: 23007 - DNA, 25 bp, Mus musculus
aaatggcaagttaggtgtccaacaa

SEQ ID NO: 23008 - DNA, 25 bp, Mus musculus
aaatggcaagttatgatatgagtat

SEQ ID NO: 23009 - DNA, 25 bp, Mus musculus
aaatggcaagtttggtgtccaacaa

SEQ ID NO: 23010 - DNA, 25 bp, Mus musculus
aaatggcaagttttgatatgagtat

SEQ ID NO: 23011 - DNA, 25 bp, Mus musculus
aaatggcaatttcgcgtctcagtcg

SEQ ID NO: 23012 - DNA, 25 bp, Mus musculus
aaatggcaatttggcgtctcagtcg

SEQ ID NO: 23013 - DNA, 25 bp, Mus musculus
aaatggcacaccaagattcttctgg

SEQ ID NO: 23014 - DNA, 25 bp, Mus musculus
aaatggcacacctagattcttctgg

SEQ ID NO: 23015 - DNA, 25 bp, Mus musculus
aaatggcacacgaagttttgcctgt

SEQ ID NO: 23016 - DNA, 25 bp, Mus musculus
aaatggcacacgtagttttgcctgt

SEQ ID NO: 23017 - DNA, 25 bp, Mus musculus
aaatggcacgggagtcaacagcact

SEQ ID NO: 23018 - DNA, 25 bp, Mus musculus
aaatggcacgggtgtcaacagcact

SEQ ID NO: 23019 - DNA, 25 bp, Mus musculus
aaatggcactagacacacacctcaa

SEQ ID NO: 23020 - DNA, 25 bp, Mus musculus
aaatggcactagtcacacacctcaa

SEQ ID NO: 23021 - DNA, 25 bp, Mus musculus
aaatggcagcagataactaaagctt

SEQ ID NO: 23022 - DNA, 25 bp, Mus musculus
aaatggcagcagttaactaaagctt

SEQ ID NO: 23023 - DNA, 25 bp, Mus musculus
aaatggcagccgattccagacttct

SEQ ID NO: 23024 - DNA, 25 bp, Mus musculus
aaatggcagccgtttccagacttct

SEQ ID NO: 23025 - DNA, 25 bp, Mus musculus
aaatggcaggacagcgagctgccca

SEQ ID NO: 23026 - DNA, 25 bp, Mus musculus
aaatggcaggactgcgagctgccca

SEQ ID NO: 23027 - DNA, 25 bp, Mus musculus
aaatggcaggtaattacatcttcac

SEQ ID NO: 23028 - DNA, 25 bp, Mus musculus
aaatggcaggtatttacatcttcac

SEQ ID NO: 23029 - DNA, 25 bp, Mus musculus
aaatggcaggtccttaacagcggct

SEQ ID NO: 23030 - DNA, 25 bp, Mus musculus
aaatggcaggtcgttaacagcggct

SEQ ID NO: 23031 - DNA, 25 bp, Mus musculus
aaatggcagtcaagctttcttctgc

SEQ ID NO: 23032 - DNA, 25 bp, Mus musculus
aaatggcagtcatgctttcttctgc

SEQ ID NO: 23033 - DNA, 25 bp, Mus musculus
aaatggcatataaatcctaacgggc

SEQ ID NO: 23034 - DNA, 25 bp, Mus musculus
aaatggcatatatatcctaacgggc

SEQ ID NO: 23035 - DNA, 25 bp, Mus musculus
aaatggcatgtgaggctaaagagat

SEQ ID NO: 23036 - DNA, 25 bp, Mus musculus
aaatggcatgtgtggctaaagagat

SEQ ID NO: 23037 - DNA, 25 bp, Mus musculus
aaatggccaaggagggccccaggct

SEQ ID NO: 23038 - DNA, 25 bp, Mus musculus
aaatggccaaggtgggccccaggct

SEQ ID NO: 23039 - DNA, 25 bp, Mus musculus
aaatggccaattatgcctccaggaa

SEQ ID NO: 23040 - DNA, 25 bp, Mus musculus
aaatggccaattttgcctccaggaa

SEQ ID NO: 23041 - DNA, 25 bp, Mus musculus
aaatggccacaaccctggatccatg

SEQ ID NO: 23042 - DNA, 25 bp, Mus musculus
aaatggccacaagcctggatccatg

SEQ ID NO: 23043 - DNA, 25 bp, Mus musculus
aaatggccacacacagagatcctga

SEQ ID NO: 23044 - DNA, 25 bp, Mus musculus
aaatggccacactcagagatcctga

SEQ ID NO: 23045 - DNA, 25 bp, Mus musculus
aaatggccacagaagtagctgctga

SEQ ID NO: 23046 - DNA, 25 bp, Mus musculus
aaatggccacagtagtagctgctga

SEQ ID NO: 23047 - DNA, 25 bp, Mus musculus
aaatggccaccactcctgagggctc

SEQ ID NO: 23048 - DNA, 25 bp, Mus musculus
aaatggccaccagtcctgagggctc

SEQ ID NO: 23049 - DNA, 25 bp, Mus musculus
aaatggccagtgacaaaatgttatt

SEQ ID NO: 23050 - DNA, 25 bp, Mus musculus
aaatggccagtgtcaaaatgttatt

SEQ ID NO: 23051 - DNA, 25 bp, Mus musculus
aaatggcccaagatgtcatctttta

SEQ ID NO: 23052 - DNA, 25 bp, Mus musculus
aaatggcccaagttgtcatctttta

SEQ ID NO: 23053 - DNA, 25 bp, Mus musculus
aaatggcccacaattgatcctcaga

SEQ ID NO: 23054 - DNA, 25 bp, Mus musculus
aaatggcccacatttgatcctcaga

SEQ ID NO: 23055 - DNA, 25 bp, Mus musculus
aaatggcccagcctttgagcgggat

SEQ ID NO: 23056 - DNA, 25 bp, Mus musculus
aaatggcccagcgtttgagcgggat

SEQ ID NO: 23057 - DNA, 25 bp, Mus musculus
aaatggcccatcatcctatattcaa

SEQ ID NO: 23058 - DNA, 25 bp, Mus musculus
aaatggcccatcttcctatattcaa

SEQ ID NO: 23059 - DNA, 25 bp, Mus musculus
aaatggccccatcatggtggcagca

SEQ ID NO: 23060 - DNA, 25 bp, Mus musculus
aaatggccccatgatggtggcagca

SEQ ID NO: 23061 - DNA, 25 bp, Mus musculus
aaatggcccctgattgaacactcat

SEQ ID NO: 23062 - DNA, 25 bp, Mus musculus
aaatggcccctgtttgaacactcat

SEQ ID NO: 23063 - DNA, 25 bp, Mus musculus
aaatggccctagcatattgccctgt

SEQ ID NO: 23064 - DNA, 25 bp, Mus musculus
aaatggccctaggatattgccctgt

SEQ ID NO: 23065 - DNA, 25 bp, Mus musculus
aaatggccgattagctttgttaaat

SEQ ID NO: 23066 - DNA, 25 bp, Mus musculus
aaatggccgatttgctttgttaaat

SEQ ID NO: 23067 - DNA, 25 bp, Mus musculus
aaatggcctcagattattaatatag

SEQ ID NO: 23068 - DNA, 25 bp, Mus musculus
aaatggcctcagtttattaatatag

SEQ ID NO: 23069 - DNA, 25 bp, Mus musculus
aaatggcctcctatattaggtgtgt

SEQ ID NO: 23070 - DNA, 25 bp, Mus musculus
aaatggcctcctttattaggtgtgt

SEQ ID NO: 23071 - DNA, 25 bp, Mus musculus
aaatggcctcgaatttatgacactt

SEQ ID NO: 23072 - DNA, 25 bp, Mus musculus
aaatggcctcgattttatgacactt

SEQ ID NO: 23073 - DNA, 25 bp, Mus musculus
aaatggcctggtacagtaagaactc

SEQ ID NO: 23074 - DNA, 25 bp, Mus musculus
aaatggcctggttcagtaagaactc

SEQ ID NO: 23075 - DNA, 25 bp, Mus musculus
aaatggcctgtaacctgtgtatcct

SEQ ID NO: 23076 - DNA, 25 bp, Mus musculus
aaatggcctgtatcctgtgtatcct

SEQ ID NO: 23077 - DNA, 25 bp, Mus musculus
aaatggcctgtcatgtgttttgtca

SEQ ID NO: 23078 - DNA, 25 bp, Mus musculus
aaatggcctgtcttgtgttttgtca

SEQ ID NO: 23079 - DNA, 25 bp, Mus musculus
aaatggccttttccttgtctggtaa

SEQ ID NO: 23080 - DNA, 25 bp, Mus musculus
aaatggccttttgcttgtctggtaa

SEQ ID NO: 23081 - DNA, 25 bp, Mus musculus
aaatggcgaacaagtgcttcactca

SEQ ID NO: 23082 - DNA, 25 bp, Mus musculus
aaatggcgaacatgtgcttcactca

SEQ ID NO: 23083 - DNA, 25 bp, Mus musculus
aaatggcgatctaaattactcataa

SEQ ID NO: 23084 - DNA, 25 bp, Mus musculus
aaatggcgatcttaattactcataa

SEQ ID NO: 23085 - DNA, 25 bp, Mus musculus
aaatggcgcaacaggcttgcttctg

SEQ ID NO: 23086 - DNA, 25 bp, Mus musculus
aaatggcgcaactggcttgcttctg

SEQ ID NO: 23087 - DNA, 25 bp, Mus musculus
aaatggcgcccaagcatagagcata

SEQ ID NO: 23088 - DNA, 25 bp, Mus musculus
aaatggcgcccatgcatagagcata

SEQ ID NO: 23089 - DNA, 25 bp, Mus musculus
aaatggcgtctcctatatgaagaac

SEQ ID NO: 23090 - DNA, 25 bp, Mus musculus
aaatggcgtctcgtatatgaagaac

SEQ ID NO: 23091 - DNA, 25 bp, Mus musculus
aaatggcgtgagacagaggcactct

SEQ ID NO: 23092 - DNA, 25 bp, Mus musculus
aaatggcgtgagtcagaggcactct

SEQ ID NO: 23093 - DNA, 25 bp, Mus musculus
aaatggctaaccacagtttcctgat

SEQ ID NO: 23094 - DNA, 25 bp, Mus musculus
aaatggctaacctcagtttcctgat

SEQ ID NO: 23095 - DNA, 25 bp, Mus musculus
aaatggctaatgcttttctctcaca

SEQ ID NO: 23096 - DNA, 25 bp, Mus musculus
aaatggctaatggttttctctcaca

SEQ ID NO: 23097 - DNA, 25 bp, Mus musculus
aaatggctactgaacctgagaacac

SEQ ID NO: 23098 - DNA, 25 bp, Mus musculus
aaatggctactgtacctgagaacac

SEQ ID NO: 23099 - DNA, 25 bp, Mus musculus
aaatggctatgacccttatcatata

SEQ ID NO: 23100 - DNA, 25 bp, Mus musculus
aaatggctatgagccttatcatata

SEQ ID NO: 23101 - DNA, 25 bp, Mus musculus
aaatggctcagaactcccagaactg

SEQ ID NO: 23102 - DNA, 25 bp, Mus musculus
aaatggctcagatctcccagaactg

SEQ ID NO: 23103 - DNA, 25 bp, Mus musculus
aaatggctcagtatgcccagcgtgc

SEQ ID NO: 23104 - DNA, 25 bp, Mus musculus
aaatggctcagtccttgtggtgttg

SEQ ID NO: 23105 - DNA, 25 bp, Mus musculus
aaatggctcagtgcttgtggtgttg

SEQ ID NO: 23106 - DNA, 25 bp, Mus musculus
aaatggctcagtttgcccagcgtgc

SEQ ID NO: 23107 - DNA, 25 bp, Mus musculus
aaatggctccacaggagttgccgct

SEQ ID NO: 23108 - DNA, 25 bp, Mus musculus
aaatggctccactggagttgccgct

SEQ ID NO: 23109 - DNA, 25 bp, Mus musculus
aaatggctccagaggtttaaccaca

SEQ ID NO: 23110 - DNA, 25 bp, Mus musculus
aaatggctccagtggtttaaccaca

SEQ ID NO: 23111 - DNA, 25 bp, Mus musculus
aaatggctcctaaggctccagaagc

SEQ ID NO: 23112 - DNA, 25 bp, Mus musculus
aaatggctcctatggctccagaagc

SEQ ID NO: 23113 - DNA, 25 bp, Mus musculus
aaatggctcctgaccaaagtgctta

SEQ ID NO: 23114 - DNA, 25 bp, Mus musculus
aaatggctcctgagccaagccaggg

SEQ ID NO: 23115 - DNA, 25 bp, Mus musculus
aaatggctcctgatttgcctgaata

SEQ ID NO: 23116 - DNA, 25 bp, Mus musculus
aaatggctcctgtccaaagtgctta

SEQ ID NO: 23117 - DNA, 25 bp, Mus musculus
aaatggctcctgtgccaagccaggg

SEQ ID NO: 23118 - DNA, 25 bp, Mus musculus
aaatggctcctgttttgcctgaata

SEQ ID NO: 23119 - DNA, 25 bp, Mus musculus
aaatggctgaaaagcttatctaaca

SEQ ID NO: 23120 - DNA, 25 bp, Mus musculus
aaatggctgaaatgcttatctaaca

SEQ ID NO: 23121 - DNA, 25 bp, Mus musculus
aaatggctgcacagcacggtggtat

SEQ ID NO: 23122 - DNA, 25 bp, Mus musculus
aaatggctgcactgcacggtggtat

SEQ ID NO: 23123 - DNA, 25 bp, Mus musculus
aaatggctgcagacctatctggttt

SEQ ID NO: 23124 - DNA, 25 bp, Mus musculus
aaatggctgcagtcctatctggttt

SEQ ID NO: 23125 - DNA, 25 bp, Mus musculus
aaatggctgcccacatggaagacag

SEQ ID NO: 23126 - DNA, 25 bp, Mus musculus
aaatggctgccctcatggaagacag

SEQ ID NO: 23127 - DNA, 25 bp, Mus musculus
aaatggctggctagggcctctcttc

SEQ ID NO: 23128 - DNA, 25 bp, Mus musculus
aaatggctggcttgggcctctcttc

SEQ ID NO: 23129 - DNA, 25 bp, Mus musculus
aaatggctgtagaatctagctgatt

SEQ ID NO: 23130 - DNA, 25 bp, Mus musculus
aaatggctgtagtatctagctgatt

SEQ ID NO: 23131 - DNA, 25 bp, Mus musculus
aaatggcttaacagagatacagtga

SEQ ID NO: 23132 - DNA, 25 bp, Mus musculus
aaatggcttaactgagatacagtga

SEQ ID NO: 23133 - DNA, 25 bp, Mus musculus
aaatggcttatgacggcttcagaat

SEQ ID NO: 23134 - DNA, 25 bp, Mus musculus
aaatggcttatgtcggcttcagaat

SEQ ID NO: 23135 - DNA, 25 bp, Mus musculus
aaatggcttcatagcagagacaggt

SEQ ID NO: 23136 - DNA, 25 bp, Mus musculus
aaatggcttcattgcagagacaggt

SEQ ID NO: 23137 - DNA, 25 bp, Mus musculus
aaatggcttctcaaggacgggaact

SEQ ID NO: 23138 - DNA, 25 bp, Mus musculus
aaatggcttctctaggacgggaact

SEQ ID NO: 23139 - DNA, 25 bp, Mus musculus
aaatggcttgccagtaacacctcag

SEQ ID NO: 23140 - DNA, 25 bp, Mus musculus
aaatggcttgcctgtaacacctcag

SEQ ID NO: 23141 - DNA, 25 bp, Mus musculus
aaatggcttggtcccattctgggct

SEQ ID NO: 23142 - DNA, 25 bp, Mus musculus
aaatggcttggtgccattctgggct

SEQ ID NO: 23143 - DNA, 25 bp, Mus musculus
aaatggcttgtgagtgatgccgtgt

SEQ ID NO: 23144 - DNA, 25 bp, Mus musculus
aaatggcttgtgtgtgatgccgtgt

SEQ ID NO: 23145 - DNA, 25 bp, Mus musculus
aaatggctttctaattcaaaactgg

SEQ ID NO: 23146 - DNA, 25 bp, Mus musculus
aaatggctttctatgctcagaaaaa

SEQ ID NO: 23147 - DNA, 25 bp, Mus musculus
aaatggctttcttattcaaaactgg

SEQ ID NO: 23148 - DNA, 25 bp, Mus musculus
aaatggctttctttgctcagaaaaa

SEQ ID NO: 23149 - DNA, 25 bp, Mus musculus
aaatggctttgtaagtggacttgct

SEQ ID NO: 23150 - DNA, 25 bp, Mus musculus
aaatggctttgttagtggacttgct

SEQ ID NO: 23151 - DNA, 25 bp, Mus musculus
aaatgggaaagaaccgcagccttca

SEQ ID NO: 23152 - DNA, 25 bp, Mus musculus
aaatgggaaagatccgcagccttca

SEQ ID NO: 23153 - DNA, 25 bp, Mus musculus
aaatgggaacagactctggatggct

SEQ ID NO: 23154 - DNA, 25 bp, Mus musculus
aaatgggaacagtctctggatggct

SEQ ID NO: 23155 - DNA, 25 bp, Mus musculus
aaatgggacaagctacaacagctta

SEQ ID NO: 23156 - DNA, 25 bp, Mus musculus
aaatgggacaaggtacaacagctta

SEQ ID NO: 23157 - DNA, 25 bp, Mus musculus
aaatgggaccagaagtttgccaact

SEQ ID NO: 23158 - DNA, 25 bp, Mus musculus
aaatgggaccagtagtttgccaact

SEQ ID NO: 23159 - DNA, 25 bp, Mus musculus
aaatgggaccataacaggtgtggca

SEQ ID NO: 23160 - DNA, 25 bp, Mus musculus
aaatgggaccattacaggtgtggca

SEQ ID NO: 23161 - DNA, 25 bp, Mus musculus
aaatgggacccaaatgttgtgcttc

SEQ ID NO: 23162 - DNA, 25 bp, Mus musculus
aaatgggacccatatgttgtgcttc

SEQ ID NO: 23163 - DNA, 25 bp, Mus musculus
aaatgggaccctcaagagacaccca

SEQ ID NO: 23164 - DNA, 25 bp, Mus musculus
aaatgggaccctgaagagacaccca

SEQ ID NO: 23165 - DNA, 25 bp, Mus musculus
aaatgggacgttccagttttcgaat

SEQ ID NO: 23166 - DNA, 25 bp, Mus musculus
aaatgggacgttgcagttttcgaat

SEQ ID NO: 23167 - DNA, 25 bp, Mus musculus
aaatgggacttaactcctgaagaaa

SEQ ID NO: 23168 - DNA, 25 bp, Mus musculus
aaatgggacttatctcctgaagaaa

SEQ ID NO: 23169 - DNA, 25 bp, Mus musculus
aaatgggagctgatgccttttgtac

SEQ ID NO: 23170 - DNA, 25 bp, Mus musculus
aaatgggagctgcttacctagaata

SEQ ID NO: 23171 - DNA, 25 bp, Mus musculus
aaatgggagctggttacctagaata

SEQ ID NO: 23172 - DNA, 25 bp, Mus musculus
aaatgggagctgttgccttttgtac

SEQ ID NO: 23173 - DNA, 25 bp, Mus musculus
aaatgggaggtcctggctttcagca

SEQ ID NO: 23174 - DNA, 25 bp, Mus musculus
aaatgggaggtcgtggctttcagca

SEQ ID NO: 23175 - DNA, 25 bp, Mus musculus
aaatgggagttcacagctgggaaac

SEQ ID NO: 23176 - DNA, 25 bp, Mus musculus
aaatgggagttctcagctgggaaac

SEQ ID NO: 23177 - DNA, 25 bp, Mus musculus
aaatgggatagcagtttcctccaaa

SEQ ID NO: 23178 - DNA, 25 bp, Mus musculus
aaatgggatagctgtttcctccaaa

SEQ ID NO: 23179 - DNA, 25 bp, Mus musculus
aaatgggatcctctgcttagctatt

SEQ ID NO: 23180 - DNA, 25 bp, Mus musculus
aaatgggatcctgtgcttagctatt

SEQ ID NO: 23181 - DNA, 25 bp, Mus musculus
aaatgggatttcagtgtggcctggc

SEQ ID NO: 23182 - DNA, 25 bp, Mus musculus
aaatgggatttctgtgtggcctggc

SEQ ID NO: 23183 - DNA, 25 bp, Mus musculus
aaatgggattttagcctgttgactt

SEQ ID NO: 23184 - DNA, 25 bp, Mus musculus
aaatgggatttttgcctgttgactt

SEQ ID NO: 23185 - DNA, 25 bp, Mus musculus
aaatgggcaaaaagtggcctgtgaa

SEQ ID NO: 23186 - DNA, 25 bp, Mus musculus
aaatgggcaaaatgtggcctgtgaa

SEQ ID NO: 23187 - DNA, 25 bp, Mus musculus
aaatgggcaacacgaagagtcaaca

SEQ ID NO: 23188 - DNA, 25 bp, Mus musculus
aaatgggcaacaggaagagtcaaca

SEQ ID NO: 23189 - DNA, 25 bp, Mus musculus
aaatgggcaaggatagaggcgctcc

SEQ ID NO: 23190 - DNA, 25 bp, Mus musculus
aaatgggcaaggttagaggcgctcc

SEQ ID NO: 23191 - DNA, 25 bp, Mus musculus
aaatgggcaccaacgtaccagcagt

SEQ ID NO: 23192 - DNA, 25 bp, Mus musculus
aaatgggcaccatcgtaccagcagt

SEQ ID NO: 23193 - DNA, 25 bp, Mus musculus
aaatgggcactaacagacccctgtc

SEQ ID NO: 23194 - DNA, 25 bp, Mus musculus
aaatgggcactatcagacccctgtc

SEQ ID NO: 23195 - DNA, 25 bp, Mus musculus
aaatgggcactcacaagggctatgg

SEQ ID NO: 23196 - DNA, 25 bp, Mus musculus
aaatgggcactctcaagggctatgg

SEQ ID NO: 23197 - DNA, 25 bp, Mus musculus
aaatgggcagttactccctgataac

SEQ ID NO: 23198 - DNA, 25 bp, Mus musculus
aaatgggcagtttctccctgataac

SEQ ID NO: 23199 - DNA, 25 bp, Mus musculus
aaatgggcgagacacacctgcactc

SEQ ID NO: 23200 - DNA, 25 bp, Mus musculus
aaatgggcgagagacacctgcactc

SEQ ID NO: 23201 - DNA, 25 bp, Mus musculus
aaatgggctaagaggtctaggatgt

SEQ ID NO: 23202 - DNA, 25 bp, Mus musculus
aaatgggctaagtggtctaggatgt

SEQ ID NO: 23203 - DNA, 25 bp, Mus musculus
aaatgggctctacacttcaccctgg

SEQ ID NO: 23204 - DNA, 25 bp, Mus musculus
aaatgggctctagacttcaccctgg

SEQ ID NO: 23205 - DNA, 25 bp, Mus musculus
aaatgggctgctcgccagaacaagc

SEQ ID NO: 23206 - DNA, 25 bp, Mus musculus
aaatgggctgctggccagaacaagc

SEQ ID NO: 23207 - DNA, 25 bp, Mus musculus
aaatgggcttcacagcttctgcctg

SEQ ID NO: 23208 - DNA, 25 bp, Mus musculus
aaatgggcttcagagcttctgcctg

SEQ ID NO: 23209 - DNA, 25 bp, Mus musculus
aaatgggcttgtctgactgaatgta

SEQ ID NO: 23210 - DNA, 25 bp, Mus musculus
aaatgggcttgtgtgactgaatgta

SEQ ID NO: 23211 - DNA, 25 bp, Mus musculus
aaatgggtaatactatttcctatgt

SEQ ID NO: 23212 - DNA, 25 bp, Mus musculus
aaatgggtaatagtatttcctatgt

SEQ ID NO: 23213 - DNA, 25 bp, Mus musculus
aaatgggtatctagtgtctgggcag

SEQ ID NO: 23214 - DNA, 25 bp, Mus musculus
aaatgggtatcttgtgtctgggcag

SEQ ID NO: 23215 - DNA, 25 bp, Mus musculus
aaatgggtcagcctacaatcctgtg

SEQ ID NO: 23216 - DNA, 25 bp, Mus musculus
aaatgggtcagcgtacaatcctgtg

SEQ ID NO: 23217 - DNA, 25 bp, Mus musculus
aaatgggtccaacaattctctctct

SEQ ID NO: 23218 - DNA, 25 bp, Mus musculus
aaatgggtccaagaattctctctct

SEQ ID NO: 23219 - DNA, 25 bp, Mus musculus
aaatgggtccataggcttttccact

SEQ ID NO: 23220 - DNA, 25 bp, Mus musculus
aaatgggtccattggcttttccact

SEQ ID NO: 23221 - DNA, 25 bp, Mus musculus
aaatgggtcccgagcttttattatg

SEQ ID NO: 23222 - DNA, 25 bp, Mus musculus
aaatgggtcccgtgcttttattatg

SEQ ID NO: 23223 - DNA, 25 bp, Mus musculus
aaatgggtcctaactcaggtggcct

SEQ ID NO: 23224 - DNA, 25 bp, Mus musculus
aaatgggtcctatctcaggtggcct

SEQ ID NO: 23225 - DNA, 25 bp, Mus musculus
aaatgggtctttctctgaacctgga

SEQ ID NO: 23226 - DNA, 25 bp, Mus musculus
aaatgggtctttgtctgaacctgga

SEQ ID NO: 23227 - DNA, 25 bp, Mus musculus
aaatgggtgcatctcctgtttctca

SEQ ID NO: 23228 - DNA, 25 bp, Mus musculus
aaatgggtgcatgtcctgtttctca

SEQ ID NO: 23229 - DNA, 25 bp, Mus musculus
aaatgggtgccactacagtcgtgtc

SEQ ID NO: 23230 - DNA, 25 bp, Mus musculus
aaatgggtgccagtacagtcgtgtc

SEQ ID NO: 23231 - DNA, 25 bp, Mus musculus
aaatgggtgttccagttgccatgct

SEQ ID NO: 23232 - DNA, 25 bp, Mus musculus
aaatgggtgttcgagttgccatgct

SEQ ID NO: 23233 - DNA, 25 bp, Mus musculus
aaatgggttcgcagaatgctgtctt

SEQ ID NO: 23234 - DNA, 25 bp, Mus musculus
aaatgggttcgctgaatgctgtctt

SEQ ID NO: 23235 - DNA, 25 bp, Mus musculus
aaatgggtttggaccgcatcaagga

SEQ ID NO: 23236 - DNA, 25 bp, Mus musculus
aaatgggtttggtccgcatcaagga

SEQ ID NO: 23237 - DNA, 25 bp, Mus musculus
aaatggtaagtccttcctactgcag

SEQ ID NO: 23238 - DNA, 25 bp, Mus musculus
aaatggtaagtcgttcctactgcag

SEQ ID NO: 23239 - DNA, 25 bp, Mus musculus
aaatggtactccaatcctaatctca

SEQ ID NO: 23240 - DNA, 25 bp, Mus musculus
aaatggtactcctatcctaatctca

SEQ ID NO: 23241 - DNA, 25 bp, Mus musculus
aaatggtactttactgctccgttat

SEQ ID NO: 23242 - DNA, 25 bp, Mus musculus
aaatggtacttttctgctccgttat

SEQ ID NO: 23243 - DNA, 25 bp, Mus musculus
aaatggtagtgaagcttcagcaagc

SEQ ID NO: 23244 - DNA, 25 bp, Mus musculus
aaatggtagtgatgcttcagcaagc

SEQ ID NO: 23245 - DNA, 25 bp, Mus musculus
aaatggtagtttctattcctggaat

SEQ ID NO: 23246 - DNA, 25 bp, Mus musculus
aaatggtagtttgtattcctggaat

SEQ ID NO: 23247 - DNA, 25 bp, Mus musculus
aaatggtatggccacgaccctgaac

SEQ ID NO: 23248 - DNA, 25 bp, Mus musculus
aaatggtatggcgacgaccctgaac

SEQ ID NO: 23249 - DNA, 25 bp, Mus musculus
aaatggtattcgagtcggtggtcgt

SEQ ID NO: 23250 - DNA, 25 bp, Mus musculus
aaatggtattcgtgtcggtggtcgt

SEQ ID NO: 23251 - DNA, 25 bp, Mus musculus
aaatggtcacagcattgctctagag

SEQ ID NO: 23252 - DNA, 25 bp, Mus musculus
aaatggtcacaggattgctctagag

SEQ ID NO: 23253 - DNA, 25 bp, Mus musculus
aaatggtcactcaggtttttgcaaa

SEQ ID NO: 23254 - DNA, 25 bp, Mus musculus
aaatggtcactctggtttttgcaaa

SEQ ID NO: 23255 - DNA, 25 bp, Mus musculus
aaatggtcagaacggctgagctgtc

SEQ ID NO: 23256 - DNA, 25 bp, Mus musculus
aaatggtcagaagggctgagctgtc

SEQ ID NO: 23257 - DNA, 25 bp, Mus musculus
aaatggtccctgagtacagcacggc

SEQ ID NO: 23258 - DNA, 25 bp, Mus musculus
aaatggtccctgctcctgagtgaca

SEQ ID NO: 23259 - DNA, 25 bp, Mus musculus
aaatggtccctggtcctgagtgaca

SEQ ID NO: 23260 - DNA, 25 bp, Mus musculus
aaatggtccctgtgtacagcacggc

SEQ ID NO: 23261 - DNA, 25 bp, Mus musculus
aaatggtcctctacaagtgctcctg

SEQ ID NO: 23262 - DNA, 25 bp, Mus musculus
aaatggtcctcttcaagtgctcctg

SEQ ID NO: 23263 - DNA, 25 bp, Mus musculus
aaatggtcctggatgaccacacgct

SEQ ID NO: 23264 - DNA, 25 bp, Mus musculus
aaatggtcctggttgaccacacgct

SEQ ID NO: 23265 - DNA, 25 bp, Mus musculus
aaatggtcctttaactcctgcttct

SEQ ID NO: 23266 - DNA, 25 bp, Mus musculus
aaatggtccttttactcctgcttct

SEQ ID NO: 23267 - DNA, 25 bp, Mus musculus
aaatggtcgggtacagattctcact

SEQ ID NO: 23268 - DNA, 25 bp, Mus musculus
aaatggtcgggttcagattctcact

SEQ ID NO: 23269 - DNA, 25 bp, Mus musculus
aaatggtctctgatttcaatttcaa

SEQ ID NO: 23270 - DNA, 25 bp, Mus musculus
aaatggtctctgttttcaatttcaa

SEQ ID NO: 23271 - DNA, 25 bp, Mus musculus
aaatggtctgctcagtagactcaaa

SEQ ID NO: 23272 - DNA, 25 bp, Mus musculus
aaatggtctgctcgtaagtattttt

SEQ ID NO: 23273 - DNA, 25 bp, Mus musculus
aaatggtctgctgagtagactcaaa

SEQ ID NO: 23274 - DNA, 25 bp, Mus musculus
aaatggtctgctggtaagtattttt

SEQ ID NO: 23275 - DNA, 25 bp, Mus musculus
aaatggtctggaaacaagtgtcttt

SEQ ID NO: 23276 - DNA, 25 bp, Mus musculus
aaatggtctggatacaagtgtcttt

SEQ ID NO: 23277 - DNA, 25 bp, Mus musculus
aaatggtcttcaatctttgctaatt

SEQ ID NO: 23278 - DNA, 25 bp, Mus musculus
aaatggtcttcattctttgctaatt

SEQ ID NO: 23279 - DNA, 25 bp, Mus musculus
aaatggtcttccacataactctgcc

SEQ ID NO: 23280 - DNA, 25 bp, Mus musculus
aaatggtcttcctcataactctgcc

SEQ ID NO: 23281 - DNA, 25 bp, Mus musculus
aaatggtcttgtctgccttctttct

SEQ ID NO: 23282 - DNA, 25 bp, Mus musculus
aaatggtcttgtgtgccttctttct

SEQ ID NO: 23283 - DNA, 25 bp, Mus musculus
aaatggtctttcacctacaatttag

SEQ ID NO: 23284 - DNA, 25 bp, Mus musculus
aaatggtctttctcctacaatttag

SEQ ID NO: 23285 - DNA, 25 bp, Mus musculus
aaatggtgaagtctttctctgtgca

SEQ ID NO: 23286 - DNA, 25 bp, Mus musculus
aaatggtgaagtgtttctctgtgca

SEQ ID NO: 23287 - DNA, 25 bp, Mus musculus
aaatggtgacttcggttcatctaga

SEQ ID NO: 23288 - DNA, 25 bp, Mus musculus
aaatggtgacttgggttcatctaga

SEQ ID NO: 23289 - DNA, 25 bp, Mus musculus
aaatggtgagagctttccgctttcc

SEQ ID NO: 23290 - DNA, 25 bp, Mus musculus
aaatggtgagaggtttccgctttcc

SEQ ID NO: 23291 - DNA, 25 bp, Mus musculus
aaatggtgagcaacccacagggcag

SEQ ID NO: 23292 - DNA, 25 bp, Mus musculus
aaatggtgagcatcccacagggcag

SEQ ID NO: 23293 - DNA, 25 bp, Mus musculus
aaatggtgcaacacatctcggtctg

SEQ ID NO: 23294 - DNA, 25 bp, Mus musculus
aaatggtgcaactcatctcggtctg

SEQ ID NO: 23295 - DNA, 25 bp, Mus musculus
aaatggtgccaaagcgctaccacag

SEQ ID NO: 23296 - DNA, 25 bp, Mus musculus
aaatggtgccaatgcgctaccacag

SEQ ID NO: 23297 - DNA, 25 bp, Mus musculus
aaatggtgcctaactgttggctgac

SEQ ID NO: 23298 - DNA, 25 bp, Mus musculus
aaatggtgcctatctgttggctgac

SEQ ID NO: 23299 - DNA, 25 bp, Mus musculus
aaatggtgctgcctacattcaggga

SEQ ID NO: 23300 - DNA, 25 bp, Mus musculus
aaatggtgctgcgtacattcaggga

SEQ ID NO: 23301 - DNA, 25 bp, Mus musculus
aaatggtgcttcaataaaccgcttc

SEQ ID NO: 23302 - DNA, 25 bp, Mus musculus
aaatggtgcttctataaaccgcttc

SEQ ID NO: 23303 - DNA, 25 bp, Mus musculus
aaatggtggatgattccctcactgt

SEQ ID NO: 23304 - DNA, 25 bp, Mus musculus
aaatggtggatgtttccctcactgt

SEQ ID NO: 23305 - DNA, 25 bp, Mus musculus
aaatggtggcagaccaggtgcccta

SEQ ID NO: 23306 - DNA, 25 bp, Mus musculus
aaatggtggcagtccaggtgcccta

SEQ ID NO: 23307 - DNA, 25 bp, Mus musculus
aaatggtggtatcaagccctctccc

SEQ ID NO: 23308 - DNA, 25 bp, Mus musculus
aaatggtggtatgaagccctctccc

SEQ ID NO: 23309 - DNA, 25 bp, Mus musculus
aaatggtgtcacctgaagctgccat

SEQ ID NO: 23310 - DNA, 25 bp, Mus musculus
aaatggtgtcacgtgaagctgccat

SEQ ID NO: 23311 - DNA, 25 bp, Mus musculus
aaatggtgtcagattatgccccctc

SEQ ID NO: 23312 - DNA, 25 bp, Mus musculus
aaatggtgtcagtttatgccccctc

SEQ ID NO: 23313 - DNA, 25 bp, Mus musculus
aaatggtgtgccaaccctttaatgc

SEQ ID NO: 23314 - DNA, 25 bp, Mus musculus
aaatggtgtgcctaccctttaatgc

SEQ ID NO: 23315 - DNA, 25 bp, Mus musculus
aaatggtgtgcgagcagaggcttct

SEQ ID NO: 23316 - DNA, 25 bp, Mus musculus
aaatggtgtgcgtgcagaggcttct

SEQ ID NO: 23317 - DNA, 25 bp, Mus musculus
aaatggtgtggacctgtgcaattct

SEQ ID NO: 23318 - DNA, 25 bp, Mus musculus
aaatggtgtggagctgtgcaattct

SEQ ID NO: 23319 - DNA, 25 bp, Mus musculus
aaatggtgtttcacttccaggcttt

SEQ ID NO: 23320 - DNA, 25 bp, Mus musculus
aaatggtgtttctcttccaggcttt

SEQ ID NO: 23321 - DNA, 25 bp, Mus musculus
aaatggttaccacactctgagtcct

SEQ ID NO: 23322 - DNA, 25 bp, Mus musculus
aaatggttaccagactctgagtcct

SEQ ID NO: 23323 - DNA, 25 bp, Mus musculus
aaatggttagtcctccactgtgcta

SEQ ID NO: 23324 - DNA, 25 bp, Mus musculus
aaatggttagtcgtccactgtgcta

SEQ ID NO: 23325 - DNA, 25 bp, Mus musculus
aaatggttagttctgattggctggt

SEQ ID NO: 23326 - DNA, 25 bp, Mus musculus
aaatggttagttgtgattggctggt

SEQ ID NO: 23327 - DNA, 25 bp, Mus musculus
aaatggttcatcagcagcacatggt

SEQ ID NO: 23328 - DNA, 25 bp, Mus musculus
aaatggttcatctgcagcacatggt

SEQ ID NO: 23329 - DNA, 25 bp, Mus musculus
aaatggttccagcagttgacctcgg

SEQ ID NO: 23330 - DNA, 25 bp, Mus musculus
aaatggttccaggagttgacctcgg

SEQ ID NO: 23331 - DNA, 25 bp, Mus musculus
aaatggttctccatacggactccag

SEQ ID NO: 23332 - DNA, 25 bp, Mus musculus
aaatggttctccttacggactccag

SEQ ID NO: 23333 - DNA, 25 bp, Mus musculus
aaatggttctctcagggccaaggca

SEQ ID NO: 23334 - DNA, 25 bp, Mus musculus
aaatggttctctgagggccaaggca

SEQ ID NO: 23335 - DNA, 25 bp, Mus musculus
aaatggttctgcaaccataccacta

SEQ ID NO: 23336 - DNA, 25 bp, Mus musculus
aaatggttctgcaatgacccctaac

SEQ ID NO: 23337 - DNA, 25 bp, Mus musculus
aaatggttctgctaccataccacta

SEQ ID NO: 23338 - DNA, 25 bp, Mus musculus
aaatggttctgctatgacccctaac

SEQ ID NO: 23339 - DNA, 25 bp, Mus musculus
aaatggttctttactgcattgccgt

SEQ ID NO: 23340 - DNA, 25 bp, Mus musculus
aaatggttcttttctgcattgccgt

SEQ ID NO: 23341 - DNA, 25 bp, Mus musculus
aaatggttgcctctgatttcatcca

SEQ ID NO: 23342 - DNA, 25 bp, Mus musculus
aaatggttgcctgtgatttcatcca

SEQ ID NO: 23343 - DNA, 25 bp, Mus musculus
aaatggttgctcatggttcctctct

SEQ ID NO: 23344 - DNA, 25 bp, Mus musculus
aaatggttgctccaatgttgctgct

SEQ ID NO: 23345 - DNA, 25 bp, Mus musculus
aaatggttgctcgaatgttgctgct

SEQ ID NO: 23346 - DNA, 25 bp, Mus musculus
aaatggttgctcttggttcctctct

SEQ ID NO: 23347 - DNA, 25 bp, Mus musculus
aaatggttgggcagtctcaagaaaa

SEQ ID NO: 23348 - DNA, 25 bp, Mus musculus
aaatggttgggctgtctcaagaaaa

SEQ ID NO: 23349 - DNA, 25 bp, Mus musculus
aaatggttgtaaaggcgtgtgctgc

SEQ ID NO: 23350 - DNA, 25 bp, Mus musculus
aaatggttgtaatggcgtgtgctgc

SEQ ID NO: 23351 - DNA, 25 bp, Mus musculus
aaatggttgtcgctttgctctctgg

SEQ ID NO: 23352 - DNA, 25 bp, Mus musculus
aaatggttgtcggtttgctctctgg

SEQ ID NO: 23353 - DNA, 25 bp, Mus musculus
aaatggttgtgaacactgcctgtaa

SEQ ID NO: 23354 - DNA, 25 bp, Mus musculus
aaatggttgtgatcactgcctgtaa

SEQ ID NO: 23355 - DNA, 25 bp, Mus musculus
aaatggttgttcagcctctgttggt

SEQ ID NO: 23356 - DNA, 25 bp, Mus musculus
aaatggttgttctgcctctgttggt

SEQ ID NO: 23357 - DNA, 25 bp, Mus musculus
aaatggtttcgtcagatgtatacaa

SEQ ID NO: 23358 - DNA, 25 bp, Mus musculus
aaatggtttcgtgagatgtatacaa

SEQ ID NO: 23359 - DNA, 25 bp, Mus musculus
aaatggtttgctctatcctggataa

SEQ ID NO: 23360 - DNA, 25 bp, Mus musculus
aaatggtttgctgtatcctggataa

SEQ ID NO: 23361 - DNA, 25 bp, Mus musculus
aaatggtttggcacagatgtgctac

SEQ ID NO: 23362 - DNA, 25 bp, Mus musculus
aaatggtttggctcagatgtgctac

SEQ ID NO: 23363 - DNA, 25 bp, Mus musculus
aaatggtttggtcccagcagtggtc

SEQ ID NO: 23364 - DNA, 25 bp, Mus musculus
aaatggtttggtgccagcagtggtc

SEQ ID NO: 23365 - DNA, 25 bp, Mus musculus
aaatggtttgtcatctgctgaccct

SEQ ID NO: 23366 - DNA, 25 bp, Mus musculus
aaatggtttgtcttctgctgaccct

SEQ ID NO: 23367 - DNA, 25 bp, Mus musculus
aaatggtttgtgcttcagtcatcat

SEQ ID NO: 23368 - DNA, 25 bp, Mus musculus
aaatggtttgtggttcagtcatcat

SEQ ID NO: 23369 - DNA, 25 bp, Mus musculus
aaatggttttctccatgtccaggca

SEQ ID NO: 23370 - DNA, 25 bp, Mus musculus
aaatggttttctgcatgtccaggca

SEQ ID NO: 23371 - DNA, 25 bp, Mus musculus
aaatggttttgcacactttgatttt

SEQ ID NO: 23372 - DNA, 25 bp, Mus musculus
aaatggttttgctcactttgatttt

SEQ ID NO: 23373 - DNA, 25 bp, Mus musculus
aaatggttttgtcttcctgctgatt

SEQ ID NO: 23374 - DNA, 25 bp, Mus musculus
aaatggttttgtgttcctgctgatt

SEQ ID NO: 23375 - DNA, 25 bp, Mus musculus
aaatgtaacaagagaagctgtcgtt

SEQ ID NO: 23376 - DNA, 25 bp, Mus musculus
aaatgtaacaagtgaagctgtcgtt

SEQ ID NO: 23377 - DNA, 25 bp, Mus musculus
aaatgtaactgtctacctgcacacc

SEQ ID NO: 23378 - DNA, 25 bp, Mus musculus
aaatgtaactgtgtacctgcacacc

SEQ ID NO: 23379 - DNA, 25 bp, Mus musculus
aaatgtaagagcatccctggtccag

SEQ ID NO: 23380 - DNA, 25 bp, Mus musculus
aaatgtaagagcttccctggtccag

SEQ ID NO: 23381 - DNA, 25 bp, Mus musculus
aaatgtaagcctctcagagctacac

SEQ ID NO: 23382 - DNA, 25 bp, Mus musculus
aaatgtaagcctgtcagagctacac

SEQ ID NO: 23383 - DNA, 25 bp, Mus musculus
aaatgtaagctacttgctactgggt

SEQ ID NO: 23384 - DNA, 25 bp, Mus musculus
aaatgtaagctagttgctactgggt

SEQ ID NO: 23385 - DNA, 25 bp, Mus musculus
aaatgtaatttgagccctgggataa

SEQ ID NO: 23386 - DNA, 25 bp, Mus musculus
aaatgtaatttgtgccctgggataa

SEQ ID NO: 23387 - DNA, 25 bp, Mus musculus
aaatgtacaagtcttagaaccaaga

SEQ ID NO: 23388 - DNA, 25 bp, Mus musculus
aaatgtacaagtgttagaaccaaga

SEQ ID NO: 23389 - DNA, 25 bp, Mus musculus
aaatgtacacatccagccattgctt

SEQ ID NO: 23390 - DNA, 25 bp, Mus musculus
aaatgtacacatgcagccattgctt

SEQ ID NO: 23391 - DNA, 25 bp, Mus musculus
aaatgtacactcaatactgaaataa

SEQ ID NO: 23392 - DNA, 25 bp, Mus musculus
aaatgtacactctatactgaaataa

SEQ ID NO: 23393 - DNA, 25 bp, Mus musculus
aaatgtacacttctgtatggttctg

SEQ ID NO: 23394 - DNA, 25 bp, Mus musculus
aaatgtacacttgtgtatggttctg

SEQ ID NO: 23395 - DNA, 25 bp, Mus musculus
aaatgtacagcccttaccatagaaa

SEQ ID NO: 23396 - DNA, 25 bp, Mus musculus
aaatgtacagccgttaccatagaaa

SEQ ID NO: 23397 - DNA, 25 bp, Mus musculus
aaatgtacagtgagacttcactcct

SEQ ID NO: 23398 - DNA, 25 bp, Mus musculus
aaatgtacagtgtgacttcactcct

SEQ ID NO: 23399 - DNA, 25 bp, Mus musculus
aaatgtacatacactaggtggcaat

SEQ ID NO: 23400 - DNA, 25 bp, Mus musculus
aaatgtacatactctaggtggcaat

SEQ ID NO: 23401 - DNA, 25 bp, Mus musculus
aaatgtacatggatgctctcagtag

SEQ ID NO: 23402 - DNA, 25 bp, Mus musculus
aaatgtacatggttgctctcagtag

SEQ ID NO: 23403 - DNA, 25 bp, Mus musculus
aaatgtacccagcaagcttgtgtaa

SEQ ID NO: 23404 - DNA, 25 bp, Mus musculus
aaatgtacccaggaagcttgtgtaa

SEQ ID NO: 23405 - DNA, 25 bp, Mus musculus
aaatgtaccctgagatgctgtggtg

SEQ ID NO: 23406 - DNA, 25 bp, Mus musculus
aaatgtaccctgtgatgctgtggtg

SEQ ID NO: 23407 - DNA, 25 bp, Mus musculus
aaatgtacccttactccagtctgtc

SEQ ID NO: 23408 - DNA, 25 bp, Mus musculus
aaatgtaccctttctccagtctgtc

SEQ ID NO: 23409 - DNA, 25 bp, Mus musculus
aaatgtaccgttcgactctgctgca

SEQ ID NO: 23410 - DNA, 25 bp, Mus musculus
aaatgtaccgttggactctgctgca

SEQ ID NO: 23411 - DNA, 25 bp, Mus musculus
aaatgtaccttacttttgcagacaa

SEQ ID NO: 23412 - DNA, 25 bp, Mus musculus
aaatgtaccttagttttgcagacaa

SEQ ID NO: 23413 - DNA, 25 bp, Mus musculus
aaatgtacgcacactcagcagatga

SEQ ID NO: 23414 - DNA, 25 bp, Mus musculus
aaatgtacgcactctcagcagatga

SEQ ID NO: 23415 - DNA, 25 bp, Mus musculus
aaatgtactcaaagtgacaaagcct

SEQ ID NO: 23416 - DNA, 25 bp, Mus musculus
aaatgtactcaatgtgacaaagcct

SEQ ID NO: 23417 - DNA, 25 bp, Mus musculus
aaatgtactctcagccattagtttt

SEQ ID NO: 23418 - DNA, 25 bp, Mus musculus
aaatgtactctctgccattagtttt

SEQ ID NO: 23419 - DNA, 25 bp, Mus musculus
aaatgtacttctaatcgcattagaa

SEQ ID NO: 23420 - DNA, 25 bp, Mus musculus
aaatgtacttcttatcgcattagaa

SEQ ID NO: 23421 - DNA, 25 bp, Mus musculus
aaatgtagaaggagtttcctcccag

SEQ ID NO: 23422 - DNA, 25 bp, Mus musculus
aaatgtagaaggtgtttcctcccag

SEQ ID NO: 23423 - DNA, 25 bp, Mus musculus
aaatgtagacagcagcacttcccca

SEQ ID NO: 23424 - DNA, 25 bp, Mus musculus
aaatgtagacaggagcacttcccca

SEQ ID NO: 23425 - DNA, 25 bp, Mus musculus
aaatgtagccaaagtcactaggtta

SEQ ID NO: 23426 - DNA, 25 bp, Mus musculus
aaatgtagccaatgtcactaggtta

SEQ ID NO: 23427 - DNA, 25 bp, Mus musculus
aaatgtagcccacctttccaggagg

SEQ ID NO: 23428 - DNA, 25 bp, Mus musculus
aaatgtagcccagctttccaggagg

SEQ ID NO: 23429 - DNA, 25 bp, Mus musculus
aaatgtagccctcaggatttggcca

SEQ ID NO: 23430 - DNA, 25 bp, Mus musculus
aaatgtagccctgaggatttggcca

SEQ ID NO: 23431 - DNA, 25 bp, Mus musculus
aaatgtagctctctcagcctgtggc

SEQ ID NO: 23432 - DNA, 25 bp, Mus musculus
aaatgtagctctgtcagcctgtggc

SEQ ID NO: 23433 - DNA, 25 bp, Mus musculus
aaatgtagcttgacagattcaccat

SEQ ID NO: 23434 - DNA, 25 bp, Mus musculus
aaatgtagcttgtcagattcaccat

SEQ ID NO: 23435 - DNA, 25 bp, Mus musculus
aaatgtaggcatagcttctccacgc

SEQ ID NO: 23436 - DNA, 25 bp, Mus musculus
aaatgtaggcattgcttctccacgc

SEQ ID NO: 23437 - DNA, 25 bp, Mus musculus
aaatgtagtatgcacttgccgctaa

SEQ ID NO: 23438 - DNA, 25 bp, Mus musculus
aaatgtagtatggacttgccgctaa

SEQ ID NO: 23439 - DNA, 25 bp, Mus musculus
aaatgtagtattattaagctgtcca

SEQ ID NO: 23440 - DNA, 25 bp, Mus musculus
aaatgtagtatttttaagctgtcca

SEQ ID NO: 23441 - DNA, 25 bp, Mus musculus
aaatgtagtctgaccatgtcgggta

SEQ ID NO: 23442 - DNA, 25 bp, Mus musculus
aaatgtagtctgtccatgtcgggta

SEQ ID NO: 23443 - DNA, 25 bp, Mus musculus
aaatgtagtgctaatgtttgaacag

SEQ ID NO: 23444 - DNA, 25 bp, Mus musculus
aaatgtagtgcttatgtttgaacag

SEQ ID NO: 23445 - DNA, 25 bp, Mus musculus
aaatgtataagcaaggaacctaggt

SEQ ID NO: 23446 - DNA, 25 bp, Mus musculus
aaatgtataagctaggaacctaggt

SEQ ID NO: 23447 - DNA, 25 bp, Mus musculus
aaatgtatacatctccacactcgaa

SEQ ID NO: 23448 - DNA, 25 bp, Mus musculus
aaatgtatacatgtccacactcgaa

SEQ ID NO: 23449 - DNA, 25 bp, Mus musculus
aaatgtatactgactttagagagtt

SEQ ID NO: 23450 - DNA, 25 bp, Mus musculus
aaatgtatactgtctttagagagtt

SEQ ID NO: 23451 - DNA, 25 bp, Mus musculus
aaatgtataggcatgattcaatgac

SEQ ID NO: 23452 - DNA, 25 bp, Mus musculus
aaatgtataggcttgattcaatgac

SEQ ID NO: 23453 - DNA, 25 bp, Mus musculus
aaatgtatcagaactctgtgccaga

SEQ ID NO: 23454 - DNA, 25 bp, Mus musculus
aaatgtatcagatctctgtgccaga

SEQ ID NO: 23455 - DNA, 25 bp, Mus musculus
aaatgtatcatcagctcctaagaat

SEQ ID NO: 23456 - DNA, 25 bp, Mus musculus
aaatgtatcatctgctcctaagaat

SEQ ID NO: 23457 - DNA, 25 bp, Mus musculus
aaatgtatctgcactttgtcgggct

SEQ ID NO: 23458 - DNA, 25 bp, Mus musculus
aaatgtatctgctctttgtcgggct

SEQ ID NO: 23459 - DNA, 25 bp, Mus musculus
aaatgtatcttgctgctgctgactc

SEQ ID NO: 23460 - DNA, 25 bp, Mus musculus
aaatgtatcttggtgctgctgactc

SEQ ID NO: 23461 - DNA, 25 bp, Mus musculus
aaatgtatgaacatgtacctgagta

SEQ ID NO: 23462 - DNA, 25 bp, Mus musculus
aaatgtatgaacttgtacctgagta

SEQ ID NO: 23463 - DNA, 25 bp, Mus musculus
aaatgtatgactagcagggcgccgt

SEQ ID NO: 23464 - DNA, 25 bp, Mus musculus
aaatgtatgacttgcagggcgccgt

SEQ ID NO: 23465 - DNA, 25 bp, Mus musculus
aaatgtatgcaccaagcgtttcaag

SEQ ID NO: 23466 - DNA, 25 bp, Mus musculus
aaatgtatgcacgaagcgtttcaag

SEQ ID NO: 23467 - DNA, 25 bp, Mus musculus
aaatgtatgcatattctggctttgg

SEQ ID NO: 23468 - DNA, 25 bp, Mus musculus
aaatgtatgcattttctggctttgg

SEQ ID NO: 23469 - DNA, 25 bp, Mus musculus
aaatgtatgctaaccccattccatc

SEQ ID NO: 23470 - DNA, 25 bp, Mus musculus
aaatgtatgctatccccattccatc

SEQ ID NO: 23471 - DNA, 25 bp, Mus musculus
aaatgtatgctgatacttcacccca

SEQ ID NO: 23472 - DNA, 25 bp, Mus musculus
aaatgtatgctgttacttcacccca

SEQ ID NO: 23473 - DNA, 25 bp, Mus musculus
aaatgtatggcacttcagacgaaat

SEQ ID NO: 23474 - DNA, 25 bp, Mus musculus
aaatgtatggcagttcagacgaaat

SEQ ID NO: 23475 - DNA, 25 bp, Mus musculus
aaatgtatgtctatcactccatccc

SEQ ID NO: 23476 - DNA, 25 bp, Mus musculus
aaatgtatgtctttcactccatccc

SEQ ID NO: 23477 - DNA, 25 bp, Mus musculus
aaatgtatgtgccttagcctcccca

SEQ ID NO: 23478 - DNA, 25 bp, Mus musculus
aaatgtatgtgcgttagcctcccca

SEQ ID NO: 23479 - DNA, 25 bp, Mus musculus
aaatgtatgtgtcggtggtttgcct

SEQ ID NO: 23480 - DNA, 25 bp, Mus musculus
aaatgtatgtgtgggtggtttgcct

SEQ ID NO: 23481 - DNA, 25 bp, Mus musculus
aaatgtattcagagggtcgtgttta

SEQ ID NO: 23482 - DNA, 25 bp, Mus musculus
aaatgtattcagtgggtcgtgttta

SEQ ID NO: 23483 - DNA, 25 bp, Mus musculus
aaatgtattcataacctgacaataa

SEQ ID NO: 23484 - DNA, 25 bp, Mus musculus
aaatgtattcattacctgacaataa

SEQ ID NO: 23485 - DNA, 25 bp, Mus musculus
aaatgtattgcacctgcttccactg

SEQ ID NO: 23486 - DNA, 25 bp, Mus musculus
aaatgtattgcagctgcttccactg

SEQ ID NO: 23487 - DNA, 25 bp, Mus musculus
aaatgtcaaacccagtgagaccttt

SEQ ID NO: 23488 - DNA, 25 bp, Mus musculus
aaatgtcaaaccgagtgagaccttt

SEQ ID NO: 23489 - DNA, 25 bp, Mus musculus
aaatgtcaactacctggccattcaa

SEQ ID NO: 23490 - DNA, 25 bp, Mus musculus
aaatgtcaactagctggccattcaa

SEQ ID NO: 23491 - DNA, 25 bp, Mus musculus
aaatgtcaagagcatacacatggaa

SEQ ID NO: 23492 - DNA, 25 bp, Mus musculus
aaatgtcaagaggatacacatggaa

SEQ ID NO: 23493 - DNA, 25 bp, Mus musculus
aaatgtcaagttctgacgatacccc

SEQ ID NO: 23494 - DNA, 25 bp, Mus musculus
aaatgtcaagttgtgacgatacccc

SEQ ID NO: 23495 - DNA, 25 bp, Mus musculus
aaatgtcacaagcactctccagatg

SEQ ID NO: 23496 - DNA, 25 bp, Mus musculus
aaatgtcacaagctgctgcttccac

SEQ ID NO: 23497 - DNA, 25 bp, Mus musculus
aaatgtcacaaggactctccagatg

SEQ ID NO: 23498 - DNA, 25 bp, Mus musculus
aaatgtcacaaggtgctgcttccac

SEQ ID NO: 23499 - DNA, 25 bp, Mus musculus
aaatgtcacacgacttgtccttcag

SEQ ID NO: 23500 - DNA, 25 bp, Mus musculus
aaatgtcacacgtcttgtccttcag

SEQ ID NO: 23501 - DNA, 25 bp, Mus musculus
aaatgtcacatgaacctataaggct

SEQ ID NO: 23502 - DNA, 25 bp, Mus musculus
aaatgtcacatgtacctataaggct

SEQ ID NO: 23503 - DNA, 25 bp, Mus musculus
aaatgtcacctaataatacgggatt

SEQ ID NO: 23504 - DNA, 25 bp, Mus musculus
aaatgtcacctattaatacgggatt

SEQ ID NO: 23505 - DNA, 25 bp, Mus musculus
aaatgtcaccttaatcgaaagagat

SEQ ID NO: 23506 - DNA, 25 bp, Mus musculus
aaatgtcacctttatcgaaagagat

SEQ ID NO: 23507 - DNA, 25 bp, Mus musculus
aaatgtcacgagctttgtagtatat

SEQ ID NO: 23508 - DNA, 25 bp, Mus musculus
aaatgtcacgaggtttgtagtatat

SEQ ID NO: 23509 - DNA, 25 bp, Mus musculus
aaatgtcacttaaggctcttttatc

SEQ ID NO: 23510 - DNA, 25 bp, Mus musculus
aaatgtcacttatggctcttttatc

SEQ ID NO: 23511 - DNA, 25 bp, Mus musculus
aaatgtcagagacgccatgttccag

SEQ ID NO: 23512 - DNA, 25 bp, Mus musculus
aaatgtcagagaggccatgttccag

SEQ ID NO: 23513 - DNA, 25 bp, Mus musculus
aaatgtcagcataaacccactctgt

SEQ ID NO: 23514 - DNA, 25 bp, Mus musculus
aaatgtcagcattaacccactctgt

SEQ ID NO: 23515 - DNA, 25 bp, Mus musculus
aaatgtcagcgcaggccaaccggca

SEQ ID NO: 23516 - DNA, 25 bp, Mus musculus
aaatgtcagcgctggccaaccggca

SEQ ID NO: 23517 - DNA, 25 bp, Mus musculus
aaatgtcaggatacccaatgccaaa

SEQ ID NO: 23518 - DNA, 25 bp, Mus musculus
aaatgtcaggatatttgtggctcaa

SEQ ID NO: 23519 - DNA, 25 bp, Mus musculus
aaatgtcaggattcccaatgccaaa

SEQ ID NO: 23520 - DNA, 25 bp, Mus musculus
aaatgtcaggatttttgtggctcaa

SEQ ID NO: 23521 - DNA, 25 bp, Mus musculus
aaatgtcagtgcctgctgtgaccca

SEQ ID NO: 23522 - DNA, 25 bp, Mus musculus
aaatgtcagtgcgtgctgtgaccca

SEQ ID NO: 23523 - DNA, 25 bp, Mus musculus
aaatgtcagtggacaccgttatcta

SEQ ID NO: 23524 - DNA, 25 bp, Mus musculus
aaatgtcagtggtcaccgttatcta

SEQ ID NO: 23525 - DNA, 25 bp, Mus musculus
aaatgtcagttgctgcgtccccaga

SEQ ID NO: 23526 - DNA, 25 bp, Mus musculus
aaatgtcagttggtgcgtccccaga

SEQ ID NO: 23527 - DNA, 25 bp, Mus musculus
aaatgtcatcataagggaagccact

SEQ ID NO: 23528 - DNA, 25 bp, Mus musculus
aaatgtcatcattagggaagccact

SEQ ID NO: 23529 - DNA, 25 bp, Mus musculus
aaatgtcatcccagttgctgaccaa

SEQ ID NO: 23530 - DNA, 25 bp, Mus musculus
aaatgtcatccctgttgctgaccaa

SEQ ID NO: 23531 - DNA, 25 bp, Mus musculus
aaatgtcatgggacttgattactac

SEQ ID NO: 23532 - DNA, 25 bp, Mus musculus
aaatgtcatgggtcttgattactac

SEQ ID NO: 23533 - DNA, 25 bp, Mus musculus
aaatgtcatgttagttgtctttcca

SEQ ID NO: 23534 - DNA, 25 bp, Mus musculus
aaatgtcatgtttgttgtctttcca

SEQ ID NO: 23535 - DNA, 25 bp, Mus musculus
aaatgtcattagctttctggccaga

SEQ ID NO: 23536 - DNA, 25 bp, Mus musculus
aaatgtcattaggtttctggccaga

SEQ ID NO: 23537 - DNA, 25 bp, Mus musculus
aaatgtcattctaagagtcccctgg

SEQ ID NO: 23538 - DNA, 25 bp, Mus musculus
aaatgtcattcttagagtcccctgg

SEQ ID NO: 23539 - DNA, 25 bp, Mus musculus
aaatgtcattgacgtggtcagtgct

SEQ ID NO: 23540 - DNA, 25 bp, Mus musculus
aaatgtcattgaggtggtcagtgct

SEQ ID NO: 23541 - DNA, 25 bp, Mus musculus
aaatgtcatttaattgtgaggcact

SEQ ID NO: 23542 - DNA, 25 bp, Mus musculus
aaatgtcatttatttgtgaggcact

SEQ ID NO: 23543 - DNA, 25 bp, Mus musculus
aaatgtccaaataacagcgccaaat

SEQ ID NO: 23544 - DNA, 25 bp, Mus musculus
aaatgtccaaattacagcgccaaat

SEQ ID NO: 23545 - DNA, 25 bp, Mus musculus
aaatgtccacgtcctttgttttatt

SEQ ID NO: 23546 - DNA, 25 bp, Mus musculus
aaatgtccacgtgctttgttttatt

SEQ ID NO: 23547 - DNA, 25 bp, Mus musculus
aaatgtccactgcatgggtctttct

SEQ ID NO: 23548 - DNA, 25 bp, Mus musculus
aaatgtccactggatgggtctttct

SEQ ID NO: 23549 - DNA, 25 bp, Mus musculus
aaatgtccagaccacttaagccaca

SEQ ID NO: 23550 - DNA, 25 bp, Mus musculus
aaatgtccagacgacttaagccaca

SEQ ID NO: 23551 - DNA, 25 bp, Mus musculus
aaatgtccagcaaccaattgttagc

SEQ ID NO: 23552 - DNA, 25 bp, Mus musculus
aaatgtccagcatccaattgttagc

SEQ ID NO: 23553 - DNA, 25 bp, Mus musculus
aaatgtccaggtagctacaagatta

SEQ ID NO: 23554 - DNA, 25 bp, Mus musculus
aaatgtccaggttgctacaagatta

SEQ ID NO: 23555 - DNA, 25 bp, Mus musculus
aaatgtccagtgatggtgtttatga

SEQ ID NO: 23556 - DNA, 25 bp, Mus musculus
aaatgtccagtgttggtgtttatga

SEQ ID NO: 23557 - DNA, 25 bp, Mus musculus
aaatgtccatatccttccagagtcg

SEQ ID NO: 23558 - DNA, 25 bp, Mus musculus
aaatgtccatatgcttccagagtcg

SEQ ID NO: 23559 - DNA, 25 bp, Mus musculus
aaatgtccatgtctgtgatgactag

SEQ ID NO: 23560 - DNA, 25 bp, Mus musculus
aaatgtccatgtgtgtgatgactag

SEQ ID NO: 23561 - DNA, 25 bp, Mus musculus
aaatgtcccacacaagctcaggcat

SEQ ID NO: 23562 - DNA, 25 bp, Mus musculus
aaatgtcccacagaagctcaggcat

SEQ ID NO: 23563 - DNA, 25 bp, Mus musculus
aaatgtcccactcaacacacagcat

SEQ ID NO: 23564 - DNA, 25 bp, Mus musculus
aaatgtcccactgaacacacagcat

SEQ ID NO: 23565 - DNA, 25 bp, Mus musculus
aaatgtcccagaacttatccttctg

SEQ ID NO: 23566 - DNA, 25 bp, Mus musculus
aaatgtcccagatcttatccttctg

SEQ ID NO: 23567 - DNA, 25 bp, Mus musculus
aaatgtcccagtagtgcagttgtac

SEQ ID NO: 23568 - DNA, 25 bp, Mus musculus
aaatgtcccagttgtgcagttgtac

SEQ ID NO: 23569 - DNA, 25 bp, Mus musculus
aaatgtccccatctaggcaaggtct

SEQ ID NO: 23570 - DNA, 25 bp, Mus musculus
aaatgtccccatgtaggcaaggtct

SEQ ID NO: 23571 - DNA, 25 bp, Mus musculus
aaatgtccccgtcatcagtgaagat

SEQ ID NO: 23572 - DNA, 25 bp, Mus musculus
aaatgtccccgtctgatgtccacag

SEQ ID NO: 23573 - DNA, 25 bp, Mus musculus
aaatgtccccgtgatcagtgaagat

SEQ ID NO: 23574 - DNA, 25 bp, Mus musculus
aaatgtccccgtgtgatgtccacag

SEQ ID NO: 23575 - DNA, 25 bp, Mus musculus
aaatgtcccgcacacacagagcaat

SEQ ID NO: 23576 - DNA, 25 bp, Mus musculus
aaatgtcccgcagacacagagcaat

SEQ ID NO: 23577 - DNA, 25 bp, Mus musculus
aaatgtccctatatgctgaggctag

SEQ ID NO: 23578 - DNA, 25 bp, Mus musculus
aaatgtccctatttgctgaggctag

SEQ ID NO: 23579 - DNA, 25 bp, Mus musculus
aaatgtccctccatatcatgtctaa

SEQ ID NO: 23580 - DNA, 25 bp, Mus musculus
aaatgtccctccttatcatgtctaa

SEQ ID NO: 23581 - DNA, 25 bp, Mus musculus
aaatgtccctggaatctctgtggtc

SEQ ID NO: 23582 - DNA, 25 bp, Mus musculus
aaatgtccctggtatctctgtggtc

SEQ ID NO: 23583 - DNA, 25 bp, Mus musculus
aaatgtcccttaattgtcttgctct

SEQ ID NO: 23584 - DNA, 25 bp, Mus musculus
aaatgtcccttatttgtcttgctct

SEQ ID NO: 23585 - DNA, 25 bp, Mus musculus
aaatgtcccttgctctctgttcatt

SEQ ID NO: 23586 - DNA, 25 bp, Mus musculus
aaatgtcccttggtctctgttcatt

SEQ ID NO: 23587 - DNA, 25 bp, Mus musculus
aaatgtccgggcagcagccgtgtgc

SEQ ID NO: 23588 - DNA, 25 bp, Mus musculus
aaatgtccgggctgcagccgtgtgc

SEQ ID NO: 23589 - DNA, 25 bp, Mus musculus
aaatgtccgtgccatgttgactata

SEQ ID NO: 23590 - DNA, 25 bp, Mus musculus
aaatgtccgtgcgatgttgactata

SEQ ID NO: 23591 - DNA, 25 bp, Mus musculus
aaatgtcctacccagaatgatcttc

SEQ ID NO: 23592 - DNA, 25 bp, Mus musculus
aaatgtcctaccgagaatgatcttc

SEQ ID NO: 23593 - DNA, 25 bp, Mus musculus
aaatgtcctactcaacttgtttgtg

SEQ ID NO: 23594 - DNA, 25 bp, Mus musculus
aaatgtcctactgaacttgtttgtg

SEQ ID NO: 23595 - DNA, 25 bp, Mus musculus
aaatgtcctataaaagccctgcctc

SEQ ID NO: 23596 - DNA, 25 bp, Mus musculus
aaatgtcctatataagccctgcctc

SEQ ID NO: 23597 - DNA, 25 bp, Mus musculus
aaatgtcctattagttccatgtccc

SEQ ID NO: 23598 - DNA, 25 bp, Mus musculus
aaatgtcctatttgttccatgtccc

SEQ ID NO: 23599 - DNA, 25 bp, Mus musculus
aaatgtcctctgaaagttcactctc

SEQ ID NO: 23600 - DNA, 25 bp, Mus musculus
aaatgtcctctgtaagttcactctc

SEQ ID NO: 23601 - DNA, 25 bp, Mus musculus
aaatgtcctggaattataaagccca

SEQ ID NO: 23602 - DNA, 25 bp, Mus musculus
aaatgtcctggatttataaagccca

SEQ ID NO: 23603 - DNA, 25 bp, Mus musculus
aaatgtcctgtgactgacagtcagc

SEQ ID NO: 23604 - DNA, 25 bp, Mus musculus
aaatgtcctgtgtctgacagtcagc

SEQ ID NO: 23605 - DNA, 25 bp, Mus musculus
aaatgtccttccaaatagagccttt

SEQ ID NO: 23606 - DNA, 25 bp, Mus musculus
aaatgtccttcctaatagagccttt

SEQ ID NO: 23607 - DNA, 25 bp, Mus musculus
aaatgtccttgtcagttgtagtgag

SEQ ID NO: 23608 - DNA, 25 bp, Mus musculus
aaatgtccttgtgagttgtagtgag

SEQ ID NO: 23609 - DNA, 25 bp, Mus musculus
aaatgtcgagttaggtgatttcctg

SEQ ID NO: 23610 - DNA, 25 bp, Mus musculus
aaatgtcgagtttggtgatttcctg

SEQ ID NO: 23611 - DNA, 25 bp, Mus musculus
aaatgtcgggccaggtgtagacaga

SEQ ID NO: 23612 - DNA, 25 bp, Mus musculus
aaatgtcgggcctggtgtagacaga

SEQ ID NO: 23613 - DNA, 25 bp, Mus musculus
aaatgtcgggtcctgtgaggtaact

SEQ ID NO: 23614 - DNA, 25 bp, Mus musculus
aaatgtcgggtcgtgtgaggtaact

SEQ ID NO: 23615 - DNA, 25 bp, Mus musculus
aaatgtcgtcttaattgtcctggag

SEQ ID NO: 23616 - DNA, 25 bp, Mus musculus
aaatgtcgtcttagagcctagtacc

SEQ ID NO: 23617 - DNA, 25 bp, Mus musculus
aaatgtcgtctttattgtcctggag

SEQ ID NO: 23618 - DNA, 25 bp, Mus musculus
aaatgtcgtctttgagcctagtacc

SEQ ID NO: 23619 - DNA, 25 bp, Mus musculus
aaatgtctaaccatgcttgcataaa

SEQ ID NO: 23620 - DNA, 25 bp, Mus musculus
aaatgtctaaccttgcttgcataaa

SEQ ID NO: 23621 - DNA, 25 bp, Mus musculus
aaatgtctaagaccccagtagcctc

SEQ ID NO: 23622 - DNA, 25 bp, Mus musculus
aaatgtctaagagcccagtagcctc

SEQ ID NO: 23623 - DNA, 25 bp, Mus musculus
aaatgtctaccaactggcagaagag

SEQ ID NO: 23624 - DNA, 25 bp, Mus musculus
aaatgtctaccatctggcagaagag

SEQ ID NO: 23625 - DNA, 25 bp, Mus musculus
aaatgtctacctatctatgccctat

SEQ ID NO: 23626 - DNA, 25 bp, Mus musculus
aaatgtctacctttctatgccctat

SEQ ID NO: 23627 - DNA, 25 bp, Mus musculus
aaatgtctatgcagttacatccaga

SEQ ID NO: 23628 - DNA, 25 bp, Mus musculus
aaatgtctatgctgttacatccaga

SEQ ID NO: 23629 - DNA, 25 bp, Mus musculus
aaatgtctattgatttgcacgaatt

SEQ ID NO: 23630 - DNA, 25 bp, Mus musculus
aaatgtctattgttttgcacgaatt

SEQ ID NO: 23631 - DNA, 25 bp, Mus musculus
aaatgtctcaccatccaattctttg

SEQ ID NO: 23632 - DNA, 25 bp, Mus musculus
aaatgtctcaccttccaattctttg

SEQ ID NO: 23633 - DNA, 25 bp, Mus musculus
aaatgtctcagcatgctgctggtgc

SEQ ID NO: 23634 - DNA, 25 bp, Mus musculus
aaatgtctcagcttgctgctggtgc

SEQ ID NO: 23635 - DNA, 25 bp, Mus musculus
aaatgtctcagtcttttttggaagg

SEQ ID NO: 23636 - DNA, 25 bp, Mus musculus
aaatgtctcagtgttttttggaagg

SEQ ID NO: 23637 - DNA, 25 bp, Mus musculus
aaatgtctccaaaagccttctgctt

SEQ ID NO: 23638 - DNA, 25 bp, Mus musculus
aaatgtctccaaactgaacaaggtg

SEQ ID NO: 23639 - DNA, 25 bp, Mus musculus
aaatgtctccaatagccttctgctt

SEQ ID NO: 23640 - DNA, 25 bp, Mus musculus
aaatgtctccaatctgaacaaggtg

SEQ ID NO: 23641 - DNA, 25 bp, Mus musculus
aaatgtctcgacaaagtcctaccct

SEQ ID NO: 23642 - DNA, 25 bp, Mus musculus
aaatgtctcgactaagtcctaccct

SEQ ID NO: 23643 - DNA, 25 bp, Mus musculus
aaatgtctcggccagtgatgcaggc

SEQ ID NO: 23644 - DNA, 25 bp, Mus musculus
aaatgtctcggcgagtgatgcaggc

SEQ ID NO: 23645 - DNA, 25 bp, Mus musculus
aaatgtctctaaaactggccccaac

SEQ ID NO: 23646 - DNA, 25 bp, Mus musculus
aaatgtctctaatactggccccaac

SEQ ID NO: 23647 - DNA, 25 bp, Mus musculus
aaatgtctctcccagattgtaaagc

SEQ ID NO: 23648 - DNA, 25 bp, Mus musculus
aaatgtctctccgagattgtaaagc

SEQ ID NO: 23649 - DNA, 25 bp, Mus musculus
aaatgtctcttgacccatgtttcat

SEQ ID NO: 23650 - DNA, 25 bp, Mus musculus
aaatgtctcttgtcccatgtttcat

SEQ ID NO: 23651 - DNA, 25 bp, Mus musculus
aaatgtctgaccacacctgttaagt

SEQ ID NO: 23652 - DNA, 25 bp, Mus musculus
aaatgtctgacctcacctgttaagt

SEQ ID NO: 23653 - DNA, 25 bp, Mus musculus
aaatgtctgcatatccgtcctgatc

SEQ ID NO: 23654 - DNA, 25 bp, Mus musculus
aaatgtctgcatttccgtcctgatc

SEQ ID NO: 23655 - DNA, 25 bp, Mus musculus
aaatgtctgcttaattgtcctttta

SEQ ID NO: 23656 - DNA, 25 bp, Mus musculus
aaatgtctgctttattgtcctttta

SEQ ID NO: 23657 - DNA, 25 bp, Mus musculus
aaatgtctggccctgcttcactgtg

SEQ ID NO: 23658 - DNA, 25 bp, Mus musculus
aaatgtctggccgtgcttcactgtg

SEQ ID NO: 23659 - DNA, 25 bp, Mus musculus
aaatgtctggttaccatataacgtt

SEQ ID NO: 23660 - DNA, 25 bp, Mus musculus
aaatgtctggttccatgggttcaca

SEQ ID NO: 23661 - DNA, 25 bp, Mus musculus
aaatgtctggttgcatgggttcaca

SEQ ID NO: 23662 - DNA, 25 bp, Mus musculus
aaatgtctggtttccatataacgtt

SEQ ID NO: 23663 - DNA, 25 bp, Mus musculus
aaatgtctgtacaccgtcacagcga

SEQ ID NO: 23664 - DNA, 25 bp, Mus musculus
aaatgtctgtacctgggattcttaa

SEQ ID NO: 23665 - DNA, 25 bp, Mus musculus
aaatgtctgtacgtgggattcttaa

SEQ ID NO: 23666 - DNA, 25 bp, Mus musculus
aaatgtctgtactccgtcacagcga

SEQ ID NO: 23667 - DNA, 25 bp, Mus musculus
aaatgtctgtccacgtcctaagtga

SEQ ID NO: 23668 - DNA, 25 bp, Mus musculus
aaatgtctgtcctcgtcctaagtga

SEQ ID NO: 23669 - DNA, 25 bp, Mus musculus
aaatgtctgtctccttataaagaca

SEQ ID NO: 23670 - DNA, 25 bp, Mus musculus
aaatgtctgtctgcttataaagaca

SEQ ID NO: 23671 - DNA, 25 bp, Mus musculus
aaatgtctgtggatgtggttcctgt

SEQ ID NO: 23672 - DNA, 25 bp, Mus musculus
aaatgtctgtggttgtggttcctgt

SEQ ID NO: 23673 - DNA, 25 bp, Mus musculus
aaatgtcttaatcctctctatggga

SEQ ID NO: 23674 - DNA, 25 bp, Mus musculus
aaatgtcttaatgctctctatggga

SEQ ID NO: 23675 - DNA, 25 bp, Mus musculus
aaatgtcttactcaggaatctttcc

SEQ ID NO: 23676 - DNA, 25 bp, Mus musculus
aaatgtcttactgaggaatctttcc

SEQ ID NO: 23677 - DNA, 25 bp, Mus musculus
aaatgtcttcaaaaacctcttgtca

SEQ ID NO: 23678 - DNA, 25 bp, Mus musculus
aaatgtcttcaataacctcttgtca

SEQ ID NO: 23679 - DNA, 25 bp, Mus musculus
aaatgtcttcacaccatgaacgaaa

SEQ ID NO: 23680 - DNA, 25 bp, Mus musculus
aaatgtcttcactccatgaacgaaa

SEQ ID NO: 23681 - DNA, 25 bp, Mus musculus
aaatgtcttcagcacaggttctcca

SEQ ID NO: 23682 - DNA, 25 bp, Mus musculus
aaatgtcttcaggacaggttctcca

SEQ ID NO: 23683 - DNA, 25 bp, Mus musculus
aaatgtcttcatcctaatgtttcat

SEQ ID NO: 23684 - DNA, 25 bp, Mus musculus
aaatgtcttcatctaccatgtcccc

SEQ ID NO: 23685 - DNA, 25 bp, Mus musculus
aaatgtcttcatgctaatgtttcat

SEQ ID NO: 23686 - DNA, 25 bp, Mus musculus
aaatgtcttcatgtaccatgtcccc

SEQ ID NO: 23687 - DNA, 25 bp, Mus musculus
aaatgtcttctaatcagtcagattt

SEQ ID NO: 23688 - DNA, 25 bp, Mus musculus
aaatgtcttctattcagtcagattt

SEQ ID NO: 23689 - DNA, 25 bp, Mus musculus
aaatgtcttctcaggtcttgtggct

SEQ ID NO: 23690 - DNA, 25 bp, Mus musculus
aaatgtcttctctggtcttgtggct

SEQ ID NO: 23691 - DNA, 25 bp, Mus musculus
aaatgtcttcttattgttctccagg

SEQ ID NO: 23692 - DNA, 25 bp, Mus musculus
aaatgtcttctttttgttctccagg

SEQ ID NO: 23693 - DNA, 25 bp, Mus musculus
aaatgtcttgacacagtctgcggct

SEQ ID NO: 23694 - DNA, 25 bp, Mus musculus
aaatgtcttgactcagtctgcggct

SEQ ID NO: 23695 - DNA, 25 bp, Mus musculus
aaatgtcttgatactcttcagccat

SEQ ID NO: 23696 - DNA, 25 bp, Mus musculus
aaatgtcttgattctcttcagccat

SEQ ID NO: 23697 - DNA, 25 bp, Mus musculus
aaatgtcttgccaagcaacctctag

SEQ ID NO: 23698 - DNA, 25 bp, Mus musculus
aaatgtcttgcctagcaacctctag

SEQ ID NO: 23699 - DNA, 25 bp, Mus musculus
aaatgtcttgggatgctagcagaac

SEQ ID NO: 23700 - DNA, 25 bp, Mus musculus
aaatgtcttgggttgctagcagaac

SEQ ID NO: 23701 - DNA, 25 bp, Mus musculus
aaatgtcttggtaacttctctcttg

SEQ ID NO: 23702 - DNA, 25 bp, Mus musculus
aaatgtcttggttacttctctcttg

SEQ ID NO: 23703 - DNA, 25 bp, Mus musculus
aaatgtctttgaccttgcgcactgt

SEQ ID NO: 23704 - DNA, 25 bp, Mus musculus
aaatgtctttgagcttgcgcactgt

SEQ ID NO: 23705 - DNA, 25 bp, Mus musculus
aaatgtgaaatcactgccaatcttg

SEQ ID NO: 23706 - DNA, 25 bp, Mus musculus
aaatgtgaaatctctgccaatcttg

SEQ ID NO: 23707 - DNA, 25 bp, Mus musculus
aaatgtgaatatatctctttcctta

SEQ ID NO: 23708 - DNA, 25 bp, Mus musculus
aaatgtgaatatttctctttcctta

SEQ ID NO: 23709 - DNA, 25 bp, Mus musculus
aaatgtgaatctaactggtccagtt

SEQ ID NO: 23710 - DNA, 25 bp, Mus musculus
aaatgtgaatctccatgtgacctct

SEQ ID NO: 23711 - DNA, 25 bp, Mus musculus
aaatgtgaatctgcatgtgacctct

SEQ ID NO: 23712 - DNA, 25 bp, Mus musculus
aaatgtgaatcttactggtccagtt

SEQ ID NO: 23713 - DNA, 25 bp, Mus musculus
aaatgtgaatgcacatccagccgcc

SEQ ID NO: 23714 - DNA, 25 bp, Mus musculus
aaatgtgaatgctcatccagccgcc

SEQ ID NO: 23715 - DNA, 25 bp, Mus musculus
aaatgtgacactagaccctgaactg

SEQ ID NO: 23716 - DNA, 25 bp, Mus musculus
aaatgtgacacttgaccctgaactg

SEQ ID NO: 23717 - DNA, 25 bp, Mus musculus
aaatgtgacagtattggcagctact

SEQ ID NO: 23718 - DNA, 25 bp, Mus musculus
aaatgtgacagttttggcagctact

SEQ ID NO: 23719 - DNA, 25 bp, Mus musculus
aaatgtgaccacaactggccattca

SEQ ID NO: 23720 - DNA, 25 bp, Mus musculus
aaatgtgaccactactggccattca

SEQ ID NO: 23721 - DNA, 25 bp, Mus musculus
aaatgtgacctaaggttggcggcaa

SEQ ID NO: 23722 - DNA, 25 bp, Mus musculus
aaatgtgacctatggttggcggcaa

SEQ ID NO: 23723 - DNA, 25 bp, Mus musculus
aaatgtgactatccttttgtaaaga

SEQ ID NO: 23724 - DNA, 25 bp, Mus musculus
aaatgtgactatgcttttgtaaaga

SEQ ID NO: 23725 - DNA, 25 bp, Mus musculus
aaatgtgactccacacagctcatgc

SEQ ID NO: 23726 - DNA, 25 bp, Mus musculus
aaatgtgactcctcacagctcatgc

SEQ ID NO: 23727 - DNA, 25 bp, Mus musculus
aaatgtgactgtcaccctgaatctg

SEQ ID NO: 23728 - DNA, 25 bp, Mus musculus
aaatgtgactgtgaccctgaatctg

SEQ ID NO: 23729 - DNA, 25 bp, Mus musculus
aaatgtgagactaacctgggctgtg

SEQ ID NO: 23730 - DNA, 25 bp, Mus musculus
aaatgtgagacttacctgggctgtg

SEQ ID NO: 23731 - DNA, 25 bp, Mus musculus
aaatgtgagcacagatagccagggt

SEQ ID NO: 23732 - DNA, 25 bp, Mus musculus
aaatgtgagcactgatagccagggt

SEQ ID NO: 23733 - DNA, 25 bp, Mus musculus
aaatgtgagcagctactccaactcc

SEQ ID NO: 23734 - DNA, 25 bp, Mus musculus
aaatgtgagcaggtactccaactcc

SEQ ID NO: 23735 - DNA, 25 bp, Mus musculus
aaatgtgagcctattaatcttcgtt

SEQ ID NO: 23736 - DNA, 25 bp, Mus musculus
aaatgtgagccttttaatcttcgtt

SEQ ID NO: 23737 - DNA, 25 bp, Mus musculus
aaatgtgaggcaacagtgacttcag

SEQ ID NO: 23738 - DNA, 25 bp, Mus musculus
aaatgtgaggcatcagtgacttcag

SEQ ID NO: 23739 - DNA, 25 bp, Mus musculus
aaatgtgagtttctctgctcctgct

SEQ ID NO: 23740 - DNA, 25 bp, Mus musculus
aaatgtgagtttgtctgctcctgct

SEQ ID NO: 23741 - DNA, 25 bp, Mus musculus
aaatgtgatcatcaatcaagccctg

SEQ ID NO: 23742 - DNA, 25 bp, Mus musculus
aaatgtgatcatgaatcaagccctg

SEQ ID NO: 23743 - DNA, 25 bp, Mus musculus
aaatgtgatccaagaatcctccgaa

SEQ ID NO: 23744 - DNA, 25 bp, Mus musculus
aaatgtgatccatgaatcctccgaa

SEQ ID NO: 23745 - DNA, 25 bp, Mus musculus
aaatgtgatgaactccaatcttttc

SEQ ID NO: 23746 - DNA, 25 bp, Mus musculus
aaatgtgatgaagtccaatcttttc

SEQ ID NO: 23747 - DNA, 25 bp, Mus musculus
aaatgtgatgtcatagttccgtaca

SEQ ID NO: 23748 - DNA, 25 bp, Mus musculus
aaatgtgatgtcttagttccgtaca

SEQ ID NO: 23749 - DNA, 25 bp, Mus musculus
aaatgtgatgttctgcaaagcatga

SEQ ID NO: 23750 - DNA, 25 bp, Mus musculus
aaatgtgatgttgtgcaaagcatga

SEQ ID NO: 23751 - DNA, 25 bp, Mus musculus
aaatgtgattccaatctgtgccctt

SEQ ID NO: 23752 - DNA, 25 bp, Mus musculus
aaatgtgattcctatctgtgccctt

SEQ ID NO: 23753 - DNA, 25 bp, Mus musculus
aaatgtgatttcacatcgagagatt

SEQ ID NO: 23754 - DNA, 25 bp, Mus musculus
aaatgtgatttctcatcgagagatt

SEQ ID NO: 23755 - DNA, 25 bp, Mus musculus
aaatgtgcagcacctgctccaagag

SEQ ID NO: 23756 - DNA, 25 bp, Mus musculus
aaatgtgcagcagctgctccaagag

SEQ ID NO: 23757 - DNA, 25 bp, Mus musculus
aaatgtgcagcgctccatgagaggt

SEQ ID NO: 23758 - DNA, 25 bp, Mus musculus
aaatgtgcagcggtccatgagaggt

SEQ ID NO: 23759 - DNA, 25 bp, Mus musculus
aaatgtgcaggaatagggtctctct

SEQ ID NO: 23760 - DNA, 25 bp, Mus musculus
aaatgtgcaggattagggtctctct

SEQ ID NO: 23761 - DNA, 25 bp, Mus musculus
aaatgtgcaggtaggagatctcatc

SEQ ID NO: 23762 - DNA, 25 bp, Mus musculus
aaatgtgcaggttggagatctcatc

SEQ ID NO: 23763 - DNA, 25 bp, Mus musculus
aaatgtgcagtgacctagtgcccat

SEQ ID NO: 23764 - DNA, 25 bp, Mus musculus
aaatgtgcagtgctcaccatctgag

SEQ ID NO: 23765 - DNA, 25 bp, Mus musculus
aaatgtgcagtggtcaccatctgag

SEQ ID NO: 23766 - DNA, 25 bp, Mus musculus
aaatgtgcagtgtcctagtgcccat

SEQ ID NO: 23767 - DNA, 25 bp, Mus musculus
aaatgtgcatccattggtttgtcct

SEQ ID NO: 23768 - DNA, 25 bp, Mus musculus
aaatgtgcatcctttggtttgtcct

SEQ ID NO: 23769 - DNA, 25 bp, Mus musculus
aaatgtgcatttactgactgtatag

SEQ ID NO: 23770 - DNA, 25 bp, Mus musculus
aaatgtgcattttctgactgtatag

SEQ ID NO: 23771 - DNA, 25 bp, Mus musculus
aaatgtgccagcacatgcgacccag

SEQ ID NO: 23772 - DNA, 25 bp, Mus musculus
aaatgtgccagctcatgcgacccag

SEQ ID NO: 23773 - DNA, 25 bp, Mus musculus
aaatgtgccattcttgctttgagtt

SEQ ID NO: 23774 - DNA, 25 bp, Mus musculus
aaatgtgccattgttgctttgagtt

SEQ ID NO: 23775 - DNA, 25 bp, Mus musculus
aaatgtgcccatattcatagatgac

SEQ ID NO: 23776 - DNA, 25 bp, Mus musculus
aaatgtgcccatattttcaaggaca

SEQ ID NO: 23777 - DNA, 25 bp, Mus musculus
aaatgtgcccatctttatcctgaca

SEQ ID NO: 23778 - DNA, 25 bp, Mus musculus
aaatgtgcccatgtttatcctgaca

SEQ ID NO: 23779 - DNA, 25 bp, Mus musculus
aaatgtgcccattttcatagatgac

SEQ ID NO: 23780 - DNA, 25 bp, Mus musculus
aaatgtgcccattttttcaaggaca

SEQ ID NO: 23781 - DNA, 25 bp, Mus musculus
aaatgtgcccctaaccacaatacaa

SEQ ID NO: 23782 - DNA, 25 bp, Mus musculus
aaatgtgccccttaccacaatacaa

SEQ ID NO: 23783 - DNA, 25 bp, Mus musculus
aaatgtgcccgtatcttcaatgttg

SEQ ID NO: 23784 - DNA, 25 bp, Mus musculus
aaatgtgcccgtttcttcaatgttg

SEQ ID NO: 23785 - DNA, 25 bp, Mus musculus
aaatgtgccctgctgcttcaaacct

SEQ ID NO: 23786 - DNA, 25 bp, Mus musculus
aaatgtgccctggtgcttcaaacct

SEQ ID NO: 23787 - DNA, 25 bp, Mus musculus
aaatgtgcctaccacttagcatctg

SEQ ID NO: 23788 - DNA, 25 bp, Mus musculus
aaatgtgcctacgacttagcatctg

SEQ ID NO: 23789 - DNA, 25 bp, Mus musculus
aaatgtgcctatcttaaattcagag

SEQ ID NO: 23790 - DNA, 25 bp, Mus musculus
aaatgtgcctatgttaaattcagag

SEQ ID NO: 23791 - DNA, 25 bp, Mus musculus
aaatgtgcctcgattagaattcagc

SEQ ID NO: 23792 - DNA, 25 bp, Mus musculus
aaatgtgcctcgtttagaattcagc

SEQ ID NO: 23793 - DNA, 25 bp, Mus musculus
aaatgtgcctgccactgggtatttg

SEQ ID NO: 23794 - DNA, 25 bp, Mus musculus
aaatgtgcctgcgactgggtatttg

SEQ ID NO: 23795 - DNA, 25 bp, Mus musculus
aaatgtgcctgtcgacctggtgaga

SEQ ID NO: 23796 - DNA, 25 bp, Mus musculus
aaatgtgcctgtggacctggtgaga

SEQ ID NO: 23797 - DNA, 25 bp, Mus musculus
aaatgtgcgccaatcgcttccagtt

SEQ ID NO: 23798 - DNA, 25 bp, Mus musculus
aaatgtgcgccattcgcttccagtt

SEQ ID NO: 23799 - DNA, 25 bp, Mus musculus
aaatgtgcgcgtcttcttgtaaagg

SEQ ID NO: 23800 - DNA, 25 bp, Mus musculus
aaatgtgcgcgtgttcttgtaaagg

SEQ ID NO: 23801 - DNA, 25 bp, Mus musculus
aaatgtgctaacactactttccaac

SEQ ID NO: 23802 - DNA, 25 bp, Mus musculus
aaatgtgctaactctactttccaac

SEQ ID NO: 23803 - DNA, 25 bp, Mus musculus
aaatgtgctatcaactgtgagcccc

SEQ ID NO: 23804 - DNA, 25 bp, Mus musculus
aaatgtgctatctactgtgagcccc

SEQ ID NO: 23805 - DNA, 25 bp, Mus musculus
aaatgtgctatgcttttatcaacaa

SEQ ID NO: 23806 - DNA, 25 bp, Mus musculus
aaatgtgctatggttttatcaacaa

SEQ ID NO: 23807 - DNA, 25 bp, Mus musculus
aaatgtgctcacacaccgaggctac

SEQ ID NO: 23808 - DNA, 25 bp, Mus musculus
aaatgtgctcacaccatatttaatt

SEQ ID NO: 23809 - DNA, 25 bp, Mus musculus
aaatgtgctcactcaccgaggctac

SEQ ID NO: 23810 - DNA, 25 bp, Mus musculus
aaatgtgctcactccatatttaatt

SEQ ID NO: 23811 - DNA, 25 bp, Mus musculus
aaatgtgctctgaccaggaaggtca

SEQ ID NO: 23812 - DNA, 25 bp, Mus musculus
aaatgtgctctgtccaggaaggtca

SEQ ID NO: 23813 - DNA, 25 bp, Mus musculus
aaatgtgctgagactccacaccaga

SEQ ID NO: 23814 - DNA, 25 bp, Mus musculus
aaatgtgctgagtctccacaccaga

SEQ ID NO: 23815 - DNA, 25 bp, Mus musculus
aaatgtgctgctacttcctgtagac

SEQ ID NO: 23816 - DNA, 25 bp, Mus musculus
aaatgtgctgctcgcttttgcgggt

SEQ ID NO: 23817 - DNA, 25 bp, Mus musculus
aaatgtgctgctggcttttgcgggt

SEQ ID NO: 23818 - DNA, 25 bp, Mus musculus
aaatgtgctgcttcttcctgtagac

SEQ ID NO: 23819 - DNA, 25 bp, Mus musculus
aaatgtgctggtcagcctaggtcca

SEQ ID NO: 23820 - DNA, 25 bp, Mus musculus
aaatgtgctggtgagcctaggtcca

SEQ ID NO: 23821 - DNA, 25 bp, Mus musculus
aaatgtgctgtaagtttataagtac

SEQ ID NO: 23822 - DNA, 25 bp, Mus musculus
aaatgtgctgtatgtttataagtac

SEQ ID NO: 23823 - DNA, 25 bp, Mus musculus
aaatgtgctgtcagcacagcttctg

SEQ ID NO: 23824 - DNA, 25 bp, Mus musculus
aaatgtgctgtctgcacagcttctg

SEQ ID NO: 23825 - DNA, 25 bp, Mus musculus
aaatgtgcttcacatgagcttttca

SEQ ID NO: 23826 - DNA, 25 bp, Mus musculus
aaatgtgcttcagatgagcttttca

SEQ ID NO: 23827 - DNA, 25 bp, Mus musculus
aaatgtgcttccagagttagctcag

SEQ ID NO: 23828 - DNA, 25 bp, Mus musculus
aaatgtgcttcctgagttagctcag

SEQ ID NO: 23829 - DNA, 25 bp, Mus musculus
aaatgtgcttgtatcttggcaagag

SEQ ID NO: 23830 - DNA, 25 bp, Mus musculus
aaatgtgcttgtttcttggcaagag

SEQ ID NO: 23831 - DNA, 25 bp, Mus musculus
aaatgtggaaagacactgacctctg

SEQ ID NO: 23832 - DNA, 25 bp, Mus musculus
aaatgtggaaagtcactgacctctg

SEQ ID NO: 23833 - DNA, 25 bp, Mus musculus
aaatgtggaatcagcctaggacttc

SEQ ID NO: 23834 - DNA, 25 bp, Mus musculus
aaatgtggaatctgcctaggacttc

SEQ ID NO: 23835 - DNA, 25 bp, Mus musculus
aaatgtggacaaatcaaaagagctg

SEQ ID NO: 23836 - DNA, 25 bp, Mus musculus
aaatgtggacaattcaaaagagctg

SEQ ID NO: 23837 - DNA, 25 bp, Mus musculus
aaatgtggagctcaacgtgtgcact

SEQ ID NO: 23838 - DNA, 25 bp, Mus musculus
aaatgtggagctgaacgtgtgcact

SEQ ID NO: 23839 - DNA, 25 bp, Mus musculus
aaatgtggaggaacgcctggtgtca

SEQ ID NO: 23840 - DNA, 25 bp, Mus musculus
aaatgtggaggatcgcctggtgtca

SEQ ID NO: 23841 - DNA, 25 bp, Mus musculus
aaatgtggatccaccctcaagatgg

SEQ ID NO: 23842 - DNA, 25 bp, Mus musculus
aaatgtggatcctccctcaagatgg

SEQ ID NO: 23843 - DNA, 25 bp, Mus musculus
aaatgtggatgaaaacctacctcac

SEQ ID NO: 23844 - DNA, 25 bp, Mus musculus
aaatgtggatgataacctacctcac

SEQ ID NO: 23845 - DNA, 25 bp, Mus musculus
aaatgtggatgtcccatgttcccgg

SEQ ID NO: 23846 - DNA, 25 bp, Mus musculus
aaatgtggatgtgccatgttcccgg

SEQ ID NO: 23847 - DNA, 25 bp, Mus musculus
aaatgtggcaaaagcgctccaaaga

SEQ ID NO: 23848 - DNA, 25 bp, Mus musculus
aaatgtggcaaatgcgctccaaaga

SEQ ID NO: 23849 - DNA, 25 bp, Mus musculus
aaatgtggcaacctatgctaccaaa

SEQ ID NO: 23850 - DNA, 25 bp, Mus musculus
aaatgtggcaacgtatgctaccaaa

SEQ ID NO: 23851 - DNA, 25 bp, Mus musculus
aaatgtggcaatctcttttttacta

SEQ ID NO: 23852 - DNA, 25 bp, Mus musculus
aaatgtggcaatgtcttttttacta

SEQ ID NO: 23853 - DNA, 25 bp, Mus musculus
aaatgtggccataagggactcagtt

SEQ ID NO: 23854 - DNA, 25 bp, Mus musculus
aaatgtggccattagggactcagtt

SEQ ID NO: 23855 - DNA, 25 bp, Mus musculus
aaatgtggccgcatggagattctca

SEQ ID NO: 23856 - DNA, 25 bp, Mus musculus
aaatgtggccgcttggagattctca

SEQ ID NO: 23857 - DNA, 25 bp, Mus musculus
aaatgtggcctgacacttcacatcc

SEQ ID NO: 23858 - DNA, 25 bp, Mus musculus
aaatgtggcctgtcacttcacatcc

SEQ ID NO: 23859 - DNA, 25 bp, Mus musculus
aaatgtggctaaatctccgtgctgt

SEQ ID NO: 23860 - DNA, 25 bp, Mus musculus
aaatgtggctaattctccgtgctgt

SEQ ID NO: 23861 - DNA, 25 bp, Mus musculus
aaatgtggcttgcttttcacctctg

SEQ ID NO: 23862 - DNA, 25 bp, Mus musculus
aaatgtggcttggttttcacctctg

SEQ ID NO: 23863 - DNA, 25 bp, Mus musculus
aaatgtgggcccatgtttggataat

SEQ ID NO: 23864 - DNA, 25 bp, Mus musculus
aaatgtgggcccttgtttggataat

SEQ ID NO: 23865 - DNA, 25 bp, Mus musculus
aaatgtgggctcaattgctccaagc

SEQ ID NO: 23866 - DNA, 25 bp, Mus musculus
aaatgtgggctctattgctccaagc

SEQ ID NO: 23867 - DNA, 25 bp, Mus musculus
aaatgtgggcttcagaatttctttt

SEQ ID NO: 23868 - DNA, 25 bp, Mus musculus
aaatgtgggcttgagaatttctttt

SEQ ID NO: 23869 - DNA, 25 bp, Mus musculus
aaatgtgggtccagtccaatgctga

SEQ ID NO: 23870 - DNA, 25 bp, Mus musculus
aaatgtgggtcctgtccaatgctga

SEQ ID NO: 23871 - DNA, 25 bp, Mus musculus
aaatgtgggtgcactcaacttggga

SEQ ID NO: 23872 - DNA, 25 bp, Mus musculus
aaatgtgggtgcctatgtttcagaa

SEQ ID NO: 23873 - DNA, 25 bp, Mus musculus
aaatgtgggtgcgtatgtttcagaa

SEQ ID NO: 23874 - DNA, 25 bp, Mus musculus
aaatgtgggtgctctcaacttggga

SEQ ID NO: 23875 - DNA, 25 bp, Mus musculus
aaatgtggtacaccagactctctcc

SEQ ID NO: 23876 - DNA, 25 bp, Mus musculus
aaatgtggtacagcagactctctcc

SEQ ID NO: 23877 - DNA, 25 bp, Mus musculus
aaatgtggtaccctcctctcagatg

SEQ ID NO: 23878 - DNA, 25 bp, Mus musculus
aaatgtggtaccgtcctctcagatg

SEQ ID NO: 23879 - DNA, 25 bp, Mus musculus
aaatgtggtccgacttcttttatct

SEQ ID NO: 23880 - DNA, 25 bp, Mus musculus
aaatgtggtccgtcttcttttatct

SEQ ID NO: 23881 - DNA, 25 bp, Mus musculus
aaatgtggtcttactgggcacggtc

SEQ ID NO: 23882 - DNA, 25 bp, Mus musculus
aaatgtggtctttctgggcacggtc

SEQ ID NO: 23883 - DNA, 25 bp, Mus musculus
aaatgtggtgcacagtgtccgccgt

SEQ ID NO: 23884 - DNA, 25 bp, Mus musculus
aaatgtggtgcagagtgtccgccgt

SEQ ID NO: 23885 - DNA, 25 bp, Mus musculus
aaatgtggtgccagaaactacctct

SEQ ID NO: 23886 - DNA, 25 bp, Mus musculus
aaatgtggtgcctgaaactacctct

SEQ ID NO: 23887 - DNA, 25 bp, Mus musculus
aaatgtggtggtaacgcaggctgac

SEQ ID NO: 23888 - DNA, 25 bp, Mus musculus
aaatgtggtggttacgcaggctgac

SEQ ID NO: 23889 - DNA, 25 bp, Mus musculus
aaatgtggtgtgctcttcataaaac

SEQ ID NO: 23890 - DNA, 25 bp, Mus musculus
aaatgtggtgtggtcttcataaaac

SEQ ID NO: 23891 - DNA, 25 bp, Mus musculus
aaatgtggtttcatgtgacttggaa

SEQ ID NO: 23892 - DNA, 25 bp, Mus musculus
aaatgtggtttcttgtgacttggaa

SEQ ID NO: 23893 - DNA, 25 bp, Mus musculus
aaatgtgtacacatcccatgggacc

SEQ ID NO: 23894 - DNA, 25 bp, Mus musculus
aaatgtgtacacttcccatgggacc

SEQ ID NO: 23895 - DNA, 25 bp, Mus musculus
aaatgtgtacctcccataccacttt

SEQ ID NO: 23896 - DNA, 25 bp, Mus musculus
aaatgtgtacctgccataccacttt

SEQ ID NO: 23897 - DNA, 25 bp, Mus musculus
aaatgtgtactcctaagtgcagggt

SEQ ID NO: 23898 - DNA, 25 bp, Mus musculus
aaatgtgtactcgtaagtgcagggt

SEQ ID NO: 23899 - DNA, 25 bp, Mus musculus
aaatgtgtagccaccgtctcaggat

SEQ ID NO: 23900 - DNA, 25 bp, Mus musculus
aaatgtgtagcctccgtctcaggat

SEQ ID NO: 23901 - DNA, 25 bp, Mus musculus
aaatgtgtcattatagtataccaag

SEQ ID NO: 23902 - DNA, 25 bp, Mus musculus
aaatgtgtcattttagtataccaag

SEQ ID NO: 23903 - DNA, 25 bp, Mus musculus
aaatgtgtccatcgaaaaggtccca

SEQ ID NO: 23904 - DNA, 25 bp, Mus musculus
aaatgtgtccatggaaaaggtccca

SEQ ID NO: 23905 - DNA, 25 bp, Mus musculus
aaatgtgtcccacttgttttgctag

SEQ ID NO: 23906 - DNA, 25 bp, Mus musculus
aaatgtgtcccagttgttttgctag

SEQ ID NO: 23907 - DNA, 25 bp, Mus musculus
aaatgtgtccccatggtgatagggt

SEQ ID NO: 23908 - DNA, 25 bp, Mus musculus
aaatgtgtccccttggtgatagggt

SEQ ID NO: 23909 - DNA, 25 bp, Mus musculus
aaatgtgtctcacgtttgcctccct

SEQ ID NO: 23910 - DNA, 25 bp, Mus musculus
aaatgtgtctcactccacttgtggc

SEQ ID NO: 23911 - DNA, 25 bp, Mus musculus
aaatgtgtctcaggtttgcctccct

SEQ ID NO: 23912 - DNA, 25 bp, Mus musculus
aaatgtgtctcagtccacttgtggc

SEQ ID NO: 23913 - DNA, 25 bp, Mus musculus
aaatgtgtctgtatcggtctcacta

SEQ ID NO: 23914 - DNA, 25 bp, Mus musculus
aaatgtgtctgtctattctgtgcct

SEQ ID NO: 23915 - DNA, 25 bp, Mus musculus
aaatgtgtctgtgtattctgtgcct

SEQ ID NO: 23916 - DNA, 25 bp, Mus musculus
aaatgtgtctgtttcggtctcacta

SEQ ID NO: 23917 - DNA, 25 bp, Mus musculus
aaatgtgtgactcttccaggcacct

SEQ ID NO: 23918 - DNA, 25 bp, Mus musculus
aaatgtgtgactgttccaggcacct

SEQ ID NO: 23919 - DNA, 25 bp, Mus musculus
aaatgtgtgattacatgaagcttct

SEQ ID NO: 23920 - DNA, 25 bp, Mus musculus
aaatgtgtgatttcatgaagcttct

SEQ ID NO: 23921 - DNA, 25 bp, Mus musculus
aaatgtgtgccccagcaggtgatgc

SEQ ID NO: 23922 - DNA, 25 bp, Mus musculus
aaatgtgtgccccttatgtagtatt

SEQ ID NO: 23923 - DNA, 25 bp, Mus musculus
aaatgtgtgcccgagcaggtgatgc

SEQ ID NO: 23924 - DNA, 25 bp, Mus musculus
aaatgtgtgcccgttatgtagtatt

SEQ ID NO: 23925 - DNA, 25 bp, Mus musculus
aaatgtgtggctacccagtgaacca

SEQ ID NO: 23926 - DNA, 25 bp, Mus musculus
aaatgtgtggcttcccagtgaacca

SEQ ID NO: 23927 - DNA, 25 bp, Mus musculus
aaatgtgtggttatttccatcccat

SEQ ID NO: 23928 - DNA, 25 bp, Mus musculus
aaatgtgtggttttttccatcccat

SEQ ID NO: 23929 - DNA, 25 bp, Mus musculus
aaatgtgtgtctccttgtgctaaaa

SEQ ID NO: 23930 - DNA, 25 bp, Mus musculus
aaatgtgtgtctgcttgtgctaaaa

SEQ ID NO: 23931 - DNA, 25 bp, Mus musculus
aaatgtgtgtttactaactctcagc

SEQ ID NO: 23932 - DNA, 25 bp, Mus musculus
aaatgtgtgttttctaactctcagc

SEQ ID NO: 23933 - DNA, 25 bp, Mus musculus
aaatgtgttactccagctttctgtg

SEQ ID NO: 23934 - DNA, 25 bp, Mus musculus
aaatgtgttactgcagctttctgtg

SEQ ID NO: 23935 - DNA, 25 bp, Mus musculus
aaatgtgttatgctatgtcctcaca

SEQ ID NO: 23936 - DNA, 25 bp, Mus musculus
aaatgtgttatggtatgtcctcaca

SEQ ID NO: 23937 - DNA, 25 bp, Mus musculus
aaatgtgttctgagctatattaaaa

SEQ ID NO: 23938 - DNA, 25 bp, Mus musculus
aaatgtgttctgatatttgagcctt

SEQ ID NO: 23939 - DNA, 25 bp, Mus musculus
aaatgtgttctgctcgcttgacaac

SEQ ID NO: 23940 - DNA, 25 bp, Mus musculus
aaatgtgttctggtcgcttgacaac

SEQ ID NO: 23941 - DNA, 25 bp, Mus musculus
aaatgtgttctgtgctatattaaaa

SEQ ID NO: 23942 - DNA, 25 bp, Mus musculus
aaatgtgttctgttatttgagcctt

SEQ ID NO: 23943 - DNA, 25 bp, Mus musculus
aaatgtgttcttagtgctgcttcca

SEQ ID NO: 23944 - DNA, 25 bp, Mus musculus
aaatgtgttcttcacgttgttcata

SEQ ID NO: 23945 - DNA, 25 bp, Mus musculus
aaatgtgttcttgacgttgttcata

SEQ ID NO: 23946 - DNA, 25 bp, Mus musculus
aaatgtgttctttgtgctgcttcca

SEQ ID NO: 23947 - DNA, 25 bp, Mus musculus
aaatgtgttgccacgaatccacgga

SEQ ID NO: 23948 - DNA, 25 bp, Mus musculus
aaatgtgttgccatcattgtcccta

SEQ ID NO: 23949 - DNA, 25 bp, Mus musculus
aaatgtgttgcctcgaatccacgga

SEQ ID NO: 23950 - DNA, 25 bp, Mus musculus
aaatgtgttgccttcattgtcccta

SEQ ID NO: 23951 - DNA, 25 bp, Mus musculus
aaatgtgttgctccatatccttctc

SEQ ID NO: 23952 - DNA, 25 bp, Mus musculus
aaatgtgttgctgcatatccttctc

SEQ ID NO: 23953 - DNA, 25 bp, Mus musculus
aaatgtgtttccactggaagccaca

SEQ ID NO: 23954 - DNA, 25 bp, Mus musculus
aaatgtgtttcctctggaagccaca

SEQ ID NO: 23955 - DNA, 25 bp, Mus musculus
aaatgtgtttgaacccagctattgg

SEQ ID NO: 23956 - DNA, 25 bp, Mus musculus
aaatgtgtttgatcccagctattgg

SEQ ID NO: 23957 - DNA, 25 bp, Mus musculus
aaatgttaaccgagcgacccagaga

SEQ ID NO: 23958 - DNA, 25 bp, Mus musculus
aaatgttaaccgtgcgacccagaga

SEQ ID NO: 23959 - DNA, 25 bp, Mus musculus
aaatgttaagcccactctaccagac

SEQ ID NO: 23960 - DNA, 25 bp, Mus musculus
aaatgttaagccgactctaccagac

SEQ ID NO: 23961 - DNA, 25 bp, Mus musculus
aaatgttaatatatgctgctgtttt

SEQ ID NO: 23962 - DNA, 25 bp, Mus musculus
aaatgttaatatttgctgctgtttt

SEQ ID NO: 23963 - DNA, 25 bp, Mus musculus
aaatgttaatctcacctcaggacct

SEQ ID NO: 23964 - DNA, 25 bp, Mus musculus
aaatgttaatctgacctcaggacct

SEQ ID NO: 23965 - DNA, 25 bp, Mus musculus
aaatgttaatgtacactgagcagtg

SEQ ID NO: 23966 - DNA, 25 bp, Mus musculus
aaatgttaatgttcactgagcagtg

SEQ ID NO: 23967 - DNA, 25 bp, Mus musculus
aaatgttacagcaagtgcattggct

SEQ ID NO: 23968 - DNA, 25 bp, Mus musculus
aaatgttacagctagtgcattggct

SEQ ID NO: 23969 - DNA, 25 bp, Mus musculus
aaatgttacaggctgctgatgttta

SEQ ID NO: 23970 - DNA, 25 bp, Mus musculus
aaatgttacagggtgctgatgttta

SEQ ID NO: 23971 - DNA, 25 bp, Mus musculus
aaatgttacataagggcaggtcact

SEQ ID NO: 23972 - DNA, 25 bp, Mus musculus
aaatgttacatatgggcaggtcact

SEQ ID NO: 23973 - DNA, 25 bp, Mus musculus
aaatgttacccacatgcatttgtgc

SEQ ID NO: 23974 - DNA, 25 bp, Mus musculus
aaatgttacccagatgcatttgtgc

SEQ ID NO: 23975 - DNA, 25 bp, Mus musculus
aaatgttacctaactgcacagcata

SEQ ID NO: 23976 - DNA, 25 bp, Mus musculus
aaatgttacctatctgcacagcata

SEQ ID NO: 23977 - DNA, 25 bp, Mus musculus
aaatgttacgataccttagagagtg

SEQ ID NO: 23978 - DNA, 25 bp, Mus musculus
aaatgttacgattccttagagagtg

SEQ ID NO: 23979 - DNA, 25 bp, Mus musculus
aaatgttactagcatagcccacccg

SEQ ID NO: 23980 - DNA, 25 bp, Mus musculus
aaatgttactaggatagcccacccg

SEQ ID NO: 23981 - DNA, 25 bp, Mus musculus
aaatgttagcatctcttaggactag

SEQ ID NO: 23982 - DNA, 25 bp, Mus musculus
aaatgttagcatgtcttaggactag

SEQ ID NO: 23983 - DNA, 25 bp, Mus musculus
aaatgttagggcactaagaggcgct

SEQ ID NO: 23984 - DNA, 25 bp, Mus musculus
aaatgttagggctctaagaggcgct

SEQ ID NO: 23985 - DNA, 25 bp, Mus musculus
aaatgttatattctattccactgaa

SEQ ID NO: 23986 - DNA, 25 bp, Mus musculus
aaatgttatattgtattccactgaa

SEQ ID NO: 23987 - DNA, 25 bp, Mus musculus
aaatgttatcccaggagtacttgga

SEQ ID NO: 23988 - DNA, 25 bp, Mus musculus
aaatgttatccctggagtacttgga

SEQ ID NO: 23989 - DNA, 25 bp, Mus musculus
aaatgttatcctctagcctcccata

SEQ ID NO: 23990 - DNA, 25 bp, Mus musculus
aaatgttatcctgtagcctcccata

SEQ ID NO: 23991 - DNA, 25 bp, Mus musculus
aaatgttatgatatccttggaatcc

SEQ ID NO: 23992 - DNA, 25 bp, Mus musculus
aaatgttatgatttccttggaatcc

SEQ ID NO: 23993 - DNA, 25 bp, Mus musculus
aaatgttatgcactctgaaaggaaa

SEQ ID NO: 23994 - DNA, 25 bp, Mus musculus
aaatgttatgcagtctgaaaggaaa

SEQ ID NO: 23995 - DNA, 25 bp, Mus musculus
aaatgttatggtatagcctagataa

SEQ ID NO: 23996 - DNA, 25 bp, Mus musculus
aaatgttatggtttagcctagataa

SEQ ID NO: 23997 - DNA, 25 bp, Mus musculus
aaatgttatgttaccttctaggaag

SEQ ID NO: 23998 - DNA, 25 bp, Mus musculus
aaatgttatgtttccttctaggaag

SEQ ID NO: 23999 - DNA, 25 bp, Mus musculus
aaatgttatttcaactctcaccctg

SEQ ID NO: 24000 - DNA, 25 bp, Mus musculus
aaatgttatttcctggttaccacat

SEQ ID NO: 24001 - DNA, 25 bp, Mus musculus
aaatgttatttcgtggttaccacat

SEQ ID NO: 24002 - DNA, 25 bp, Mus musculus
aaatgttatttctactctcaccctg

SEQ ID NO: 24003 - DNA, 25 bp, Mus musculus
aaatgttcaactctgtatcattcag

SEQ ID NO: 24004 - DNA, 25 bp, Mus musculus
aaatgttcaactgtgtatcattcag

SEQ ID NO: 24005 - DNA, 25 bp, Mus musculus
aaatgttcaagaagccctatgggta

SEQ ID NO: 24006 - DNA, 25 bp, Mus musculus
aaatgttcaagatgccctatgggta

SEQ ID NO: 24007 - DNA, 25 bp, Mus musculus
aaatgttcaattcccagacagctga

SEQ ID NO: 24008 - DNA, 25 bp, Mus musculus
aaatgttcaattgccagacagctga

SEQ ID NO: 24009 - DNA, 25 bp, Mus musculus
aaatgttcacaacgtcaccacctgc

SEQ ID NO: 24010 - DNA, 25 bp, Mus musculus
aaatgttcacaacgtccagctttcg

SEQ ID NO: 24011 - DNA, 25 bp, Mus musculus
aaatgttcacaaggtcaccacctgc

SEQ ID NO: 24012 - DNA, 25 bp, Mus musculus
aaatgttcacaaggtccagctttcg

SEQ ID NO: 24013 - DNA, 25 bp, Mus musculus
aaatgttcacagagggactgaccca

SEQ ID NO: 24014 - DNA, 25 bp, Mus musculus
aaatgttcacagtgggactgaccca

SEQ ID NO: 24015 - DNA, 25 bp, Mus musculus
aaatgttcactcaggctttaaagca

SEQ ID NO: 24016 - DNA, 25 bp, Mus musculus
aaatgttcactctggctttaaagca

SEQ ID NO: 24017 - DNA, 25 bp, Mus musculus
aaatgttcatacacactgccaaatg

SEQ ID NO: 24018 - DNA, 25 bp, Mus musculus
aaatgttcatactcactgccaaatg

SEQ ID NO: 24019 - DNA, 25 bp, Mus musculus
aaatgttcatttattccgcttcttt

SEQ ID NO: 24020 - DNA, 25 bp, Mus musculus
aaatgttcattttttccgcttcttt

SEQ ID NO: 24021 - DNA, 25 bp, Mus musculus
aaatgttccactatagaatttctat

SEQ ID NO: 24022 - DNA, 25 bp, Mus musculus
aaatgttccactttagaatttctat

SEQ ID NO: 24023 - DNA, 25 bp, Mus musculus
aaatgttccagcacaatgctccttg

SEQ ID NO: 24024 - DNA, 25 bp, Mus musculus
aaatgttccagctcaatgctccttg

SEQ ID NO: 24025 - DNA, 25 bp, Mus musculus
aaatgttccattactagcctgtcaa

SEQ ID NO: 24026 - DNA, 25 bp, Mus musculus
aaatgttccatttctagcctgtcaa

SEQ ID NO: 24027 - DNA, 25 bp, Mus musculus
aaatgttcccacaaagatatgatct

SEQ ID NO: 24028 - DNA, 25 bp, Mus musculus
aaatgttcccactaagatatgatct

SEQ ID NO: 24029 - DNA, 25 bp, Mus musculus
aaatgttcccagatttgtggcttgg

SEQ ID NO: 24030 - DNA, 25 bp, Mus musculus
aaatgttcccagttttgtggcttgg

SEQ ID NO: 24031 - DNA, 25 bp, Mus musculus
aaatgttcccctattgctgggtttg

SEQ ID NO: 24032 - DNA, 25 bp, Mus musculus
aaatgttccccttttgctgggtttg

SEQ ID NO: 24033 - DNA, 25 bp, Mus musculus
aaatgttcccttagaccattaaatg

SEQ ID NO: 24034 - DNA, 25 bp, Mus musculus
aaatgttccctttgaccattaaatg

SEQ ID NO: 24035 - DNA, 25 bp, Mus musculus
aaatgttcctacaatttgaggcagg

SEQ ID NO: 24036 - DNA, 25 bp, Mus musculus
aaatgttcctacagatggttttgtt

SEQ ID NO: 24037 - DNA, 25 bp, Mus musculus
aaatgttcctactatttgaggcagg

SEQ ID NO: 24038 - DNA, 25 bp, Mus musculus
aaatgttcctactgatggttttgtt

SEQ ID NO: 24039 - DNA, 25 bp, Mus musculus
aaatgttcctgcaacatcctgagta

SEQ ID NO: 24040 - DNA, 25 bp, Mus musculus
aaatgttcctgctacatcctgagta

SEQ ID NO: 24041 - DNA, 25 bp, Mus musculus
aaatgttcctgtaagcaaccctgat

SEQ ID NO: 24042 - DNA, 25 bp, Mus musculus
aaatgttcctgtaccgatcatctgt

SEQ ID NO: 24043 - DNA, 25 bp, Mus musculus
aaatgttcctgttagcaaccctgat

SEQ ID NO: 24044 - DNA, 25 bp, Mus musculus
aaatgttcctgttccgatcatctgt

SEQ ID NO: 24045 - DNA, 25 bp, Mus musculus
aaatgttccttactggttctgcact

SEQ ID NO: 24046 - DNA, 25 bp, Mus musculus
aaatgttccttagtggttctgcact

SEQ ID NO: 24047 - DNA, 25 bp, Mus musculus
aaatgttcggtgcaactgttcctct

SEQ ID NO: 24048 - DNA, 25 bp, Mus musculus
aaatgttcggtggaactgttcctct

SEQ ID NO: 24049 - DNA, 25 bp, Mus musculus
aaatgttcgtgaccactctacgctg

SEQ ID NO: 24050 - DNA, 25 bp, Mus musculus
aaatgttcgtgagcactctacgctg

SEQ ID NO: 24051 - DNA, 25 bp, Mus musculus
aaatgttctcatagatccagcagta

SEQ ID NO: 24052 - DNA, 25 bp, Mus musculus
aaatgttctcattgatccagcagta

SEQ ID NO: 24053 - DNA, 25 bp, Mus musculus
aaatgttctgatactactcaggaag

SEQ ID NO: 24054 - DNA, 25 bp, Mus musculus
aaatgttctgattctactcaggaag

SEQ ID NO: 24055 - DNA, 25 bp, Mus musculus
aaatgttctgcacctacataggata

SEQ ID NO: 24056 - DNA, 25 bp, Mus musculus
aaatgttctgcagctacataggata

SEQ ID NO: 24057 - DNA, 25 bp, Mus musculus
aaatgttctgcccaccgagctatat

SEQ ID NO: 24058 - DNA, 25 bp, Mus musculus
aaatgttctgccgaccgagctatat

SEQ ID NO: 24059 - DNA, 25 bp, Mus musculus
aaatgttctggtcgtctagcttttc

SEQ ID NO: 24060 - DNA, 25 bp, Mus musculus
aaatgttctggtggtctagcttttc

SEQ ID NO: 24061 - DNA, 25 bp, Mus musculus
aaatgttctgtgaaaccctctgctt

SEQ ID NO: 24062 - DNA, 25 bp, Mus musculus
aaatgttctgtgatttctggtgcat

SEQ ID NO: 24063 - DNA, 25 bp, Mus musculus
aaatgttctgtgtaaccctctgctt

SEQ ID NO: 24064 - DNA, 25 bp, Mus musculus
aaatgttctgtgttttctggtgcat

SEQ ID NO: 24065 - DNA, 25 bp, Mus musculus
aaatgttctgttctgtggtaggctt

SEQ ID NO: 24066 - DNA, 25 bp, Mus musculus
aaatgttctgttgtgtggtaggctt

SEQ ID NO: 24067 - DNA, 25 bp, Mus musculus
aaatgttcttagagtcacccacctg

SEQ ID NO: 24068 - DNA, 25 bp, Mus musculus
aaatgttcttagtgtcacccacctg

SEQ ID NO: 24069 - DNA, 25 bp, Mus musculus
aaatgttcttcacgcatctggtaac

SEQ ID NO: 24070 - DNA, 25 bp, Mus musculus
aaatgttcttcaggcatctggtaac

SEQ ID NO: 24071 - DNA, 25 bp, Mus musculus
aaatgttcttgaagtattccctata

SEQ ID NO: 24072 - DNA, 25 bp, Mus musculus
aaatgttcttgatgtattccctata

SEQ ID NO: 24073 - DNA, 25 bp, Mus musculus
aaatgttcttgcaaacccttgtgaa

SEQ ID NO: 24074 - DNA, 25 bp, Mus musculus
aaatgttcttgctaacccttgtgaa

SEQ ID NO: 24075 - DNA, 25 bp, Mus musculus
aaatgttcttgtccaatgtagtgga

SEQ ID NO: 24076 - DNA, 25 bp, Mus musculus
aaatgttcttgtgcaatgtagtgga

SEQ ID NO: 24077 - DNA, 25 bp, Mus musculus
aaatgttctttaactatggcttgtc

SEQ ID NO: 24078 - DNA, 25 bp, Mus musculus
aaatgttctttatctatggcttgtc

SEQ ID NO: 24079 - DNA, 25 bp, Mus musculus
aaatgttctttgagctatcttgctt

SEQ ID NO: 24080 - DNA, 25 bp, Mus musculus
aaatgttctttgatgattcaaaggt

SEQ ID NO: 24081 - DNA, 25 bp, Mus musculus
aaatgttctttgtgctatcttgctt

SEQ ID NO: 24082 - DNA, 25 bp, Mus musculus
aaatgttctttgttgattcaaaggt

SEQ ID NO: 24083 - DNA, 25 bp, Mus musculus
aaatgttgaagtcgaagccatggga

SEQ ID NO: 24084 - DNA, 25 bp, Mus musculus
aaatgttgaagtggaagccatggga

SEQ ID NO: 24085 - DNA, 25 bp, Mus musculus
aaatgttgaggcctacttctgaaag

SEQ ID NO: 24086 - DNA, 25 bp, Mus musculus
aaatgttgaggcgtacttctgaaag

SEQ ID NO: 24087 - DNA, 25 bp, Mus musculus
aaatgttgatcgattctgttcttaa

SEQ ID NO: 24088 - DNA, 25 bp, Mus musculus
aaatgttgatcgtttctgttcttaa

SEQ ID NO: 24089 - DNA, 25 bp, Mus musculus
aaatgttgcccacgttacagtgcct

SEQ ID NO: 24090 - DNA, 25 bp, Mus musculus
aaatgttgcccaggttacagtgcct

SEQ ID NO: 24091 - DNA, 25 bp, Mus musculus
aaatgttgcctccagacaaaattaa

SEQ ID NO: 24092 - DNA, 25 bp, Mus musculus
aaatgttgcctcgagacaaaattaa

SEQ ID NO: 24093 - DNA, 25 bp, Mus musculus
aaatgttgcggacccagtctcagct

SEQ ID NO: 24094 - DNA, 25 bp, Mus musculus
aaatgttgcggagccagtctcagct

SEQ ID NO: 24095 - DNA, 25 bp, Mus musculus
aaatgttgctggcttcagcagctaa

SEQ ID NO: 24096 - DNA, 25 bp, Mus musculus
aaatgttgctgggttcagcagctaa

SEQ ID NO: 24097 - DNA, 25 bp, Mus musculus
aaatgttgctttacactacatggca

SEQ ID NO: 24098 - DNA, 25 bp, Mus musculus
aaatgttgcttttcactacatggca

SEQ ID NO: 24099 - DNA, 25 bp, Mus musculus
aaatgttggaatcgtgtggccactt

SEQ ID NO: 24100 - DNA, 25 bp, Mus musculus
aaatgttggaatggtgtggccactt

SEQ ID NO: 24101 - DNA, 25 bp, Mus musculus
aaatgttggcctactacagcccagt

SEQ ID NO: 24102 - DNA, 25 bp, Mus musculus
aaatgttggccttctacagcccagt

SEQ ID NO: 24103 - DNA, 25 bp, Mus musculus
aaatgttggctaattctaactgaaa

SEQ ID NO: 24104 - DNA, 25 bp, Mus musculus
aaatgttggctatttctaactgaaa

SEQ ID NO: 24105 - DNA, 25 bp, Mus musculus
aaatgttgtcctacatgtgtacaat

SEQ ID NO: 24106 - DNA, 25 bp, Mus musculus
aaatgttgtccttcatgtgtacaat

SEQ ID NO: 24107 - DNA, 25 bp, Mus musculus
aaatgttgtgtcactcgaaggtccg

SEQ ID NO: 24108 - DNA, 25 bp, Mus musculus
aaatgttgtgtctctcgaaggtccg

SEQ ID NO: 24109 - DNA, 25 bp, Mus musculus
aaatgttgttgcaaacccaccagtt

SEQ ID NO: 24110 - DNA, 25 bp, Mus musculus
aaatgttgttgcaaactaacgagtt

SEQ ID NO: 24111 - DNA, 25 bp, Mus musculus
aaatgttgttgctaacccaccagtt

SEQ ID NO: 24112 - DNA, 25 bp, Mus musculus
aaatgttgttgctaactaacgagtt

SEQ ID NO: 24113 - DNA, 25 bp, Mus musculus
aaatgttgttgtatgacactctaca

SEQ ID NO: 24114 - DNA, 25 bp, Mus musculus
aaatgttgttgtttgacactctaca

SEQ ID NO: 24115 - DNA, 25 bp, Mus musculus
aaatgtttaactatggatgcaataa

SEQ ID NO: 24116 - DNA, 25 bp, Mus musculus
aaatgtttaactttggatgcaataa

SEQ ID NO: 24117 - DNA, 25 bp, Mus musculus
aaatgtttaattagcctggcggact

SEQ ID NO: 24118 - DNA, 25 bp, Mus musculus
aaatgtttaatttgcctggcggact

SEQ ID NO: 24119 - DNA, 25 bp, Mus musculus
aaatgtttacatagcttctggtgat

SEQ ID NO: 24120 - DNA, 25 bp, Mus musculus
aaatgtttacattgcttctggtgat

SEQ ID NO: 24121 - DNA, 25 bp, Mus musculus
aaatgtttactaatatcttcaacac

SEQ ID NO: 24122 - DNA, 25 bp, Mus musculus
aaatgtttactattatcttcaacac

SEQ ID NO: 24123 - DNA, 25 bp, Mus musculus
aaatgtttactcacccacctgagac

SEQ ID NO: 24124 - DNA, 25 bp, Mus musculus
aaatgtttactctcccacctgagac

SEQ ID NO: 24125 - DNA, 25 bp, Mus musculus
aaatgtttagcaaactttgtagaat

SEQ ID NO: 24126 - DNA, 25 bp, Mus musculus
aaatgtttagcatactttgtagaat

SEQ ID NO: 24127 - DNA, 25 bp, Mus musculus
aaatgtttaggtagtgtgcgtgcac

SEQ ID NO: 24128 - DNA, 25 bp, Mus musculus
aaatgtttaggttgtgtgcgtgcac

SEQ ID NO: 24129 - DNA, 25 bp, Mus musculus
aaatgtttagtcacgtgttcccaag

SEQ ID NO: 24130 - DNA, 25 bp, Mus musculus
aaatgtttagtctcgtgttcccaag

SEQ ID NO: 24131 - DNA, 25 bp, Mus musculus
aaatgtttatccaggtttctctaag

SEQ ID NO: 24132 - DNA, 25 bp, Mus musculus
aaatgtttatcctggtttctctaag

SEQ ID NO: 24133 - DNA, 25 bp, Mus musculus
aaatgtttattcatagacctggaga

SEQ ID NO: 24134 - DNA, 25 bp, Mus musculus
aaatgtttattcttagacctggaga

SEQ ID NO: 24135 - DNA, 25 bp, Mus musculus
aaatgtttcagcaccacttctgtta

SEQ ID NO: 24136 - DNA, 25 bp, Mus musculus
aaatgtttcagctccacttctgtta

SEQ ID NO: 24137 - DNA, 25 bp, Mus musculus
aaatgtttcagtacacagctgtgga

SEQ ID NO: 24138 - DNA, 25 bp, Mus musculus
aaatgtttcagttcacagctgtgga

SEQ ID NO: 24139 - DNA, 25 bp, Mus musculus
aaatgtttccatctactaagctcac

SEQ ID NO: 24140 - DNA, 25 bp, Mus musculus
aaatgtttccatgtactaagctcac

SEQ ID NO: 24141 - DNA, 25 bp, Mus musculus
aaatgtttcccaccaaggctgacag

SEQ ID NO: 24142 - DNA, 25 bp, Mus musculus
aaatgtttcccagcaaggctgacag

SEQ ID NO: 24143 - DNA, 25 bp, Mus musculus
aaatgtttcccgaatcatgtatcat

SEQ ID NO: 24144 - DNA, 25 bp, Mus musculus
aaatgtttcccgtatcatgtatcat

SEQ ID NO: 24145 - DNA, 25 bp, Mus musculus
aaatgtttccgtagtgggtgtgtct

SEQ ID NO: 24146 - DNA, 25 bp, Mus musculus
aaatgtttccgttgtgggtgtgtct

SEQ ID NO: 24147 - DNA, 25 bp, Mus musculus
aaatgtttcctcagttgacctcggt

SEQ ID NO: 24148 - DNA, 25 bp, Mus musculus
aaatgtttcctctgttgacctcggt

SEQ ID NO: 24149 - DNA, 25 bp, Mus musculus
aaatgtttcctgatccagccggaac

SEQ ID NO: 24150 - DNA, 25 bp, Mus musculus
aaatgtttcctgttccagccggaac

SEQ ID NO: 24151 - DNA, 25 bp, Mus musculus
aaatgtttctcacactcagccagga

SEQ ID NO: 24152 - DNA, 25 bp, Mus musculus
aaatgtttctcagactcagccagga

SEQ ID NO: 24153 - DNA, 25 bp, Mus musculus
aaatgtttctctactgggttcagct

SEQ ID NO: 24154 - DNA, 25 bp, Mus musculus
aaatgtttctcttctgggttcagct

SEQ ID NO: 24155 - DNA, 25 bp, Mus musculus
aaatgtttctgaaatctaatgtgga

SEQ ID NO: 24156 - DNA, 25 bp, Mus musculus
aaatgtttctgatatctaatgtgga

SEQ ID NO: 24157 - DNA, 25 bp, Mus musculus
aaatgtttctgtatgaaggcaccat

SEQ ID NO: 24158 - DNA, 25 bp, Mus musculus
aaatgtttctgtttgaaggcaccat

SEQ ID NO: 24159 - DNA, 25 bp, Mus musculus
aaatgtttgcatcttgtctaagaaa

SEQ ID NO: 24160 - DNA, 25 bp, Mus musculus
aaatgtttgcatgttgtctaagaaa

SEQ ID NO: 24161 - DNA, 25 bp, Mus musculus
aaatgtttgctaataccttccaaag

SEQ ID NO: 24162 - DNA, 25 bp, Mus musculus
aaatgtttgctattaccttccaaag

SEQ ID NO: 24163 - DNA, 25 bp, Mus musculus
aaatgtttggctaagaggtctctcc

SEQ ID NO: 24164 - DNA, 25 bp, Mus musculus
aaatgtttggcttagaggtctctcc

SEQ ID NO: 24165 - DNA, 25 bp, Mus musculus
aaatgtttgggtacacacgtggtgc

SEQ ID NO: 24166 - DNA, 25 bp, Mus musculus
aaatgtttgggttcacacgtggtgc

SEQ ID NO: 24167 - DNA, 25 bp, Mus musculus
aaatgtttgtacaatgaccagctga

SEQ ID NO: 24168 - DNA, 25 bp, Mus musculus
aaatgtttgtactatgaccagctga

SEQ ID NO: 24169 - DNA, 25 bp, Mus musculus
aaatgtttgtagctggtttctggga

SEQ ID NO: 24170 - DNA, 25 bp, Mus musculus
aaatgtttgtaggtggtttctggga

SEQ ID NO: 24171 - DNA, 25 bp, Mus musculus
aaatgtttgtccaatgagccctttg

SEQ ID NO: 24172 - DNA, 25 bp, Mus musculus
aaatgtttgtcctatgagccctttg

SEQ ID NO: 24173 - DNA, 25 bp, Mus musculus
aaatgtttgtgtatgttcatctgac

SEQ ID NO: 24174 - DNA, 25 bp, Mus musculus
aaatgtttgtgtttgttcatctgac

SEQ ID NO: 24175 - DNA, 25 bp, Mus musculus
aaatgtttgttgaaccacagtgctc

SEQ ID NO: 24176 - DNA, 25 bp, Mus musculus
aaatgtttgttgtaccacagtgctc

SEQ ID NO: 24177 - DNA, 25 bp, Mus musculus
aaatgttttaccacactgttggaca

SEQ ID NO: 24178 - DNA, 25 bp, Mus musculus
aaatgttttacctcactgttggaca

SEQ ID NO: 24179 - DNA, 25 bp, Mus musculus
aaatgttttagtcaccgcctcaagt

SEQ ID NO: 24180 - DNA, 25 bp, Mus musculus
aaatgttttagtgaccgcctcaagt

SEQ ID NO: 24181 - DNA, 25 bp, Mus musculus
aaatgttttatgctgggcttttgca

SEQ ID NO: 24182 - DNA, 25 bp, Mus musculus
aaatgttttatggtgggcttttgca

SEQ ID NO: 24183 - DNA, 25 bp, Mus musculus
aaatgttttcaactaaattcctcag

SEQ ID NO: 24184 - DNA, 25 bp, Mus musculus
aaatgttttcaagtaaattcctcag

SEQ ID NO: 24185 - DNA, 25 bp, Mus musculus
aaatgttttgatctttggaaacatc

SEQ ID NO: 24186 - DNA, 25 bp, Mus musculus
aaatgttttgatgtttggaaacatc

SEQ ID NO: 24187 - DNA, 25 bp, Mus musculus
aaatgtttttacaatcagctctttt

SEQ ID NO: 24188 - DNA, 25 bp, Mus musculus
aaatgtttttactatcagctctttt

SEQ ID NO: 24189 - DNA, 25 bp, Mus musculus
aaatgtttttgaccttgtatcagag

SEQ ID NO: 24190 - DNA, 25 bp, Mus musculus
aaatgtttttgagcttgtatcagag

SEQ ID NO: 24191 - DNA, 25 bp, Mus musculus
aaattaaaactcacactgcccgtag

SEQ ID NO: 24192 - DNA, 25 bp, Mus musculus
aaattaaaactctcactgcccgtag

SEQ ID NO: 24193 - DNA, 25 bp, Mus musculus
aaattaaaatgaatgtacggaagct

SEQ ID NO: 24194 - DNA, 25 bp, Mus musculus
aaattaaaatgattgtacggaagct

SEQ ID NO: 24195 - DNA, 25 bp, Mus musculus
aaattaaactctctagatcagcggt

SEQ ID NO: 24196 - DNA, 25 bp, Mus musculus
aaattaaactctgtagatcagcggt

SEQ ID NO: 24197 - DNA, 25 bp, Mus musculus
aaattaaacttccacagcgctcaga

SEQ ID NO: 24198 - DNA, 25 bp, Mus musculus
aaattaaacttcgacagcgctcaga

SEQ ID NO: 24199 - DNA, 25 bp, Mus musculus
aaattaacccaccatcaggctgagt

SEQ ID NO: 24200 - DNA, 25 bp, Mus musculus
aaattaacccacgatcaggctgagt

SEQ ID NO: 24201 - DNA, 25 bp, Mus musculus
aaattaaccctcagcccttgagtgg

SEQ ID NO: 24202 - DNA, 25 bp, Mus musculus
aaattaaccctctgcccttgagtgg

SEQ ID NO: 24203 - DNA, 25 bp, Mus musculus
aaattaactgtgctgaaacctgctc

SEQ ID NO: 24204 - DNA, 25 bp, Mus musculus
aaattaactgtggtgaaacctgctc

SEQ ID NO: 24205 - DNA, 25 bp, Mus musculus
aaattaactttcattcctctggaag

SEQ ID NO: 24206 - DNA, 25 bp, Mus musculus
aaattaactttctttcctctggaag

SEQ ID NO: 24207 - DNA, 25 bp, Mus musculus
aaattaacttttagtgcccagcctg

SEQ ID NO: 24208 - DNA, 25 bp, Mus musculus
aaattaactttttgtgcccagcctg

SEQ ID NO: 24209 - DNA, 25 bp, Mus musculus
aaattaagaaacacctcactccagc

SEQ ID NO: 24210 - DNA, 25 bp, Mus musculus
aaattaagaaactcctcactccagc

SEQ ID NO: 24211 - DNA, 25 bp, Mus musculus
aaattaagatgaactgcagaggcag

SEQ ID NO: 24212 - DNA, 25 bp, Mus musculus
aaattaagatgatctgcagaggcag

SEQ ID NO: 24213 - DNA, 25 bp, Mus musculus
aaattaagcagacccggcattggcg

SEQ ID NO: 24214 - DNA, 25 bp, Mus musculus
aaattaagcagagccggcattggcg

SEQ ID NO: 24215 - DNA, 25 bp, Mus musculus
aaattaagctgtctggcatccttcc

SEQ ID NO: 24216 - DNA, 25 bp, Mus musculus
aaattaagctgtgtggcatccttcc

SEQ ID NO: 24217 - DNA, 25 bp, Mus musculus
aaattaaggccacctaactccactg

SEQ ID NO: 24218 - DNA, 25 bp, Mus musculus
aaattaaggccagctaactccactg

SEQ ID NO: 24219 - DNA, 25 bp, Mus musculus
aaattaagtagtaactcttcataat

SEQ ID NO: 24220 - DNA, 25 bp, Mus musculus
aaattaagtagttactcttcataat

SEQ ID NO: 24221 - DNA, 25 bp, Mus musculus
aaattaatcctcaggcccagtggtt

SEQ ID NO: 24222 - DNA, 25 bp, Mus musculus
aaattaatcctctggcccagtggtt

SEQ ID NO: 24223 - DNA, 25 bp, Mus musculus
aaattaatcgcactgttttctaact

SEQ ID NO: 24224 - DNA, 25 bp, Mus musculus
aaattaatcgcagtgttttctaact

SEQ ID NO: 24225 - DNA, 25 bp, Mus musculus
aaattaatgagtatagcatgtatgc

SEQ ID NO: 24226 - DNA, 25 bp, Mus musculus
aaattaatgagtttagcatgtatgc

SEQ ID NO: 24227 - DNA, 25 bp, Mus musculus
aaattaatgattctcccttctttga

SEQ ID NO: 24228 - DNA, 25 bp, Mus musculus
aaattaatgattgtcccttctttga

SEQ ID NO: 24229 - DNA, 25 bp, Mus musculus
aaattaattgtgctttaatcccagc

SEQ ID NO: 24230 - DNA, 25 bp, Mus musculus
aaattaattgtggtttaatcccagc

SEQ ID NO: 24231 - DNA, 25 bp, Mus musculus
aaattacaacgccagattccgacac

SEQ ID NO: 24232 - DNA, 25 bp, Mus musculus
aaattacaacgcgagattccgacac

SEQ ID NO: 24233 - DNA, 25 bp, Mus musculus
aaattacaagcaacaggtctctgtg

SEQ ID NO: 24234 - DNA, 25 bp, Mus musculus
aaattacaagcatcaggtctctgtg

SEQ ID NO: 24235 - DNA, 25 bp, Mus musculus
aaattacacagccttcagaatgaat

SEQ ID NO: 24236 - DNA, 25 bp, Mus musculus
aaattacacagcgttcagaatgaat

SEQ ID NO: 24237 - DNA, 25 bp, Mus musculus
aaattacacatgatggcttctcttc

SEQ ID NO: 24238 - DNA, 25 bp, Mus musculus
aaattacacatgttggcttctcttc

SEQ ID NO: 24239 - DNA, 25 bp, Mus musculus
aaattacaccctaggtgccttggag

SEQ ID NO: 24240 - DNA, 25 bp, Mus musculus
aaattacacccttggtgccttggag

SEQ ID NO: 24241 - DNA, 25 bp, Mus musculus
aaattacagcgtcagttgccaccgc

SEQ ID NO: 24242 - DNA, 25 bp, Mus musculus
aaattacagcgtgagttgccaccgc

SEQ ID NO: 24243 - DNA, 25 bp, Mus musculus
aaattacaggccagatgactcccct

SEQ ID NO: 24244 - DNA, 25 bp, Mus musculus
aaattacaggcctgatgactcccct

SEQ ID NO: 24245 - DNA, 25 bp, Mus musculus
aaattacatcggaagcaactgatac

SEQ ID NO: 24246 - DNA, 25 bp, Mus musculus
aaattacatcggtagcaactgatac

SEQ ID NO: 24247 - DNA, 25 bp, Mus musculus
aaattacatggtaatagactaggcc

SEQ ID NO: 24248 - DNA, 25 bp, Mus musculus
aaattacatggttatagactaggcc

SEQ ID NO: 24249 - DNA, 25 bp, Mus musculus
aaattacattaactgccaggcagtg

SEQ ID NO: 24250 - DNA, 25 bp, Mus musculus
aaattacattaagtgccaggcagtg

SEQ ID NO: 24251 - DNA, 25 bp, Mus musculus
aaattaccacacaaagatcatgctt

SEQ ID NO: 24252 - DNA, 25 bp, Mus musculus
aaattaccacactaagatcatgctt

SEQ ID NO: 24253 - DNA, 25 bp, Mus musculus
aaattaccactgagcacccgatgag

SEQ ID NO: 24254 - DNA, 25 bp, Mus musculus
aaattaccactgtgcacccgatgag

SEQ ID NO: 24255 - DNA, 25 bp, Mus musculus
aaattaccatcacggaaactgtgga

SEQ ID NO: 24256 - DNA, 25 bp, Mus musculus
aaattaccatcagggaaactgtgga

SEQ ID NO: 24257 - DNA, 25 bp, Mus musculus
aaattaccatgcacactcatcactc

SEQ ID NO: 24258 - DNA, 25 bp, Mus musculus
aaattaccatgctcactcatcactc

SEQ ID NO: 24259 - DNA, 25 bp, Mus musculus
aaattaccattgactcttctgatac

SEQ ID NO: 24260 - DNA, 25 bp, Mus musculus
aaattaccattgtctcttctgatac

SEQ ID NO: 24261 - DNA, 25 bp, Mus musculus
aaattaccgcacagagcgtggcctg

SEQ ID NO: 24262 - DNA, 25 bp, Mus musculus
aaattaccgcactgagcgtggcctg

SEQ ID NO: 24263 - DNA, 25 bp, Mus musculus
aaattacctcctccttttggagcag

SEQ ID NO: 24264 - DNA, 25 bp, Mus musculus
aaattacctcctctgctgttagtgc

SEQ ID NO: 24265 - DNA, 25 bp, Mus musculus
aaattacctcctgcttttggagcag

SEQ ID NO: 24266 - DNA, 25 bp, Mus musculus
aaattacctcctgtgctgttagtgc

SEQ ID NO: 24267 - DNA, 25 bp, Mus musculus
aaattacctgcccatttggctggac

SEQ ID NO: 24268 - DNA, 25 bp, Mus musculus
aaattacctgccgatttggctggac

SEQ ID NO: 24269 - DNA, 25 bp, Mus musculus
aaattactagtgatctagccaggtg

SEQ ID NO: 24270 - DNA, 25 bp, Mus musculus
aaattactagtgttctagccaggtg

SEQ ID NO: 24271 - DNA, 25 bp, Mus musculus
aaattactcactcagcaacagcatg

SEQ ID NO: 24272 - DNA, 25 bp, Mus musculus
aaattactcactgagcaacagcatg

SEQ ID NO: 24273 - DNA, 25 bp, Mus musculus
aaattactcagtagccttacctcat

SEQ ID NO: 24274 - DNA, 25 bp, Mus musculus
aaattactcagttgccttacctcat

SEQ ID NO: 24275 - DNA, 25 bp, Mus musculus
aaattactcattatcttaccatcaa

SEQ ID NO: 24276 - DNA, 25 bp, Mus musculus
aaattactcattttcttaccatcaa

SEQ ID NO: 24277 - DNA, 25 bp, Mus musculus
aaattactccacaaaagctcccaag

SEQ ID NO: 24278 - DNA, 25 bp, Mus musculus
aaattactccactaaagctcccaag

SEQ ID NO: 24279 - DNA, 25 bp, Mus musculus
aaattactctatcagacgcttgtct

SEQ ID NO: 24280 - DNA, 25 bp, Mus musculus
aaattactctatgagacgcttgtct

SEQ ID NO: 24281 - DNA, 25 bp, Mus musculus
aaattactctccagaatgcctgagg

SEQ ID NO: 24282 - DNA, 25 bp, Mus musculus
aaattactctcctgaatgcctgagg

SEQ ID NO: 24283 - DNA, 25 bp, Mus musculus
aaattactctgcatggttttgccct

SEQ ID NO: 24284 - DNA, 25 bp, Mus musculus
aaattactctgcttggttttgccct

SEQ ID NO: 24285 - DNA, 25 bp, Mus musculus
aaattactcttaccgtgattctcac

SEQ ID NO: 24286 - DNA, 25 bp, Mus musculus
aaattactcttagcgtgattctcac

SEQ ID NO: 24287 - DNA, 25 bp, Mus musculus
aaattactctttaactgtccacagc

SEQ ID NO: 24288 - DNA, 25 bp, Mus musculus
aaattactcttttactgtccacagc

SEQ ID NO: 24289 - DNA, 25 bp, Mus musculus
aaattactgagcagtgtccccagtg

SEQ ID NO: 24290 - DNA, 25 bp, Mus musculus
aaattactgagctgtgtccccagtg

SEQ ID NO: 24291 - DNA, 25 bp, Mus musculus
aaattactgctgatacacctccatt

SEQ ID NO: 24292 - DNA, 25 bp, Mus musculus
aaattactgctgttacacctccatt

SEQ ID NO: 24293 - DNA, 25 bp, Mus musculus
aaattactgcttatgaggactacgt

SEQ ID NO: 24294 - DNA, 25 bp, Mus musculus
aaattactgcttttgaggactacgt

SEQ ID NO: 24295 - DNA, 25 bp, Mus musculus
aaattactggcaccctggaaggaca

SEQ ID NO: 24296 - DNA, 25 bp, Mus musculus
aaattactggcagcctggaaggaca

SEQ ID NO: 24297 - DNA, 25 bp, Mus musculus
aaattactggtcaatggcatgaagc

SEQ ID NO: 24298 - DNA, 25 bp, Mus musculus
aaattactggtctatggcatgaagc

SEQ ID NO: 24299 - DNA, 25 bp, Mus musculus
aaattactgtaaagtggatgctggg

SEQ ID NO: 24300 - DNA, 25 bp, Mus musculus
aaattactgtaatgtggatgctggg

SEQ ID NO: 24301 - DNA, 25 bp, Mus musculus
aaattactgtgtacacactctgaac

SEQ ID NO: 24302 - DNA, 25 bp, Mus musculus
aaattactgtgttcacactctgaac

SEQ ID NO: 24303 - DNA, 25 bp, Mus musculus
aaattacttcatccgtgttcctatc

SEQ ID NO: 24304 - DNA, 25 bp, Mus musculus
aaattacttcatgcgtgttcctatc

SEQ ID NO: 24305 - DNA, 25 bp, Mus musculus
aaattacttcccagctgtttcaagc

SEQ ID NO: 24306 - DNA, 25 bp, Mus musculus
aaattacttccctgctgtttcaagc

SEQ ID NO: 24307 - DNA, 25 bp, Mus musculus
aaattacttgaaagatggccactta

SEQ ID NO: 24308 - DNA, 25 bp, Mus musculus
aaattacttgaatgatggccactta

SEQ ID NO: 24309 - DNA, 25 bp, Mus musculus
aaattactttgacaccaagagtggt

SEQ ID NO: 24310 - DNA, 25 bp, Mus musculus
aaattactttgagaccaagagtggt

SEQ ID NO: 24311 - DNA, 25 bp, Mus musculus
aaattagacaatcaccccacttcct

SEQ ID NO: 24312 - DNA, 25 bp, Mus musculus
aaattagacaatgaccccacttcct

SEQ ID NO: 24313 - DNA, 25 bp, Mus musculus
aaattagacatgacctcctccctat

SEQ ID NO: 24314 - DNA, 25 bp, Mus musculus
aaattagacatgtcctcctccctat

SEQ ID NO: 24315 - DNA, 25 bp, Mus musculus
aaattagactacaacacccactcac

SEQ ID NO: 24316 - DNA, 25 bp, Mus musculus
aaattagactactacacccactcac

SEQ ID NO: 24317 - DNA, 25 bp, Mus musculus
aaattagagcttatccttgacaaat

SEQ ID NO: 24318 - DNA, 25 bp, Mus musculus
aaattagagcttttccttgacaaat

SEQ ID NO: 24319 - DNA, 25 bp, Mus musculus
aaattagaggttagagctgggcttg

SEQ ID NO: 24320 - DNA, 25 bp, Mus musculus
aaattagaggtttgagctgggcttg

SEQ ID NO: 24321 - DNA, 25 bp, Mus musculus
aaattagagtcaacgcaccagggtg

SEQ ID NO: 24322 - DNA, 25 bp, Mus musculus
aaattagagtcatcgcaccagggtg

SEQ ID NO: 24323 - DNA, 25 bp, Mus musculus
aaattagatcctcggctaccaagat

SEQ ID NO: 24324 - DNA, 25 bp, Mus musculus
aaattagatcctgggctaccaagat

SEQ ID NO: 24325 - DNA, 25 bp, Mus musculus
aaattagccccaattggtcctctag

SEQ ID NO: 24326 - DNA, 25 bp, Mus musculus
aaattagccccatttggtcctctag

SEQ ID NO: 24327 - DNA, 25 bp, Mus musculus
aaattagccgacagcagaatatccg

SEQ ID NO: 24328 - DNA, 25 bp, Mus musculus
aaattagccgactgcagaatatccg

SEQ ID NO: 24329 - DNA, 25 bp, Mus musculus
aaattagccgtcaccaggagcagtt

SEQ ID NO: 24330 - DNA, 25 bp, Mus musculus
aaattagccgtctccaggagcagtt

SEQ ID NO: 24331 - DNA, 25 bp, Mus musculus
aaattagctgtaaagtcttggatac

SEQ ID NO: 24332 - DNA, 25 bp, Mus musculus
aaattagctgtatagtcttggatac

SEQ ID NO: 24333 - DNA, 25 bp, Mus musculus
aaattagcttcgacagacacagtga

SEQ ID NO: 24334 - DNA, 25 bp, Mus musculus
aaattagcttcgtcagacacagtga

SEQ ID NO: 24335 - DNA, 25 bp, Mus musculus
aaattagcttttagcaggtattcta

SEQ ID NO: 24336 - DNA, 25 bp, Mus musculus
aaattagctttttgcaggtattcta

SEQ ID NO: 24337 - DNA, 25 bp, Mus musculus
aaattaggagagctctgctcttcat

SEQ ID NO: 24338 - DNA, 25 bp, Mus musculus
aaattaggagaggtctgctcttcat

SEQ ID NO: 24339 - DNA, 25 bp, Mus musculus
aaattaggagcgactactttgtatt

SEQ ID NO: 24340 - DNA, 25 bp, Mus musculus
aaattaggagcgtctactttgtatt

SEQ ID NO: 24341 - DNA, 25 bp, Mus musculus
aaattaggctgcaccatgtatatgt

SEQ ID NO: 24342 - DNA, 25 bp, Mus musculus
aaattaggctgctccatgtatatgt

SEQ ID NO: 24343 - DNA, 25 bp, Mus musculus
aaattagggcaaccggctccctggt

SEQ ID NO: 24344 - DNA, 25 bp, Mus musculus
aaattagggcaagcggctccctggt

SEQ ID NO: 24345 - DNA, 25 bp, Mus musculus
aaattaggtcacatgtggtggcaaa

SEQ ID NO: 24346 - DNA, 25 bp, Mus musculus
aaattaggtcacttgtggtggcaaa

SEQ ID NO: 24347 - DNA, 25 bp, Mus musculus
aaattaggtggacctctgcccgatc

SEQ ID NO: 24348 - DNA, 25 bp, Mus musculus
aaattaggtggagctctgcccgatc

SEQ ID NO: 24349 - DNA, 25 bp, Mus musculus
aaattagtagagactgtgggctatc

SEQ ID NO: 24350 - DNA, 25 bp, Mus musculus
aaattagtagagtctgtgggctatc

SEQ ID NO: 24351 - DNA, 25 bp, Mus musculus
aaattagtcattctttatgctacat

SEQ ID NO: 24352 - DNA, 25 bp, Mus musculus
aaattagtcattgtttatgctacat

SEQ ID NO: 24353 - DNA, 25 bp, Mus musculus
aaattagtctctcatcatcttcaac

SEQ ID NO: 24354 - DNA, 25 bp, Mus musculus
aaattagtctctgatcatcttcaac

SEQ ID NO: 24355 - DNA, 25 bp, Mus musculus
aaattagtcttgaaccatagggtga

SEQ ID NO: 24356 - DNA, 25 bp, Mus musculus
aaattagtcttgtaccatagggtga

SEQ ID NO: 24357 - DNA, 25 bp, Mus musculus
aaattagtgcccacaaacgagccct

SEQ ID NO: 24358 - DNA, 25 bp, Mus musculus
aaattagtgccctcaaacgagccct

SEQ ID NO: 24359 - DNA, 25 bp, Mus musculus
aaattagtgggcactaatcaaatga

SEQ ID NO: 24360 - DNA, 25 bp, Mus musculus
aaattagtgggctctaatcaaatga

SEQ ID NO: 24361 - DNA, 25 bp, Mus musculus
aaattagtgtgcacttgtcatgatc

SEQ ID NO: 24362 - DNA, 25 bp, Mus musculus
aaattagtgtgctcttgtcatgatc

SEQ ID NO: 24363 - DNA, 25 bp, Mus musculus
aaattatacagcctgccaagcttcc

SEQ ID NO: 24364 - DNA, 25 bp, Mus musculus
aaattatacagcgtgccaagcttcc

SEQ ID NO: 24365 - DNA, 25 bp, Mus musculus
aaattataccagcactaccatcacc

SEQ ID NO: 24366 - DNA, 25 bp, Mus musculus
aaattataccaggactaccatcacc

SEQ ID NO: 24367 - DNA, 25 bp, Mus musculus
aaattatagcttacctttaggcagg

SEQ ID NO: 24368 - DNA, 25 bp, Mus musculus
aaattatagctttcctttaggcagg

SEQ ID NO: 24369 - DNA, 25 bp, Mus musculus
aaattatatcgcatagcttccacta

SEQ ID NO: 24370 - DNA, 25 bp, Mus musculus
aaattatatcgcttagcttccacta

SEQ ID NO: 24371 - DNA, 25 bp, Mus musculus
aaattatatctcctcctcaaggcaa

SEQ ID NO: 24372 - DNA, 25 bp, Mus musculus
aaattatatctcgtcctcaaggcaa

SEQ ID NO: 24373 - DNA, 25 bp, Mus musculus
aaattatatgccacccagatgtaca

SEQ ID NO: 24374 - DNA, 25 bp, Mus musculus
aaattatatgcctcccagatgtaca

SEQ ID NO: 24375 - DNA, 25 bp, Mus musculus
aaattatatgctcttatcaatagat

SEQ ID NO: 24376 - DNA, 25 bp, Mus musculus
aaattatatgctgttatcaatagat

SEQ ID NO: 24377 - DNA, 25 bp, Mus musculus
aaattatatgtacctgtggctattt

SEQ ID NO: 24378 - DNA, 25 bp, Mus musculus
aaattatatgtagctgtggctattt

SEQ ID NO: 24379 - DNA, 25 bp, Mus musculus
aaattatcatgcacgctctacacgt

SEQ ID NO: 24380 - DNA, 25 bp, Mus musculus
aaattatcatgctcgctctacacgt

SEQ ID NO: 24381 - DNA, 25 bp, Mus musculus
aaattatccatcacttgcaaaatga

SEQ ID NO: 24382 - DNA, 25 bp, Mus musculus
aaattatccatctcttgcaaaatga

SEQ ID NO: 24383 - DNA, 25 bp, Mus musculus
aaattatcctcaccaccaatgcctt

SEQ ID NO: 24384 - DNA, 25 bp, Mus musculus
aaattatcctcagcaccaatgcctt

SEQ ID NO: 24385 - DNA, 25 bp, Mus musculus
aaattatcctttaggcagtcagaat

SEQ ID NO: 24386 - DNA, 25 bp, Mus musculus
aaattatccttttggcagtcagaat

SEQ ID NO: 24387 - DNA, 25 bp, Mus musculus
aaattatctcccctgagtggtctca

SEQ ID NO: 24388 - DNA, 25 bp, Mus musculus
aaattatctcccgtgagtggtctca

SEQ ID NO: 24389 - DNA, 25 bp, Mus musculus
aaattatcttatctcatcccattcc

SEQ ID NO: 24390 - DNA, 25 bp, Mus musculus
aaattatcttatgtcatcccattcc

SEQ ID NO: 24391 - DNA, 25 bp, Mus musculus
aaattatcttcaagctctggtaggg

SEQ ID NO: 24392 - DNA, 25 bp, Mus musculus
aaattatcttcatgctctggtaggg

SEQ ID NO: 24393 - DNA, 25 bp, Mus musculus
aaattatcttccattcacccgagag

SEQ ID NO: 24394 - DNA, 25 bp, Mus musculus
aaattatcttcctttcacccgagag

SEQ ID NO: 24395 - DNA, 25 bp, Mus musculus
aaattatctttaatgtggagtccca

SEQ ID NO: 24396 - DNA, 25 bp, Mus musculus
aaattatctttattgtggagtccca

SEQ ID NO: 24397 - DNA, 25 bp, Mus musculus
aaattatgaattatggtacagggca

SEQ ID NO: 24398 - DNA, 25 bp, Mus musculus
aaattatgaattttggtacagggca

SEQ ID NO: 24399 - DNA, 25 bp, Mus musculus
aaattatgacgcacagccaacgcaa

SEQ ID NO: 24400 - DNA, 25 bp, Mus musculus
aaattatgacgctcagccaacgcaa

SEQ ID NO: 24401 - DNA, 25 bp, Mus musculus
aaattatgaggtatgcccatgtggc

SEQ ID NO: 24402 - DNA, 25 bp, Mus musculus
aaattatgaggtttgcccatgtggc

SEQ ID NO: 24403 - DNA, 25 bp, Mus musculus
aaattatgcatacttcttttttaat

SEQ ID NO: 24404 - DNA, 25 bp, Mus musculus
aaattatgcatagttcttttttaat

SEQ ID NO: 24405 - DNA, 25 bp, Mus musculus
aaattatgccgtagtctctttagag

SEQ ID NO: 24406 - DNA, 25 bp, Mus musculus
aaattatgccgtcgcgaggttgttt

SEQ ID NO: 24407 - DNA, 25 bp, Mus musculus
aaattatgccgtggcgaggttgttt

SEQ ID NO: 24408 - DNA, 25 bp, Mus musculus
aaattatgccgttgtctctttagag

SEQ ID NO: 24409 - DNA, 25 bp, Mus musculus
aaattatgctctatgtggggactga

SEQ ID NO: 24410 - DNA, 25 bp, Mus musculus
aaattatgctctttgtggggactga

SEQ ID NO: 24411 - DNA, 25 bp, Mus musculus
aaattatgctgcaattacagactta

SEQ ID NO: 24412 - DNA, 25 bp, Mus musculus
aaattatgctgctattacagactta

SEQ ID NO: 24413 - DNA, 25 bp, Mus musculus
aaattatggcaacctggctggtcct

SEQ ID NO: 24414 - DNA, 25 bp, Mus musculus
aaattatggcaagctggctggtcct

SEQ ID NO: 24415 - DNA, 25 bp, Mus musculus
aaattatggccaattcctacaggga

SEQ ID NO: 24416 - DNA, 25 bp, Mus musculus
aaattatggccatttcctacaggga

SEQ ID NO: 24417 - DNA, 25 bp, Mus musculus
aaattatggctacttctggtgttgt

SEQ ID NO: 24418 - DNA, 25 bp, Mus musculus
aaattatggctagttctggtgttgt

SEQ ID NO: 24419 - DNA, 25 bp, Mus musculus
aaattatgtcacagccgggtgtggt

SEQ ID NO: 24420 - DNA, 25 bp, Mus musculus
aaattatgtcactgccgggtgtggt

SEQ ID NO: 24421 - DNA, 25 bp, Mus musculus
aaattatgtccgatccagtctttca

SEQ ID NO: 24422 - DNA, 25 bp, Mus musculus
aaattatgtccgttccagtctttca

SEQ ID NO: 24423 - DNA, 25 bp, Mus musculus
aaattatgtggcacctttgcactca

SEQ ID NO: 24424 - DNA, 25 bp, Mus musculus
aaattatgtggctcctttgcactca

SEQ ID NO: 24425 - DNA, 25 bp, Mus musculus
aaattattatccagagcctgtgtta

SEQ ID NO: 24426 - DNA, 25 bp, Mus musculus
aaattattatcctgagcctgtgtta

SEQ ID NO: 24427 - DNA, 25 bp, Mus musculus
aaattattcatgcatagtgtatgga

SEQ ID NO: 24428 - DNA, 25 bp, Mus musculus
aaattattcatggatagtgtatgga

SEQ ID NO: 24429 - DNA, 25 bp, Mus musculus
aaattattcccaatgtggccaccat

SEQ ID NO: 24430 - DNA, 25 bp, Mus musculus
aaattattcccattgtggccaccat

SEQ ID NO: 24431 - DNA, 25 bp, Mus musculus
aaattattgatcactttttggcttt

SEQ ID NO: 24432 - DNA, 25 bp, Mus musculus
aaattattgatctctttttggcttt

SEQ ID NO: 24433 - DNA, 25 bp, Mus musculus
aaattattttgcaggtggtgtcact

SEQ ID NO: 24434 - DNA, 25 bp, Mus musculus
aaattattttgctggtggtgtcact

SEQ ID NO: 24435 - DNA, 25 bp, Mus musculus
aaattcaaaccaaatccacacacaa

SEQ ID NO: 24436 - DNA, 25 bp, Mus musculus
aaattcaaaccatatccacacacaa

SEQ ID NO: 24437 - DNA, 25 bp, Mus musculus
aaattcaaacctctgtaactgtgga

SEQ ID NO: 24438 - DNA, 25 bp, Mus musculus
aaattcaaacctgtgtaactgtgga

SEQ ID NO: 24439 - DNA, 25 bp, Mus musculus
aaattcaaagctaccctgggctgca

SEQ ID NO: 24440 - DNA, 25 bp, Mus musculus
aaattcaaagcttccctgggctgca

SEQ ID NO: 24441 - DNA, 25 bp, Mus musculus
aaattcaaatggcatacacacgtat

SEQ ID NO: 24442 - DNA, 25 bp, Mus musculus
aaattcaaatgggatacacacgtat

SEQ ID NO: 24443 - DNA, 25 bp, Mus musculus
aaattcaacttgctgtgggagcaga

SEQ ID NO: 24444 - DNA, 25 bp, Mus musculus
aaattcaacttggtgtgggagcaga

SEQ ID NO: 24445 - DNA, 25 bp, Mus musculus
aaattcaagacacgcctttatagtg

SEQ ID NO: 24446 - DNA, 25 bp, Mus musculus
aaattcaagacaggcctttatagtg

SEQ ID NO: 24447 - DNA, 25 bp, Mus musculus
aaattcaagagacgcccttggtggc

SEQ ID NO: 24448 - DNA, 25 bp, Mus musculus
aaattcaagagaggcccttggtggc

SEQ ID NO: 24449 - DNA, 25 bp, Mus musculus
aaattcaagctccaatgtcttccct

SEQ ID NO: 24450 - DNA, 25 bp, Mus musculus
aaattcaagctcgaatgtcttccct

SEQ ID NO: 24451 - DNA, 25 bp, Mus musculus
aaattcaagggcacacacaccaaaa

SEQ ID NO: 24452 - DNA, 25 bp, Mus musculus
aaattcaagggctcacacaccaaaa

SEQ ID NO: 24453 - DNA, 25 bp, Mus musculus
aaattcaaggtcattgtgatctaca

SEQ ID NO: 24454 - DNA, 25 bp, Mus musculus
aaattcaaggtctttgtgatctaca

SEQ ID NO: 24455 - DNA, 25 bp, Mus musculus
aaattcaatgttaggtaggtatcaa

SEQ ID NO: 24456 - DNA, 25 bp, Mus musculus
aaattcaatgtttggtaggtatcaa

SEQ ID NO: 24457 - DNA, 25 bp, Mus musculus
aaattcacaactaacatgggtgttc

SEQ ID NO: 24458 - DNA, 25 bp, Mus musculus
aaattcacaacttacatgggtgttc

SEQ ID NO: 24459 - DNA, 25 bp, Mus musculus
aaattcacaagaatcagggcgtggg

SEQ ID NO: 24460 - DNA, 25 bp, Mus musculus
aaattcacaagattcagggcgtggg

SEQ ID NO: 24461 - DNA, 25 bp, Mus musculus
aaattcacaaggatcaacccggcca

SEQ ID NO: 24462 - DNA, 25 bp, Mus musculus
aaattcacaaggttcaacccggcca

SEQ ID NO: 24463 - DNA, 25 bp, Mus musculus
aaattcacagccatctctttaaaca

SEQ ID NO: 24464 - DNA, 25 bp, Mus musculus
aaattcacagccttctctttaaaca

SEQ ID NO: 24465 - DNA, 25 bp, Mus musculus
aaattcacagctcattttgtctgat

SEQ ID NO: 24466 - DNA, 25 bp, Mus musculus
aaattcacagctgattttgtctgat

SEQ ID NO: 24467 - DNA, 25 bp, Mus musculus
aaattcacgctgaccttgcagagca

SEQ ID NO: 24468 - DNA, 25 bp, Mus musculus
aaattcacgctgtccttgcagagca

SEQ ID NO: 24469 - DNA, 25 bp, Mus musculus
aaattcactacacatgcagtctcca

SEQ ID NO: 24470 - DNA, 25 bp, Mus musculus
aaattcactacagatgcagtctcca

SEQ ID NO: 24471 - DNA, 25 bp, Mus musculus
aaattcactatcaagcctcacagcg

SEQ ID NO: 24472 - DNA, 25 bp, Mus musculus
aaattcactatctagcctcacagcg

SEQ ID NO: 24473 - DNA, 25 bp, Mus musculus
aaattcactgtgctggctctcgtac

SEQ ID NO: 24474 - DNA, 25 bp, Mus musculus
aaattcactgtggtggctctcgtac

SEQ ID NO: 24475 - DNA, 25 bp, Mus musculus
aaattcacttgactttgctattctt

SEQ ID NO: 24476 - DNA, 25 bp, Mus musculus
aaattcacttgagtttgctattctt

SEQ ID NO: 24477 - DNA, 25 bp, Mus musculus
aaattcagaaagagacagcccttct

SEQ ID NO: 24478 - DNA, 25 bp, Mus musculus
aaattcagaaagtgacagcccttct

SEQ ID NO: 24479 - DNA, 25 bp, Mus musculus
aaattcagaaccacagcactcggtg

SEQ ID NO: 24480 - DNA, 25 bp, Mus musculus
aaattcagaacctcagcactcggtg

SEQ ID NO: 24481 - DNA, 25 bp, Mus musculus
aaattcagactgcaggccttcaacc

SEQ ID NO: 24482 - DNA, 25 bp, Mus musculus
aaattcagactggaggccttcaacc

SEQ ID NO: 24483 - DNA, 25 bp, Mus musculus
aaattcagagccattgggtctccct

SEQ ID NO: 24484 - DNA, 25 bp, Mus musculus
aaattcagagcctttgggtctccct

SEQ ID NO: 24485 - DNA, 25 bp, Mus musculus
aaattcagagtaacagattggctta

SEQ ID NO: 24486 - DNA, 25 bp, Mus musculus
aaattcagagtatcagattggctta

SEQ ID NO: 24487 - DNA, 25 bp, Mus musculus
aaattcagagtgatttgcctccctc

SEQ ID NO: 24488 - DNA, 25 bp, Mus musculus
aaattcagagtgttttgcctccctc

SEQ ID NO: 24489 - DNA, 25 bp, Mus musculus
aaattcagatcaagcataataccag

SEQ ID NO: 24490 - DNA, 25 bp, Mus musculus
aaattcagatcatgcataataccag

SEQ ID NO: 24491 - DNA, 25 bp, Mus musculus
aaattcagatgcatctcttgggcca

SEQ ID NO: 24492 - DNA, 25 bp, Mus musculus
aaattcagatgcttctcttgggcca

SEQ ID NO: 24493 - DNA, 25 bp, Mus musculus
aaattcagatttaccatggtgcatc

SEQ ID NO: 24494 - DNA, 25 bp, Mus musculus
aaattcagattttccatggtgcatc

SEQ ID NO: 24495 - DNA, 25 bp, Mus musculus
aaattcagcaccaaacagccagctc

SEQ ID NO: 24496 - DNA, 25 bp, Mus musculus
aaattcagcacctaacagccagctc

SEQ ID NO: 24497 - DNA, 25 bp, Mus musculus
aaattcagcattcgctcagagagtc

SEQ ID NO: 24498 - DNA, 25 bp, Mus musculus
aaattcagcattggctcagagagtc

SEQ ID NO: 24499 - DNA, 25 bp, Mus musculus
aaattcagcctgcatcttttacaat

SEQ ID NO: 24500 - DNA, 25 bp, Mus musculus
aaattcagcctggatcttttacaat

SEQ ID NO: 24501 - DNA, 25 bp, Mus musculus
aaattcagctataggtgtatttcaa

SEQ ID NO: 24502 - DNA, 25 bp, Mus musculus
aaattcagctattggtgtatttcaa

SEQ ID NO: 24503 - DNA, 25 bp, Mus musculus
aaattcagctttcagtctgggtagc

SEQ ID NO: 24504 - DNA, 25 bp, Mus musculus
aaattcagctttctccttggaaagg

SEQ ID NO: 24505 - DNA, 25 bp, Mus musculus
aaattcagctttgagtctgggtagc

SEQ ID NO: 24506 - DNA, 25 bp, Mus musculus
aaattcagctttgtccttggaaagg

SEQ ID NO: 24507 - DNA, 25 bp, Mus musculus
aaattcaggattagaccccagccag

SEQ ID NO: 24508 - DNA, 25 bp, Mus musculus
aaattcaggatttgaccccagccag

SEQ ID NO: 24509 - DNA, 25 bp, Mus musculus
aaattcaggcctacacacttctaag

SEQ ID NO: 24510 - DNA, 25 bp, Mus musculus
aaattcaggccttcacacttctaag

SEQ ID NO: 24511 - DNA, 25 bp, Mus musculus
aaattcaggctgcaagctgctctcg

SEQ ID NO: 24512 - DNA, 25 bp, Mus musculus
aaattcaggctggaagctgctctcg

SEQ ID NO: 24513 - DNA, 25 bp, Mus musculus
aaattcaggtcgctaggcctgcttg

SEQ ID NO: 24514 - DNA, 25 bp, Mus musculus
aaattcaggtcggtaggcctgcttg

SEQ ID NO: 24515 - DNA, 25 bp, Mus musculus
aaattcagtccccatgacagtacat

SEQ ID NO: 24516 - DNA, 25 bp, Mus musculus
aaattcagtcccgatgacagtacat

SEQ ID NO: 24517 - DNA, 25 bp, Mus musculus
aaattcagtcttcagcacccacatt

SEQ ID NO: 24518 - DNA, 25 bp, Mus musculus
aaattcagtcttgagcacccacatt

SEQ ID NO: 24519 - DNA, 25 bp, Mus musculus
aaattcagtgggagactctacacag

SEQ ID NO: 24520 - DNA, 25 bp, Mus musculus
aaattcagtgggtgactctacacag

SEQ ID NO: 24521 - DNA, 25 bp, Mus musculus
aaattcatacgcatgtttgtataaa

SEQ ID NO: 24522 - DNA, 25 bp, Mus musculus
aaattcatacgcttgtttgtataaa

SEQ ID NO: 24523 - DNA, 25 bp, Mus musculus
aaattcatacggcttccttaagaag

SEQ ID NO: 24524 - DNA, 25 bp, Mus musculus
aaattcatacgggttccttaagaag

SEQ ID NO: 24525 - DNA, 25 bp, Mus musculus
aaattcatacttaggtttgatcaca

SEQ ID NO: 24526 - DNA, 25 bp, Mus musculus
aaattcatactttggtttgatcaca

SEQ ID NO: 24527 - DNA, 25 bp, Mus musculus
aaattcatcattctcaactcttgag

SEQ ID NO: 24528 - DNA, 25 bp, Mus musculus
aaattcatcattgtcaactcttgag

SEQ ID NO: 24529 - DNA, 25 bp, Mus musculus
aaattcatccagagacttccaggag

SEQ ID NO: 24530 - DNA, 25 bp, Mus musculus
aaattcatccagtgacttccaggag

SEQ ID NO: 24531 - DNA, 25 bp, Mus musculus
aaattcatccgtcgcagagctgtgt

SEQ ID NO: 24532 - DNA, 25 bp, Mus musculus
aaattcatccgtggcagagctgtgt

SEQ ID NO: 24533 - DNA, 25 bp, Mus musculus
aaattcatctaccagtccgatgtgc

SEQ ID NO: 24534 - DNA, 25 bp, Mus musculus
aaattcatctacgagtccgatgtgc

SEQ ID NO: 24535 - DNA, 25 bp, Mus musculus
aaattcatggtcattattctgtagt

SEQ ID NO: 24536 - DNA, 25 bp, Mus musculus
aaattcatggtccagttccggcttg

SEQ ID NO: 24537 - DNA, 25 bp, Mus musculus
aaattcatggtcgagttccggcttg

SEQ ID NO: 24538 - DNA, 25 bp, Mus musculus
aaattcatggtctttattctgtagt

SEQ ID NO: 24539 - DNA, 25 bp, Mus musculus
aaattcatggtgattcgggctgtca

SEQ ID NO: 24540 - DNA, 25 bp, Mus musculus
aaattcatggtgtttcgggctgtca

SEQ ID NO: 24541 - DNA, 25 bp, Mus musculus
aaattcatgttcacctatccctgtt

SEQ ID NO: 24542 - DNA, 25 bp, Mus musculus
aaattcatgttctcctatccctgtt

SEQ ID NO: 24543 - DNA, 25 bp, Mus musculus
aaattcattaacacttgctaaggta

SEQ ID NO: 24544 - DNA, 25 bp, Mus musculus
aaattcattaacatgcccagtgtgc

SEQ ID NO: 24545 - DNA, 25 bp, Mus musculus
aaattcattaactcttgctaaggta

SEQ ID NO: 24546 - DNA, 25 bp, Mus musculus
aaattcattaacttgcccagtgtgc

SEQ ID NO: 24547 - DNA, 25 bp, Mus musculus
aaattcattgttcaaggctgcttca

SEQ ID NO: 24548 - DNA, 25 bp, Mus musculus
aaattcattgttgaaggctgcttca

SEQ ID NO: 24549 - DNA, 25 bp, Mus musculus
aaattcatttataccaccgagaaga

SEQ ID NO: 24550 - DNA, 25 bp, Mus musculus
aaattcatttattccaccgagaaga

SEQ ID NO: 24551 - DNA, 25 bp, Mus musculus
aaattcatttgcagcatctttctcc

SEQ ID NO: 24552 - DNA, 25 bp, Mus musculus
aaattcatttgctgcatctttctcc

SEQ ID NO: 24553 - DNA, 25 bp, Mus musculus
aaattcattttactatcctgggcat

SEQ ID NO: 24554 - DNA, 25 bp, Mus musculus
aaattcattttagtatcctgggcat

SEQ ID NO: 24555 - DNA, 25 bp, Mus musculus
aaattcatttttcacacctcccgtg

SEQ ID NO: 24556 - DNA, 25 bp, Mus musculus
aaattcatttttgacacctcccgtg

SEQ ID NO: 24557 - DNA, 25 bp, Mus musculus
aaattccaaagaaggctttgtttgc

SEQ ID NO: 24558 - DNA, 25 bp, Mus musculus
aaattccaaagatggctttgtttgc

SEQ ID NO: 24559 - DNA, 25 bp, Mus musculus
aaattccaacctatagctctaaaga

SEQ ID NO: 24560 - DNA, 25 bp, Mus musculus
aaattccaacctttagctctaaaga

SEQ ID NO: 24561 - DNA, 25 bp, Mus musculus
aaattccaacgacccatcactggtg

SEQ ID NO: 24562 - DNA, 25 bp, Mus musculus
aaattccaacgagccatcactggtg

SEQ ID NO: 24563 - DNA, 25 bp, Mus musculus
aaattccacatgaaggttgatagac

SEQ ID NO: 24564 - DNA, 25 bp, Mus musculus
aaattccacatgtaggttgatagac

SEQ ID NO: 24565 - DNA, 25 bp, Mus musculus
aaattccactctcgtcaccatagtg

SEQ ID NO: 24566 - DNA, 25 bp, Mus musculus
aaattccactctggtcaccatagtg

SEQ ID NO: 24567 - DNA, 25 bp, Mus musculus
aaattccactggactgtttccattg

SEQ ID NO: 24568 - DNA, 25 bp, Mus musculus
aaattccactggtctgtttccattg

SEQ ID NO: 24569 - DNA, 25 bp, Mus musculus
aaattccagccacgccagatttcag

SEQ ID NO: 24570 - DNA, 25 bp, Mus musculus
aaattccagccaggccagatttcag

SEQ ID NO: 24571 - DNA, 25 bp, Mus musculus
aaattccagcctcagccagggcttc

SEQ ID NO: 24572 - DNA, 25 bp, Mus musculus
aaattccagcctgagccagggcttc

SEQ ID NO: 24573 - DNA, 25 bp, Mus musculus
aaattccaggacacccaacgctact

SEQ ID NO: 24574 - DNA, 25 bp, Mus musculus
aaattccaggactcccaacgctact

SEQ ID NO: 24575 - DNA, 25 bp, Mus musculus
aaattccaggagctgtataggattt

SEQ ID NO: 24576 - DNA, 25 bp, Mus musculus
aaattccaggaggtgtataggattt

SEQ ID NO: 24577 - DNA, 25 bp, Mus musculus
aaattccaggctacattttgacaaa

SEQ ID NO: 24578 - DNA, 25 bp, Mus musculus
aaattccaggcttcattttgacaaa

SEQ ID NO: 24579 - DNA, 25 bp, Mus musculus
aaattccagtccccggccagagaca

SEQ ID NO: 24580 - DNA, 25 bp, Mus musculus
aaattccagtccgcggccagagaca

SEQ ID NO: 24581 - DNA, 25 bp, Mus musculus
aaattccatgaacttaaatctgtga

SEQ ID NO: 24582 - DNA, 25 bp, Mus musculus
aaattccatgaagttaaatctgtga

SEQ ID NO: 24583 - DNA, 25 bp, Mus musculus
aaattccatgccagctgtcaacatt

SEQ ID NO: 24584 - DNA, 25 bp, Mus musculus
aaattccatgcctgctgtcaacatt

SEQ ID NO: 24585 - DNA, 25 bp, Mus musculus
aaattccatgggatgttgccagtaa

SEQ ID NO: 24586 - DNA, 25 bp, Mus musculus
aaattccatgggttgttgccagtaa

SEQ ID NO: 24587 - DNA, 25 bp, Mus musculus
aaattccattccaagcgattctgtg

SEQ ID NO: 24588 - DNA, 25 bp, Mus musculus
aaattccattcctagcgattctgtg

SEQ ID NO: 24589 - DNA, 25 bp, Mus musculus
aaattccattggacgtgacatcccc

SEQ ID NO: 24590 - DNA, 25 bp, Mus musculus
aaattccattggtcgtgacatcccc

SEQ ID NO: 24591 - DNA, 25 bp, Mus musculus
aaattcccaatcagcctttctggga

SEQ ID NO: 24592 - DNA, 25 bp, Mus musculus
aaattcccaatctgcctttctggga

SEQ ID NO: 24593 - DNA, 25 bp, Mus musculus
aaattcccactgaccacggagtcag

SEQ ID NO: 24594 - DNA, 25 bp, Mus musculus
aaattcccactgtccacggagtcag

SEQ ID NO: 24595 - DNA, 25 bp, Mus musculus
aaattcccagaaccagtccaggcgg

SEQ ID NO: 24596 - DNA, 25 bp, Mus musculus
aaattcccagaagcagtccaggcgg

SEQ ID NO: 24597 - DNA, 25 bp, Mus musculus
aaattcccattcagtctcaagtgac

SEQ ID NO: 24598 - DNA, 25 bp, Mus musculus
aaattcccattctgtctcaagtgac

SEQ ID NO: 24599 - DNA, 25 bp, Mus musculus
aaattcccatttatagccacagctg

SEQ ID NO: 24600 - DNA, 25 bp, Mus musculus
aaattcccatttttagccacagctg

SEQ ID NO: 24601 - DNA, 25 bp, Mus musculus
aaattccccatcagcttgtagaagc

SEQ ID NO: 24602 - DNA, 25 bp, Mus musculus
aaattccccatctgcttgtagaagc

SEQ ID NO: 24603 - DNA, 25 bp, Mus musculus
aaattcccgtggagatggcccaggc

SEQ ID NO: 24604 - DNA, 25 bp, Mus musculus
aaattcccgtggtgatggcccaggc

SEQ ID NO: 24605 - DNA, 25 bp, Mus musculus
aaattccgagccaacaagggactga

SEQ ID NO: 24606 - DNA, 25 bp, Mus musculus
aaattccgagcctacaagggactga

SEQ ID NO: 24607 - DNA, 25 bp, Mus musculus
aaattccgatggagtcactggcgcc

SEQ ID NO: 24608 - DNA, 25 bp, Mus musculus
aaattccgatggtgtcactggcgcc

SEQ ID NO: 24609 - DNA, 25 bp, Mus musculus
aaattccgccagcaagtcacgaaag

SEQ ID NO: 24610 - DNA, 25 bp, Mus musculus
aaattccgccaggaagtcacgaaag

SEQ ID NO: 24611 - DNA, 25 bp, Mus musculus
aaattccgtcctcgctcattaactg

SEQ ID NO: 24612 - DNA, 25 bp, Mus musculus
aaattccgtcctggctcattaactg

SEQ ID NO: 24613 - DNA, 25 bp, Mus musculus
aaattccgtcttcgttctgtactat

SEQ ID NO: 24614 - DNA, 25 bp, Mus musculus
aaattccgtcttggttctgtactat

SEQ ID NO: 24615 - DNA, 25 bp, Mus musculus
aaattcctaaatcggccatcccaag

SEQ ID NO: 24616 - DNA, 25 bp, Mus musculus
aaattcctaaatgggccatcccaag

SEQ ID NO: 24617 - DNA, 25 bp, Mus musculus
aaattcctaagcattctctgttccc

SEQ ID NO: 24618 - DNA, 25 bp, Mus musculus
aaattcctaagccttgcaccgatgg

SEQ ID NO: 24619 - DNA, 25 bp, Mus musculus
aaattcctaagcgttgcaccgatgg

SEQ ID NO: 24620 - DNA, 25 bp, Mus musculus
aaattcctaagctttctctgttccc

SEQ ID NO: 24621 - DNA, 25 bp, Mus musculus
aaattcctaggaatggctgccaggg

SEQ ID NO: 24622 - DNA, 25 bp, Mus musculus
aaattcctaggattggctgccaggg

SEQ ID NO: 24623 - DNA, 25 bp, Mus musculus
aaattcctaggcactttctggactt

SEQ ID NO: 24624 - DNA, 25 bp, Mus musculus
aaattcctaggctctttctggactt

SEQ ID NO: 24625 - DNA, 25 bp, Mus musculus
aaattcctatctccatctaagcctg

SEQ ID NO: 24626 - DNA, 25 bp, Mus musculus
aaattcctatctgcatctaagcctg

SEQ ID NO: 24627 - DNA, 25 bp, Mus musculus
aaattcctatgtactttgtttatat

SEQ ID NO: 24628 - DNA, 25 bp, Mus musculus
aaattcctatgttctttgtttatat

SEQ ID NO: 24629 - DNA, 25 bp, Mus musculus
aaattcctcactattagacacactc

SEQ ID NO: 24630 - DNA, 25 bp, Mus musculus
aaattcctcacttttagacacactc

SEQ ID NO: 24631 - DNA, 25 bp, Mus musculus
aaattcctcagtatcagggctggtg

SEQ ID NO: 24632 - DNA, 25 bp, Mus musculus
aaattcctcagtttcagggctggtg

SEQ ID NO: 24633 - DNA, 25 bp, Mus musculus
aaattcctctccaaagacacacggg

SEQ ID NO: 24634 - DNA, 25 bp, Mus musculus
aaattcctctcctaagacacacggg

SEQ ID NO: 24635 - DNA, 25 bp, Mus musculus
aaattcctcttaaaccaatagctgg

SEQ ID NO: 24636 - DNA, 25 bp, Mus musculus
aaattcctcttataccaatagctgg

SEQ ID NO: 24637 - DNA, 25 bp, Mus musculus
aaattcctcttgagtgctcctcctt

SEQ ID NO: 24638 - DNA, 25 bp, Mus musculus
aaattcctcttgtgtgctcctcctt

SEQ ID NO: 24639 - DNA, 25 bp, Mus musculus
aaattcctctttcttcctgagatca

SEQ ID NO: 24640 - DNA, 25 bp, Mus musculus
aaattcctctttgttcctgagatca

SEQ ID NO: 24641 - DNA, 25 bp, Mus musculus
aaattcctgaatacccaattgcacc

SEQ ID NO: 24642 - DNA, 25 bp, Mus musculus
aaattcctgaatcctgtggatccag

SEQ ID NO: 24643 - DNA, 25 bp, Mus musculus
aaattcctgaatgctgtggatccag

SEQ ID NO: 24644 - DNA, 25 bp, Mus musculus
aaattcctgaattcccaattgcacc

SEQ ID NO: 24645 - DNA, 25 bp, Mus musculus
aaattcctgattacttgtgagttgt

SEQ ID NO: 24646 - DNA, 25 bp, Mus musculus
aaattcctgatttcttgtgagttgt

SEQ ID NO: 24647 - DNA, 25 bp, Mus musculus
aaattcctgctcctcacttgtgtgt

SEQ ID NO: 24648 - DNA, 25 bp, Mus musculus
aaattcctgctcgtcacttgtgtgt

SEQ ID NO: 24649 - DNA, 25 bp, Mus musculus
aaattcctgcttctggccttttgaa

SEQ ID NO: 24650 - DNA, 25 bp, Mus musculus
aaattcctgcttgtggccttttgaa

SEQ ID NO: 24651 - DNA, 25 bp, Mus musculus
aaattcctggcaaataactctttga

SEQ ID NO: 24652 - DNA, 25 bp, Mus musculus
aaattcctggcatataactctttga

SEQ ID NO: 24653 - DNA, 25 bp, Mus musculus
aaattcctgtgaaccttgcgctgtt

SEQ ID NO: 24654 - DNA, 25 bp, Mus musculus
aaattcctgtgatccttgcgctgtt

SEQ ID NO: 24655 - DNA, 25 bp, Mus musculus
aaattccttaaccatctccattgta

SEQ ID NO: 24656 - DNA, 25 bp, Mus musculus
aaattccttaacgatctccattgta

SEQ ID NO: 24657 - DNA, 25 bp, Mus musculus
aaattccttctccagttgcatcaac

SEQ ID NO: 24658 - DNA, 25 bp, Mus musculus
aaattccttctcgagttgcatcaac

SEQ ID NO: 24659 - DNA, 25 bp, Mus musculus
aaattccttgcaagtcatctcaggt

SEQ ID NO: 24660 - DNA, 25 bp, Mus musculus
aaattccttgcatgtcatctcaggt

SEQ ID NO: 24661 - DNA, 25 bp, Mus musculus
aaattcgaacttctcattctcctgc

SEQ ID NO: 24662 - DNA, 25 bp, Mus musculus
aaattcgaacttgtcattctcctgc

SEQ ID NO: 24663 - DNA, 25 bp, Mus musculus
aaattcgacttaatcttcctcctct

SEQ ID NO: 24664 - DNA, 25 bp, Mus musculus
aaattcgacttattcttcctcctct

SEQ ID NO: 24665 - DNA, 25 bp, Mus musculus
aaattcgccgagatatgggactgca

SEQ ID NO: 24666 - DNA, 25 bp, Mus musculus
aaattcgccgagttatgggactgca

SEQ ID NO: 24667 - DNA, 25 bp, Mus musculus
aaattcgcctgcctcattctggaaa

SEQ ID NO: 24668 - DNA, 25 bp, Mus musculus
aaattcgcctgcgtcattctggaaa

SEQ ID NO: 24669 - DNA, 25 bp, Mus musculus
aaattcgcgacaacctgcagcagaa

SEQ ID NO: 24670 - DNA, 25 bp, Mus musculus
aaattcgcgacatcctgcagcagaa

SEQ ID NO: 24671 - DNA, 25 bp, Mus musculus
aaattcggagctatacgtgtgtgca

SEQ ID NO: 24672 - DNA, 25 bp, Mus musculus
aaattcggagctttacgtgtgtgca

SEQ ID NO: 24673 - DNA, 25 bp, Mus musculus
aaattcggctgtcattcttttcttc

SEQ ID NO: 24674 - DNA, 25 bp, Mus musculus
aaattcggctgtgattcttttcttc

SEQ ID NO: 24675 - DNA, 25 bp, Mus musculus
aaattcgggtatagatttcaggtat

SEQ ID NO: 24676 - DNA, 25 bp, Mus musculus
aaattcgggtattgatttcaggtat

SEQ ID NO: 24677 - DNA, 25 bp, Mus musculus
aaattcggttgtaagatcaagcggt

SEQ ID NO: 24678 - DNA, 25 bp, Mus musculus
aaattcggttgttagatcaagcggt

SEQ ID NO: 24679 - DNA, 25 bp, Mus musculus
aaattcggtttgagccggctgacaa

SEQ ID NO: 24680 - DNA, 25 bp, Mus musculus
aaattcggtttgtgccggctgacaa

SEQ ID NO: 24681 - DNA, 25 bp, Mus musculus
aaattcgtcaaccatggcccagtgg

SEQ ID NO: 24682 - DNA, 25 bp, Mus musculus
aaattcgtcaacgatggcccagtgg

SEQ ID NO: 24683 - DNA, 25 bp, Mus musculus
aaattcgtcttccatggccataata

SEQ ID NO: 24684 - DNA, 25 bp, Mus musculus
aaattcgtcttcgatggccataata

SEQ ID NO: 24685 - DNA, 25 bp, Mus musculus
aaattcgtcttgaagagtgaggcac

SEQ ID NO: 24686 - DNA, 25 bp, Mus musculus
aaattcgtcttgtagagtgaggcac

SEQ ID NO: 24687 - DNA, 25 bp, Mus musculus
aaattcgtggctcaggttcttgacc

SEQ ID NO: 24688 - DNA, 25 bp, Mus musculus
aaattcgtggctgaggttcttgacc

SEQ ID NO: 24689 - DNA, 25 bp, Mus musculus
aaattcgtgggaacagctttccaga

SEQ ID NO: 24690 - DNA, 25 bp, Mus musculus
aaattcgtgggatcagctttccaga

SEQ ID NO: 24691 - DNA, 25 bp, Mus musculus
aaattctaacccaactgtgcactaa

SEQ ID NO: 24692 - DNA, 25 bp, Mus musculus
aaattctaaccctactgtgcactaa

SEQ ID NO: 24693 - DNA, 25 bp, Mus musculus
aaattctaatacactgttacacagt

SEQ ID NO: 24694 - DNA, 25 bp, Mus musculus
aaattctaatactctgttacacagt

SEQ ID NO: 24695 - DNA, 25 bp, Mus musculus
aaattctaatcaatgtcgtccaggc

SEQ ID NO: 24696 - DNA, 25 bp, Mus musculus
aaattctaatcattgtcgtccaggc

SEQ ID NO: 24697 - DNA, 25 bp, Mus musculus
aaattctaatctcttccagctatga

SEQ ID NO: 24698 - DNA, 25 bp, Mus musculus
aaattctaatctgttccagctatga

SEQ ID NO: 24699 - DNA, 25 bp, Mus musculus
aaattctaatgtccctagtcacaag

SEQ ID NO: 24700 - DNA, 25 bp, Mus musculus
aaattctaatgtgcctagtcacaag

SEQ ID NO: 24701 - DNA, 25 bp, Mus musculus
aaattctacattaacccaggttctg

SEQ ID NO: 24702 - DNA, 25 bp, Mus musculus
aaattctacatttacccaggttctg

SEQ ID NO: 24703 - DNA, 25 bp, Mus musculus
aaattctaccagcacagacatcctt

SEQ ID NO: 24704 - DNA, 25 bp, Mus musculus
aaattctaccaggacagacatcctt

SEQ ID NO: 24705 - DNA, 25 bp, Mus musculus
aaattctaccatctctgactgctga

SEQ ID NO: 24706 - DNA, 25 bp, Mus musculus
aaattctaccatgtctgactgctga

SEQ ID NO: 24707 - DNA, 25 bp, Mus musculus
aaattctaccttctgccatgatgag

SEQ ID NO: 24708 - DNA, 25 bp, Mus musculus
aaattctaccttgtgccatgatgag

SEQ ID NO: 24709 - DNA, 25 bp, Mus musculus
aaattctatcttagaccagtggcat

SEQ ID NO: 24710 - DNA, 25 bp, Mus musculus
aaattctatctttgaccagtggcat

SEQ ID NO: 24711 - DNA, 25 bp, Mus musculus
aaattctcaagcatcattttagcaa

SEQ ID NO: 24712 - DNA, 25 bp, Mus musculus
aaattctcaagcttcattttagcaa

SEQ ID NO: 24713 - DNA, 25 bp, Mus musculus
aaattctcatcacctgttgtagaag

SEQ ID NO: 24714 - DNA, 25 bp, Mus musculus
aaattctcatcagctgttgtagaag

SEQ ID NO: 24715 - DNA, 25 bp, Mus musculus
aaattctccacaatttgtaagctgt

SEQ ID NO: 24716 - DNA, 25 bp, Mus musculus
aaattctccacattttgtaagctgt

SEQ ID NO: 24717 - DNA, 25 bp, Mus musculus
aaattctccaggcatcatctctgca

SEQ ID NO: 24718 - DNA, 25 bp, Mus musculus
aaattctccagggatcatctctgca

SEQ ID NO: 24719 - DNA, 25 bp, Mus musculus
aaattctcccctatgtgttggactg

SEQ ID NO: 24720 - DNA, 25 bp, Mus musculus
aaattctcccctttgtgttggactg

SEQ ID NO: 24721 - DNA, 25 bp, Mus musculus
aaattctccctgaccaggctataga

SEQ ID NO: 24722 - DNA, 25 bp, Mus musculus
aaattctccctgtccaggctataga

SEQ ID NO: 24723 - DNA, 25 bp, Mus musculus
aaattctcctctctagtttcttgtg

SEQ ID NO: 24724 - DNA, 25 bp, Mus musculus
aaattctcctctgtagtttcttgtg

SEQ ID NO: 24725 - DNA, 25 bp, Mus musculus
aaattctccttcagtgagtacaaga

SEQ ID NO: 24726 - DNA, 25 bp, Mus musculus
aaattctccttctgtgagtacaaga

SEQ ID NO: 24727 - DNA, 25 bp, Mus musculus
aaattctcctttcatacagttaatc

SEQ ID NO: 24728 - DNA, 25 bp, Mus musculus
aaattctcctttgatacagttaatc

SEQ ID NO: 24729 - DNA, 25 bp, Mus musculus
aaattctcgtacctgcatgattgcc

SEQ ID NO: 24730 - DNA, 25 bp, Mus musculus
aaattctcgtacgtgcatgattgcc

SEQ ID NO: 24731 - DNA, 25 bp, Mus musculus
aaattctctcataacttgtgcttgt

SEQ ID NO: 24732 - DNA, 25 bp, Mus musculus
aaattctctcattacttgtgcttgt

SEQ ID NO: 24733 - DNA, 25 bp, Mus musculus
aaattctctcctcattggcattcct

SEQ ID NO: 24734 - DNA, 25 bp, Mus musculus
aaattctctcctgattggcattcct

SEQ ID NO: 24735 - DNA, 25 bp, Mus musculus
aaattctctgaacccggcccttgtg

SEQ ID NO: 24736 - DNA, 25 bp, Mus musculus
aaattctctgaagccggcccttgtg

SEQ ID NO: 24737 - DNA, 25 bp, Mus musculus
aaattctctgagaggtgtggaaaag

SEQ ID NO: 24738 - DNA, 25 bp, Mus musculus
aaattctctgagtggtgtggaaaag

SEQ ID NO: 24739 - DNA, 25 bp, Mus musculus
aaattctctgccacaataccctaac

SEQ ID NO: 24740 - DNA, 25 bp, Mus musculus
aaattctctgcctcaataccctaac

SEQ ID NO: 24741 - DNA, 25 bp, Mus musculus
aaattctctggaacacctttgcata

SEQ ID NO: 24742 - DNA, 25 bp, Mus musculus
aaattctctggatcacctttgcata

SEQ ID NO: 24743 - DNA, 25 bp, Mus musculus
aaattctctgtcagctcaccagttg

SEQ ID NO: 24744 - DNA, 25 bp, Mus musculus
aaattctctgtctgctcaccagttg

SEQ ID NO: 24745 - DNA, 25 bp, Mus musculus
aaattctctgtgatttggcagccaa

SEQ ID NO: 24746 - DNA, 25 bp, Mus musculus
aaattctctgtgttttggcagccaa

SEQ ID NO: 24747 - DNA, 25 bp, Mus musculus
aaattctctgttagcactttttatt

SEQ ID NO: 24748 - DNA, 25 bp, Mus musculus
aaattctctgtttgcactttttatt

SEQ ID NO: 24749 - DNA, 25 bp, Mus musculus
aaattctctttacatcctctggctt

SEQ ID NO: 24750 - DNA, 25 bp, Mus musculus
aaattctctttagatcctctggctt

SEQ ID NO: 24751 - DNA, 25 bp, Mus musculus
aaattctctttcagtagtacaatag

SEQ ID NO: 24752 - DNA, 25 bp, Mus musculus
aaattctctttctgtagtacaatag

SEQ ID NO: 24753 - DNA, 25 bp, Mus musculus
aaattctctttgaaccattttgtgg

SEQ ID NO: 24754 - DNA, 25 bp, Mus musculus
aaattctctttgtaccattttgtgg

SEQ ID NO: 24755 - DNA, 25 bp, Mus musculus
aaattctgactcaggtttgcagtga

SEQ ID NO: 24756 - DNA, 25 bp, Mus musculus
aaattctgactctggtttgcagtga

SEQ ID NO: 24757 - DNA, 25 bp, Mus musculus
aaattctgacttccctccaaaatga

SEQ ID NO: 24758 - DNA, 25 bp, Mus musculus
aaattctgacttgcctccaaaatga

SEQ ID NO: 24759 - DNA, 25 bp, Mus musculus
aaattctgagcccttgatttaattc

SEQ ID NO: 24760 - DNA, 25 bp, Mus musculus
aaattctgagccgttgatttaattc

SEQ ID NO: 24761 - DNA, 25 bp, Mus musculus
aaattctgagctacagcctccagca

SEQ ID NO: 24762 - DNA, 25 bp, Mus musculus
aaattctgagcttcagcctccagca

SEQ ID NO: 24763 - DNA, 25 bp, Mus musculus
aaattctgaggtcctgggctgacaa

SEQ ID NO: 24764 - DNA, 25 bp, Mus musculus
aaattctgaggtgctgggctgacaa

SEQ ID NO: 24765 - DNA, 25 bp, Mus musculus
aaattctgagtgaaccaatggctgc

SEQ ID NO: 24766 - DNA, 25 bp, Mus musculus
aaattctgagtgtaccaatggctgc

SEQ ID NO: 24767 - DNA, 25 bp, Mus musculus
aaattctgattgatctgtgccctca

SEQ ID NO: 24768 - DNA, 25 bp, Mus musculus
aaattctgattgttctgtgccctca

SEQ ID NO: 24769 - DNA, 25 bp, Mus musculus
aaattctgcacaatcgttcctaagg

SEQ ID NO: 24770 - DNA, 25 bp, Mus musculus
aaattctgcacattcgttcctaagg

SEQ ID NO: 24771 - DNA, 25 bp, Mus musculus
aaattctgcagccagtgcattctct

SEQ ID NO: 24772 - DNA, 25 bp, Mus musculus
aaattctgcagcgagtgcattctct

SEQ ID NO: 24773 - DNA, 25 bp, Mus musculus
aaattctgcattcacctgttactgg

SEQ ID NO: 24774 - DNA, 25 bp, Mus musculus
aaattctgcattgacctgttactgg

SEQ ID NO: 24775 - DNA, 25 bp, Mus musculus
aaattctgcctgacgagatgcctga

SEQ ID NO: 24776 - DNA, 25 bp, Mus musculus
aaattctgcctgtcgagatgcctga

SEQ ID NO: 24777 - DNA, 25 bp, Mus musculus
aaattctgccttatcgtttctgacc

SEQ ID NO: 24778 - DNA, 25 bp, Mus musculus
aaattctgccttttcgtttctgacc

SEQ ID NO: 24779 - DNA, 25 bp, Mus musculus
aaattctggcgtcgattatcgaggg

SEQ ID NO: 24780 - DNA, 25 bp, Mus musculus
aaattctggcgtggattatcgaggg

SEQ ID NO: 24781 - DNA, 25 bp, Mus musculus
aaattctggcttagagtgacatcct

SEQ ID NO: 24782 - DNA, 25 bp, Mus musculus
aaattctggctttgagtgacatcct

SEQ ID NO: 24783 - DNA, 25 bp, Mus musculus
aaattctgggagaccaagtatacaa

SEQ ID NO: 24784 - DNA, 25 bp, Mus musculus
aaattctgggagtccaagtatacaa

SEQ ID NO: 24785 - DNA, 25 bp, Mus musculus
aaattctgggctaggttctggtgtg

SEQ ID NO: 24786 - DNA, 25 bp, Mus musculus
aaattctgggcttggttctggtgtg

SEQ ID NO: 24787 - DNA, 25 bp, Mus musculus
aaattctgtcaaagaaggcggccct

SEQ ID NO: 24788 - DNA, 25 bp, Mus musculus
aaattctgtcaatgaaggcggccct

SEQ ID NO: 24789 - DNA, 25 bp, Mus musculus
aaattctgtcagacgcacttattcc

SEQ ID NO: 24790 - DNA, 25 bp, Mus musculus
aaattctgtcagtcgcacttattcc

SEQ ID NO: 24791 - DNA, 25 bp, Mus musculus
aaattctgtcctctgtaggctgtag

SEQ ID NO: 24792 - DNA, 25 bp, Mus musculus
aaattctgtcctgtgtaggctgtag

SEQ ID NO: 24793 - DNA, 25 bp, Mus musculus
aaattctgtggcagagacctctgtc

SEQ ID NO: 24794 - DNA, 25 bp, Mus musculus
aaattctgtggctgagacctctgtc

SEQ ID NO: 24795 - DNA, 25 bp, Mus musculus
aaattctgttgcctttcatggccca

SEQ ID NO: 24796 - DNA, 25 bp, Mus musculus
aaattctgttgcgtttcatggccca

SEQ ID NO: 24797 - DNA, 25 bp, Mus musculus
aaattctgtttcacgtgccaaatcc

SEQ ID NO: 24798 - DNA, 25 bp, Mus musculus
aaattctgtttctcgtgccaaatcc

SEQ ID NO: 24799 - DNA, 25 bp, Mus musculus
aaattctgtttgatggccgtcacac

SEQ ID NO: 24800 - DNA, 25 bp, Mus musculus
aaattctgtttgttggccgtcacac

SEQ ID NO: 24801 - DNA, 25 bp, Mus musculus
aaattcttaatgatggtatgatatc

SEQ ID NO: 24802 - DNA, 25 bp, Mus musculus
aaattcttaatgttggtatgatatc

SEQ ID NO: 24803 - DNA, 25 bp, Mus musculus
aaattcttaattccttcactgagaa

SEQ ID NO: 24804 - DNA, 25 bp, Mus musculus
aaattcttaattgcttcactgagaa

SEQ ID NO: 24805 - DNA, 25 bp, Mus musculus
aaattcttacttcatggatgtgaaa

SEQ ID NO: 24806 - DNA, 25 bp, Mus musculus
aaattcttacttgatggatgtgaaa

SEQ ID NO: 24807 - DNA, 25 bp, Mus musculus
aaattcttagcaaagtaggctttga

SEQ ID NO: 24808 - DNA, 25 bp, Mus musculus
aaattcttagcatagtaggctttga

SEQ ID NO: 24809 - DNA, 25 bp, Mus musculus
aaattcttagctatcattcctctgg

SEQ ID NO: 24810 - DNA, 25 bp, Mus musculus
aaattcttagctttcattcctctgg

SEQ ID NO: 24811 - DNA, 25 bp, Mus musculus
aaattcttagtgcagctgtgtgctt

SEQ ID NO: 24812 - DNA, 25 bp, Mus musculus
aaattcttagtggagctgtgtgctt

SEQ ID NO: 24813 - DNA, 25 bp, Mus musculus
aaattcttatttccacccatctagt

SEQ ID NO: 24814 - DNA, 25 bp, Mus musculus
aaattcttatttgcacccatctagt

SEQ ID NO: 24815 - DNA, 25 bp, Mus musculus
aaattcttccctagaagtactgcaa

SEQ ID NO: 24816 - DNA, 25 bp, Mus musculus
aaattcttcccttgaagtactgcaa

SEQ ID NO: 24817 - DNA, 25 bp, Mus musculus
aaattcttcgacagctggtgactga

SEQ ID NO: 24818 - DNA, 25 bp, Mus musculus
aaattcttcgactgctggtgactga

SEQ ID NO: 24819 - DNA, 25 bp, Mus musculus
aaattcttctacagtctacgcaagg

SEQ ID NO: 24820 - DNA, 25 bp, Mus musculus
aaattcttctactgtctacgcaagg

SEQ ID NO: 24821 - DNA, 25 bp, Mus musculus
aaattcttctctatcttacaacaat

SEQ ID NO: 24822 - DNA, 25 bp, Mus musculus
aaattcttctctttcttacaacaat

SEQ ID NO: 24823 - DNA, 25 bp, Mus musculus
aaattcttctggatgttaactgaga

SEQ ID NO: 24824 - DNA, 25 bp, Mus musculus
aaattcttctggttgttaactgaga

SEQ ID NO: 24825 - DNA, 25 bp, Mus musculus
aaattcttctgtccctagttctaag

SEQ ID NO: 24826 - DNA, 25 bp, Mus musculus
aaattcttctgtgcctagttctaag

SEQ ID NO: 24827 - DNA, 25 bp, Mus musculus
aaattcttgaagagcctctgtgtgt

SEQ ID NO: 24828 - DNA, 25 bp, Mus musculus
aaattcttgaagtgcctctgtgtgt

SEQ ID NO: 24829 - DNA, 25 bp, Mus musculus
aaattcttgattactttcatcaatt

SEQ ID NO: 24830 - DNA, 25 bp, Mus musculus
aaattcttgatttctttcatcaatt

SEQ ID NO: 24831 - DNA, 25 bp, Mus musculus
aaattcttgccgactggtatacagt

SEQ ID NO: 24832 - DNA, 25 bp, Mus musculus
aaattcttgccgtctggtatacagt

SEQ ID NO: 24833 - DNA, 25 bp, Mus musculus
aaattcttgcctcatatttcctcac

SEQ ID NO: 24834 - DNA, 25 bp, Mus musculus
aaattcttgcctctgggaatgcctt

SEQ ID NO: 24835 - DNA, 25 bp, Mus musculus
aaattcttgcctgatatttcctcac

SEQ ID NO: 24836 - DNA, 25 bp, Mus musculus
aaattcttgcctgtgggaatgcctt

SEQ ID NO: 24837 - DNA, 25 bp, Mus musculus
aaattcttggaaatgcatgctgaca

SEQ ID NO: 24838 - DNA, 25 bp, Mus musculus
aaattcttggaattgcatgctgaca

SEQ ID NO: 24839 - DNA, 25 bp, Mus musculus
aaattcttgtgcccacacttgatga

SEQ ID NO: 24840 - DNA, 25 bp, Mus musculus
aaattcttgtgcgcacacttgatga

SEQ ID NO: 24841 - DNA, 25 bp, Mus musculus
aaattcttgtttctccttacacaca

SEQ ID NO: 24842 - DNA, 25 bp, Mus musculus
aaattcttgtttgtccttacacaca

SEQ ID NO: 24843 - DNA, 25 bp, Mus musculus
aaattctttctaacttgattgatga

SEQ ID NO: 24844 - DNA, 25 bp, Mus musculus
aaattctttctatcttgattgatga

SEQ ID NO: 24845 - DNA, 25 bp, Mus musculus
aaattctttgatacagcctggacca

SEQ ID NO: 24846 - DNA, 25 bp, Mus musculus
aaattctttgattcagcctggacca

SEQ ID NO: 24847 - DNA, 25 bp, Mus musculus
aaattctttgtgatcctaccatcct

SEQ ID NO: 24848 - DNA, 25 bp, Mus musculus
aaattctttgtgcattcttgacttt

SEQ ID NO: 24849 - DNA, 25 bp, Mus musculus
aaattctttgtgctgtttactgctg

SEQ ID NO: 24850 - DNA, 25 bp, Mus musculus
aaattctttgtggattcttgacttt

SEQ ID NO: 24851 - DNA, 25 bp, Mus musculus
aaattctttgtggtgtttactgctg

SEQ ID NO: 24852 - DNA, 25 bp, Mus musculus
aaattctttgtgttcctaccatcct

SEQ ID NO: 24853 - DNA, 25 bp, Mus musculus
aaattctttttcctacagcccagag

SEQ ID NO: 24854 - DNA, 25 bp, Mus musculus
aaattctttttcgtacagcccagag

SEQ ID NO: 24855 - DNA, 25 bp, Mus musculus
aaattgaaacgcaggctctagagag

SEQ ID NO: 24856 - DNA, 25 bp, Mus musculus
aaattgaaacgctggctctagagag

SEQ ID NO: 24857 - DNA, 25 bp, Mus musculus
aaattgaactcaaaggacccacctg

SEQ ID NO: 24858 - DNA, 25 bp, Mus musculus
aaattgaactcataggacccacctg

SEQ ID NO: 24859 - DNA, 25 bp, Mus musculus
aaattgaaggttattctcagttaca

SEQ ID NO: 24860 - DNA, 25 bp, Mus musculus
aaattgaaggtttttctcagttaca

SEQ ID NO: 24861 - DNA, 25 bp, Mus musculus
aaattgaataacaggcttgtatgat

SEQ ID NO: 24862 - DNA, 25 bp, Mus musculus
aaattgaataactggcttgtatgat

SEQ ID NO: 24863 - DNA, 25 bp, Mus musculus
aaattgaatattcacctgcctctcc

SEQ ID NO: 24864 - DNA, 25 bp, Mus musculus
aaattgaatattgacctgcctctcc

SEQ ID NO: 24865 - DNA, 25 bp, Mus musculus
aaattgaatcccataccctgtcatg

SEQ ID NO: 24866 - DNA, 25 bp, Mus musculus
aaattgaatcccttaccctgtcatg

SEQ ID NO: 24867 - DNA, 25 bp, Mus musculus
aaattgaatctcctggtggttagct

SEQ ID NO: 24868 - DNA, 25 bp, Mus musculus
aaattgaatctcgtggtggttagct

SEQ ID NO: 24869 - DNA, 25 bp, Mus musculus
aaattgaatgttacctaagcataag

SEQ ID NO: 24870 - DNA, 25 bp, Mus musculus
aaattgaatgtttcctaagcataag

SEQ ID NO: 24871 - DNA, 25 bp, Mus musculus
aaattgacaccaactgcgatgccag

SEQ ID NO: 24872 - DNA, 25 bp, Mus musculus
aaattgacaccatctgcgatgccag

SEQ ID NO: 24873 - DNA, 25 bp, Mus musculus
aaattgacagttctctaaccctcac

SEQ ID NO: 24874 - DNA, 25 bp, Mus musculus
aaattgacagttgtctaaccctcac

SEQ ID NO: 24875 - DNA, 25 bp, Mus musculus
aaattgacatcacggccacttcatc

SEQ ID NO: 24876 - DNA, 25 bp, Mus musculus
aaattgacatcagggccacttcatc

SEQ ID NO: 24877 - DNA, 25 bp, Mus musculus
aaattgaccctgaggtatcggcctt

SEQ ID NO: 24878 - DNA, 25 bp, Mus musculus
aaattgaccctgtggtatcggcctt

SEQ ID NO: 24879 - DNA, 25 bp, Mus musculus
aaattgactcaacttattcctgtag

SEQ ID NO: 24880 - DNA, 25 bp, Mus musculus
aaattgactcaagttattcctgtag

SEQ ID NO: 24881 - DNA, 25 bp, Mus musculus
aaattgactgttagcctggtgcaat

SEQ ID NO: 24882 - DNA, 25 bp, Mus musculus
aaattgactgtttgcctggtgcaat

SEQ ID NO: 24883 - DNA, 25 bp, Mus musculus
aaattgagcccaagtatatttacat

SEQ ID NO: 24884 - DNA, 25 bp, Mus musculus
aaattgagcccatgtatatttacat

SEQ ID NO: 24885 - DNA, 25 bp, Mus musculus
aaattgagcctgacactttgggagt

SEQ ID NO: 24886 - DNA, 25 bp, Mus musculus
aaattgagcctgtcactttgggagt

SEQ ID NO: 24887 - DNA, 25 bp, Mus musculus
aaattgaggcacacaatgcagacta

SEQ ID NO: 24888 - DNA, 25 bp, Mus musculus
aaattgaggcactcaatgcagacta

SEQ ID NO: 24889 - DNA, 25 bp, Mus musculus
aaattgaggcctccatgtgggaagt

SEQ ID NO: 24890 - DNA, 25 bp, Mus musculus
aaattgaggcctgcatgtgggaagt

SEQ ID NO: 24891 - DNA, 25 bp, Mus musculus
aaattgaggtgccttccttgtgtac

SEQ ID NO: 24892 - DNA, 25 bp, Mus musculus
aaattgaggtgcgttccttgtgtac

SEQ ID NO: 24893 - DNA, 25 bp, Mus musculus
aaattgagttgcctttgcaccgtgg

SEQ ID NO: 24894 - DNA, 25 bp, Mus musculus
aaattgagttgcgtttgcaccgtgg

SEQ ID NO: 24895 - DNA, 25 bp, Mus musculus
aaattgatccctagcatttgcaaca

SEQ ID NO: 24896 - DNA, 25 bp, Mus musculus
aaattgatcccttgcatttgcaaca

SEQ ID NO: 24897 - DNA, 25 bp, Mus musculus
aaattgatcctcaaattcccttggt

SEQ ID NO: 24898 - DNA, 25 bp, Mus musculus
aaattgatcctctaattcccttggt

SEQ ID NO: 24899 - DNA, 25 bp, Mus musculus
aaattgatctctatactctagcccc

SEQ ID NO: 24900 - DNA, 25 bp, Mus musculus
aaattgatctctttactctagcccc

SEQ ID NO: 24901 - DNA, 25 bp, Mus musculus
aaattgatgccaagacctaccgcga

SEQ ID NO: 24902 - DNA, 25 bp, Mus musculus
aaattgatgccatgacctaccgcga

SEQ ID NO: 24903 - DNA, 25 bp, Mus musculus
aaattgatgcttcccagaccatgag

SEQ ID NO: 24904 - DNA, 25 bp, Mus musculus
aaattgatgcttgccagaccatgag

SEQ ID NO: 24905 - DNA, 25 bp, Mus musculus
aaattgatgtacactatctaggtag

SEQ ID NO: 24906 - DNA, 25 bp, Mus musculus
aaattgatgtactctatctaggtag

SEQ ID NO: 24907 - DNA, 25 bp, Mus musculus
aaattgatgtccagacctcatgtct

SEQ ID NO: 24908 - DNA, 25 bp, Mus musculus
aaattgatgtcctgacctcatgtct

SEQ ID NO: 24909 - DNA, 25 bp, Mus musculus
aaattgattgttcctttcccgaaat

SEQ ID NO: 24910 - DNA, 25 bp, Mus musculus
aaattgattgttgctttcccgaaat

SEQ ID NO: 24911 - DNA, 25 bp, Mus musculus
aaattgatttctcgctggttactaa

SEQ ID NO: 24912 - DNA, 25 bp, Mus musculus
aaattgatttctggctggttactaa

SEQ ID NO: 24913 - DNA, 25 bp, Mus musculus
aaattgatttgcctttgggtactag

SEQ ID NO: 24914 - DNA, 25 bp, Mus musculus
aaattgatttgcgtttgggtactag

SEQ ID NO: 24915 - DNA, 25 bp, Mus musculus
aaattgcaaattatcctcctggcgt

SEQ ID NO: 24916 - DNA, 25 bp, Mus musculus
aaattgcaaattttcctcctggcgt

SEQ ID NO: 24917 - DNA, 25 bp, Mus musculus
aaattgcaatgaacactcttctccc

SEQ ID NO: 24918 - DNA, 25 bp, Mus musculus
aaattgcaatgatcactcttctccc

SEQ ID NO: 24919 - DNA, 25 bp, Mus musculus
aaattgcacagtcggttgttcctcc

SEQ ID NO: 24920 - DNA, 25 bp, Mus musculus
aaattgcacagtgggttgttcctcc

SEQ ID NO: 24921 - DNA, 25 bp, Mus musculus
aaattgcacgtactgggttctcctc

SEQ ID NO: 24922 - DNA, 25 bp, Mus musculus
aaattgcacgtagtgggttctcctc

SEQ ID NO: 24923 - DNA, 25 bp, Mus musculus
aaattgcacttgctttgccttttgc

SEQ ID NO: 24924 - DNA, 25 bp, Mus musculus
aaattgcacttggtttgccttttgc

SEQ ID NO: 24925 - DNA, 25 bp, Mus musculus
aaattgcaggtgctttctgtcccta

SEQ ID NO: 24926 - DNA, 25 bp, Mus musculus
aaattgcaggtggtttctgtcccta

SEQ ID NO: 24927 - DNA, 25 bp, Mus musculus
aaattgcatactaattccggagtac

SEQ ID NO: 24928 - DNA, 25 bp, Mus musculus
aaattgcatacttattccggagtac

SEQ ID NO: 24929 - DNA, 25 bp, Mus musculus
aaattgcatctaactgggtatccac

SEQ ID NO: 24930 - DNA, 25 bp, Mus musculus
aaattgcatctatctgggtatccac

SEQ ID NO: 24931 - DNA, 25 bp, Mus musculus
aaattgcatttcagacttgtggagt

SEQ ID NO: 24932 - DNA, 25 bp, Mus musculus
aaattgcatttctgacttgtggagt

SEQ ID NO: 24933 - DNA, 25 bp, Mus musculus
aaattgcattttcccattgctaaat

SEQ ID NO: 24934 - DNA, 25 bp, Mus musculus
aaattgcattttgccattgctaaat

SEQ ID NO: 24935 - DNA, 25 bp, Mus musculus
aaattgccaaatacatctttcagtg

SEQ ID NO: 24936 - DNA, 25 bp, Mus musculus
aaattgccaaattcatctttcagtg

SEQ ID NO: 24937 - DNA, 25 bp, Mus musculus
aaattgccaacaagagtaccctgcc

SEQ ID NO: 24938 - DNA, 25 bp, Mus musculus
aaattgccaacatgagtaccctgcc

SEQ ID NO: 24939 - DNA, 25 bp, Mus musculus
aaattgccaaccagcaagagctgct

SEQ ID NO: 24940 - DNA, 25 bp, Mus musculus
aaattgccaacctgcaagagctgct

SEQ ID NO: 24941 - DNA, 25 bp, Mus musculus
aaattgccaccaaagggtgcatgga

SEQ ID NO: 24942 - DNA, 25 bp, Mus musculus
aaattgccaccatagggtgcatgga

SEQ ID NO: 24943 - DNA, 25 bp, Mus musculus
aaattgccacccatggccactgtca

SEQ ID NO: 24944 - DNA, 25 bp, Mus musculus
aaattgccacccttggccactgtca

SEQ ID NO: 24945 - DNA, 25 bp, Mus musculus
aaattgccacgaaaactgcagcccc

SEQ ID NO: 24946 - DNA, 25 bp, Mus musculus
aaattgccacgataactgcagcccc

SEQ ID NO: 24947 - DNA, 25 bp, Mus musculus
aaattgccactcaccgcagcaaggt

SEQ ID NO: 24948 - DNA, 25 bp, Mus musculus
aaattgccactctccgcagcaaggt

SEQ ID NO: 24949 - DNA, 25 bp, Mus musculus
aaattgccagcgctgtgctttgcat

SEQ ID NO: 24950 - DNA, 25 bp, Mus musculus
aaattgccagcggtgtgctttgcat

SEQ ID NO: 24951 - DNA, 25 bp, Mus musculus
aaattgccaggaccatgggccattt

SEQ ID NO: 24952 - DNA, 25 bp, Mus musculus
aaattgccaggagcatgggccattt

SEQ ID NO: 24953 - DNA, 25 bp, Mus musculus
aaattgccagtgatcctttaagtgc

SEQ ID NO: 24954 - DNA, 25 bp, Mus musculus
aaattgccagtgttcctttaagtgc

SEQ ID NO: 24955 - DNA, 25 bp, Mus musculus
aaattgcccattcttgctgaagctg

SEQ ID NO: 24956 - DNA, 25 bp, Mus musculus
aaattgcccattgttgctgaagctg

SEQ ID NO: 24957 - DNA, 25 bp, Mus musculus
aaattgccctgcagatgaatcgtcc

SEQ ID NO: 24958 - DNA, 25 bp, Mus musculus
aaattgccctgctgatgaatcgtcc

SEQ ID NO: 24959 - DNA, 25 bp, Mus musculus
aaattgcctagaaaactattgtgcc

SEQ ID NO: 24960 - DNA, 25 bp, Mus musculus
aaattgcctagataactattgtgcc

SEQ ID NO: 24961 - DNA, 25 bp, Mus musculus
aaattgcctgaccaaggctgccgac

SEQ ID NO: 24962 - DNA, 25 bp, Mus musculus
aaattgcctgacgaaggctgccgac

SEQ ID NO: 24963 - DNA, 25 bp, Mus musculus
aaattgccttatctcaccatgggtt

SEQ ID NO: 24964 - DNA, 25 bp, Mus musculus
aaattgccttatgtcaccatgggtt

SEQ ID NO: 24965 - DNA, 25 bp, Mus musculus
aaattgccttgtatgcgcgggagta

SEQ ID NO: 24966 - DNA, 25 bp, Mus musculus
aaattgccttgtttgcgcgggagta

SEQ ID NO: 24967 - DNA, 25 bp, Mus musculus
aaattgcctttcatgtctgttgtac

SEQ ID NO: 24968 - DNA, 25 bp, Mus musculus
aaattgcctttcttgtctgttgtac

SEQ ID NO: 24969 - DNA, 25 bp, Mus musculus
aaattgcggtgaattattgtgcacg

SEQ ID NO: 24970 - DNA, 25 bp, Mus musculus
aaattgcggtgatttattgtgcacg

SEQ ID NO: 24971 - DNA, 25 bp, Mus musculus
aaattgctaaggcatcgtggttgtt

SEQ ID NO: 24972 - DNA, 25 bp, Mus musculus
aaattgctaagggatcgtggttgtt

SEQ ID NO: 24973 - DNA, 25 bp, Mus musculus
aaattgctaatgcagccagccatag

SEQ ID NO: 24974 - DNA, 25 bp, Mus musculus
aaattgctaatggagccagccatag

SEQ ID NO: 24975 - DNA, 25 bp, Mus musculus
aaattgctacatatccctacagcca

SEQ ID NO: 24976 - DNA, 25 bp, Mus musculus
aaattgctacatttccctacagcca

SEQ ID NO: 24977 - DNA, 25 bp, Mus musculus
aaattgctacccaagacacctttga

SEQ ID NO: 24978 - DNA, 25 bp, Mus musculus
aaattgctaccctagacacctttga

SEQ ID NO: 24979 - DNA, 25 bp, Mus musculus
aaattgctactcatcatcgatgttg

SEQ ID NO: 24980 - DNA, 25 bp, Mus musculus
aaattgctactcttcatcgatgttg

SEQ ID NO: 24981 - DNA, 25 bp, Mus musculus
aaattgctagcaacattcactgttt

SEQ ID NO: 24982 - DNA, 25 bp, Mus musculus
aaattgctagcatcattcactgttt

SEQ ID NO: 24983 - DNA, 25 bp, Mus musculus
aaattgctagtacgcactgcctggg

SEQ ID NO: 24984 - DNA, 25 bp, Mus musculus
aaattgctagtaggcactgcctggg

SEQ ID NO: 24985 - DNA, 25 bp, Mus musculus
aaattgctatacaaattacttcctg

SEQ ID NO: 24986 - DNA, 25 bp, Mus musculus
aaattgctatactaattacttcctg

SEQ ID NO: 24987 - DNA, 25 bp, Mus musculus
aaattgctcaaaagcccttcttact

SEQ ID NO: 24988 - DNA, 25 bp, Mus musculus
aaattgctcaaactctagtacacaa

SEQ ID NO: 24989 - DNA, 25 bp, Mus musculus
aaattgctcaaagtctagtacacaa

SEQ ID NO: 24990 - DNA, 25 bp, Mus musculus
aaattgctcaaatgcccttcttact

SEQ ID NO: 24991 - DNA, 25 bp, Mus musculus
aaattgctcagtcatcatggatatc

SEQ ID NO: 24992 - DNA, 25 bp, Mus musculus
aaattgctcagtgatcatggatatc

SEQ ID NO: 24993 - DNA, 25 bp, Mus musculus
aaattgctctaacccgacgagttga

SEQ ID NO: 24994 - DNA, 25 bp, Mus musculus
aaattgctctaagccgacgagttga

SEQ ID NO: 24995 - DNA, 25 bp, Mus musculus
aaattgctctctaaccctgttcttg

SEQ ID NO: 24996 - DNA, 25 bp, Mus musculus
aaattgctctcttaccctgttcttg

SEQ ID NO: 24997 - DNA, 25 bp, Mus musculus
aaattgctgactaggatagcccatg

SEQ ID NO: 24998 - DNA, 25 bp, Mus musculus
aaattgctgacttggatagcccatg

SEQ ID NO: 24999 - DNA, 25 bp, Mus musculus
aaattgctgctgcttagatcactgc

SEQ ID NO: 25000 - DNA, 25 bp, Mus musculus
aaattgctgctggttagatcactgc

SEQ ID NO: 25001 - DNA, 25 bp, Mus musculus
aaattgctggtgactccaagagcta

SEQ ID NO: 25002 - DNA, 25 bp, Mus musculus
aaattgctggtgtctccaagagcta

SEQ ID NO: 25003 - DNA, 25 bp, Mus musculus
aaattgctgtatataccacccactt

SEQ ID NO: 25004 - DNA, 25 bp, Mus musculus
aaattgctgtatttaccacccactt

SEQ ID NO: 25005 - DNA, 25 bp, Mus musculus
aaattgctgtgcagcatagcccggc

SEQ ID NO: 25006 - DNA, 25 bp, Mus musculus
aaattgctgtgctgcatagcccggc

SEQ ID NO: 25007 - DNA, 25 bp, Mus musculus
aaattgcttgaacttgtcctatgaa

SEQ ID NO: 25008 - DNA, 25 bp, Mus musculus
aaattgcttgaagttgtcctatgaa

SEQ ID NO: 25009 - DNA, 25 bp, Mus musculus
aaattgcttggcagcttttctctga

SEQ ID NO: 25010 - DNA, 25 bp, Mus musculus
aaattgcttggctgcttttctctga

SEQ ID NO: 25011 - DNA, 25 bp, Mus musculus
aaattgctttttcaggcttcggtgc

SEQ ID NO: 25012 - DNA, 25 bp, Mus musculus
aaattgctttttgaggcttcggtgc

SEQ ID NO: 25013 - DNA, 25 bp, Mus musculus
aaattggaatccactcacctgttcc

SEQ ID NO: 25014 - DNA, 25 bp, Mus musculus
aaattggaatcctctcacctgttcc

SEQ ID NO: 25015 - DNA, 25 bp, Mus musculus
aaattggactgcagctcatggcctt

SEQ ID NO: 25016 - DNA, 25 bp, Mus musculus
aaattggactgctgctcatggcctt

SEQ ID NO: 25017 - DNA, 25 bp, Mus musculus
aaattggagacgaggcctgcccgag

SEQ ID NO: 25018 - DNA, 25 bp, Mus musculus
aaattggagacgtggcctgcccgag

SEQ ID NO: 25019 - DNA, 25 bp, Mus musculus
aaattggagcatcaaagccatccag

SEQ ID NO: 25020 - DNA, 25 bp, Mus musculus
aaattggagcatgaaagccatccag

SEQ ID NO: 25021 - DNA, 25 bp, Mus musculus
aaattggagccaacttttatcccag

SEQ ID NO: 25022 - DNA, 25 bp, Mus musculus
aaattggagccatcttttatcccag

SEQ ID NO: 25023 - DNA, 25 bp, Mus musculus
aaattggagcttccagtgaccctct

SEQ ID NO: 25024 - DNA, 25 bp, Mus musculus
aaattggagcttgcagtgaccctct

SEQ ID NO: 25025 - DNA, 25 bp, Mus musculus
aaattggagtttcttcgctgttaat

SEQ ID NO: 25026 - DNA, 25 bp, Mus musculus
aaattggagtttgttcgctgttaat

SEQ ID NO: 25027 - DNA, 25 bp, Mus musculus
aaattggatctcactggcacattca

SEQ ID NO: 25028 - DNA, 25 bp, Mus musculus
aaattggatctctctggcacattca

SEQ ID NO: 25029 - DNA, 25 bp, Mus musculus
aaattggcacataaacacaaaaatg

SEQ ID NO: 25030 - DNA, 25 bp, Mus musculus
aaattggcacattaacacaaaaatg

SEQ ID NO: 25031 - DNA, 25 bp, Mus musculus
aaattggcaccaatactgggagaac

SEQ ID NO: 25032 - DNA, 25 bp, Mus musculus
aaattggcaccattactgggagaac

SEQ ID NO: 25033 - DNA, 25 bp, Mus musculus
aaattggcactgcactggcaatggc

SEQ ID NO: 25034 - DNA, 25 bp, Mus musculus
aaattggcactggactggcaatggc

SEQ ID NO: 25035 - DNA, 25 bp, Mus musculus
aaattggcccatcaagtctctgcaa

SEQ ID NO: 25036 - DNA, 25 bp, Mus musculus
aaattggcccatgaagtctctgcaa

SEQ ID NO: 25037 - DNA, 25 bp, Mus musculus
aaattggcccctactataatccctg

SEQ ID NO: 25038 - DNA, 25 bp, Mus musculus
aaattggccccttctataatccctg

SEQ ID NO: 25039 - DNA, 25 bp, Mus musculus
aaattggccctgatttgatctggca

SEQ ID NO: 25040 - DNA, 25 bp, Mus musculus
aaattggccctgttttgatctggca

SEQ ID NO: 25041 - DNA, 25 bp, Mus musculus
aaattggctccaaggtgatctctcc

SEQ ID NO: 25042 - DNA, 25 bp, Mus musculus
aaattggctccatggtgatctctcc

SEQ ID NO: 25043 - DNA, 25 bp, Mus musculus
aaattggctccgaacttctgaagtt

SEQ ID NO: 25044 - DNA, 25 bp, Mus musculus
aaattggctccgtacttctgaagtt

SEQ ID NO: 25045 - DNA, 25 bp, Mus musculus
aaattggctgtgctcgtgactggaa

SEQ ID NO: 25046 - DNA, 25 bp, Mus musculus
aaattggctgtggtcgtgactggaa

SEQ ID NO: 25047 - DNA, 25 bp, Mus musculus
aaattggcttagagtccccattgct

SEQ ID NO: 25048 - DNA, 25 bp, Mus musculus
aaattggcttagtgtccccattgct

SEQ ID NO: 25049 - DNA, 25 bp, Mus musculus
aaattgggaattcccagccgcacag

SEQ ID NO: 25050 - DNA, 25 bp, Mus musculus
aaattgggaattgccagccgcacag

SEQ ID NO: 25051 - DNA, 25 bp, Mus musculus
aaattgggagtcatcttccagatcc

SEQ ID NO: 25052 - DNA, 25 bp, Mus musculus
aaattgggagtcttcttccagatcc

SEQ ID NO: 25053 - DNA, 25 bp, Mus musculus
aaattgggatgtactctcgttctgt

SEQ ID NO: 25054 - DNA, 25 bp, Mus musculus
aaattgggatgttctctcgttctgt

SEQ ID NO: 25055 - DNA, 25 bp, Mus musculus
aaattgggcaacactggagctccat

SEQ ID NO: 25056 - DNA, 25 bp, Mus musculus
aaattgggcaactctggagctccat

SEQ ID NO: 25057 - DNA, 25 bp, Mus musculus
aaattgggcatcctgttaaccctca

SEQ ID NO: 25058 - DNA, 25 bp, Mus musculus
aaattgggcatcgtgttaaccctca

SEQ ID NO: 25059 - DNA, 25 bp, Mus musculus
aaattgggcctaagtcttgcttcat

SEQ ID NO: 25060 - DNA, 25 bp, Mus musculus
aaattgggcctatgtcttgcttcat

SEQ ID NO: 25061 - DNA, 25 bp, Mus musculus
aaattgggcgccatcacacctgggc

SEQ ID NO: 25062 - DNA, 25 bp, Mus musculus
aaattgggcgccttcacacctgggc

SEQ ID NO: 25063 - DNA, 25 bp, Mus musculus
aaattgggcttaatctgatgtcata

SEQ ID NO: 25064 - DNA, 25 bp, Mus musculus
aaattgggcttattctgatgtcata

SEQ ID NO: 25065 - DNA, 25 bp, Mus musculus
aaattgggtgttagcttgaggtgtt

SEQ ID NO: 25066 - DNA, 25 bp, Mus musculus
aaattgggtgtttgcttgaggtgtt

SEQ ID NO: 25067 - DNA, 25 bp, Mus musculus
aaattggtaacaacttcactgaaat

SEQ ID NO: 25068 - DNA, 25 bp, Mus musculus
aaattggtaacatcttcactgaaat

SEQ ID NO: 25069 - DNA, 25 bp, Mus musculus
aaattggtagctcttttccagagtg

SEQ ID NO: 25070 - DNA, 25 bp, Mus musculus
aaattggtagctgttttccagagtg

SEQ ID NO: 25071 - DNA, 25 bp, Mus musculus
aaattggtcaggatgggctttggct

SEQ ID NO: 25072 - DNA, 25 bp, Mus musculus
aaattggtcaggttgggctttggct

SEQ ID NO: 25073 - DNA, 25 bp, Mus musculus
aaattggtccggctctatgtacagg

SEQ ID NO: 25074 - DNA, 25 bp, Mus musculus
aaattggtccgggtctatgtacagg

SEQ ID NO: 25075 - DNA, 25 bp, Mus musculus
aaattggtctccatgagtgggcctt

SEQ ID NO: 25076 - DNA, 25 bp, Mus musculus
aaattggtctccttgagtgggcctt

SEQ ID NO: 25077 - DNA, 25 bp, Mus musculus
aaattggtgacgatgtttctgtgat

SEQ ID NO: 25078 - DNA, 25 bp, Mus musculus
aaattggtgacgttgtttctgtgat

SEQ ID NO: 25079 - DNA, 25 bp, Mus musculus
aaattggtggagatcatgtagctga

SEQ ID NO: 25080 - DNA, 25 bp, Mus musculus
aaattggtggagttcatgtagctga

SEQ ID NO: 25081 - DNA, 25 bp, Mus musculus
aaattggtgttcagcggccactgta

SEQ ID NO: 25082 - DNA, 25 bp, Mus musculus
aaattggtgttctgcggccactgta

SEQ ID NO: 25083 - DNA, 25 bp, Mus musculus
aaattggttaacagattggttcatt

SEQ ID NO: 25084 - DNA, 25 bp, Mus musculus
aaattggttaactgattggttcatt

SEQ ID NO: 25085 - DNA, 25 bp, Mus musculus
aaattggtttgtacatggcccttca

SEQ ID NO: 25086 - DNA, 25 bp, Mus musculus
aaattggtttgtcatttacctccat

SEQ ID NO: 25087 - DNA, 25 bp, Mus musculus
aaattggtttgtgatttacctccat

SEQ ID NO: 25088 - DNA, 25 bp, Mus musculus
aaattggtttgttcatggcccttca

SEQ ID NO: 25089 - DNA, 25 bp, Mus musculus
aaattgtaaacactggaacgcacca

SEQ ID NO: 25090 - DNA, 25 bp, Mus musculus
aaattgtaaacagtggaacgcacca

SEQ ID NO: 25091 - DNA, 25 bp, Mus musculus
aaattgtaattgctttactgcagcc

SEQ ID NO: 25092 - DNA, 25 bp, Mus musculus
aaattgtaattggtttactgcagcc

SEQ ID NO: 25093 - DNA, 25 bp, Mus musculus
aaattgtagctcaggcgcctgtgct

SEQ ID NO: 25094 - DNA, 25 bp, Mus musculus
aaattgtagctctggcgcctgtgct

SEQ ID NO: 25095 - DNA, 25 bp, Mus musculus
aaattgtaggcgactgaaactccag

SEQ ID NO: 25096 - DNA, 25 bp, Mus musculus
aaattgtaggcgtctgaaactccag

SEQ ID NO: 25097 - DNA, 25 bp, Mus musculus
aaattgtatcaaatccttgggctgg

SEQ ID NO: 25098 - DNA, 25 bp, Mus musculus
aaattgtatcaattccttgggctgg

SEQ ID NO: 25099 - DNA, 25 bp, Mus musculus
aaattgtatgctaccctcttattcc

SEQ ID NO: 25100 - DNA, 25 bp, Mus musculus
aaattgtatgcttccctcttattcc

SEQ ID NO: 25101 - DNA, 25 bp, Mus musculus
aaattgtcaaatcaccttggaacta

SEQ ID NO: 25102 - DNA, 25 bp, Mus musculus
aaattgtcaaatgaccttggaacta

SEQ ID NO: 25103 - DNA, 25 bp, Mus musculus
aaattgtcaactcaccaatgtggca

SEQ ID NO: 25104 - DNA, 25 bp, Mus musculus
aaattgtcaactgaccaatgtggca

SEQ ID NO: 25105 - DNA, 25 bp, Mus musculus
aaattgtcagcacggctgtatccct

SEQ ID NO: 25106 - DNA, 25 bp, Mus musculus
aaattgtcagcagggctgtatccct

SEQ ID NO: 25107 - DNA, 25 bp, Mus musculus
aaattgtcaggactcttgttcctca

SEQ ID NO: 25108 - DNA, 25 bp, Mus musculus
aaattgtcaggagtcttgttcctca

SEQ ID NO: 25109 - DNA, 25 bp, Mus musculus
aaattgtcagtgatctccccaattc

SEQ ID NO: 25110 - DNA, 25 bp, Mus musculus
aaattgtcagtgttctccccaattc

SEQ ID NO: 25111 - DNA, 25 bp, Mus musculus
aaattgtccataatttgcttttctg

SEQ ID NO: 25112 - DNA, 25 bp, Mus musculus
aaattgtccatattttgcttttctg

SEQ ID NO: 25113 - DNA, 25 bp, Mus musculus
aaattgtcccatctgccttacatct

SEQ ID NO: 25114 - DNA, 25 bp, Mus musculus
aaattgtcccatgtgccttacatct

SEQ ID NO: 25115 - DNA, 25 bp, Mus musculus
aaattgtccttgcacccgtggcgtg

SEQ ID NO: 25116 - DNA, 25 bp, Mus musculus
aaattgtccttggacccgtggcgtg

SEQ ID NO: 25117 - DNA, 25 bp, Mus musculus
aaattgtcgacaatctccaaaagga

SEQ ID NO: 25118 - DNA, 25 bp, Mus musculus
aaattgtcgacattctccaaaagga

SEQ ID NO: 25119 - DNA, 25 bp, Mus musculus
aaattgtctactcttgcgccagcta

SEQ ID NO: 25120 - DNA, 25 bp, Mus musculus
aaattgtctactgttgcgccagcta

SEQ ID NO: 25121 - DNA, 25 bp, Mus musculus
aaattgtctaggctcaggtgtccct

SEQ ID NO: 25122 - DNA, 25 bp, Mus musculus
aaattgtctagggtcaggtgtccct

SEQ ID NO: 25123 - DNA, 25 bp, Mus musculus
aaattgtctcagagggccaccgagc

SEQ ID NO: 25124 - DNA, 25 bp, Mus musculus
aaattgtctcagctctattacaaga

SEQ ID NO: 25125 - DNA, 25 bp, Mus musculus
aaattgtctcaggtctattacaaga

SEQ ID NO: 25126 - DNA, 25 bp, Mus musculus
aaattgtctcagtgggccaccgagc

SEQ ID NO: 25127 - DNA, 25 bp, Mus musculus
aaattgtctgtaaaccagtacaagt

SEQ ID NO: 25128 - DNA, 25 bp, Mus musculus
aaattgtctgtataccagtacaagt

SEQ ID NO: 25129 - DNA, 25 bp, Mus musculus
aaattgtctgtcctgaggagaccca

SEQ ID NO: 25130 - DNA, 25 bp, Mus musculus
aaattgtctgtcgtgaggagaccca

SEQ ID NO: 25131 - DNA, 25 bp, Mus musculus
aaattgtcttaactccgtccagtat

SEQ ID NO: 25132 - DNA, 25 bp, Mus musculus
aaattgtcttaagtccgtccagtat

SEQ ID NO: 25133 - DNA, 25 bp, Mus musculus
aaattgtcttcacgccgtgtttata

SEQ ID NO: 25134 - DNA, 25 bp, Mus musculus
aaattgtcttcaggccgtgtttata

SEQ ID NO: 25135 - DNA, 25 bp, Mus musculus
aaattgtcttctccagttttctgtt

SEQ ID NO: 25136 - DNA, 25 bp, Mus musculus
aaattgtcttctgcagttttctgtt

SEQ ID NO: 25137 - DNA, 25 bp, Mus musculus
aaattgtgacagacatctcctgaca

SEQ ID NO: 25138 - DNA, 25 bp, Mus musculus
aaattgtgacagtcatctcctgaca

SEQ ID NO: 25139 - DNA, 25 bp, Mus musculus
aaattgtgacttcccgagcatcgaa

SEQ ID NO: 25140 - DNA, 25 bp, Mus musculus
aaattgtgacttgccgagcatcgaa

SEQ ID NO: 25141 - DNA, 25 bp, Mus musculus
aaattgtgaggtcctctaccctcaa

SEQ ID NO: 25142 - DNA, 25 bp, Mus musculus
aaattgtgaggtgctctaccctcaa

SEQ ID NO: 25143 - DNA, 25 bp, Mus musculus
aaattgtgcaaaagcccctcacggg

SEQ ID NO: 25144 - DNA, 25 bp, Mus musculus
aaattgtgcaaatgcccctcacggg

SEQ ID NO: 25145 - DNA, 25 bp, Mus musculus
aaattgtgcacaaagtccttattac

SEQ ID NO: 25146 - DNA, 25 bp, Mus musculus
aaattgtgcacatagtccttattac

SEQ ID NO: 25147 - DNA, 25 bp, Mus musculus
aaattgtgccaaagcctacatacat

SEQ ID NO: 25148 - DNA, 25 bp, Mus musculus
aaattgtgccaatgcctacatacat

SEQ ID NO: 25149 - DNA, 25 bp, Mus musculus
aaattgtgccagacgaaaggcctac

SEQ ID NO: 25150 - DNA, 25 bp, Mus musculus
aaattgtgccagtcgaaaggcctac

SEQ ID NO: 25151 - DNA, 25 bp, Mus musculus
aaattgtggcaccagatggctacgc

SEQ ID NO: 25152 - DNA, 25 bp, Mus musculus
aaattgtggcacgagatggctacgc

SEQ ID NO: 25153 - DNA, 25 bp, Mus musculus
aaattgtgtactaagcattttgaat

SEQ ID NO: 25154 - DNA, 25 bp, Mus musculus
aaattgtgtactccggacaggtgtt

SEQ ID NO: 25155 - DNA, 25 bp, Mus musculus
aaattgtgtactgcggacaggtgtt

SEQ ID NO: 25156 - DNA, 25 bp, Mus musculus
aaattgtgtacttagcattttgaat

SEQ ID NO: 25157 - DNA, 25 bp, Mus musculus
aaattgtgtagtacttttgcctgct

SEQ ID NO: 25158 - DNA, 25 bp, Mus musculus
aaattgtgtagttcttttgcctgct

SEQ ID NO: 25159 - DNA, 25 bp, Mus musculus
aaattgtgtgagcagaagtttgata

SEQ ID NO: 25160 - DNA, 25 bp, Mus musculus
aaattgtgtgaggagaagtttgata

SEQ ID NO: 25161 - DNA, 25 bp, Mus musculus
aaattgtgtgccaggtgtgtgacgc

SEQ ID NO: 25162 - DNA, 25 bp, Mus musculus
aaattgtgtgccatcagtgatgtgc

SEQ ID NO: 25163 - DNA, 25 bp, Mus musculus
aaattgtgtgcctggtgtgtgacgc

SEQ ID NO: 25164 - DNA, 25 bp, Mus musculus
aaattgtgtgccttcagtgatgtgc

SEQ ID NO: 25165 - DNA, 25 bp, Mus musculus
aaattgtgttcactgctgtgcattt

SEQ ID NO: 25166 - DNA, 25 bp, Mus musculus
aaattgtgttcagtgctgtgcattt

SEQ ID NO: 25167 - DNA, 25 bp, Mus musculus
aaattgtgttctatctctacctcga

SEQ ID NO: 25168 - DNA, 25 bp, Mus musculus
aaattgtgttctttctctacctcga

SEQ ID NO: 25169 - DNA, 25 bp, Mus musculus
aaattgttaagcagtggaaaccact

SEQ ID NO: 25170 - DNA, 25 bp, Mus musculus
aaattgttaagctgtggaaaccact

SEQ ID NO: 25171 - DNA, 25 bp, Mus musculus
aaattgttcagaaactgtgtcctct

SEQ ID NO: 25172 - DNA, 25 bp, Mus musculus
aaattgttcagacctgtttctgcct

SEQ ID NO: 25173 - DNA, 25 bp, Mus musculus
aaattgttcagagctgtttctgcct

SEQ ID NO: 25174 - DNA, 25 bp, Mus musculus
aaattgttcagatactgtgtcctct

SEQ ID NO: 25175 - DNA, 25 bp, Mus musculus
aaattgttcagcacctatgacgcac

SEQ ID NO: 25176 - DNA, 25 bp, Mus musculus
aaattgttcagctcctatgacgcac

SEQ ID NO: 25177 - DNA, 25 bp, Mus musculus
aaattgttcatcacgcttgttttca

SEQ ID NO: 25178 - DNA, 25 bp, Mus musculus
aaattgttcatctcgcttgttttca

SEQ ID NO: 25179 - DNA, 25 bp, Mus musculus
aaattgttcgcacagtgttttcatc

SEQ ID NO: 25180 - DNA, 25 bp, Mus musculus
aaattgttcgcagagtgttttcatc

SEQ ID NO: 25181 - DNA, 25 bp, Mus musculus
aaattgttctaaagccaggactttg

SEQ ID NO: 25182 - DNA, 25 bp, Mus musculus
aaattgttctaatgccaggactttg

SEQ ID NO: 25183 - DNA, 25 bp, Mus musculus
aaattgttctagaaattcttgcaac

SEQ ID NO: 25184 - DNA, 25 bp, Mus musculus
aaattgttctagtaattcttgcaac

SEQ ID NO: 25185 - DNA, 25 bp, Mus musculus
aaattgttctctcatctccacttgt

SEQ ID NO: 25186 - DNA, 25 bp, Mus musculus
aaattgttctctgatctccacttgt

SEQ ID NO: 25187 - DNA, 25 bp, Mus musculus
aaattgttctgcatgagacctaaac

SEQ ID NO: 25188 - DNA, 25 bp, Mus musculus
aaattgttctgcttgagacctaaac

SEQ ID NO: 25189 - DNA, 25 bp, Mus musculus
aaattgttgcccagatgccaggtgc

SEQ ID NO: 25190 - DNA, 25 bp, Mus musculus
aaattgttgccctgatgccaggtgc

SEQ ID NO: 25191 - DNA, 25 bp, Mus musculus
aaattgttgctcaacttgcattggg

SEQ ID NO: 25192 - DNA, 25 bp, Mus musculus
aaattgttgctctacttgcattggg

SEQ ID NO: 25193 - DNA, 25 bp, Mus musculus
aaattgttggctcctcgtcacttac

SEQ ID NO: 25194 - DNA, 25 bp, Mus musculus
aaattgttggctgctcgtcacttac

SEQ ID NO: 25195 - DNA, 25 bp, Mus musculus
aaattgttgtctctttcctcagatc

SEQ ID NO: 25196 - DNA, 25 bp, Mus musculus
aaattgttgtctgtttcctcagatc

SEQ ID NO: 25197 - DNA, 25 bp, Mus musculus
aaattgtttactaatgtgtcgtaga

SEQ ID NO: 25198 - DNA, 25 bp, Mus musculus
aaattgtttacttatgtgtcgtaga

SEQ ID NO: 25199 - DNA, 25 bp, Mus musculus
aaattgtttatgacctcaagccctc

SEQ ID NO: 25200 - DNA, 25 bp, Mus musculus
aaattgtttatgtcctcaagccctc

SEQ ID NO: 25201 - DNA, 25 bp, Mus musculus
aaattgtttcttagggaccaggcat

SEQ ID NO: 25202 - DNA, 25 bp, Mus musculus
aaattgtttctttgggaccaggcat

SEQ ID NO: 25203 - DNA, 25 bp, Mus musculus
aaattgtttgtcactctctatacat

SEQ ID NO: 25204 - DNA, 25 bp, Mus musculus
aaattgtttgtctctctctatacat

SEQ ID NO: 25205 - DNA, 25 bp, Mus musculus
aaatttaaacaaagcctggctagtg

SEQ ID NO: 25206 - DNA, 25 bp, Mus musculus
aaatttaaacaatgcctggctagtg

SEQ ID NO: 25207 - DNA, 25 bp, Mus musculus
aaatttaacactatcatggtaatga

SEQ ID NO: 25208 - DNA, 25 bp, Mus musculus
aaatttaacactttcatggtaatga

SEQ ID NO: 25209 - DNA, 25 bp, Mus musculus
aaatttaactgaaggcctcttgctg

SEQ ID NO: 25210 - DNA, 25 bp, Mus musculus
aaatttaactgatggcctcttgctg

SEQ ID NO: 25211 - DNA, 25 bp, Mus musculus
aaatttaagcatctgggaataccca

SEQ ID NO: 25212 - DNA, 25 bp, Mus musculus
aaatttaagcatgtgggaataccca

SEQ ID NO: 25213 - DNA, 25 bp, Mus musculus
aaatttaagtcaagtgtgtcttata

SEQ ID NO: 25214 - DNA, 25 bp, Mus musculus
aaatttaagtcatgtgtgtcttata

SEQ ID NO: 25215 - DNA, 25 bp, Mus musculus
aaatttaatgcgcatgatcacaaga

SEQ ID NO: 25216 - DNA, 25 bp, Mus musculus
aaatttaatgcggatgatcacaaga

SEQ ID NO: 25217 - DNA, 25 bp, Mus musculus
aaatttacaccgacactgacctccg

SEQ ID NO: 25218 - DNA, 25 bp, Mus musculus
aaatttacaccgtcactgacctccg

SEQ ID NO: 25219 - DNA, 25 bp, Mus musculus
aaatttacaggaactggactccgat

SEQ ID NO: 25220 - DNA, 25 bp, Mus musculus
aaatttacaggatctggactccgat

SEQ ID NO: 25221 - DNA, 25 bp, Mus musculus
aaatttacgcttcgctatatcacaa

SEQ ID NO: 25222 - DNA, 25 bp, Mus musculus
aaatttacgcttggctatatcacaa

SEQ ID NO: 25223 - DNA, 25 bp, Mus musculus
aaatttacgtgtccccattcacttt

SEQ ID NO: 25224 - DNA, 25 bp, Mus musculus
aaatttacgtgtgcccattcacttt

SEQ ID NO: 25225 - DNA, 25 bp, Mus musculus
aaatttagcagaaaattgggtctct

SEQ ID NO: 25226 - DNA, 25 bp, Mus musculus
aaatttagcagataattgggtctct

SEQ ID NO: 25227 - DNA, 25 bp, Mus musculus
aaatttagccagactcttattgagc

SEQ ID NO: 25228 - DNA, 25 bp, Mus musculus
aaatttagccagtctcttattgagc

SEQ ID NO: 25229 - DNA, 25 bp, Mus musculus
aaatttagcctcaaccatggattag

SEQ ID NO: 25230 - DNA, 25 bp, Mus musculus
aaatttagcctctaccatggattag

SEQ ID NO: 25231 - DNA, 25 bp, Mus musculus
aaatttaggttcatacatattgtaa

SEQ ID NO: 25232 - DNA, 25 bp, Mus musculus
aaatttaggttcttacatattgtaa

SEQ ID NO: 25233 - DNA, 25 bp, Mus musculus
aaatttaggttgaggccttgcgata

SEQ ID NO: 25234 - DNA, 25 bp, Mus musculus
aaatttaggttgtggccttgcgata

SEQ ID NO: 25235 - DNA, 25 bp, Mus musculus
aaatttagtgtgatgccctgctttc

SEQ ID NO: 25236 - DNA, 25 bp, Mus musculus
aaatttagtgtgttgccctgctttc

SEQ ID NO: 25237 - DNA, 25 bp, Mus musculus
aaatttatggtaagcctgacagatt

SEQ ID NO: 25238 - DNA, 25 bp, Mus musculus
aaatttatggtatgcctgacagatt

SEQ ID NO: 25239 - DNA, 25 bp, Mus musculus
aaatttattctcacgctctgtatag

SEQ ID NO: 25240 - DNA, 25 bp, Mus musculus
aaatttattctctcgctctgtatag

SEQ ID NO: 25241 - DNA, 25 bp, Mus musculus
aaatttattgctactcccaatttag

SEQ ID NO: 25242 - DNA, 25 bp, Mus musculus
aaatttattgcttctcccaatttag

SEQ ID NO: 25243 - DNA, 25 bp, Mus musculus
aaatttatttggctgagtggtcact

SEQ ID NO: 25244 - DNA, 25 bp, Mus musculus
aaatttatttgggtgagtggtcact

SEQ ID NO: 25245 - DNA, 25 bp, Mus musculus
aaatttcaatcacgcgtttggcttt

SEQ ID NO: 25246 - DNA, 25 bp, Mus musculus
aaatttcaatcaggcgtttggcttt

SEQ ID NO: 25247 - DNA, 25 bp, Mus musculus
aaatttcaatggctgtctgaaggcc

SEQ ID NO: 25248 - DNA, 25 bp, Mus musculus
aaatttcaatgggtgtctgaaggcc

SEQ ID NO: 25249 - DNA, 25 bp, Mus musculus
aaatttcacactatagcccgggctg

SEQ ID NO: 25250 - DNA, 25 bp, Mus musculus
aaatttcacactttagcccgggctg

SEQ ID NO: 25251 - DNA, 25 bp, Mus musculus
aaatttcacaggcacacttctgtaa

SEQ ID NO: 25252 - DNA, 25 bp, Mus musculus
aaatttcacagggacacttctgtaa

SEQ ID NO: 25253 - DNA, 25 bp, Mus musculus
aaatttcacccaataattcagccaa

SEQ ID NO: 25254 - DNA, 25 bp, Mus musculus
aaatttcacccattaattcagccaa

SEQ ID NO: 25255 - DNA, 25 bp, Mus musculus
aaatttcaccctcctcaccggaagg

SEQ ID NO: 25256 - DNA, 25 bp, Mus musculus
aaatttcaccctgctcaccggaagg

SEQ ID NO: 25257 - DNA, 25 bp, Mus musculus
aaatttcaccttctcgtgactatgg

SEQ ID NO: 25258 - DNA, 25 bp, Mus musculus
aaatttcaccttgtcgtgactatgg

SEQ ID NO: 25259 - DNA, 25 bp, Mus musculus
aaatttcactacctacatgtggtac

SEQ ID NO: 25260 - DNA, 25 bp, Mus musculus
aaatttcactacgtacatgtggtac

SEQ ID NO: 25261 - DNA, 25 bp, Mus musculus
aaatttcactggctgagacggtgta

SEQ ID NO: 25262 - DNA, 25 bp, Mus musculus
aaatttcactgggtgagacggtgta

SEQ ID NO: 25263 - DNA, 25 bp, Mus musculus
aaatttcagagcatccaggaccaca

SEQ ID NO: 25264 - DNA, 25 bp, Mus musculus
aaatttcagagcttccaggaccaca

SEQ ID NO: 25265 - DNA, 25 bp, Mus musculus
aaatttcagtcacttcactatagaa

SEQ ID NO: 25266 - DNA, 25 bp, Mus musculus
aaatttcagtcagttcactatagaa

SEQ ID NO: 25267 - DNA, 25 bp, Mus musculus
aaatttcatagtccagtctgttctt

SEQ ID NO: 25268 - DNA, 25 bp, Mus musculus
aaatttcatagtgcagtctgttctt

SEQ ID NO: 25269 - DNA, 25 bp, Mus musculus
aaatttcatcctcagcacttcgtgt

SEQ ID NO: 25270 - DNA, 25 bp, Mus musculus
aaatttcatcctgagcacttcgtgt

SEQ ID NO: 25271 - DNA, 25 bp, Mus musculus
aaatttcattctattcttcctcaca

SEQ ID NO: 25272 - DNA, 25 bp, Mus musculus
aaatttcattcttttcttcctcaca

SEQ ID NO: 25273 - DNA, 25 bp, Mus musculus
aaatttccaagcagccacagctagc

SEQ ID NO: 25274 - DNA, 25 bp, Mus musculus
aaatttccaagctgccacagctagc

SEQ ID NO: 25275 - DNA, 25 bp, Mus musculus
aaatttccaaggaattatgccatca

SEQ ID NO: 25276 - DNA, 25 bp, Mus musculus
aaatttccaaggactcccatgtgct

SEQ ID NO: 25277 - DNA, 25 bp, Mus musculus
aaatttccaaggtattatgccatca

SEQ ID NO: 25278 - DNA, 25 bp, Mus musculus
aaatttccaaggtctcccatgtgct

SEQ ID NO: 25279 - DNA, 25 bp, Mus musculus
aaatttccacaaaatatagcagtgt

SEQ ID NO: 25280 - DNA, 25 bp, Mus musculus
aaatttccacaatatatagcagtgt

SEQ ID NO: 25281 - DNA, 25 bp, Mus musculus
aaatttccacttcagcagttttcaa

SEQ ID NO: 25282 - DNA, 25 bp, Mus musculus
aaatttccacttcagtcctacttat

SEQ ID NO: 25283 - DNA, 25 bp, Mus musculus
aaatttccacttgagcagttttcaa

SEQ ID NO: 25284 - DNA, 25 bp, Mus musculus
aaatttccacttgagtcctacttat

SEQ ID NO: 25285 - DNA, 25 bp, Mus musculus
aaatttccagacatgccactttaat

SEQ ID NO: 25286 - DNA, 25 bp, Mus musculus
aaatttccagacattctgtggcatt

SEQ ID NO: 25287 - DNA, 25 bp, Mus musculus
aaatttccagacttgccactttaat

SEQ ID NO: 25288 - DNA, 25 bp, Mus musculus
aaatttccagactttctgtggcatt

SEQ ID NO: 25289 - DNA, 25 bp, Mus musculus
aaatttccagcgacagttcacacgg

SEQ ID NO: 25290 - DNA, 25 bp, Mus musculus
aaatttccagcgtcagttcacacgg

SEQ ID NO: 25291 - DNA, 25 bp, Mus musculus
aaatttccaggcaacttggtcctag

SEQ ID NO: 25292 - DNA, 25 bp, Mus musculus
aaatttccaggctacttggtcctag

SEQ ID NO: 25293 - DNA, 25 bp, Mus musculus
aaatttccagtcagacactgctgaa

SEQ ID NO: 25294 - DNA, 25 bp, Mus musculus
aaatttccagtctgacactgctgaa

SEQ ID NO: 25295 - DNA, 25 bp, Mus musculus
aaatttccatcaccaactggcagga

SEQ ID NO: 25296 - DNA, 25 bp, Mus musculus
aaatttccatcagcaactggcagga

SEQ ID NO: 25297 - DNA, 25 bp, Mus musculus
aaatttccattcagtgccttgtgag

SEQ ID NO: 25298 - DNA, 25 bp, Mus musculus
aaatttccattctgtgccttgtgag

SEQ ID NO: 25299 - DNA, 25 bp, Mus musculus
aaatttcccaacaagattggccagt

SEQ ID NO: 25300 - DNA, 25 bp, Mus musculus
aaatttcccaactagattggccagt

SEQ ID NO: 25301 - DNA, 25 bp, Mus musculus
aaatttcccaatacaagctacaatt

SEQ ID NO: 25302 - DNA, 25 bp, Mus musculus
aaatttcccaattcaagctacaatt

SEQ ID NO: 25303 - DNA, 25 bp, Mus musculus
aaatttcccaggagggcttctctga

SEQ ID NO: 25304 - DNA, 25 bp, Mus musculus
aaatttcccaggtgggcttctctga

SEQ ID NO: 25305 - DNA, 25 bp, Mus musculus
aaatttccccatctaaatatgtgtt

SEQ ID NO: 25306 - DNA, 25 bp, Mus musculus
aaatttccccatgtaaatatgtgtt

SEQ ID NO: 25307 - DNA, 25 bp, Mus musculus
aaatttccgaagagctccttggtga

SEQ ID NO: 25308 - DNA, 25 bp, Mus musculus
aaatttccgaagtgctccttggtga

SEQ ID NO: 25309 - DNA, 25 bp, Mus musculus
aaatttcctactagcctgagtcatt

SEQ ID NO: 25310 - DNA, 25 bp, Mus musculus
aaatttcctacttgcctgagtcatt

SEQ ID NO: 25311 - DNA, 25 bp, Mus musculus
aaatttcctataatccttcagcaat

SEQ ID NO: 25312 - DNA, 25 bp, Mus musculus
aaatttcctatattccttcagcaat

SEQ ID NO: 25313 - DNA, 25 bp, Mus musculus
aaatttcctcttattcactagcagc

SEQ ID NO: 25314 - DNA, 25 bp, Mus musculus
aaatttcctctttttcactagcagc

SEQ ID NO: 25315 - DNA, 25 bp, Mus musculus
aaatttcctgcacctttgtggacgc

SEQ ID NO: 25316 - DNA, 25 bp, Mus musculus
aaatttcctgcagctttgtggacgc

SEQ ID NO: 25317 - DNA, 25 bp, Mus musculus
aaatttcctgtcacctagcagtttt

SEQ ID NO: 25318 - DNA, 25 bp, Mus musculus
aaatttcctgtctcctagcagtttt

SEQ ID NO: 25319 - DNA, 25 bp, Mus musculus
aaatttcctttcagtatccacggag

SEQ ID NO: 25320 - DNA, 25 bp, Mus musculus
aaatttcctttctgtatccacggag

SEQ ID NO: 25321 - DNA, 25 bp, Mus musculus
aaatttccttttacatacacttgat

SEQ ID NO: 25322 - DNA, 25 bp, Mus musculus
aaatttcctttttcatacacttgat

SEQ ID NO: 25323 - DNA, 25 bp, Mus musculus
aaatttcggagcactacttcttctt

SEQ ID NO: 25324 - DNA, 25 bp, Mus musculus
aaatttcggagctctacttcttctt

SEQ ID NO: 25325 - DNA, 25 bp, Mus musculus
aaatttcggcctactgaatggagta

SEQ ID NO: 25326 - DNA, 25 bp, Mus musculus
aaatttcggccttctgaatggagta

SEQ ID NO: 25327 - DNA, 25 bp, Mus musculus
aaatttcgtgcacccttcaggaagc

SEQ ID NO: 25328 - DNA, 25 bp, Mus musculus
aaatttcgtgcagccttcaggaagc

SEQ ID NO: 25329 - DNA, 25 bp, Mus musculus
aaatttctaattcttcattgctcat

SEQ ID NO: 25330 - DNA, 25 bp, Mus musculus
aaatttctaattgttcattgctcat

SEQ ID NO: 25331 - DNA, 25 bp, Mus musculus
aaatttctacacatgccatttgcat

SEQ ID NO: 25332 - DNA, 25 bp, Mus musculus
aaatttctacacttgccatttgcat

SEQ ID NO: 25333 - DNA, 25 bp, Mus musculus
aaatttctacttcagcacacctgcc

SEQ ID NO: 25334 - DNA, 25 bp, Mus musculus
aaatttctacttgagcacacctgcc

SEQ ID NO: 25335 - DNA, 25 bp, Mus musculus
aaatttctcacaacctcattggcgg

SEQ ID NO: 25336 - DNA, 25 bp, Mus musculus
aaatttctcacatcctcattggcgg

SEQ ID NO: 25337 - DNA, 25 bp, Mus musculus
aaatttctcagtctgttgccctgtc

SEQ ID NO: 25338 - DNA, 25 bp, Mus musculus
aaatttctcagtgtgttgccctgtc

SEQ ID NO: 25339 - DNA, 25 bp, Mus musculus
aaatttctctttctagtcccagaat

SEQ ID NO: 25340 - DNA, 25 bp, Mus musculus
aaatttctctttgtagtcccagaat

SEQ ID NO: 25341 - DNA, 25 bp, Mus musculus
aaatttctgaccaggaacaccctca

SEQ ID NO: 25342 - DNA, 25 bp, Mus musculus
aaatttctgacctggaacaccctca

SEQ ID NO: 25343 - DNA, 25 bp, Mus musculus
aaatttctgagaacttccccttctt

SEQ ID NO: 25344 - DNA, 25 bp, Mus musculus
aaatttctgagatcttccccttctt

SEQ ID NO: 25345 - DNA, 25 bp, Mus musculus
aaatttctgcatatcaagccaggtg

SEQ ID NO: 25346 - DNA, 25 bp, Mus musculus
aaatttctgcatttcaagccaggtg

SEQ ID NO: 25347 - DNA, 25 bp, Mus musculus
aaatttctgcccacgtaacattata

SEQ ID NO: 25348 - DNA, 25 bp, Mus musculus
aaatttctgccctcgtaacattata

SEQ ID NO: 25349 - DNA, 25 bp, Mus musculus
aaatttctgcgtagatccgagctcc

SEQ ID NO: 25350 - DNA, 25 bp, Mus musculus
aaatttctgcgttgatccgagctcc

SEQ ID NO: 25351 - DNA, 25 bp, Mus musculus
aaatttctgctgcacaacccgtaca

SEQ ID NO: 25352 - DNA, 25 bp, Mus musculus
aaatttctgctggacaacccgtaca

SEQ ID NO: 25353 - DNA, 25 bp, Mus musculus
aaatttctgtcaagtgtgccatcac

SEQ ID NO: 25354 - DNA, 25 bp, Mus musculus
aaatttctgtcatgtgtgccatcac

SEQ ID NO: 25355 - DNA, 25 bp, Mus musculus
aaatttcttctgaccatgttgcatg

SEQ ID NO: 25356 - DNA, 25 bp, Mus musculus
aaatttcttctgtccatgttgcatg

SEQ ID NO: 25357 - DNA, 25 bp, Mus musculus
aaatttcttgaactagcgcttgcat

SEQ ID NO: 25358 - DNA, 25 bp, Mus musculus
aaatttcttgaagtagcgcttgcat

SEQ ID NO: 25359 - DNA, 25 bp, Mus musculus
aaatttctttttctctggactccag

SEQ ID NO: 25360 - DNA, 25 bp, Mus musculus
aaatttctttttgtctggactccag

SEQ ID NO: 25361 - DNA, 25 bp, Mus musculus
aaatttgaaatcagacttgccttga

SEQ ID NO: 25362 - DNA, 25 bp, Mus musculus
aaatttgaaatctgacttgccttga

SEQ ID NO: 25363 - DNA, 25 bp, Mus musculus
aaatttgaactacaacctgctgctg

SEQ ID NO: 25364 - DNA, 25 bp, Mus musculus
aaatttgaactagaacctgctgctg

SEQ ID NO: 25365 - DNA, 25 bp, Mus musculus
aaatttgaagcaattgagcatgaaa

SEQ ID NO: 25366 - DNA, 25 bp, Mus musculus
aaatttgaagcatttgagcatgaaa

SEQ ID NO: 25367 - DNA, 25 bp, Mus musculus
aaatttgaagtcagtacaaaagctt

SEQ ID NO: 25368 - DNA, 25 bp, Mus musculus
aaatttgaagtctgtacaaaagctt

SEQ ID NO: 25369 - DNA, 25 bp, Mus musculus
aaatttgactgactgtcctttccat

SEQ ID NO: 25370 - DNA, 25 bp, Mus musculus
aaatttgactgagtgtcctttccat

SEQ ID NO: 25371 - DNA, 25 bp, Mus musculus
aaatttgactgtccctcttgacata

SEQ ID NO: 25372 - DNA, 25 bp, Mus musculus
aaatttgactgtgcctcttgacata

SEQ ID NO: 25373 - DNA, 25 bp, Mus musculus
aaatttgacttacgctgggtgtggt

SEQ ID NO: 25374 - DNA, 25 bp, Mus musculus
aaatttgacttaggctgggtgtggt

SEQ ID NO: 25375 - DNA, 25 bp, Mus musculus
aaatttgagctgaccatgccctgtt

SEQ ID NO: 25376 - DNA, 25 bp, Mus musculus
aaatttgagctgtccatgccctgtt

SEQ ID NO: 25377 - DNA, 25 bp, Mus musculus
aaatttgatcgccttaactactgta

SEQ ID NO: 25378 - DNA, 25 bp, Mus musculus
aaatttgatcgcgttaactactgta

SEQ ID NO: 25379 - DNA, 25 bp, Mus musculus
aaatttgatgctcgtgaactgtcag

SEQ ID NO: 25380 - DNA, 25 bp, Mus musculus
aaatttgatgctggtgaactgtcag

SEQ ID NO: 25381 - DNA, 25 bp, Mus musculus
aaatttgatgttcggcctatgtccg

SEQ ID NO: 25382 - DNA, 25 bp, Mus musculus
aaatttgatgttgggcctatgtccg

SEQ ID NO: 25383 - DNA, 25 bp, Mus musculus
aaatttgcaacgatcttacagagga

SEQ ID NO: 25384 - DNA, 25 bp, Mus musculus
aaatttgcaacgttcttacagagga

SEQ ID NO: 25385 - DNA, 25 bp, Mus musculus
aaatttgcaccacctgggcatcctt

SEQ ID NO: 25386 - DNA, 25 bp, Mus musculus
aaatttgcaccagctgggcatcctt

SEQ ID NO: 25387 - DNA, 25 bp, Mus musculus
aaatttgcactcaagtttcttaatg

SEQ ID NO: 25388 - DNA, 25 bp, Mus musculus
aaatttgcactctagtttcttaatg

SEQ ID NO: 25389 - DNA, 25 bp, Mus musculus
aaatttgcagcaaggtactaaggaa

SEQ ID NO: 25390 - DNA, 25 bp, Mus musculus
aaatttgcagcatggtactaaggaa

SEQ ID NO: 25391 - DNA, 25 bp, Mus musculus
aaatttgcagtcaaagtgccactag

SEQ ID NO: 25392 - DNA, 25 bp, Mus musculus
aaatttgcagtcctcatgtggctcc

SEQ ID NO: 25393 - DNA, 25 bp, Mus musculus
aaatttgcagtcgtcatgtggctcc

SEQ ID NO: 25394 - DNA, 25 bp, Mus musculus
aaatttgcagtctaagtgccactag

SEQ ID NO: 25395 - DNA, 25 bp, Mus musculus
aaatttgcatgaaattctccaggat

SEQ ID NO: 25396 - DNA, 25 bp, Mus musculus
aaatttgcatgatattctccaggat

SEQ ID NO: 25397 - DNA, 25 bp, Mus musculus
aaatttgcatgtctctgtccccaga

SEQ ID NO: 25398 - DNA, 25 bp, Mus musculus
aaatttgcatgtgtctgtccccaga

SEQ ID NO: 25399 - DNA, 25 bp, Mus musculus
aaatttgccactagccttagatgat

SEQ ID NO: 25400 - DNA, 25 bp, Mus musculus
aaatttgccactatgaaatctttct

SEQ ID NO: 25401 - DNA, 25 bp, Mus musculus
aaatttgccacttgccttagatgat

SEQ ID NO: 25402 - DNA, 25 bp, Mus musculus
aaatttgccactttgaaatctttct

SEQ ID NO: 25403 - DNA, 25 bp, Mus musculus
aaatttgcctcgactgatggtctcc

SEQ ID NO: 25404 - DNA, 25 bp, Mus musculus
aaatttgcctcgtctgatggtctcc

SEQ ID NO: 25405 - DNA, 25 bp, Mus musculus
aaatttgcggacaccccaagataat

SEQ ID NO: 25406 - DNA, 25 bp, Mus musculus
aaatttgcggactccccaagataat

SEQ ID NO: 25407 - DNA, 25 bp, Mus musculus
aaatttgctatcattctaaccttta

SEQ ID NO: 25408 - DNA, 25 bp, Mus musculus
aaatttgctatctttctaaccttta

SEQ ID NO: 25409 - DNA, 25 bp, Mus musculus
aaatttgctatgatccagccctaaa

SEQ ID NO: 25410 - DNA, 25 bp, Mus musculus
aaatttgctatgttccagccctaaa

SEQ ID NO: 25411 - DNA, 25 bp, Mus musculus
aaatttgctattagatcctggaggc

SEQ ID NO: 25412 - DNA, 25 bp, Mus musculus
aaatttgctatttgatcctggaggc

SEQ ID NO: 25413 - DNA, 25 bp, Mus musculus
aaatttgctgtgcaattttgtctcc

SEQ ID NO: 25414 - DNA, 25 bp, Mus musculus
aaatttgctgtggaattttgtctcc

SEQ ID NO: 25415 - DNA, 25 bp, Mus musculus
aaatttgcttccacagtattctgcc

SEQ ID NO: 25416 - DNA, 25 bp, Mus musculus
aaatttgcttcctcagtattctgcc

SEQ ID NO: 25417 - DNA, 25 bp, Mus musculus
aaatttgcttctacactcagatgcc

SEQ ID NO: 25418 - DNA, 25 bp, Mus musculus
aaatttgcttcttcactcagatgcc

SEQ ID NO: 25419 - DNA, 25 bp, Mus musculus
aaatttgctttgctctaacctgaag

SEQ ID NO: 25420 - DNA, 25 bp, Mus musculus
aaatttgctttggtctaacctgaag

SEQ ID NO: 25421 - DNA, 25 bp, Mus musculus
aaatttggatctccagactggtctc

SEQ ID NO: 25422 - DNA, 25 bp, Mus musculus
aaatttggatctgcagactggtctc

SEQ ID NO: 25423 - DNA, 25 bp, Mus musculus
aaatttggcaaactgttcaagacac

SEQ ID NO: 25424 - DNA, 25 bp, Mus musculus
aaatttggcaaagtgttcaagacac

SEQ ID NO: 25425 - DNA, 25 bp, Mus musculus
aaatttggcacaatacctgggtatt

SEQ ID NO: 25426 - DNA, 25 bp, Mus musculus
aaatttggcacattacctgggtatt

SEQ ID NO: 25427 - DNA, 25 bp, Mus musculus
aaatttggccatcgtcgcttccaga

SEQ ID NO: 25428 - DNA, 25 bp, Mus musculus
aaatttggccatggtcgcttccaga

SEQ ID NO: 25429 - DNA, 25 bp, Mus musculus
aaatttggcgctattctggcccaag

SEQ ID NO: 25430 - DNA, 25 bp, Mus musculus
aaatttggcgcttttctggcccaag

SEQ ID NO: 25431 - DNA, 25 bp, Mus musculus
aaatttggcttgcaactgtcagcac

SEQ ID NO: 25432 - DNA, 25 bp, Mus musculus
aaatttggcttggaactgtcagcac

SEQ ID NO: 25433 - DNA, 25 bp, Mus musculus
aaatttgggctcagggttggccatt

SEQ ID NO: 25434 - DNA, 25 bp, Mus musculus
aaatttgggctctgggttggccatt

SEQ ID NO: 25435 - DNA, 25 bp, Mus musculus
aaatttggtcctcagcgcatgtata

SEQ ID NO: 25436 - DNA, 25 bp, Mus musculus
aaatttggtcctgagcgcatgtata

SEQ ID NO: 25437 - DNA, 25 bp, Mus musculus
aaatttggtctcacttgatctaagg

SEQ ID NO: 25438 - DNA, 25 bp, Mus musculus
aaatttggtctctcttgatctaagg

SEQ ID NO: 25439 - DNA, 25 bp, Mus musculus
aaatttggtttgagatctttctgtt

SEQ ID NO: 25440 - DNA, 25 bp, Mus musculus
aaatttggtttgtgatctttctgtt

SEQ ID NO: 25441 - DNA, 25 bp, Mus musculus
aaatttgtacatattctagctctaa

SEQ ID NO: 25442 - DNA, 25 bp, Mus musculus
aaatttgtacattttctagctctaa

SEQ ID NO: 25443 - DNA, 25 bp, Mus musculus
aaatttgtacgtcggacacccatca

SEQ ID NO: 25444 - DNA, 25 bp, Mus musculus
aaatttgtacgtgggacacccatca

SEQ ID NO: 25445 - DNA, 25 bp, Mus musculus
aaatttgtaggcaccaccattttga

SEQ ID NO: 25446 - DNA, 25 bp, Mus musculus
aaatttgtaggctccaccattttga

SEQ ID NO: 25447 - DNA, 25 bp, Mus musculus
aaatttgtattgcttcccaggccaa

SEQ ID NO: 25448 - DNA, 25 bp, Mus musculus
aaatttgtattggttcccaggccaa

SEQ ID NO: 25449 - DNA, 25 bp, Mus musculus
aaatttgtctataactatgtgccag

SEQ ID NO: 25450 - DNA, 25 bp, Mus musculus
aaatttgtctatctttctagtgcct

SEQ ID NO: 25451 - DNA, 25 bp, Mus musculus
aaatttgtctatgtttctagtgcct

SEQ ID NO: 25452 - DNA, 25 bp, Mus musculus
aaatttgtctattactatgtgccag

SEQ ID NO: 25453 - DNA, 25 bp, Mus musculus
aaatttgtctcactctcagaaaagg

SEQ ID NO: 25454 - DNA, 25 bp, Mus musculus
aaatttgtctcagtctcagaaaagg

SEQ ID NO: 25455 - DNA, 25 bp, Mus musculus
aaatttgtctctcagtggctgtgtc

SEQ ID NO: 25456 - DNA, 25 bp, Mus musculus
aaatttgtctctgagtggctgtgtc

SEQ ID NO: 25457 - DNA, 25 bp, Mus musculus
aaatttgtctgcagggttggtttga

SEQ ID NO: 25458 - DNA, 25 bp, Mus musculus
aaatttgtctgctgggttggtttga

SEQ ID NO: 25459 - DNA, 25 bp, Mus musculus
aaatttgtgctgcatttcttctttg

SEQ ID NO: 25460 - DNA, 25 bp, Mus musculus
aaatttgtgctggatttcttctttg

SEQ ID NO: 25461 - DNA, 25 bp, Mus musculus
aaatttgtgtggatagcctcccctg

SEQ ID NO: 25462 - DNA, 25 bp, Mus musculus
aaatttgtgtggttagcctcccctg

SEQ ID NO: 25463 - DNA, 25 bp, Mus musculus
aaattttaagtcactcccatccatg

SEQ ID NO: 25464 - DNA, 25 bp, Mus musculus
aaattttaagtctctcccatccatg

SEQ ID NO: 25465 - DNA, 25 bp, Mus musculus
aaattttaattgacctccacctgag

SEQ ID NO: 25466 - DNA, 25 bp, Mus musculus
aaattttaattgtcctccacctgag

SEQ ID NO: 25467 - DNA, 25 bp, Mus musculus
aaattttagctaaccagcactacac

SEQ ID NO: 25468 - DNA, 25 bp, Mus musculus
aaattttagctatccagcactacac

SEQ ID NO: 25469 - DNA, 25 bp, Mus musculus
aaattttatcatactcactttccat

SEQ ID NO: 25470 - DNA, 25 bp, Mus musculus
aaattttatcattctcactttccat

SEQ ID NO: 25471 - DNA, 25 bp, Mus musculus
aaattttatgaaccccaggcatact

SEQ ID NO: 25472 - DNA, 25 bp, Mus musculus
aaattttatgaagcccaggcatact

SEQ ID NO: 25473 - DNA, 25 bp, Mus musculus
aaattttcaccaagacttttggtag

SEQ ID NO: 25474 - DNA, 25 bp, Mus musculus
aaattttcaccatgacttttggtag

SEQ ID NO: 25475 - DNA, 25 bp, Mus musculus
aaattttcaggtcttgtgcacagga

SEQ ID NO: 25476 - DNA, 25 bp, Mus musculus
aaattttcaggtgttgtgcacagga

SEQ ID NO: 25477 - DNA, 25 bp, Mus musculus
aaattttcagtcattcactcacagt

SEQ ID NO: 25478 - DNA, 25 bp, Mus musculus
aaattttcagtctttcactcacagt

SEQ ID NO: 25479 - DNA, 25 bp, Mus musculus
aaattttcctatagcttacgtgtag

SEQ ID NO: 25480 - DNA, 25 bp, Mus musculus
aaattttcctattgcttacgtgtag

SEQ ID NO: 25481 - DNA, 25 bp, Mus musculus
aaattttcctgtctgtggacttctg

SEQ ID NO: 25482 - DNA, 25 bp, Mus musculus
aaattttcctgtgtgtggacttctg

SEQ ID NO: 25483 - DNA, 25 bp, Mus musculus
aaattttcgacactggtggccagac

SEQ ID NO: 25484 - DNA, 25 bp, Mus musculus
aaattttcgacagtggtggccagac

SEQ ID NO: 25485 - DNA, 25 bp, Mus musculus
aaattttcgcacacatctttggacc

SEQ ID NO: 25486 - DNA, 25 bp, Mus musculus
aaattttcgcactcatctttggacc

SEQ ID NO: 25487 - DNA, 25 bp, Mus musculus
aaattttctaccactaatcaatatg

SEQ ID NO: 25488 - DNA, 25 bp, Mus musculus
aaattttctacctctaatcaatatg

SEQ ID NO: 25489 - DNA, 25 bp, Mus musculus
aaattttctcataaacactttgctg

SEQ ID NO: 25490 - DNA, 25 bp, Mus musculus
aaattttctcattaacactttgctg

SEQ ID NO: 25491 - DNA, 25 bp, Mus musculus
aaattttctctcataaggctttggt

SEQ ID NO: 25492 - DNA, 25 bp, Mus musculus
aaattttctctcttaaggctttggt

SEQ ID NO: 25493 - DNA, 25 bp, Mus musculus
aaattttctgtccagtagtccctgt

SEQ ID NO: 25494 - DNA, 25 bp, Mus musculus
aaattttctgtcgagtagtccctgt

SEQ ID NO: 25495 - DNA, 25 bp, Mus musculus
aaattttctgtgctgattgcctgga

SEQ ID NO: 25496 - DNA, 25 bp, Mus musculus
aaattttctgtggtgattgcctgga

SEQ ID NO: 25497 - DNA, 25 bp, Mus musculus
aaattttgacccatccagtctgctt

SEQ ID NO: 25498 - DNA, 25 bp, Mus musculus
aaattttgacccttccagtctgctt

SEQ ID NO: 25499 - DNA, 25 bp, Mus musculus
aaattttgagctatccaacagaaga

SEQ ID NO: 25500 - DNA, 25 bp, Mus musculus
aaattttgagctttccaacagaaga

SEQ ID NO: 25501 - DNA, 25 bp, Mus musculus
aaattttgagttcctggctccttgt

SEQ ID NO: 25502 - DNA, 25 bp, Mus musculus
aaattttgagttgctggctccttgt

SEQ ID NO: 25503 - DNA, 25 bp, Mus musculus
aaattttgatacacatcgcacctgt

SEQ ID NO: 25504 - DNA, 25 bp, Mus musculus
aaattttgatactcatcgcacctgt

SEQ ID NO: 25505 - DNA, 25 bp, Mus musculus
aaattttgatagctgggtcacagtc

SEQ ID NO: 25506 - DNA, 25 bp, Mus musculus
aaattttgataggtgggtcacagtc

SEQ ID NO: 25507 - DNA, 25 bp, Mus musculus
aaattttgatgtcagtgccccttcc

SEQ ID NO: 25508 - DNA, 25 bp, Mus musculus
aaattttgatgtgagtgccccttcc

SEQ ID NO: 25509 - DNA, 25 bp, Mus musculus
aaattttgcaccctaggattttgcg

SEQ ID NO: 25510 - DNA, 25 bp, Mus musculus
aaattttgcaccgtaggattttgcg

SEQ ID NO: 25511 - DNA, 25 bp, Mus musculus
aaattttgccaaacattctcagata

SEQ ID NO: 25512 - DNA, 25 bp, Mus musculus
aaattttgccaatcattctcagata

SEQ ID NO: 25513 - DNA, 25 bp, Mus musculus
aaattttgcgctcggtgcgatactg

SEQ ID NO: 25514 - DNA, 25 bp, Mus musculus
aaattttgcgctgggtgcgatactg

SEQ ID NO: 25515 - DNA, 25 bp, Mus musculus
aaattttgctgactccctgtagaag

SEQ ID NO: 25516 - DNA, 25 bp, Mus musculus
aaattttgctgagtccctgtagaag

SEQ ID NO: 25517 - DNA, 25 bp, Mus musculus
aaattttgcttcagggcactatgag

SEQ ID NO: 25518 - DNA, 25 bp, Mus musculus
aaattttgcttctgggcactatgag

SEQ ID NO: 25519 - DNA, 25 bp, Mus musculus
aaattttggccccacaggcattggg

SEQ ID NO: 25520 - DNA, 25 bp, Mus musculus
aaattttggcccgacaggcattggg

SEQ ID NO: 25521 - DNA, 25 bp, Mus musculus
aaattttggctcattctcttgtcat

SEQ ID NO: 25522 - DNA, 25 bp, Mus musculus
aaattttggctctttctcttgtcat

SEQ ID NO: 25523 - DNA, 25 bp, Mus musculus
aaattttgtcatccgtgttttctca

SEQ ID NO: 25524 - DNA, 25 bp, Mus musculus
aaattttgtcatgcgtgttttctca

SEQ ID NO: 25525 - DNA, 25 bp, Mus musculus
aaattttgtccgagctgtatccgtg

SEQ ID NO: 25526 - DNA, 25 bp, Mus musculus
aaattttgtccgtgctgtatccgtg

SEQ ID NO: 25527 - DNA, 25 bp, Mus musculus
aaattttgtctgaaactggcacaat

SEQ ID NO: 25528 - DNA, 25 bp, Mus musculus
aaattttgtctgtaactggcacaat

SEQ ID NO: 25529 - DNA, 25 bp, Mus musculus
aaatttttaccaaataagaagacat

SEQ ID NO: 25530 - DNA, 25 bp, Mus musculus
aaatttttaccatataagaagacat

SEQ ID NO: 25531 - DNA, 25 bp, Mus musculus
aaatttttcacaatccgagcaaggg

SEQ ID NO: 25532 - DNA, 25 bp, Mus musculus
aaatttttcacattccgagcaaggg

SEQ ID NO: 25533 - DNA, 25 bp, Mus musculus
aaatttttccatcaggtagtttcag

SEQ ID NO: 25534 - DNA, 25 bp, Mus musculus
aaatttttccatgaggtagtttcag

SEQ ID NO: 25535 - DNA, 25 bp, Mus musculus
aaatttttccttctgtgagcactat

SEQ ID NO: 25536 - DNA, 25 bp, Mus musculus
aaatttttccttgtgtgagcactat

SEQ ID NO: 25537 - DNA, 25 bp, Mus musculus
aaatttttctgtcctccccatatga

SEQ ID NO: 25538 - DNA, 25 bp, Mus musculus
aaatttttctgtgctccccatatga

SEQ ID NO: 25539 - DNA, 25 bp, Mus musculus
aaatttttgctaagatccacaactt

SEQ ID NO: 25540 - DNA, 25 bp, Mus musculus
aaatttttgctatgatccacaactt

SEQ ID NO: 25541 - DNA, 25 bp, Mus musculus
aaatttttgtatcctgtcaaatgga

SEQ ID NO: 25542 - DNA, 25 bp, Mus musculus
aaatttttgtatgctgtcaaatgga

SEQ ID NO: 25543 - DNA, 25 bp, Mus musculus
aaatttttgtgcatgctttagggtt

SEQ ID NO: 25544 - DNA, 25 bp, Mus musculus
aaatttttgtgcttgctttagggtt

SEQ ID NO: 25545 - DNA, 25 bp, Mus musculus
aaatttttgtgtctccatagggata

SEQ ID NO: 25546 - DNA, 25 bp, Mus musculus
aaatttttgtgtgtccatagggata

SEQ ID NO: 25547 - DNA, 25 bp, Mus musculus
aaattttttcatataacggcagctg

SEQ ID NO: 25548 - DNA, 25 bp, Mus musculus
aaattttttcatttaacggcagctg

SEQ ID NO: 25549 - DNA, 25 bp, Mus musculus
aaattttttgcaagcccatgagcat

SEQ ID NO: 25550 - DNA, 25 bp, Mus musculus
aaattttttgcatgcccatgagcat

SEQ ID NO: 25551 - DNA, 25 bp, Mus musculus
aacaaaacaacaagctgataaggat

SEQ ID NO: 25552 - DNA, 25 bp, Mus musculus
aacaaaacaacatgctgataaggat

SEQ ID NO: 25553 - DNA, 25 bp, Mus musculus
aacaaaacaactctgcactggcttc

SEQ ID NO: 25554 - DNA, 25 bp, Mus musculus
aacaaaacaactgtgcactggcttc

SEQ ID NO: 25555 - DNA, 25 bp, Mus musculus
aacaaaacacacacgatactcaggg

SEQ ID NO: 25556 - DNA, 25 bp, Mus musculus
aacaaaacacactcgatactcaggg

SEQ ID NO: 25557 - DNA, 25 bp, Mus musculus
aacaaaacagaaacctagcactagt

SEQ ID NO: 25558 - DNA, 25 bp, Mus musculus
aacaaaacagaatcctagcactagt

SEQ ID NO: 25559 - DNA, 25 bp, Mus musculus
aacaaaaccacaacagattgttggg

SEQ ID NO: 25560 - DNA, 25 bp, Mus musculus
aacaaaaccacatcagattgttggg

SEQ ID NO: 25561 - DNA, 25 bp, Mus musculus
aacaaaaccagcagcggcagcactt

SEQ ID NO: 25562 - DNA, 25 bp, Mus musculus
aacaaaaccagctgcggcagcactt

SEQ ID NO: 25563 - DNA, 25 bp, Mus musculus
aacaaaactagcattacttgagaga

SEQ ID NO: 25564 - DNA, 25 bp, Mus musculus
aacaaaactagctttacttgagaga

SEQ ID NO: 25565 - DNA, 25 bp, Mus musculus
aacaaaactgtacctgctgaagcac

SEQ ID NO: 25566 - DNA, 25 bp, Mus musculus
aacaaaactgtagctgctgaagcac

SEQ ID NO: 25567 - DNA, 25 bp, Mus musculus
aacaaaagaataccagctgctcagt

SEQ ID NO: 25568 - DNA, 25 bp, Mus musculus
aacaaaagaatagcagctgctcagt

SEQ ID NO: 25569 - DNA, 25 bp, Mus musculus
aacaaaagactgctgactatcatga

SEQ ID NO: 25570 - DNA, 25 bp, Mus musculus
aacaaaagactggtgactatcatga

SEQ ID NO: 25571 - DNA, 25 bp, Mus musculus
aacaaaagagagacacccgcaccac

SEQ ID NO: 25572 - DNA, 25 bp, Mus musculus
aacaaaagagagtcacccgcaccac

SEQ ID NO: 25573 - DNA, 25 bp, Mus musculus
aacaaaagcggcatgcggcgcgcat

SEQ ID NO: 25574 - DNA, 25 bp, Mus musculus
aacaaaagcggcttgcggcgcgcat

SEQ ID NO: 25575 - DNA, 25 bp, Mus musculus
aacaaaagctttaggctgaagatca

SEQ ID NO: 25576 - DNA, 25 bp, Mus musculus
aacaaaagcttttggctgaagatca

SEQ ID NO: 25577 - DNA, 25 bp, Mus musculus
aacaaaaggcctaagagtcatctct

SEQ ID NO: 25578 - DNA, 25 bp, Mus musculus
aacaaaaggccttagagtcatctct

SEQ ID NO: 25579 - DNA, 25 bp, Mus musculus
aacaaaagtcccctcatgcggaggt

SEQ ID NO: 25580 - DNA, 25 bp, Mus musculus
aacaaaagtcccgtcatgcggaggt

SEQ ID NO: 25581 - DNA, 25 bp, Mus musculus
aacaaaatacttctgctgacctaat

SEQ ID NO: 25582 - DNA, 25 bp, Mus musculus
aacaaaatacttgtgctgacctaat

SEQ ID NO: 25583 - DNA, 25 bp, Mus musculus
aacaaaatccaaacacttcacagct

SEQ ID NO: 25584 - DNA, 25 bp, Mus musculus
aacaaaatccaatcacttcacagct

SEQ ID NO: 25585 - DNA, 25 bp, Mus musculus
aacaaaatccctccattattaatga

SEQ ID NO: 25586 - DNA, 25 bp, Mus musculus
aacaaaatccctgcattattaatga

SEQ ID NO: 25587 - DNA, 25 bp, Mus musculus
aacaaaatcgcaacttcttttccct

SEQ ID NO: 25588 - DNA, 25 bp, Mus musculus
aacaaaatcgcatcttcttttccct

SEQ ID NO: 25589 - DNA, 25 bp, Mus musculus
aacaaaatgggtaccaggctagcct

SEQ ID NO: 25590 - DNA, 25 bp, Mus musculus
aacaaaatgggttccaggctagcct

SEQ ID NO: 25591 - DNA, 25 bp, Mus musculus
aacaaaatgtatacactcttctttg

SEQ ID NO: 25592 - DNA, 25 bp, Mus musculus
aacaaaatgtattcactcttctttg

SEQ ID NO: 25593 - DNA, 25 bp, Mus musculus
aacaaaattccaaccacgttccatg

SEQ ID NO: 25594 - DNA, 25 bp, Mus musculus
aacaaaattccatccacgttccatg

SEQ ID NO: 25595 - DNA, 25 bp, Mus musculus
aacaaaatttcaacacgcccttgag

SEQ ID NO: 25596 - DNA, 25 bp, Mus musculus
aacaaaatttcatcacgcccttgag

SEQ ID NO: 25597 - DNA, 25 bp, Mus musculus
aacaaacacacaatgtgccttcatg

SEQ ID NO: 25598 - DNA, 25 bp, Mus musculus
aacaaacacacacatagtgctggag

SEQ ID NO: 25599 - DNA, 25 bp, Mus musculus
aacaaacacacagatagtgctggag

SEQ ID NO: 25600 - DNA, 25 bp, Mus musculus
aacaaacacacattgtgccttcatg

SEQ ID NO: 25601 - DNA, 25 bp, Mus musculus
aacaaacagagtccctgctcgctag

SEQ ID NO: 25602 - DNA, 25 bp, Mus musculus
aacaaacagagtgcctgctcgctag

SEQ ID NO: 25603 - DNA, 25 bp, Mus musculus
aacaaacagatgaccatttcttcta

SEQ ID NO: 25604 - DNA, 25 bp, Mus musculus
aacaaacagatgtccatttcttcta

SEQ ID NO: 25605 - DNA, 25 bp, Mus musculus
aacaaacagccgactacagccacgt

SEQ ID NO: 25606 - DNA, 25 bp, Mus musculus
aacaaacagccgtctacagccacgt

SEQ ID NO: 25607 - DNA, 25 bp, Mus musculus
aacaaacagcctatataggatatgc

SEQ ID NO: 25608 - DNA, 25 bp, Mus musculus
aacaaacagcctttataggatatgc

SEQ ID NO: 25609 - DNA, 25 bp, Mus musculus
aacaaacagtttagagccttatgct

SEQ ID NO: 25610 - DNA, 25 bp, Mus musculus
aacaaacagttttgagccttatgct

SEQ ID NO: 25611 - DNA, 25 bp, Mus musculus
aacaaacatactcactcagctcctg

SEQ ID NO: 25612 - DNA, 25 bp, Mus musculus
aacaaacatactgactcagctcctg

SEQ ID NO: 25613 - DNA, 25 bp, Mus musculus
aacaaacatcccaagacaaccaagt

SEQ ID NO: 25614 - DNA, 25 bp, Mus musculus
aacaaacatccctagacaaccaagt

SEQ ID NO: 25615 - DNA, 25 bp, Mus musculus
aacaaacatgacaattcccaagctc

SEQ ID NO: 25616 - DNA, 25 bp, Mus musculus
aacaaacatgaccaggagtacaccc

SEQ ID NO: 25617 - DNA, 25 bp, Mus musculus
aacaaacatgacgaggagtacaccc

SEQ ID NO: 25618 - DNA, 25 bp, Mus musculus
aacaaacatgactattcccaagctc

SEQ ID NO: 25619 - DNA, 25 bp, Mus musculus
aacaaacattcaacagccatgctga

SEQ ID NO: 25620 - DNA, 25 bp, Mus musculus
aacaaacattcatcagccatgctga

SEQ ID NO: 25621 - DNA, 25 bp, Mus musculus
aacaaacatttgactgtagtcgaga

SEQ ID NO: 25622 - DNA, 25 bp, Mus musculus
aacaaacatttgtctgtagtcgaga

SEQ ID NO: 25623 - DNA, 25 bp, Mus musculus
aacaaaccagtaagacctcacgtct

SEQ ID NO: 25624 - DNA, 25 bp, Mus musculus
aacaaaccagtatgacctcacgtct

SEQ ID NO: 25625 - DNA, 25 bp, Mus musculus
aacaaaccatctaatcctatctcta

SEQ ID NO: 25626 - DNA, 25 bp, Mus musculus
aacaaaccatcttatcctatctcta

SEQ ID NO: 25627 - DNA, 25 bp, Mus musculus
aacaaaccatgtatttgatgtgtgg

SEQ ID NO: 25628 - DNA, 25 bp, Mus musculus
aacaaaccatgtttttgatgtgtgg

SEQ ID NO: 25629 - DNA, 25 bp, Mus musculus
aacaaaccctgaccttacgtggctg

SEQ ID NO: 25630 - DNA, 25 bp, Mus musculus
aacaaaccctgagcttacgtggctg

SEQ ID NO: 25631 - DNA, 25 bp, Mus musculus
aacaaaccggatcagcgtggcttca

SEQ ID NO: 25632 - DNA, 25 bp, Mus musculus
aacaaaccggatgagcgtggcttca

SEQ ID NO: 25633 - DNA, 25 bp, Mus musculus
aacaaacgcacgcaatgggcccata

SEQ ID NO: 25634 - DNA, 25 bp, Mus musculus
aacaaacgcacggaatgggcccata

SEQ ID NO: 25635 - DNA, 25 bp, Mus musculus
aacaaacggcatattggccattcag

SEQ ID NO: 25636 - DNA, 25 bp, Mus musculus
aacaaacggcattttggccattcag

SEQ ID NO: 25637 - DNA, 25 bp, Mus musculus
aacaaacgtactcaccgctgagctg

SEQ ID NO: 25638 - DNA, 25 bp, Mus musculus
aacaaacgtactgaccgctgagctg

SEQ ID NO: 25639 - DNA, 25 bp, Mus musculus
aacaaacgttggatgcgtgttgagt

SEQ ID NO: 25640 - DNA, 25 bp, Mus musculus
aacaaacgttggttgcgtgttgagt

SEQ ID NO: 25641 - DNA, 25 bp, Mus musculus
aacaaactaatcatgggctgggcgt

SEQ ID NO: 25642 - DNA, 25 bp, Mus musculus
aacaaactaatcttgggctgggcgt

SEQ ID NO: 25643 - DNA, 25 bp, Mus musculus
aacaaactgaaaatctgctcctaaa

SEQ ID NO: 25644 - DNA, 25 bp, Mus musculus
aacaaactgaaattctgctcctaaa

SEQ ID NO: 25645 - DNA, 25 bp, Mus musculus
aacaaactggaaagggaccaaacag

SEQ ID NO: 25646 - DNA, 25 bp, Mus musculus
aacaaactggaatgggaccaaacag

SEQ ID NO: 25647 - DNA, 25 bp, Mus musculus
aacaaactggatcaactggactctg

SEQ ID NO: 25648 - DNA, 25 bp, Mus musculus
aacaaactggatgaactggactctg

SEQ ID NO: 25649 - DNA, 25 bp, Mus musculus
aacaaactgtcacatcgcgggctcc

SEQ ID NO: 25650 - DNA, 25 bp, Mus musculus
aacaaactgtcagatcgcgggctcc

SEQ ID NO: 25651 - DNA, 25 bp, Mus musculus
aacaaacttagcaattggtctcatg

SEQ ID NO: 25652 - DNA, 25 bp, Mus musculus
aacaaacttagccaaagagaagact

SEQ ID NO: 25653 - DNA, 25 bp, Mus musculus
aacaaacttagcgaaagagaagact

SEQ ID NO: 25654 - DNA, 25 bp, Mus musculus
aacaaacttagctattggtctcatg

SEQ ID NO: 25655 - DNA, 25 bp, Mus musculus
aacaaacttcccaagccgagtcgat

SEQ ID NO: 25656 - DNA, 25 bp, Mus musculus
aacaaacttccctagccgagtcgat

SEQ ID NO: 25657 - DNA, 25 bp, Mus musculus
aacaaacttgaccagtgtcctcagc

SEQ ID NO: 25658 - DNA, 25 bp, Mus musculus
aacaaacttgacgagtgtcctcagc

SEQ ID NO: 25659 - DNA, 25 bp, Mus musculus
aacaaactttctccgttctatgact

SEQ ID NO: 25660 - DNA, 25 bp, Mus musculus
aacaaactttctgcgttctatgact

SEQ ID NO: 25661 - DNA, 25 bp, Mus musculus
aacaaagaaagacattggaagccct

SEQ ID NO: 25662 - DNA, 25 bp, Mus musculus
aacaaagaaagagattggaagccct

SEQ ID NO: 25663 - DNA, 25 bp, Mus musculus
aacaaagaacggcagatcactgagg

SEQ ID NO: 25664 - DNA, 25 bp, Mus musculus
aacaaagaacgggagatcactgagg

SEQ ID NO: 25665 - DNA, 25 bp, Mus musculus
aacaaagacaaccaggaattcctag

SEQ ID NO: 25666 - DNA, 25 bp, Mus musculus
aacaaagacaacgaggaattcctag

SEQ ID NO: 25667 - DNA, 25 bp, Mus musculus
aacaaagacaggatcgccagggctt

SEQ ID NO: 25668 - DNA, 25 bp, Mus musculus
aacaaagacaggttcgccagggctt

SEQ ID NO: 25669 - DNA, 25 bp, Mus musculus
aacaaagacatacagaagcttactt

SEQ ID NO: 25670 - DNA, 25 bp, Mus musculus
aacaaagacatagagaagcttactt

SEQ ID NO: 25671 - DNA, 25 bp, Mus musculus
aacaaagaccgacctgaagatatat

SEQ ID NO: 25672 - DNA, 25 bp, Mus musculus
aacaaagaccgagctgaagatatat

SEQ ID NO: 25673 - DNA, 25 bp, Mus musculus
aacaaagactgaacagccatgcctc

SEQ ID NO: 25674 - DNA, 25 bp, Mus musculus
aacaaagactgatcagccatgcctc

SEQ ID NO: 25675 - DNA, 25 bp, Mus musculus
aacaaagacttcctgcatggccggc

SEQ ID NO: 25676 - DNA, 25 bp, Mus musculus
aacaaagacttcgtgcatggccggc

SEQ ID NO: 25677 - DNA, 25 bp, Mus musculus
aacaaagagatccaggcggcccgtc

SEQ ID NO: 25678 - DNA, 25 bp, Mus musculus
aacaaagagatcgaggcggcccgtc

SEQ ID NO: 25679 - DNA, 25 bp, Mus musculus
aacaaagagtgaacagtccttctta

SEQ ID NO: 25680 - DNA, 25 bp, Mus musculus
aacaaagagtgatcagtccttctta

SEQ ID NO: 25681 - DNA, 25 bp, Mus musculus
aacaaagatcatcaggtgaatggat

SEQ ID NO: 25682 - DNA, 25 bp, Mus musculus
aacaaagatcatgaggtgaatggat

SEQ ID NO: 25683 - DNA, 25 bp, Mus musculus
aacaaagatcctctagcggcatcca

SEQ ID NO: 25684 - DNA, 25 bp, Mus musculus
aacaaagatcctgtagcggcatcca

SEQ ID NO: 25685 - DNA, 25 bp, Mus musculus
aacaaagatgacctccatgggcgca

SEQ ID NO: 25686 - DNA, 25 bp, Mus musculus
aacaaagatgacgtccatgggcgca

SEQ ID NO: 25687 - DNA, 25 bp, Mus musculus
aacaaagcatcacaccccggggcag

SEQ ID NO: 25688 - DNA, 25 bp, Mus musculus
aacaaagcatcagaccccggggcag

SEQ ID NO: 25689 - DNA, 25 bp, Mus musculus
aacaaagcctcccaaatccatgaag

SEQ ID NO: 25690 - DNA, 25 bp, Mus musculus
aacaaagcctccgaaatccatgaag

SEQ ID NO: 25691 - DNA, 25 bp, Mus musculus
aacaaagcctttcgcttgacttcta

SEQ ID NO: 25692 - DNA, 25 bp, Mus musculus
aacaaagcctttggcttgacttcta

SEQ ID NO: 25693 - DNA, 25 bp, Mus musculus
aacaaagcggtcagtcaatgcctct

SEQ ID NO: 25694 - DNA, 25 bp, Mus musculus
aacaaagcggtctgtcaatgcctct

SEQ ID NO: 25695 - DNA, 25 bp, Mus musculus
aacaaagcgtttcctcgtgttgcct

SEQ ID NO: 25696 - DNA, 25 bp, Mus musculus
aacaaagcgtttgctcgtgttgcct

SEQ ID NO: 25697 - DNA, 25 bp, Mus musculus
aacaaagctctccaggtcttattct

SEQ ID NO: 25698 - DNA, 25 bp, Mus musculus
aacaaagctctcgaggtcttattct

SEQ ID NO: 25699 - DNA, 25 bp, Mus musculus
aacaaagctctgataaagtcactgt

SEQ ID NO: 25700 - DNA, 25 bp, Mus musculus
aacaaagctctgttaaagtcactgt

SEQ ID NO: 25701 - DNA, 25 bp, Mus musculus
aacaaagctgtccttacttgggaga

SEQ ID NO: 25702 - DNA, 25 bp, Mus musculus
aacaaagctgtcgttacttgggaga

SEQ ID NO: 25703 - DNA, 25 bp, Mus musculus
aacaaagcttggatccagatttgga

SEQ ID NO: 25704 - DNA, 25 bp, Mus musculus
aacaaagcttggttccagatttgga

SEQ ID NO: 25705 - DNA, 25 bp, Mus musculus
aacaaagcttgtcacttagtcttta

SEQ ID NO: 25706 - DNA, 25 bp, Mus musculus
aacaaagcttgtgacttagtcttta

SEQ ID NO: 25707 - DNA, 25 bp, Mus musculus
aacaaaggaaacatctctgtgccaa

SEQ ID NO: 25708 - DNA, 25 bp, Mus musculus
aacaaaggaaacttctctgtgccaa

SEQ ID NO: 25709 - DNA, 25 bp, Mus musculus
aacaaaggcagcagcttcagcggca

SEQ ID NO: 25710 - DNA, 25 bp, Mus musculus
aacaaaggcagctgcttcagcggca

SEQ ID NO: 25711 - DNA, 25 bp, Mus musculus
aacaaaggccctcgtccatggtctc

SEQ ID NO: 25712 - DNA, 25 bp, Mus musculus
aacaaaggccctggtccatggtctc

SEQ ID NO: 25713 - DNA, 25 bp, Mus musculus
aacaaagggtggcacttcctgtagt

SEQ ID NO: 25714 - DNA, 25 bp, Mus musculus
aacaaagggtgggacttcctgtagt

SEQ ID NO: 25715 - DNA, 25 bp, Mus musculus
aacaaaggtaccatcccttggctgg

SEQ ID NO: 25716 - DNA, 25 bp, Mus musculus
aacaaaggtaccttcccttggctgg

SEQ ID NO: 25717 - DNA, 25 bp, Mus musculus
aacaaaggtctaatcggattgcata

SEQ ID NO: 25718 - DNA, 25 bp, Mus musculus
aacaaaggtctattcggattgcata

SEQ ID NO: 25719 - DNA, 25 bp, Mus musculus
aacaaagtaagtcgagctgttcagt

SEQ ID NO: 25720 - DNA, 25 bp, Mus musculus
aacaaagtaagtggagctgttcagt

SEQ ID NO: 25721 - DNA, 25 bp, Mus musculus
aacaaagtatatcggctggtgttcc

SEQ ID NO: 25722 - DNA, 25 bp, Mus musculus
aacaaagtatatgggctggtgttcc

SEQ ID NO: 25723 - DNA, 25 bp, Mus musculus
aacaaagtcaccatggcgatatctg

SEQ ID NO: 25724 - DNA, 25 bp, Mus musculus
aacaaagtcaccttggcgatatctg

SEQ ID NO: 25725 - DNA, 25 bp, Mus musculus
aacaaagtccagataaccctcacct

SEQ ID NO: 25726 - DNA, 25 bp, Mus musculus
aacaaagtccagttaaccctcacct

SEQ ID NO: 25727 - DNA, 25 bp, Mus musculus
aacaaagtgcagatgtgccagctgg

SEQ ID NO: 25728 - DNA, 25 bp, Mus musculus
aacaaagtgcagttgtgccagctgg

SEQ ID NO: 25729 - DNA, 25 bp, Mus musculus
aacaaagtgctgattggacttgggt

SEQ ID NO: 25730 - DNA, 25 bp, Mus musculus
aacaaagtgctgtttggacttgggt

SEQ ID NO: 25731 - DNA, 25 bp, Mus musculus
aacaaagtgtgtcccttgggtgttc

SEQ ID NO: 25732 - DNA, 25 bp, Mus musculus
aacaaagtgtgtgccttgggtgttc

SEQ ID NO: 25733 - DNA, 25 bp, Mus musculus
aacaaagttgagctccggtcatcca

SEQ ID NO: 25734 - DNA, 25 bp, Mus musculus
aacaaagttgaggtccggtcatcca

SEQ ID NO: 25735 - DNA, 25 bp, Mus musculus
aacaaagtttgcagctgagacgaaa

SEQ ID NO: 25736 - DNA, 25 bp, Mus musculus
aacaaagtttgctgctgagacgaaa

SEQ ID NO: 25737 - DNA, 25 bp, Mus musculus
aacaaataaggtaggctcactggat

SEQ ID NO: 25738 - DNA, 25 bp, Mus musculus
aacaaataaggttggctcactggat

SEQ ID NO: 25739 - DNA, 25 bp, Mus musculus
aacaaatactttcttgatcaatatg

SEQ ID NO: 25740 - DNA, 25 bp, Mus musculus
aacaaatactttgttgatcaatatg

SEQ ID NO: 25741 - DNA, 25 bp, Mus musculus
aacaaatagttcatctggctcccag

SEQ ID NO: 25742 - DNA, 25 bp, Mus musculus
aacaaatagttcttctggctcccag

SEQ ID NO: 25743 - DNA, 25 bp, Mus musculus
aacaaatatgtgaagcgatctctat

SEQ ID NO: 25744 - DNA, 25 bp, Mus musculus
aacaaatatgtgtagcgatctctat

SEQ ID NO: 25745 - DNA, 25 bp, Mus musculus
aacaaatattttcgctggcgggatg

SEQ ID NO: 25746 - DNA, 25 bp, Mus musculus
aacaaatattttggctggcgggatg

SEQ ID NO: 25747 - DNA, 25 bp, Mus musculus
aacaaatcaagtactggaacccaga

SEQ ID NO: 25748 - DNA, 25 bp, Mus musculus
aacaaatcaagttctggaacccaga

SEQ ID NO: 25749 - DNA, 25 bp, Mus musculus
aacaaatcatccaaaaagctatata

SEQ ID NO: 25750 - DNA, 25 bp, Mus musculus
aacaaatcatcctaaaagctatata

SEQ ID NO: 25751 - DNA, 25 bp, Mus musculus
aacaaatcctacaatggctcagtgg

SEQ ID NO: 25752 - DNA, 25 bp, Mus musculus
aacaaatcctactatggctcagtgg

SEQ ID NO: 25753 - DNA, 25 bp, Mus musculus
aacaaatcgaatcggttctagtcat

SEQ ID NO: 25754 - DNA, 25 bp, Mus musculus
aacaaatcgaatgggttctagtcat

SEQ ID NO: 25755 - DNA, 25 bp, Mus musculus
aacaaatctcagaccctgactaaca

SEQ ID NO: 25756 - DNA, 25 bp, Mus musculus
aacaaatctcagtccctgactaaca

SEQ ID NO: 25757 - DNA, 25 bp, Mus musculus
aacaaatctgagacggatattcccg

SEQ ID NO: 25758 - DNA, 25 bp, Mus musculus
aacaaatctgagtcggatattcccg

SEQ ID NO: 25759 - DNA, 25 bp, Mus musculus
aacaaatctgtgagatctgggtgta

SEQ ID NO: 25760 - DNA, 25 bp, Mus musculus
aacaaatctgtgtgatctgggtgta

SEQ ID NO: 25761 - DNA, 25 bp, Mus musculus
aacaaatgctgcactccctggagga

SEQ ID NO: 25762 - DNA, 25 bp, Mus musculus
aacaaatgctgctctccctggagga

SEQ ID NO: 25763 - DNA, 25 bp, Mus musculus
aacaaatgcttaccatgtgcctcac

SEQ ID NO: 25764 - DNA, 25 bp, Mus musculus
aacaaatgcttagcatgtgcctcac

SEQ ID NO: 25765 - DNA, 25 bp, Mus musculus
aacaaatggagtaatcaggctgcac

SEQ ID NO: 25766 - DNA, 25 bp, Mus musculus
aacaaatggagttatcaggctgcac

SEQ ID NO: 25767 - DNA, 25 bp, Mus musculus
aacaaatggtacaggcctggagctt

SEQ ID NO: 25768 - DNA, 25 bp, Mus musculus
aacaaatggtactggcctggagctt

SEQ ID NO: 25769 - DNA, 25 bp, Mus musculus
aacaaatgtaccactcgggtcagaa

SEQ ID NO: 25770 - DNA, 25 bp, Mus musculus
aacaaatgtacctctcgggtcagaa

SEQ ID NO: 25771 - DNA, 25 bp, Mus musculus
aacaaatgtcacaggtcaaaaactg

SEQ ID NO: 25772 - DNA, 25 bp, Mus musculus
aacaaatgtcactggtcaaaaactg

SEQ ID NO: 25773 - DNA, 25 bp, Mus musculus
aacaaatgttctatcttgccgagcc

SEQ ID NO: 25774 - DNA, 25 bp, Mus musculus
aacaaatgttctttcttgccgagcc

SEQ ID NO: 25775 - DNA, 25 bp, Mus musculus
aacaaatgttgacctcgggactttg

SEQ ID NO: 25776 - DNA, 25 bp, Mus musculus
aacaaatgttgagctcgggactttg

SEQ ID NO: 25777 - DNA, 25 bp, Mus musculus
aacaaattcctgctggttcaacaat

SEQ ID NO: 25778 - DNA, 25 bp, Mus musculus
aacaaattcctggtggttcaacaat

SEQ ID NO: 25779 - DNA, 25 bp, Mus musculus
aacaaattctagacttcatgctgag

SEQ ID NO: 25780 - DNA, 25 bp, Mus musculus
aacaaattctagtcttcatgctgag

SEQ ID NO: 25781 - DNA, 25 bp, Mus musculus
aacaaattctccatgctgagggaaa

SEQ ID NO: 25782 - DNA, 25 bp, Mus musculus
aacaaattctccttgctgagggaaa

SEQ ID NO: 25783 - DNA, 25 bp, Mus musculus
aacaaattctgtcacctgcatctcc

SEQ ID NO: 25784 - DNA, 25 bp, Mus musculus
aacaaattctgtgacctgcatctcc

SEQ ID NO: 25785 - DNA, 25 bp, Mus musculus
aacaaattcttgcttgtccggcagg

SEQ ID NO: 25786 - DNA, 25 bp, Mus musculus
aacaaattcttggttgtccggcagg

SEQ ID NO: 25787 - DNA, 25 bp, Mus musculus
aacaaattgccgactacaatgccct

SEQ ID NO: 25788 - DNA, 25 bp, Mus musculus
aacaaattgccgtctacaatgccct

SEQ ID NO: 25789 - DNA, 25 bp, Mus musculus
aacaaattgtccagctgccactgga

SEQ ID NO: 25790 - DNA, 25 bp, Mus musculus
aacaaattgtcctgctgccactgga

SEQ ID NO: 25791 - DNA, 25 bp, Mus musculus
aacaaatttaggagcccctgctggc

SEQ ID NO: 25792 - DNA, 25 bp, Mus musculus
aacaaatttaggtgcccctgctggc

SEQ ID NO: 25793 - DNA, 25 bp, Mus musculus
aacaaatttgtacccctcatgagaa

SEQ ID NO: 25794 - DNA, 25 bp, Mus musculus
aacaaatttgtagccctcatgagaa

SEQ ID NO: 25795 - DNA, 25 bp, Mus musculus
aacaacaaacctatcagtgtattga

SEQ ID NO: 25796 - DNA, 25 bp, Mus musculus
aacaacaaacctttcagtgtattga

SEQ ID NO: 25797 - DNA, 25 bp, Mus musculus
aacaacaacttgctggtgacatgga

SEQ ID NO: 25798 - DNA, 25 bp, Mus musculus
aacaacaacttggtggtgacatgga

SEQ ID NO: 25799 - DNA, 25 bp, Mus musculus
aacaacaactttaattccatggata

SEQ ID NO: 25800 - DNA, 25 bp, Mus musculus
aacaacaacttttattccatggata

SEQ ID NO: 25801 - DNA, 25 bp, Mus musculus
aacaacaatgctcccagctgctgag

SEQ ID NO: 25802 - DNA, 25 bp, Mus musculus
aacaacaatgctgccagctgctgag

SEQ ID NO: 25803 - DNA, 25 bp, Mus musculus
aacaacaatgttcgctcctcatcag

SEQ ID NO: 25804 - DNA, 25 bp, Mus musculus
aacaacaatgttggctcctcatcag

SEQ ID NO: 25805 - DNA, 25 bp, Mus musculus
aacaacacagctataccgacaggat

SEQ ID NO: 25806 - DNA, 25 bp, Mus musculus
aacaacacagctttaccgacaggat

SEQ ID NO: 25807 - DNA, 25 bp, Mus musculus
aacaacaccagacgagaccagcttg

SEQ ID NO: 25808 - DNA, 25 bp, Mus musculus
aacaacaccagaggagaccagcttg

SEQ ID NO: 25809 - DNA, 25 bp, Mus musculus
aacaacaccagtaatgactgtctaa

SEQ ID NO: 25810 - DNA, 25 bp, Mus musculus
aacaacaccagttatgactgtctaa

SEQ ID NO: 25811 - DNA, 25 bp, Mus musculus
aacaacactaatcccttgctctgga

SEQ ID NO: 25812 - DNA, 25 bp, Mus musculus
aacaacactaatgccttgctctgga

SEQ ID NO: 25813 - DNA, 25 bp, Mus musculus
aacaacactactactccaagcatga

SEQ ID NO: 25814 - DNA, 25 bp, Mus musculus
aacaacactacttctccaagcatga

SEQ ID NO: 25815 - DNA, 25 bp, Mus musculus
aacaacactgacacatgctatacta

SEQ ID NO: 25816 - DNA, 25 bp, Mus musculus
aacaacactgactcatgctatacta

SEQ ID NO: 25817 - DNA, 25 bp, Mus musculus
aacaacactgtcatttgtctcctgc

SEQ ID NO: 25818 - DNA, 25 bp, Mus musculus
aacaacactgtcttttgtctcctgc

SEQ ID NO: 25819 - DNA, 25 bp, Mus musculus
aacaacacttacagtctccatgagt

SEQ ID NO: 25820 - DNA, 25 bp, Mus musculus
aacaacacttactgtctccatgagt

SEQ ID NO: 25821 - DNA, 25 bp, Mus musculus
aacaacacttgcaaggtctacccag

SEQ ID NO: 25822 - DNA, 25 bp, Mus musculus
aacaacacttgctaggtctacccag

SEQ ID NO: 25823 - DNA, 25 bp, Mus musculus
aacaacactttaacatcctccatta

SEQ ID NO: 25824 - DNA, 25 bp, Mus musculus
aacaacactttatcatcctccatta

SEQ ID NO: 25825 - DNA, 25 bp, Mus musculus
aacaacagaacacagggcaacacaa

SEQ ID NO: 25826 - DNA, 25 bp, Mus musculus
aacaacagaacagagggcaacacaa

SEQ ID NO: 25827 - DNA, 25 bp, Mus musculus
aacaacagacctacagtgtttcaac

SEQ ID NO: 25828 - DNA, 25 bp, Mus musculus
aacaacagaccttcagtgtttcaac

SEQ ID NO: 25829 - DNA, 25 bp, Mus musculus
aacaacagctaactcattgcagaag

SEQ ID NO: 25830 - DNA, 25 bp, Mus musculus
aacaacagctaagtcattgcagaag

SEQ ID NO: 25831 - DNA, 25 bp, Mus musculus
aacaacagggttatgtgcactcatt

SEQ ID NO: 25832 - DNA, 25 bp, Mus musculus
aacaacagggttttgtgcactcatt

SEQ ID NO: 25833 - DNA, 25 bp, Mus musculus
aacaacagtgtcatcttacctgaaa

SEQ ID NO: 25834 - DNA, 25 bp, Mus musculus
aacaacagtgtcttcttacctgaaa

SEQ ID NO: 25835 - DNA, 25 bp, Mus musculus
aacaacagttctagtctggtgactt

SEQ ID NO: 25836 - DNA, 25 bp, Mus musculus
aacaacagttcttgtctggtgactt

SEQ ID NO: 25837 - DNA, 25 bp, Mus musculus
aacaacatacctatttctccatcct

SEQ ID NO: 25838 - DNA, 25 bp, Mus musculus
aacaacatacctttttctccatcct

SEQ ID NO: 25839 - DNA, 25 bp, Mus musculus
aacaacatatctacagtgctctggt

SEQ ID NO: 25840 - DNA, 25 bp, Mus musculus
aacaacatatcttcagtgctctggt

SEQ ID NO: 25841 - DNA, 25 bp, Mus musculus
aacaacatcataattctgggagctg

SEQ ID NO: 25842 - DNA, 25 bp, Mus musculus
aacaacatcatatttctgggagctg

SEQ ID NO: 25843 - DNA, 25 bp, Mus musculus
aacaacatccagctccagaggcaga

SEQ ID NO: 25844 - DNA, 25 bp, Mus musculus
aacaacatccaggtccagaggcaga

SEQ ID NO: 25845 - DNA, 25 bp, Mus musculus
aacaacatcttaaggcacgctcatc

SEQ ID NO: 25846 - DNA, 25 bp, Mus musculus
aacaacatcttatggcacgctcatc

SEQ ID NO: 25847 - DNA, 25 bp, Mus musculus
aacaacatgatacgacccatgcaaa

SEQ ID NO: 25848 - DNA, 25 bp, Mus musculus
aacaacatgataggacccatgcaaa

SEQ ID NO: 25849 - DNA, 25 bp, Mus musculus
aacaacatggccacgtcctagatag

SEQ ID NO: 25850 - DNA, 25 bp, Mus musculus
aacaacatggcctcgtcctagatag

SEQ ID NO: 25851 - DNA, 25 bp, Mus musculus
aacaacatgggtccgactccgaaga

SEQ ID NO: 25852 - DNA, 25 bp, Mus musculus
aacaacatgggtgcgactccgaaga

SEQ ID NO: 25853 - DNA, 25 bp, Mus musculus
aacaacatgtctctccagaaagcta

SEQ ID NO: 25854 - DNA, 25 bp, Mus musculus
aacaacatgtctgtccagaaagcta

SEQ ID NO: 25855 - DNA, 25 bp, Mus musculus
aacaacattatgaaagtccatatgt

SEQ ID NO: 25856 - DNA, 25 bp, Mus musculus
aacaacattatgtaagtccatatgt

SEQ ID NO: 25857 - DNA, 25 bp, Mus musculus
aacaacattcctcctaaggtgcttt

SEQ ID NO: 25858 - DNA, 25 bp, Mus musculus
aacaacattcctgctaaggtgcttt

SEQ ID NO: 25859 - DNA, 25 bp, Mus musculus
aacaacattggcatggtggtcatcc

SEQ ID NO: 25860 - DNA, 25 bp, Mus musculus
aacaacattggcttggtggtcatcc

SEQ ID NO: 25861 - DNA, 25 bp, Mus musculus
aacaacatttgtcgccttctcttaa

SEQ ID NO: 25862 - DNA, 25 bp, Mus musculus
aacaacatttgtggccttctcttaa

SEQ ID NO: 25863 - DNA, 25 bp, Mus musculus
aacaaccaattaatattcacctaag

SEQ ID NO: 25864 - DNA, 25 bp, Mus musculus
aacaaccaattattattcacctaag

SEQ ID NO: 25865 - DNA, 25 bp, Mus musculus
aacaaccacataaattggtggctgg

SEQ ID NO: 25866 - DNA, 25 bp, Mus musculus
aacaaccacatatattggtggctgg

SEQ ID NO: 25867 - DNA, 25 bp, Mus musculus
aacaaccaccaaacctaggcactat

SEQ ID NO: 25868 - DNA, 25 bp, Mus musculus
aacaaccaccaatcctaggcactat

SEQ ID NO: 25869 - DNA, 25 bp, Mus musculus
aacaaccacggactagattatcata

SEQ ID NO: 25870 - DNA, 25 bp, Mus musculus
aacaaccacggagtagattatcata

SEQ ID NO: 25871 - DNA, 25 bp, Mus musculus
aacaaccacgtcagcacaggtgtgt

SEQ ID NO: 25872 - DNA, 25 bp, Mus musculus
aacaaccacgtctgcacaggtgtgt

SEQ ID NO: 25873 - DNA, 25 bp, Mus musculus
aacaaccagaagatcctcaactcaa

SEQ ID NO: 25874 - DNA, 25 bp, Mus musculus
aacaaccagaagttcctcaactcaa

SEQ ID NO: 25875 - DNA, 25 bp, Mus musculus
aacaaccagcaaattctgagtactt

SEQ ID NO: 25876 - DNA, 25 bp, Mus musculus
aacaaccagcaatttctgagtactt

SEQ ID NO: 25877 - DNA, 25 bp, Mus musculus
aacaaccagtatatcaaccatcacc

SEQ ID NO: 25878 - DNA, 25 bp, Mus musculus
aacaaccagtatttcaaccatcacc

SEQ ID NO: 25879 - DNA, 25 bp, Mus musculus
aacaaccatatcaccgtttttggat

SEQ ID NO: 25880 - DNA, 25 bp, Mus musculus
aacaaccatatctccgtttttggat

SEQ ID NO: 25881 - DNA, 25 bp, Mus musculus
aacaacccagtaagtaattcatcac

SEQ ID NO: 25882 - DNA, 25 bp, Mus musculus
aacaacccagtatgtaattcatcac

SEQ ID NO: 25883 - DNA, 25 bp, Mus musculus
aacaaccccagcaatgttcggagtt

SEQ ID NO: 25884 - DNA, 25 bp, Mus musculus
aacaaccccagctatgttcggagtt

SEQ ID NO: 25885 - DNA, 25 bp, Mus musculus
aacaaccccgggcacaggtgcagtg

SEQ ID NO: 25886 - DNA, 25 bp, Mus musculus
aacaaccccggggacaggtgcagtg

SEQ ID NO: 25887 - DNA, 25 bp, Mus musculus
aacaacccgatcaatgtacattccc

SEQ ID NO: 25888 - DNA, 25 bp, Mus musculus
aacaacccgatctatgtacattccc

SEQ ID NO: 25889 - DNA, 25 bp, Mus musculus
aacaaccctatgacatccctagaat

SEQ ID NO: 25890 - DNA, 25 bp, Mus musculus
aacaaccctatgtcatccctagaat

SEQ ID NO: 25891 - DNA, 25 bp, Mus musculus
aacaaccctcgaactgtgaggctgt

SEQ ID NO: 25892 - DNA, 25 bp, Mus musculus
aacaaccctcgatctgtgaggctgt

SEQ ID NO: 25893 - DNA, 25 bp, Mus musculus
aacaaccctgagaagaactgaggtg

SEQ ID NO: 25894 - DNA, 25 bp, Mus musculus
aacaaccctgagtagaactgaggtg

SEQ ID NO: 25895 - DNA, 25 bp, Mus musculus
aacaaccctggtctaagattacatg

SEQ ID NO: 25896 - DNA, 25 bp, Mus musculus
aacaaccctggtgtaagattacatg

SEQ ID NO: 25897 - DNA, 25 bp, Mus musculus
aacaaccctgttcgcctgttggtgc

SEQ ID NO: 25898 - DNA, 25 bp, Mus musculus
aacaaccctgttggcctgttggtgc

SEQ ID NO: 25899 - DNA, 25 bp, Mus musculus
aacaacccttttcacagtgtactgt

SEQ ID NO: 25900 - DNA, 25 bp, Mus musculus
aacaacccttttgacagtgtactgt

SEQ ID NO: 25901 - DNA, 25 bp, Mus musculus
aacaacctaaacacagactacctct

SEQ ID NO: 25902 - DNA, 25 bp, Mus musculus
aacaacctaaactcagactacctct

SEQ ID NO: 25903 - DNA, 25 bp, Mus musculus
aacaacctacccacatggaattcat

SEQ ID NO: 25904 - DNA, 25 bp, Mus musculus
aacaacctaccctcatggaattcat

SEQ ID NO: 25905 - DNA, 25 bp, Mus musculus
aacaacctattcaaggatgaaccat

SEQ ID NO: 25906 - DNA, 25 bp, Mus musculus
aacaacctattctaggatgaaccat

SEQ ID NO: 25907 - DNA, 25 bp, Mus musculus
aacaacctctgacataggtcctgag

SEQ ID NO: 25908 - DNA, 25 bp, Mus musculus
aacaacctctgagataggtcctgag

SEQ ID NO: 25909 - DNA, 25 bp, Mus musculus
aacaacctctttagaagttctcttg

SEQ ID NO: 25910 - DNA, 25 bp, Mus musculus
aacaacctcttttgaagttctcttg

SEQ ID NO: 25911 - DNA, 25 bp, Mus musculus
aacaacctgaagattgctttctgaa

SEQ ID NO: 25912 - DNA, 25 bp, Mus musculus
aacaacctgaagtttgctttctgaa

SEQ ID NO: 25913 - DNA, 25 bp, Mus musculus
aacaacctggacactggactcagtg

SEQ ID NO: 25914 - DNA, 25 bp, Mus musculus
aacaacctggactctggactcagtg

SEQ ID NO: 25915 - DNA, 25 bp, Mus musculus
aacaacctggtcattgctcattctg

SEQ ID NO: 25916 - DNA, 25 bp, Mus musculus
aacaacctggtctttgctcattctg

SEQ ID NO: 25917 - DNA, 25 bp, Mus musculus
aacaacctgtaacggctggccctgc

SEQ ID NO: 25918 - DNA, 25 bp, Mus musculus
aacaacctgtaagggctggccctgc

SEQ ID NO: 25919 - DNA, 25 bp, Mus musculus
aacaacctgtgtactcgctttgatg

SEQ ID NO: 25920 - DNA, 25 bp, Mus musculus
aacaacctgtgttctcgctttgatg

SEQ ID NO: 25921 - DNA, 25 bp, Mus musculus
aacaaccttctaagtcgtgtcactc

SEQ ID NO: 25922 - DNA, 25 bp, Mus musculus
aacaaccttctatgtcgtgtcactc

SEQ ID NO: 25923 - DNA, 25 bp, Mus musculus
aacaaccttgctagtatcagcaacg

SEQ ID NO: 25924 - DNA, 25 bp, Mus musculus
aacaaccttgcttgtatcagcaacg

SEQ ID NO: 25925 - DNA, 25 bp, Mus musculus
aacaacctttgcaaccattatatat

SEQ ID NO: 25926 - DNA, 25 bp, Mus musculus
aacaacctttgctaccattatatat

SEQ ID NO: 25927 - DNA, 25 bp, Mus musculus
aacaacctttggaggcctctgtggg

SEQ ID NO: 25928 - DNA, 25 bp, Mus musculus
aacaacctttggtggcctctgtggg

SEQ ID NO: 25929 - DNA, 25 bp, Mus musculus
aacaacgaagtcacagcttctcaga

SEQ ID NO: 25930 - DNA, 25 bp, Mus musculus
aacaacgaagtctcagcttctcaga

SEQ ID NO: 25931 - DNA, 25 bp, Mus musculus
aacaacgactatctccagtgtggga

SEQ ID NO: 25932 - DNA, 25 bp, Mus musculus
aacaacgactatgtccagtgtggga

SEQ ID NO: 25933 - DNA, 25 bp, Mus musculus
aacaacgcatgtacacttgtatatg

SEQ ID NO: 25934 - DNA, 25 bp, Mus musculus
aacaacgcatgttcacttgtatatg

SEQ ID NO: 25935 - DNA, 25 bp, Mus musculus
aacaacggaagtcccattatcctca

SEQ ID NO: 25936 - DNA, 25 bp, Mus musculus
aacaacggaagtgccattatcctca

SEQ ID NO: 25937 - DNA, 25 bp, Mus musculus
aacaacgtcaccacagaatataact

SEQ ID NO: 25938 - DNA, 25 bp, Mus musculus
aacaacgtcacctcagaatataact

SEQ ID NO: 25939 - DNA, 25 bp, Mus musculus
aacaacgtcataaggctatttcttt

SEQ ID NO: 25940 - DNA, 25 bp, Mus musculus
aacaacgtcatatggctatttcttt

SEQ ID NO: 25941 - DNA, 25 bp, Mus musculus
aacaacgtccatcaaagagctgctt

SEQ ID NO: 25942 - DNA, 25 bp, Mus musculus
aacaacgtccatgaaagagctgctt

SEQ ID NO: 25943 - DNA, 25 bp, Mus musculus
aacaacgtctagcatggctcagcaa

SEQ ID NO: 25944 - DNA, 25 bp, Mus musculus
aacaacgtctaggatggctcagcaa

SEQ ID NO: 25945 - DNA, 25 bp, Mus musculus
aacaacgtgtctccagaaactgtac

SEQ ID NO: 25946 - DNA, 25 bp, Mus musculus
aacaacgtgtctgcagaaactgtac

SEQ ID NO: 25947 - DNA, 25 bp, Mus musculus
aacaactacctgaagcttttcggca

SEQ ID NO: 25948 - DNA, 25 bp, Mus musculus
aacaactacctgtagcttttcggca

SEQ ID NO: 25949 - DNA, 25 bp, Mus musculus
aacaactagatccaaggttcggctg

SEQ ID NO: 25950 - DNA, 25 bp, Mus musculus
aacaactagatcgaaggttcggctg

SEQ ID NO: 25951 - DNA, 25 bp, Mus musculus
aacaactagctcattctcatctctg

SEQ ID NO: 25952 - DNA, 25 bp, Mus musculus
aacaactagctctttctcatctctg

SEQ ID NO: 25953 - DNA, 25 bp, Mus musculus
aacaactatatcaccacttggtaat

SEQ ID NO: 25954 - DNA, 25 bp, Mus musculus
aacaactatatctccacttggtaat

SEQ ID NO: 25955 - DNA, 25 bp, Mus musculus
aacaactcagaccatataaagaaat

SEQ ID NO: 25956 - DNA, 25 bp, Mus musculus
aacaactcagacgatataaagaaat

SEQ ID NO: 25957 - DNA, 25 bp, Mus musculus
aacaactcagagatgcggcgcgtta

SEQ ID NO: 25958 - DNA, 25 bp, Mus musculus
aacaactcagagttgcggcgcgtta

SEQ ID NO: 25959 - DNA, 25 bp, Mus musculus
aacaactcatttcctgagagggccc

SEQ ID NO: 25960 - DNA, 25 bp, Mus musculus
aacaactcatttgctgagagggccc

SEQ ID NO: 25961 - DNA, 25 bp, Mus musculus
aacaactccgcgacgtccgcttctt

SEQ ID NO: 25962 - DNA, 25 bp, Mus musculus
aacaactccgcgtcgtccgcttctt

SEQ ID NO: 25963 - DNA, 25 bp, Mus musculus
aacaactccttgaatcttatcagag

SEQ ID NO: 25964 - DNA, 25 bp, Mus musculus
aacaactccttgtatcttatcagag

SEQ ID NO: 25965 - DNA, 25 bp, Mus musculus
aacaactcgttacctgctggacaga

SEQ ID NO: 25966 - DNA, 25 bp, Mus musculus
aacaactcgttagctgctggacaga

SEQ ID NO: 25967 - DNA, 25 bp, Mus musculus
aacaactctccaagtgtagcactct

SEQ ID NO: 25968 - DNA, 25 bp, Mus musculus
aacaactctccatgtgtagcactct

SEQ ID NO: 25969 - DNA, 25 bp, Mus musculus
aacaactgaagcaaccaggcagcca

SEQ ID NO: 25970 - DNA, 25 bp, Mus musculus
aacaactgaagctaccaggcagcca

SEQ ID NO: 25971 - DNA, 25 bp, Mus musculus
aacaactgaggccttccttatttat

SEQ ID NO: 25972 - DNA, 25 bp, Mus musculus
aacaactgaggcgttccttatttat

SEQ ID NO: 25973 - DNA, 25 bp, Mus musculus
aacaactgcagaaggctaacagcta

SEQ ID NO: 25974 - DNA, 25 bp, Mus musculus
aacaactgcagatggctaacagcta

SEQ ID NO: 25975 - DNA, 25 bp, Mus musculus
aacaactgccggagatactggtagt

SEQ ID NO: 25976 - DNA, 25 bp, Mus musculus
aacaactgccggtgatactggtagt

SEQ ID NO: 25977 - DNA, 25 bp, Mus musculus
aacaactgctaacctggagacctcc

SEQ ID NO: 25978 - DNA, 25 bp, Mus musculus
aacaactgctaagctggagacctcc

SEQ ID NO: 25979 - DNA, 25 bp, Mus musculus
aacaactgctgtattaactgtcatt

SEQ ID NO: 25980 - DNA, 25 bp, Mus musculus
aacaactgctgttttaactgtcatt

SEQ ID NO: 25981 - DNA, 25 bp, Mus musculus
aacaactgcttgcagacctgaaact

SEQ ID NO: 25982 - DNA, 25 bp, Mus musculus
aacaactgcttggagacctgaaact

SEQ ID NO: 25983 - DNA, 25 bp, Mus musculus
aacaactggacgatctgaaggtgga

SEQ ID NO: 25984 - DNA, 25 bp, Mus musculus
aacaactggacgttctgaaggtgga

SEQ ID NO: 25985 - DNA, 25 bp, Mus musculus
aacaactgtctgctttcttcataag

SEQ ID NO: 25986 - DNA, 25 bp, Mus musculus
aacaactgtctggtttcttcataag

SEQ ID NO: 25987 - DNA, 25 bp, Mus musculus
aacaactgtgtgctgtcattaataa

SEQ ID NO: 25988 - DNA, 25 bp, Mus musculus
aacaactgtgtggtgtcattaataa

SEQ ID NO: 25989 - DNA, 25 bp, Mus musculus
aacaactgttagcttttgctcacgt

SEQ ID NO: 25990 - DNA, 25 bp, Mus musculus
aacaactgttaggttttgctcacgt

SEQ ID NO: 25991 - DNA, 25 bp, Mus musculus
aacaacttacctcacagggcctgtg

SEQ ID NO: 25992 - DNA, 25 bp, Mus musculus
aacaacttacctgacagggcctgtg

SEQ ID NO: 25993 - DNA, 25 bp, Mus musculus
aacaacttcatgatgcgcataggca

SEQ ID NO: 25994 - DNA, 25 bp, Mus musculus
aacaacttcatgttgcgcataggca

SEQ ID NO: 25995 - DNA, 25 bp, Mus musculus
aacaacttcctacaacattgtggtg

SEQ ID NO: 25996 - DNA, 25 bp, Mus musculus
aacaacttcctagaacattgtggtg

SEQ ID NO: 25997 - DNA, 25 bp, Mus musculus
aacaacttctaaattccttcactgg

SEQ ID NO: 25998 - DNA, 25 bp, Mus musculus
aacaacttctaatttccttcactgg

SEQ ID NO: 25999 - DNA, 25 bp, Mus musculus
aacaacttctccattttggccaagg

SEQ ID NO: 26000 - DNA, 25 bp, Mus musculus
aacaacttctcctttttggccaagg

SEQ ID NO: 26001 - DNA, 25 bp, Mus musculus
aacaacttctgtcccttcaatctga

SEQ ID NO: 26002 - DNA, 25 bp, Mus musculus
aacaacttctgtgccttcaatctga

SEQ ID NO: 26003 - DNA, 25 bp, Mus musculus
aacaacttgaaaccagctcacaaag

SEQ ID NO: 26004 - DNA, 25 bp, Mus musculus
aacaacttgaaagcagctcacaaag

SEQ ID NO: 26005 - DNA, 25 bp, Mus musculus
aacaacttgagcaacactggagggc

SEQ ID NO: 26006 - DNA, 25 bp, Mus musculus
aacaacttgagctacactggagggc

SEQ ID NO: 26007 - DNA, 25 bp, Mus musculus
aacaacttgctcatctcttgcgctg

SEQ ID NO: 26008 - DNA, 25 bp, Mus musculus
aacaacttgctcttctcttgcgctg

SEQ ID NO: 26009 - DNA, 25 bp, Mus musculus
aacaactttagacttcccactgcca

SEQ ID NO: 26010 - DNA, 25 bp, Mus musculus
aacaactttagagttcccactgcca

SEQ ID NO: 26011 - DNA, 25 bp, Mus musculus
aacaactttcatctctatcaacggg

SEQ ID NO: 26012 - DNA, 25 bp, Mus musculus
aacaactttcatgtctatcaacggg

SEQ ID NO: 26013 - DNA, 25 bp, Mus musculus
aacaactttctgaggcgaaagcaag

SEQ ID NO: 26014 - DNA, 25 bp, Mus musculus
aacaactttctgtggcgaaagcaag

SEQ ID NO: 26015 - DNA, 25 bp, Mus musculus
aacaactttttcctcatcttaggat

SEQ ID NO: 26016 - DNA, 25 bp, Mus musculus
aacaactttttcgtcatcttaggat

SEQ ID NO: 26017 - DNA, 25 bp, Mus musculus
aacaagaaaatcactcatacgcata

SEQ ID NO: 26018 - DNA, 25 bp, Mus musculus
aacaagaaaatctctcatacgcata

SEQ ID NO: 26019 - DNA, 25 bp, Mus musculus
aacaagaaacacctgtccagaccgg

SEQ ID NO: 26020 - DNA, 25 bp, Mus musculus
aacaagaaacacgtgtccagaccgg

SEQ ID NO: 26021 - DNA, 25 bp, Mus musculus
aacaagaaacttcgccaaagcaaat

SEQ ID NO: 26022 - DNA, 25 bp, Mus musculus
aacaagaaacttggccaaagcaaat

SEQ ID NO: 26023 - DNA, 25 bp, Mus musculus
aacaagaacaccagtcctggagacc

SEQ ID NO: 26024 - DNA, 25 bp, Mus musculus
aacaagaacacctgtcctggagacc

SEQ ID NO: 26025 - DNA, 25 bp, Mus musculus
aacaagaacagcacttatctctctg

SEQ ID NO: 26026 - DNA, 25 bp, Mus musculus
aacaagaacagctcttatctctctg

SEQ ID NO: 26027 - DNA, 25 bp, Mus musculus
aacaagaactcaatgcctgggagaa

SEQ ID NO: 26028 - DNA, 25 bp, Mus musculus
aacaagaactcattgcctgggagaa

SEQ ID NO: 26029 - DNA, 25 bp, Mus musculus
aacaagaactgacacgctgacaccc

SEQ ID NO: 26030 - DNA, 25 bp, Mus musculus
aacaagaactgagacgctgacaccc

SEQ ID NO: 26031 - DNA, 25 bp, Mus musculus
aacaagaagcagatcaccattcccc

SEQ ID NO: 26032 - DNA, 25 bp, Mus musculus
aacaagaagcagttcaccattcccc

SEQ ID NO: 26033 - DNA, 25 bp, Mus musculus
aacaagaatgtgagggttgccctag

SEQ ID NO: 26034 - DNA, 25 bp, Mus musculus
aacaagaatgtgtgggttgccctag

SEQ ID NO: 26035 - DNA, 25 bp, Mus musculus
aacaagacagttacgcccaatagat

SEQ ID NO: 26036 - DNA, 25 bp, Mus musculus
aacaagacagtttcgcccaatagat

SEQ ID NO: 26037 - DNA, 25 bp, Mus musculus
aacaagacatttacatattggattc

SEQ ID NO: 26038 - DNA, 25 bp, Mus musculus
aacaagacattttcatattggattc

SEQ ID NO: 26039 - DNA, 25 bp, Mus musculus
aacaagaccatgagccaagctcagg

SEQ ID NO: 26040 - DNA, 25 bp, Mus musculus
aacaagaccatgtgccaagctcagg

SEQ ID NO: 26041 - DNA, 25 bp, Mus musculus
aacaagacctggctccagatgggcg

SEQ ID NO: 26042 - DNA, 25 bp, Mus musculus
aacaagacctgggtccagatgggcg

SEQ ID NO: 26043 - DNA, 25 bp, Mus musculus
aacaagacctgtatgtaagcagttt

SEQ ID NO: 26044 - DNA, 25 bp, Mus musculus
aacaagacctgtttgtaagcagttt

SEQ ID NO: 26045 - DNA, 25 bp, Mus musculus
aacaagacgcagatcttcgagcagc

SEQ ID NO: 26046 - DNA, 25 bp, Mus musculus
aacaagacgcagttcttcgagcagc

SEQ ID NO: 26047 - DNA, 25 bp, Mus musculus
aacaagacttggcatagtggcacac

SEQ ID NO: 26048 - DNA, 25 bp, Mus musculus
aacaagacttgggatagtggcacac

SEQ ID NO: 26049 - DNA, 25 bp, Mus musculus
aacaagagacccctgtctgacagtc

SEQ ID NO: 26050 - DNA, 25 bp, Mus musculus
aacaagagacccgtgtctgacagtc

SEQ ID NO: 26051 - DNA, 25 bp, Mus musculus
aacaagagcaacagcgcgcgggatc

SEQ ID NO: 26052 - DNA, 25 bp, Mus musculus
aacaagagcaactgcgcgcgggatc

SEQ ID NO: 26053 - DNA, 25 bp, Mus musculus
aacaagagccagaggtgtatttaag

SEQ ID NO: 26054 - DNA, 25 bp, Mus musculus
aacaagagccagtggtgtatttaag

SEQ ID NO: 26055 - DNA, 25 bp, Mus musculus
aacaagagcccaagtctcctgaaca

SEQ ID NO: 26056 - DNA, 25 bp, Mus musculus
aacaagagcccatgtctcctgaaca

SEQ ID NO: 26057 - DNA, 25 bp, Mus musculus
aacaagagctgcaagaaccaagccc

SEQ ID NO: 26058 - DNA, 25 bp, Mus musculus
aacaagagctgctagaaccaagccc

SEQ ID NO: 26059 - DNA, 25 bp, Mus musculus
aacaagagctggaaaccctgctgct

SEQ ID NO: 26060 - DNA, 25 bp, Mus musculus
aacaagagctggtaaccctgctgct

SEQ ID NO: 26061 - DNA, 25 bp, Mus musculus
aacaagagtgatacttgctgctatt

SEQ ID NO: 26062 - DNA, 25 bp, Mus musculus
aacaagagtgattcttgctgctatt

SEQ ID NO: 26063 - DNA, 25 bp, Mus musculus
aacaagagtgctatgacttcccagg

SEQ ID NO: 26064 - DNA, 25 bp, Mus musculus
aacaagagtgctttgacttcccagg

SEQ ID NO: 26065 - DNA, 25 bp, Mus musculus
aacaagagttacacaccggcttcac

SEQ ID NO: 26066 - DNA, 25 bp, Mus musculus
aacaagagttactcaccggcttcac

SEQ ID NO: 26067 - DNA, 25 bp, Mus musculus
aacaagatacataaactctcagcat

SEQ ID NO: 26068 - DNA, 25 bp, Mus musculus
aacaagatacattaactctcagcat

SEQ ID NO: 26069 - DNA, 25 bp, Mus musculus
aacaagatatctccagcctgccgaa

SEQ ID NO: 26070 - DNA, 25 bp, Mus musculus
aacaagatatctgcagcctgccgaa

SEQ ID NO: 26071 - DNA, 25 bp, Mus musculus
aacaagatcggcaaaaggactacat

SEQ ID NO: 26072 - DNA, 25 bp, Mus musculus
aacaagatcggctaaaggactacat

SEQ ID NO: 26073 - DNA, 25 bp, Mus musculus
aacaagatctatcagcttacgctgg

SEQ ID NO: 26074 - DNA, 25 bp, Mus musculus
aacaagatctatgagcttacgctgg

SEQ ID NO: 26075 - DNA, 25 bp, Mus musculus
aacaagatctcaatccatgacccag

SEQ ID NO: 26076 - DNA, 25 bp, Mus musculus
aacaagatctcattccatgacccag

SEQ ID NO: 26077 - DNA, 25 bp, Mus musculus
aacaagatctctagcctgaaacgga

SEQ ID NO: 26078 - DNA, 25 bp, Mus musculus
aacaagatctcttgcctgaaacgga

SEQ ID NO: 26079 - DNA, 25 bp, Mus musculus
aacaagatggtgagcagccttggaa

SEQ ID NO: 26080 - DNA, 25 bp, Mus musculus
aacaagatggtgtgcagccttggaa

SEQ ID NO: 26081 - DNA, 25 bp, Mus musculus
aacaagatgtccacctgaaaacaga

SEQ ID NO: 26082 - DNA, 25 bp, Mus musculus
aacaagatgtcctcctgaaaacaga

SEQ ID NO: 26083 - DNA, 25 bp, Mus musculus
aacaagattctacaggcccggcaac

SEQ ID NO: 26084 - DNA, 25 bp, Mus musculus
aacaagattctacctgtcattcctc

SEQ ID NO: 26085 - DNA, 25 bp, Mus musculus
aacaagattctagaggcccggcaac

SEQ ID NO: 26086 - DNA, 25 bp, Mus musculus
aacaagattctagctgtcattcctc

SEQ ID NO: 26087 - DNA, 25 bp, Mus musculus
aacaagcaagctatcatccattttt

SEQ ID NO: 26088 - DNA, 25 bp, Mus musculus
aacaagcaagctttcatccattttt

SEQ ID NO: 26089 - DNA, 25 bp, Mus musculus
aacaagcaatgtaaccgtggatgta

SEQ ID NO: 26090 - DNA, 25 bp, Mus musculus
aacaagcaatgttaccgtggatgta

SEQ ID NO: 26091 - DNA, 25 bp, Mus musculus
aacaagcacaccatttcagttcttc

SEQ ID NO: 26092 - DNA, 25 bp, Mus musculus
aacaagcacaccttttcagttcttc

SEQ ID NO: 26093 - DNA, 25 bp, Mus musculus
aacaagcaccaaatccaaccataat

SEQ ID NO: 26094 - DNA, 25 bp, Mus musculus
aacaagcaccaattccaaccataat

SEQ ID NO: 26095 - DNA, 25 bp, Mus musculus
aacaagcactgtatctactctaaaa

SEQ ID NO: 26096 - DNA, 25 bp, Mus musculus
aacaagcactgtttctactctaaaa

SEQ ID NO: 26097 - DNA, 25 bp, Mus musculus
aacaagcacttgactgaccagcagc

SEQ ID NO: 26098 - DNA, 25 bp, Mus musculus
aacaagcacttgtctgaccagcagc

SEQ ID NO: 26099 - DNA, 25 bp, Mus musculus
aacaagcagagacaagcatccgcct

SEQ ID NO: 26100 - DNA, 25 bp, Mus musculus
aacaagcagagagaagcatccgcct

SEQ ID NO: 26101 - DNA, 25 bp, Mus musculus
aacaagcagccgcaggagcagtatg

SEQ ID NO: 26102 - DNA, 25 bp, Mus musculus
aacaagcagccggaggagcagtatg

SEQ ID NO: 26103 - DNA, 25 bp, Mus musculus
aacaagcaggtcatccgggtctaca

SEQ ID NO: 26104 - DNA, 25 bp, Mus musculus
aacaagcaggtcttccgggtctaca

SEQ ID NO: 26105 - DNA, 25 bp, Mus musculus
aacaagcatctactggctgcgggag

SEQ ID NO: 26106 - DNA, 25 bp, Mus musculus
aacaagcatctagtggctgcgggag

SEQ ID NO: 26107 - DNA, 25 bp, Mus musculus
aacaagccactaccaaacagttaat

SEQ ID NO: 26108 - DNA, 25 bp, Mus musculus
aacaagccactagcaaacagttaat

SEQ ID NO: 26109 - DNA, 25 bp, Mus musculus
aacaagccagggacttctgaagcca

SEQ ID NO: 26110 - DNA, 25 bp, Mus musculus
aacaagccagggtcttctgaagcca

SEQ ID NO: 26111 - DNA, 25 bp, Mus musculus
aacaagccattgagtagcaaaagag

SEQ ID NO: 26112 - DNA, 25 bp, Mus musculus
aacaagccattgtgtagcaaaagag

SEQ ID NO: 26113 - DNA, 25 bp, Mus musculus
aacaagccatttatcaacttcccag

SEQ ID NO: 26114 - DNA, 25 bp, Mus musculus
aacaagccatttttcaacttcccag

SEQ ID NO: 26115 - DNA, 25 bp, Mus musculus
aacaagccgagtaggtgagcctcca

SEQ ID NO: 26116 - DNA, 25 bp, Mus musculus
aacaagccgagttggtgagcctcca

SEQ ID NO: 26117 - DNA, 25 bp, Mus musculus
aacaagcctccacctgcaaggcaaa

SEQ ID NO: 26118 - DNA, 25 bp, Mus musculus
aacaagcctccagctgcaaggcaaa

SEQ ID NO: 26119 - DNA, 25 bp, Mus musculus
aacaagcctgccaacgagatcaaca

SEQ ID NO: 26120 - DNA, 25 bp, Mus musculus
aacaagcctgcctacgagatcaaca

SEQ ID NO: 26121 - DNA, 25 bp, Mus musculus
aacaagccttgcctagaaattggta

SEQ ID NO: 26122 - DNA, 25 bp, Mus musculus
aacaagccttgcgtagaaattggta

SEQ ID NO: 26123 - DNA, 25 bp, Mus musculus
aacaagcgacctctggcaggacatt

SEQ ID NO: 26124 - DNA, 25 bp, Mus musculus
aacaagcgacctgtggcaggacatt

SEQ ID NO: 26125 - DNA, 25 bp, Mus musculus
aacaagcgagttatcatgctgaccc

SEQ ID NO: 26126 - DNA, 25 bp, Mus musculus
aacaagcgagttttcatgctgaccc

SEQ ID NO: 26127 - DNA, 25 bp, Mus musculus
aacaagcgggcaccacagatggact

SEQ ID NO: 26128 - DNA, 25 bp, Mus musculus
aacaagcgggcagcacagatggact

SEQ ID NO: 26129 - DNA, 25 bp, Mus musculus
aacaagctaaggcacagctggcagt

SEQ ID NO: 26130 - DNA, 25 bp, Mus musculus
aacaagctaagggacagctggcagt

SEQ ID NO: 26131 - DNA, 25 bp, Mus musculus
aacaagctcaagaactcactcacac

SEQ ID NO: 26132 - DNA, 25 bp, Mus musculus
aacaagctcaagtactcactcacac

SEQ ID NO: 26133 - DNA, 25 bp, Mus musculus
aacaagctcatgcttggcaagagga

SEQ ID NO: 26134 - DNA, 25 bp, Mus musculus
aacaagctcatggttggcaagagga

SEQ ID NO: 26135 - DNA, 25 bp, Mus musculus
aacaagctccttactcagggactgg

SEQ ID NO: 26136 - DNA, 25 bp, Mus musculus
aacaagctcctttctcagggactgg

SEQ ID NO: 26137 - DNA, 25 bp, Mus musculus
aacaagctctctcctgacttgtatt

SEQ ID NO: 26138 - DNA, 25 bp, Mus musculus
aacaagctctctgctgacttgtatt

SEQ ID NO: 26139 - DNA, 25 bp, Mus musculus
aacaagctctttaaactccacagtg

SEQ ID NO: 26140 - DNA, 25 bp, Mus musculus
aacaagctcttttaactccacagtg

SEQ ID NO: 26141 - DNA, 25 bp, Mus musculus
aacaagctgcctctggttagcttac

SEQ ID NO: 26142 - DNA, 25 bp, Mus musculus
aacaagctgcctgtggttagcttac

SEQ ID NO: 26143 - DNA, 25 bp, Mus musculus
aacaagctgggtaacatgctccacg

SEQ ID NO: 26144 - DNA, 25 bp, Mus musculus
aacaagctgggttacatgctccacg

SEQ ID NO: 26145 - DNA, 25 bp, Mus musculus
aacaagctggtcactgtactctacg

SEQ ID NO: 26146 - DNA, 25 bp, Mus musculus
aacaagctggtctctgtactctacg

SEQ ID NO: 26147 - DNA, 25 bp, Mus musculus
aacaagctgtaaaagcccatcccct

SEQ ID NO: 26148 - DNA, 25 bp, Mus musculus
aacaagctgtaatagcccatcccct

SEQ ID NO: 26149 - DNA, 25 bp, Mus musculus
aacaagctgtgcagtgagggcctag

SEQ ID NO: 26150 - DNA, 25 bp, Mus musculus
aacaagctgtgctgtgagggcctag

SEQ ID NO: 26151 - DNA, 25 bp, Mus musculus
aacaagctgtgtacctattggttca

SEQ ID NO: 26152 - DNA, 25 bp, Mus musculus
aacaagctgtgttcctattggttca

SEQ ID NO: 26153 - DNA, 25 bp, Mus musculus
aacaagcttagtagcaaacgaataa

SEQ ID NO: 26154 - DNA, 25 bp, Mus musculus
aacaagcttagttgcaaacgaataa

SEQ ID NO: 26155 - DNA, 25 bp, Mus musculus
aacaagcttattcttctacaccaca

SEQ ID NO: 26156 - DNA, 25 bp, Mus musculus
aacaagcttattgttctacaccaca

SEQ ID NO: 26157 - DNA, 25 bp, Mus musculus
aacaagcttcacactgtttacgagg

SEQ ID NO: 26158 - DNA, 25 bp, Mus musculus
aacaagcttcactctgtttacgagg

SEQ ID NO: 26159 - DNA, 25 bp, Mus musculus
aacaagcttcgcaagtgtttacagc

SEQ ID NO: 26160 - DNA, 25 bp, Mus musculus
aacaagcttcgctagtgtttacagc

SEQ ID NO: 26161 - DNA, 25 bp, Mus musculus
aacaagcttgctatgcggtttgcct

SEQ ID NO: 26162 - DNA, 25 bp, Mus musculus
aacaagcttgctttgcggtttgcct

SEQ ID NO: 26163 - DNA, 25 bp, Mus musculus
aacaagcttgttctggtgacttagg

SEQ ID NO: 26164 - DNA, 25 bp, Mus musculus
aacaagcttgttgtggtgacttagg

SEQ ID NO: 26165 - DNA, 25 bp, Mus musculus
aacaagctttaaaggtctcaagcat

SEQ ID NO: 26166 - DNA, 25 bp, Mus musculus
aacaagctttaatggtctcaagcat

SEQ ID NO: 26167 - DNA, 25 bp, Mus musculus
aacaaggaacagcagctgaaacttc

SEQ ID NO: 26168 - DNA, 25 bp, Mus musculus
aacaaggaacaggagctgaaacttc

SEQ ID NO: 26169 - DNA, 25 bp, Mus musculus
aacaaggacactcgcacgtacgagg

SEQ ID NO: 26170 - DNA, 25 bp, Mus musculus
aacaaggacactggcacgtacgagg

SEQ ID NO: 26171 - DNA, 25 bp, Mus musculus
aacaaggacattccggaccatggat

SEQ ID NO: 26172 - DNA, 25 bp, Mus musculus
aacaaggacattgcggaccatggat

SEQ ID NO: 26173 - DNA, 25 bp, Mus musculus
aacaaggacctgaggtggagcctgc

SEQ ID NO: 26174 - DNA, 25 bp, Mus musculus
aacaaggacctgtggtggagcctgc

SEQ ID NO: 26175 - DNA, 25 bp, Mus musculus
aacaaggactgcatccaaattccaa

SEQ ID NO: 26176 - DNA, 25 bp, Mus musculus
aacaaggactgcatggtgtcccgtg

SEQ ID NO: 26177 - DNA, 25 bp, Mus musculus
aacaaggactgcttccaaattccaa

SEQ ID NO: 26178 - DNA, 25 bp, Mus musculus
aacaaggactgcttggtgtcccgtg

SEQ ID NO: 26179 - DNA, 25 bp, Mus musculus
aacaaggagaagacggctcagccca

SEQ ID NO: 26180 - DNA, 25 bp, Mus musculus
aacaaggagaagtcggctcagccca

SEQ ID NO: 26181 - DNA, 25 bp, Mus musculus
aacaaggagctgcagggttccatta

SEQ ID NO: 26182 - DNA, 25 bp, Mus musculus
aacaaggagctggagggttccatta

SEQ ID NO: 26183 - DNA, 25 bp, Mus musculus
aacaaggataccaaggacgaagagt

SEQ ID NO: 26184 - DNA, 25 bp, Mus musculus
aacaaggatacctaggacgaagagt

SEQ ID NO: 26185 - DNA, 25 bp, Mus musculus
aacaaggattgcctgctacttccag

SEQ ID NO: 26186 - DNA, 25 bp, Mus musculus
aacaaggattgcgtgctacttccag

SEQ ID NO: 26187 - DNA, 25 bp, Mus musculus
aacaaggcacctcaacgagcgataa

SEQ ID NO: 26188 - DNA, 25 bp, Mus musculus
aacaaggcacctgaacgagcgataa

SEQ ID NO: 26189 - DNA, 25 bp, Mus musculus
aacaaggcacttcgttctgatattg

SEQ ID NO: 26190 - DNA, 25 bp, Mus musculus
aacaaggcacttggttctgatattg

SEQ ID NO: 26191 - DNA, 25 bp, Mus musculus
aacaaggcccgccaatgttgggagc

SEQ ID NO: 26192 - DNA, 25 bp, Mus musculus
aacaaggcccgcgaatgttgggagc

SEQ ID NO: 26193 - DNA, 25 bp, Mus musculus
aacaaggccctgaatgtcagtgaca

SEQ ID NO: 26194 - DNA, 25 bp, Mus musculus
aacaaggccctgtatgtcagtgaca

SEQ ID NO: 26195 - DNA, 25 bp, Mus musculus
aacaaggcgcagattgaagatcgaa

SEQ ID NO: 26196 - DNA, 25 bp, Mus musculus
aacaaggcgcagtttgaagatcgaa

SEQ ID NO: 26197 - DNA, 25 bp, Mus musculus
aacaaggcggccagggaagagctta

SEQ ID NO: 26198 - DNA, 25 bp, Mus musculus
aacaaggcggcctgggaagagctta

SEQ ID NO: 26199 - DNA, 25 bp, Mus musculus
aacaaggctaaccttctgcttcagt

SEQ ID NO: 26200 - DNA, 25 bp, Mus musculus
aacaaggctaacgttctgcttcagt

SEQ ID NO: 26201 - DNA, 25 bp, Mus musculus
aacaaggctcacaacacaatttaga

SEQ ID NO: 26202 - DNA, 25 bp, Mus musculus
aacaaggctcactacacaatttaga

SEQ ID NO: 26203 - DNA, 25 bp, Mus musculus
aacaaggctggacccgagaaggaac

SEQ ID NO: 26204 - DNA, 25 bp, Mus musculus
aacaaggctggagccgagaaggaac

SEQ ID NO: 26205 - DNA, 25 bp, Mus musculus
aacaaggctgttctcacgttgctct

SEQ ID NO: 26206 - DNA, 25 bp, Mus musculus
aacaaggctgttgtcacgttgctct

SEQ ID NO: 26207 - DNA, 25 bp, Mus musculus
aacaagggacacaaccagaggactc

SEQ ID NO: 26208 - DNA, 25 bp, Mus musculus
aacaagggacactaccagaggactc

SEQ ID NO: 26209 - DNA, 25 bp, Mus musculus
aacaagggcttgacacaccgtggtg

SEQ ID NO: 26210 - DNA, 25 bp, Mus musculus
aacaagggcttgtcacaccgtggtg

SEQ ID NO: 26211 - DNA, 25 bp, Mus musculus
aacaaggtacccagatttgcttcct

SEQ ID NO: 26212 - DNA, 25 bp, Mus musculus
aacaaggtaccctgatttgcttcct

SEQ ID NO: 26213 - DNA, 25 bp, Mus musculus
aacaaggtaggccaacaggacagcc

SEQ ID NO: 26214 - DNA, 25 bp, Mus musculus
aacaaggtaggcgaacaggacagcc

SEQ ID NO: 26215 - DNA, 25 bp, Mus musculus
aacaaggtctcaataggtagctcta

SEQ ID NO: 26216 - DNA, 25 bp, Mus musculus
aacaaggtctcattaggtagctcta

SEQ ID NO: 26217 - DNA, 25 bp, Mus musculus
aacaaggtctcgaggacgggctgtt

SEQ ID NO: 26218 - DNA, 25 bp, Mus musculus
aacaaggtctcgtggacgggctgtt

SEQ ID NO: 26219 - DNA, 25 bp, Mus musculus
aacaaggtcttccatgggccactgt

SEQ ID NO: 26220 - DNA, 25 bp, Mus musculus
aacaaggtcttcgatgggccactgt

SEQ ID NO: 26221 - DNA, 25 bp, Mus musculus
aacaaggtgactatctgctacaata

SEQ ID NO: 26222 - DNA, 25 bp, Mus musculus
aacaaggtgactttctgctacaata

SEQ ID NO: 26223 - DNA, 25 bp, Mus musculus
aacaaggtgataaggccttttcgat

SEQ ID NO: 26224 - DNA, 25 bp, Mus musculus
aacaaggtgatatggccttttcgat

SEQ ID NO: 26225 - DNA, 25 bp, Mus musculus
aacaaggtgccacacaacagtaact

SEQ ID NO: 26226 - DNA, 25 bp, Mus musculus
aacaaggtgccagacaacagtaact

SEQ ID NO: 26227 - DNA, 25 bp, Mus musculus
aacaaggtgctgctgtcctccggta

SEQ ID NO: 26228 - DNA, 25 bp, Mus musculus
aacaaggtgctggtgtcctccggta

SEQ ID NO: 26229 - DNA, 25 bp, Mus musculus
aacaaggtggaaaccagatcggaaa

SEQ ID NO: 26230 - DNA, 25 bp, Mus musculus
aacaaggtggaatccagatcggaaa

SEQ ID NO: 26231 - DNA, 25 bp, Mus musculus
aacaaggtgggcattgaagtaacat

SEQ ID NO: 26232 - DNA, 25 bp, Mus musculus
aacaaggtgggctttgaagtaacat

SEQ ID NO: 26233 - DNA, 25 bp, Mus musculus
aacaaggtgggtcccattccaggca

SEQ ID NO: 26234 - DNA, 25 bp, Mus musculus
aacaaggtgggtgccattccaggca

SEQ ID NO: 26235 - DNA, 25 bp, Mus musculus
aacaaggtggtgagatggtttccct

SEQ ID NO: 26236 - DNA, 25 bp, Mus musculus
aacaaggtggtgtgatggtttccct

SEQ ID NO: 26237 - DNA, 25 bp, Mus musculus
aacaaggtgtttccagttcagcagg

SEQ ID NO: 26238 - DNA, 25 bp, Mus musculus
aacaaggtgtttgcagttcagcagg

SEQ ID NO: 26239 - DNA, 25 bp, Mus musculus
aacaaggttccacagtccaaagatg

SEQ ID NO: 26240 - DNA, 25 bp, Mus musculus
aacaaggttccagagtccaaagatg

SEQ ID NO: 26241 - DNA, 25 bp, Mus musculus
aacaaggttgccactcacaggttgt

SEQ ID NO: 26242 - DNA, 25 bp, Mus musculus
aacaaggttgcctctcacaggttgt

SEQ ID NO: 26243 - DNA, 25 bp, Mus musculus
aacaagtaaacaaatttgccaccaa

SEQ ID NO: 26244 - DNA, 25 bp, Mus musculus
aacaagtaaacatatttgccaccaa

SEQ ID NO: 26245 - DNA, 25 bp, Mus musculus
aacaagtactagactcccaaggagc

SEQ ID NO: 26246 - DNA, 25 bp, Mus musculus
aacaagtactagtctcccaaggagc

SEQ ID NO: 26247 - DNA, 25 bp, Mus musculus
aacaagtacttgatcctgctagaca

SEQ ID NO: 26248 - DNA, 25 bp, Mus musculus
aacaagtacttgttcctgctagaca

SEQ ID NO: 26249 - DNA, 25 bp, Mus musculus
aacaagtaggcccttgctacacggg

SEQ ID NO: 26250 - DNA, 25 bp, Mus musculus
aacaagtaggccgttgctacacggg

SEQ ID NO: 26251 - DNA, 25 bp, Mus musculus
aacaagtatattccttccccataat

SEQ ID NO: 26252 - DNA, 25 bp, Mus musculus
aacaagtatattgcttccccataat

SEQ ID NO: 26253 - DNA, 25 bp, Mus musculus
aacaagtcaactaccgttctccaat

SEQ ID NO: 26254 - DNA, 25 bp, Mus musculus
aacaagtcaacttccgttctccaat

SEQ ID NO: 26255 - DNA, 25 bp, Mus musculus
aacaagtcactgcattctctctgtc

SEQ ID NO: 26256 - DNA, 25 bp, Mus musculus
aacaagtcactgctatggtggctga

SEQ ID NO: 26257 - DNA, 25 bp, Mus musculus
aacaagtcactggattctctctgtc

SEQ ID NO: 26258 - DNA, 25 bp, Mus musculus
aacaagtcactggtatggtggctga

SEQ ID NO: 26259 - DNA, 25 bp, Mus musculus
aacaagtcatacaggatctcactgt

SEQ ID NO: 26260 - DNA, 25 bp, Mus musculus
aacaagtcatactggatctcactgt

SEQ ID NO: 26261 - DNA, 25 bp, Mus musculus
aacaagtcatggagagactgtccgg

SEQ ID NO: 26262 - DNA, 25 bp, Mus musculus
aacaagtcatggtgagactgtccgg

SEQ ID NO: 26263 - DNA, 25 bp, Mus musculus
aacaagtccacgcagtcactgcagg

SEQ ID NO: 26264 - DNA, 25 bp, Mus musculus
aacaagtccacggagtcactgcagg

SEQ ID NO: 26265 - DNA, 25 bp, Mus musculus
aacaagtccagcctagagttcccaa

SEQ ID NO: 26266 - DNA, 25 bp, Mus musculus
aacaagtccagcgtagagttcccaa

SEQ ID NO: 26267 - DNA, 25 bp, Mus musculus
aacaagtcccacaaataactcgctc

SEQ ID NO: 26268 - DNA, 25 bp, Mus musculus
aacaagtcccacagttgttctgctc

SEQ ID NO: 26269 - DNA, 25 bp, Mus musculus
aacaagtcccactaataactcgctc

SEQ ID NO: 26270 - DNA, 25 bp, Mus musculus
aacaagtcccactgttgttctgctc

SEQ ID NO: 26271 - DNA, 25 bp, Mus musculus
aacaagtcccgacgtcacaacaagg

SEQ ID NO: 26272 - DNA, 25 bp, Mus musculus
aacaagtcccgaggtcacaacaagg

SEQ ID NO: 26273 - DNA, 25 bp, Mus musculus
aacaagtccttaactccattcttaa

SEQ ID NO: 26274 - DNA, 25 bp, Mus musculus
aacaagtccttatctccattcttaa

SEQ ID NO: 26275 - DNA, 25 bp, Mus musculus
aacaagtctattattctgcggatcc

SEQ ID NO: 26276 - DNA, 25 bp, Mus musculus
aacaagtctatttttctgcggatcc

SEQ ID NO: 26277 - DNA, 25 bp, Mus musculus
aacaagtgagacatccgaccggtgc

SEQ ID NO: 26278 - DNA, 25 bp, Mus musculus
aacaagtgagacttccgaccggtgc

SEQ ID NO: 26279 - DNA, 25 bp, Mus musculus
aacaagtgagctacagcctgcagag

SEQ ID NO: 26280 - DNA, 25 bp, Mus musculus
aacaagtgagcttcagcctgcagag

SEQ ID NO: 26281 - DNA, 25 bp, Mus musculus
aacaagtgcaccagagaccctacag

SEQ ID NO: 26282 - DNA, 25 bp, Mus musculus
aacaagtgcacctgagaccctacag

SEQ ID NO: 26283 - DNA, 25 bp, Mus musculus
aacaagtgccaccacggctagtgtt

SEQ ID NO: 26284 - DNA, 25 bp, Mus musculus
aacaagtgccacgacggctagtgtt

SEQ ID NO: 26285 - DNA, 25 bp, Mus musculus
aacaagtgccttcggcttgaatcct

SEQ ID NO: 26286 - DNA, 25 bp, Mus musculus
aacaagtgccttgggcttgaatcct

SEQ ID NO: 26287 - DNA, 25 bp, Mus musculus
aacaagtgctcacggcttctttgtc

SEQ ID NO: 26288 - DNA, 25 bp, Mus musculus
aacaagtgctcagggcttctttgtc

SEQ ID NO: 26289 - DNA, 25 bp, Mus musculus
aacaagtgcttgataggctgagagc

SEQ ID NO: 26290 - DNA, 25 bp, Mus musculus
aacaagtgcttgattttgtccctgc

SEQ ID NO: 26291 - DNA, 25 bp, Mus musculus
aacaagtgcttgttaggctgagagc

SEQ ID NO: 26292 - DNA, 25 bp, Mus musculus
aacaagtgcttgtttttgtccctgc

SEQ ID NO: 26293 - DNA, 25 bp, Mus musculus
aacaagtgggacagcctcagccatg

SEQ ID NO: 26294 - DNA, 25 bp, Mus musculus
aacaagtgggactgcctcagccatg

SEQ ID NO: 26295 - DNA, 25 bp, Mus musculus
aacaagtgggtcagatgacctgctg

SEQ ID NO: 26296 - DNA, 25 bp, Mus musculus
aacaagtgggtctgatgacctgctg

SEQ ID NO: 26297 - DNA, 25 bp, Mus musculus
aacaagtgggttactctagctacat

SEQ ID NO: 26298 - DNA, 25 bp, Mus musculus
aacaagtgggtttctctagctacat

SEQ ID NO: 26299 - DNA, 25 bp, Mus musculus
aacaagtgtacaagtgtccctgtgt

SEQ ID NO: 26300 - DNA, 25 bp, Mus musculus
aacaagtgtacatgtgtccctgtgt

SEQ ID NO: 26301 - DNA, 25 bp, Mus musculus
aacaagtgtcttcaactctcggttc

SEQ ID NO: 26302 - DNA, 25 bp, Mus musculus
aacaagtgtcttgaactctcggttc

SEQ ID NO: 26303 - DNA, 25 bp, Mus musculus
aacaagtgtgcacgagccttgccgg

SEQ ID NO: 26304 - DNA, 25 bp, Mus musculus
aacaagtgtgcaggagccttgccgg

SEQ ID NO: 26305 - DNA, 25 bp, Mus musculus
aacaagtgttgtcgcctctgcatct

SEQ ID NO: 26306 - DNA, 25 bp, Mus musculus
aacaagtgttgtggcctctgcatct

SEQ ID NO: 26307 - DNA, 25 bp, Mus musculus
aacaagttacggacactagatgact

SEQ ID NO: 26308 - DNA, 25 bp, Mus musculus
aacaagttacggtcactagatgact

SEQ ID NO: 26309 - DNA, 25 bp, Mus musculus
aacaagttcaccattggcaaagaat

SEQ ID NO: 26310 - DNA, 25 bp, Mus musculus
aacaagttcacctttggcaaagaat

SEQ ID NO: 26311 - DNA, 25 bp, Mus musculus
aacaagttcactattcccattaaag

SEQ ID NO: 26312 - DNA, 25 bp, Mus musculus
aacaagttcacttttcccattaaag

SEQ ID NO: 26313 - DNA, 25 bp, Mus musculus
aacaagttcagtccctttctgcaga

SEQ ID NO: 26314 - DNA, 25 bp, Mus musculus
aacaagttcagtgcctttctgcaga

SEQ ID NO: 26315 - DNA, 25 bp, Mus musculus
aacaagttctatacaggcaccggct

SEQ ID NO: 26316 - DNA, 25 bp, Mus musculus
aacaagttctattcaggcaccggct

SEQ ID NO: 26317 - DNA, 25 bp, Mus musculus
aacaagttctctcggtatcagggac

SEQ ID NO: 26318 - DNA, 25 bp, Mus musculus
aacaagttctctgggtatcagggac

SEQ ID NO: 26319 - DNA, 25 bp, Mus musculus
aacaagttgaaaactcagttctgaa

SEQ ID NO: 26320 - DNA, 25 bp, Mus musculus
aacaagttgaaatctcagttctgaa

SEQ ID NO: 26321 - DNA, 25 bp, Mus musculus
aacaagttgcatcccttctcaatgg

SEQ ID NO: 26322 - DNA, 25 bp, Mus musculus
aacaagttgcatgccttctcaatgg

SEQ ID NO: 26323 - DNA, 25 bp, Mus musculus
aacaagttgccaaggtcgaccgatg

SEQ ID NO: 26324 - DNA, 25 bp, Mus musculus
aacaagttgccatggtcgaccgatg

SEQ ID NO: 26325 - DNA, 25 bp, Mus musculus
aacaagttgtgcaatgcttcatggc

SEQ ID NO: 26326 - DNA, 25 bp, Mus musculus
aacaagttgtgctatgcttcatggc

SEQ ID NO: 26327 - DNA, 25 bp, Mus musculus
aacaataacatcctgacccatacat

SEQ ID NO: 26328 - DNA, 25 bp, Mus musculus
aacaataacatcgtgacccatacat

SEQ ID NO: 26329 - DNA, 25 bp, Mus musculus
aacaataactgaattgcccgctgct

SEQ ID NO: 26330 - DNA, 25 bp, Mus musculus
aacaataactgatttgcccgctgct

SEQ ID NO: 26331 - DNA, 25 bp, Mus musculus
aacaataactgtacttccaaattag

SEQ ID NO: 26332 - DNA, 25 bp, Mus musculus
aacaataactgttcttccaaattag

SEQ ID NO: 26333 - DNA, 25 bp, Mus musculus
aacaataatctcaacctcaaacacc

SEQ ID NO: 26334 - DNA, 25 bp, Mus musculus
aacaataatctctacctcaaacacc

SEQ ID NO: 26335 - DNA, 25 bp, Mus musculus
aacaataccatcacgtgcagttaat

SEQ ID NO: 26336 - DNA, 25 bp, Mus musculus
aacaataccatctcgtgcagttaat

SEQ ID NO: 26337 - DNA, 25 bp, Mus musculus
aacaatacccagacttacagtgcag

SEQ ID NO: 26338 - DNA, 25 bp, Mus musculus
aacaatacccagtcttacagtgcag

SEQ ID NO: 26339 - DNA, 25 bp, Mus musculus
aacaatacctacagtgttcctggca

SEQ ID NO: 26340 - DNA, 25 bp, Mus musculus
aacaatacctactgtgttcctggca

SEQ ID NO: 26341 - DNA, 25 bp, Mus musculus
aacaatactaacacctccaattcct

SEQ ID NO: 26342 - DNA, 25 bp, Mus musculus
aacaatactaactcctccaattcct

SEQ ID NO: 26343 - DNA, 25 bp, Mus musculus
aacaatactttgagtggctctgtgg

SEQ ID NO: 26344 - DNA, 25 bp, Mus musculus
aacaatactttgtgtggctctgtgg

SEQ ID NO: 26345 - DNA, 25 bp, Mus musculus
aacaatagcacacaatgacctgggc

SEQ ID NO: 26346 - DNA, 25 bp, Mus musculus
aacaatagcacagaatgacctgggc

SEQ ID NO: 26347 - DNA, 25 bp, Mus musculus
aacaatagcatcaaccacagacaga

SEQ ID NO: 26348 - DNA, 25 bp, Mus musculus
aacaatagcatctaccacagacaga

SEQ ID NO: 26349 - DNA, 25 bp, Mus musculus
aacaatagccagatccacaaataac

SEQ ID NO: 26350 - DNA, 25 bp, Mus musculus
aacaatagccagttccacaaataac

SEQ ID NO: 26351 - DNA, 25 bp, Mus musculus
aacaatagctaaaatgaaagtgcaa

SEQ ID NO: 26352 - DNA, 25 bp, Mus musculus
aacaatagctaatatgaaagtgcaa

SEQ ID NO: 26353 - DNA, 25 bp, Mus musculus
aacaatagcttcatcagcgtgtaga

SEQ ID NO: 26354 - DNA, 25 bp, Mus musculus
aacaatagcttcttcagcgtgtaga

SEQ ID NO: 26355 - DNA, 25 bp, Mus musculus
aacaatagtttactggcctgagctt

SEQ ID NO: 26356 - DNA, 25 bp, Mus musculus
aacaatagtttagtggcctgagctt

SEQ ID NO: 26357 - DNA, 25 bp, Mus musculus
aacaatatagacagccactcttcct

SEQ ID NO: 26358 - DNA, 25 bp, Mus musculus
aacaatatagactgccactcttcct

SEQ ID NO: 26359 - DNA, 25 bp, Mus musculus
aacaatatcctcagagaccctgcag

SEQ ID NO: 26360 - DNA, 25 bp, Mus musculus
aacaatatcctctgagaccctgcag

SEQ ID NO: 26361 - DNA, 25 bp, Mus musculus
aacaatatgcagatgtgcccaggtt

SEQ ID NO: 26362 - DNA, 25 bp, Mus musculus
aacaatatgcagttgtgcccaggtt

SEQ ID NO: 26363 - DNA, 25 bp, Mus musculus
aacaatattagcatttctcagagaa

SEQ ID NO: 26364 - DNA, 25 bp, Mus musculus
aacaatattagcttttctcagagaa

SEQ ID NO: 26365 - DNA, 25 bp, Mus musculus
aacaatatttagcacataacaggca

SEQ ID NO: 26366 - DNA, 25 bp, Mus musculus
aacaatatttaggacataacaggca

SEQ ID NO: 26367 - DNA, 25 bp, Mus musculus
aacaatattttcactaccatcacca

SEQ ID NO: 26368 - DNA, 25 bp, Mus musculus
aacaatattttctctaccatcacca

SEQ ID NO: 26369 - DNA, 25 bp, Mus musculus
aacaatatttttcgtgcatgcatag

SEQ ID NO: 26370 - DNA, 25 bp, Mus musculus
aacaatatttttggtgcatgcatag

SEQ ID NO: 26371 - DNA, 25 bp, Mus musculus
aacaatcaacgactggtgccgactc

SEQ ID NO: 26372 - DNA, 25 bp, Mus musculus
aacaatcaacgagtggtgccgactc

SEQ ID NO: 26373 - DNA, 25 bp, Mus musculus
aacaatcaacttatctgccttcatt

SEQ ID NO: 26374 - DNA, 25 bp, Mus musculus
aacaatcaacttttctgccttcatt

SEQ ID NO: 26375 - DNA, 25 bp, Mus musculus
aacaatcacatcagcagagttgcaa

SEQ ID NO: 26376 - DNA, 25 bp, Mus musculus
aacaatcacatctgcagagttgcaa

SEQ ID NO: 26377 - DNA, 25 bp, Mus musculus
aacaatcacccgcaggatggagtca

SEQ ID NO: 26378 - DNA, 25 bp, Mus musculus
aacaatcacccggaggatggagtca

SEQ ID NO: 26379 - DNA, 25 bp, Mus musculus
aacaatcaccctctggctggagttt

SEQ ID NO: 26380 - DNA, 25 bp, Mus musculus
aacaatcaccctgtggctggagttt

SEQ ID NO: 26381 - DNA, 25 bp, Mus musculus
aacaatcactgcattttatactact

SEQ ID NO: 26382 - DNA, 25 bp, Mus musculus
aacaatcactgctttttatactact

SEQ ID NO: 26383 - DNA, 25 bp, Mus musculus
aacaatcacttaacagagaatgcat

SEQ ID NO: 26384 - DNA, 25 bp, Mus musculus
aacaatcacttatcagagaatgcat

SEQ ID NO: 26385 - DNA, 25 bp, Mus musculus
aacaatcagggaacggcagcttgct

SEQ ID NO: 26386 - DNA, 25 bp, Mus musculus
aacaatcagggatcggcagcttgct

SEQ ID NO: 26387 - DNA, 25 bp, Mus musculus
aacaatcagtctaccaattttgggc

SEQ ID NO: 26388 - DNA, 25 bp, Mus musculus
aacaatcagtcttccaattttgggc

SEQ ID NO: 26389 - DNA, 25 bp, Mus musculus
aacaatcagtgcatccggtgacagc

SEQ ID NO: 26390 - DNA, 25 bp, Mus musculus
aacaatcagtgcttccggtgacagc

SEQ ID NO: 26391 - DNA, 25 bp, Mus musculus
aacaatccaggtctggtcattccaa

SEQ ID NO: 26392 - DNA, 25 bp, Mus musculus
aacaatccaggtgtggtcattccaa

SEQ ID NO: 26393 - DNA, 25 bp, Mus musculus
aacaatcccagaaccatatggcatg

SEQ ID NO: 26394 - DNA, 25 bp, Mus musculus
aacaatcccagatccatatggcatg

SEQ ID NO: 26395 - DNA, 25 bp, Mus musculus
aacaatccccggaggactgacaaga

SEQ ID NO: 26396 - DNA, 25 bp, Mus musculus
aacaatccccggtggactgacaaga

SEQ ID NO: 26397 - DNA, 25 bp, Mus musculus
aacaatccctatatttctatataat

SEQ ID NO: 26398 - DNA, 25 bp, Mus musculus
aacaatccctatttttctatataat

SEQ ID NO: 26399 - DNA, 25 bp, Mus musculus
aacaatccgtgaacagcctcaagtt

SEQ ID NO: 26400 - DNA, 25 bp, Mus musculus
aacaatccgtgatcagcctcaagtt

SEQ ID NO: 26401 - DNA, 25 bp, Mus musculus
aacaatcctataaacctgcccaggt

SEQ ID NO: 26402 - DNA, 25 bp, Mus musculus
aacaatcctatatacctgcccaggt

SEQ ID NO: 26403 - DNA, 25 bp, Mus musculus
aacaatcctcaaattacactagtag

SEQ ID NO: 26404 - DNA, 25 bp, Mus musculus
aacaatcctcaatttacactagtag

SEQ ID NO: 26405 - DNA, 25 bp, Mus musculus
aacaatcgagctaaccactgacctt

SEQ ID NO: 26406 - DNA, 25 bp, Mus musculus
aacaatcgagcttaccactgacctt

SEQ ID NO: 26407 - DNA, 25 bp, Mus musculus
aacaatcgatttctctaccccagag

SEQ ID NO: 26408 - DNA, 25 bp, Mus musculus
aacaatcgatttgtctaccccagag

SEQ ID NO: 26409 - DNA, 25 bp, Mus musculus
aacaatctacagacacagcacactt

SEQ ID NO: 26410 - DNA, 25 bp, Mus musculus
aacaatctacagtcacagcacactt

SEQ ID NO: 26411 - DNA, 25 bp, Mus musculus
aacaatctcaacaatctggcagtgt

SEQ ID NO: 26412 - DNA, 25 bp, Mus musculus
aacaatctcaactatctggcagtgt

SEQ ID NO: 26413 - DNA, 25 bp, Mus musculus
aacaatctcaagagctgctgcagaa

SEQ ID NO: 26414 - DNA, 25 bp, Mus musculus
aacaatctcaagtgctgctgcagaa

SEQ ID NO: 26415 - DNA, 25 bp, Mus musculus
aacaatctcagtcccctcctttcct

SEQ ID NO: 26416 - DNA, 25 bp, Mus musculus
aacaatctcagtgccctcctttcct

SEQ ID NO: 26417 - DNA, 25 bp, Mus musculus
aacaatctcatccatctgttcttat

SEQ ID NO: 26418 - DNA, 25 bp, Mus musculus
aacaatctcatcgatctgttcttat

SEQ ID NO: 26419 - DNA, 25 bp, Mus musculus
aacaatctccttccaggtgctcagg

SEQ ID NO: 26420 - DNA, 25 bp, Mus musculus
aacaatctccttgcaggtgctcagg

SEQ ID NO: 26421 - DNA, 25 bp, Mus musculus
aacaatctgaccaaggtaacaggaa

SEQ ID NO: 26422 - DNA, 25 bp, Mus musculus
aacaatctgacctaggtaacaggaa

SEQ ID NO: 26423 - DNA, 25 bp, Mus musculus
aacaatctgaggatgtggctctcca

SEQ ID NO: 26424 - DNA, 25 bp, Mus musculus
aacaatctgaggttgtggctctcca

SEQ ID NO: 26425 - DNA, 25 bp, Mus musculus
aacaatctgagtcacctgccacaag

SEQ ID NO: 26426 - DNA, 25 bp, Mus musculus
aacaatctgagtgacctgccacaag

SEQ ID NO: 26427 - DNA, 25 bp, Mus musculus
aacaatctgccaacaatcttctcaa

SEQ ID NO: 26428 - DNA, 25 bp, Mus musculus
aacaatctgccatcaatcttctcaa

SEQ ID NO: 26429 - DNA, 25 bp, Mus musculus
aacaatctgcttatgatatctgtga

SEQ ID NO: 26430 - DNA, 25 bp, Mus musculus
aacaatctgcttttgatatctgtga

SEQ ID NO: 26431 - DNA, 25 bp, Mus musculus
aacaatctgtccaggagttgcccgg

SEQ ID NO: 26432 - DNA, 25 bp, Mus musculus
aacaatctgtcctggagttgcccgg

SEQ ID NO: 26433 - DNA, 25 bp, Mus musculus
aacaatctgttgctgcgagttcact

SEQ ID NO: 26434 - DNA, 25 bp, Mus musculus
aacaatctgttggtgcgagttcact

SEQ ID NO: 26435 - DNA, 25 bp, Mus musculus
aacaatcttctgatccctaggttcc

SEQ ID NO: 26436 - DNA, 25 bp, Mus musculus
aacaatcttctgttccctaggttcc

SEQ ID NO: 26437 - DNA, 25 bp, Mus musculus
aacaatcttgttactaatgctcatt

SEQ ID NO: 26438 - DNA, 25 bp, Mus musculus
aacaatcttgtttctaatgctcatt

SEQ ID NO: 26439 - DNA, 25 bp, Mus musculus
aacaatctttgactaggctggcaag

SEQ ID NO: 26440 - DNA, 25 bp, Mus musculus
aacaatctttgagtaggctggcaag

SEQ ID NO: 26441 - DNA, 25 bp, Mus musculus
aacaatcttttaagtcttgtcatac

SEQ ID NO: 26442 - DNA, 25 bp, Mus musculus
aacaatcttttatgtcttgtcatac

SEQ ID NO: 26443 - DNA, 25 bp, Mus musculus
aacaatgacattaccctattctctt

SEQ ID NO: 26444 - DNA, 25 bp, Mus musculus
aacaatgacatttccctattctctt

SEQ ID NO: 26445 - DNA, 25 bp, Mus musculus
aacaatgaccttcgagcctacagcc

SEQ ID NO: 26446 - DNA, 25 bp, Mus musculus
aacaatgaccttggagcctacagcc

SEQ ID NO: 26447 - DNA, 25 bp, Mus musculus
aacaatgacttcagtcgcctgggtt

SEQ ID NO: 26448 - DNA, 25 bp, Mus musculus
aacaatgacttctgtcgcctgggtt

SEQ ID NO: 26449 - DNA, 25 bp, Mus musculus
aacaatgagcttaccttttgagtca

SEQ ID NO: 26450 - DNA, 25 bp, Mus musculus
aacaatgagcttcaactgttctgtt

SEQ ID NO: 26451 - DNA, 25 bp, Mus musculus
aacaatgagcttctccgtgacatct

SEQ ID NO: 26452 - DNA, 25 bp, Mus musculus
aacaatgagcttgaactgttctgtt

SEQ ID NO: 26453 - DNA, 25 bp, Mus musculus
aacaatgagcttgtccgtgacatct

SEQ ID NO: 26454 - DNA, 25 bp, Mus musculus
aacaatgagctttccttttgagtca

SEQ ID NO: 26455 - DNA, 25 bp, Mus musculus
aacaatgaggcactggatcacccat

SEQ ID NO: 26456 - DNA, 25 bp, Mus musculus
aacaatgaggcagtggatcacccat

SEQ ID NO: 26457 - DNA, 25 bp, Mus musculus
aacaatgagtcgctcaggctccttc

SEQ ID NO: 26458 - DNA, 25 bp, Mus musculus
aacaatgagtcggtcaggctccttc

SEQ ID NO: 26459 - DNA, 25 bp, Mus musculus
aacaatgagttcatctaaggcaaag

SEQ ID NO: 26460 - DNA, 25 bp, Mus musculus
aacaatgagttcttctaaggcaaag

SEQ ID NO: 26461 - DNA, 25 bp, Mus musculus
aacaatgcacagagcaaccacagct

SEQ ID NO: 26462 - DNA, 25 bp, Mus musculus
aacaatgcacagtgcaaccacagct

SEQ ID NO: 26463 - DNA, 25 bp, Mus musculus
aacaatgcaggtatccgagtgtgga

SEQ ID NO: 26464 - DNA, 25 bp, Mus musculus
aacaatgcaggtttccgagtgtgga

SEQ ID NO: 26465 - DNA, 25 bp, Mus musculus
aacaatgcatgtatacttacctgtg

SEQ ID NO: 26466 - DNA, 25 bp, Mus musculus
aacaatgcatgtttacttacctgtg

SEQ ID NO: 26467 - DNA, 25 bp, Mus musculus
aacaatgcctccattttcacttttc

SEQ ID NO: 26468 - DNA, 25 bp, Mus musculus
aacaatgcctcctttttcacttttc

SEQ ID NO: 26469 - DNA, 25 bp, Mus musculus
aacaatgcgggcctgaagtgtaatt

SEQ ID NO: 26470 - DNA, 25 bp, Mus musculus
aacaatgcgggcgtgaagtgtaatt

SEQ ID NO: 26471 - DNA, 25 bp, Mus musculus
aacaatgctaataacggctcacagg

SEQ ID NO: 26472 - DNA, 25 bp, Mus musculus
aacaatgctaattacggctcacagg

SEQ ID NO: 26473 - DNA, 25 bp, Mus musculus
aacaatgctacgcagggccgtgtta

SEQ ID NO: 26474 - DNA, 25 bp, Mus musculus
aacaatgctacggagggccgtgtta

SEQ ID NO: 26475 - DNA, 25 bp, Mus musculus
aacaatgctagccttcttttaagca

SEQ ID NO: 26476 - DNA, 25 bp, Mus musculus
aacaatgctagcgttcttttaagca

SEQ ID NO: 26477 - DNA, 25 bp, Mus musculus
aacaatgctatcagctatgtgaaca

SEQ ID NO: 26478 - DNA, 25 bp, Mus musculus
aacaatgctatctgctatgtgaaca

SEQ ID NO: 26479 - DNA, 25 bp, Mus musculus
aacaatggcaatatcttctctcctc

SEQ ID NO: 26480 - DNA, 25 bp, Mus musculus
aacaatggcaatttcttctctcctc

SEQ ID NO: 26481 - DNA, 25 bp, Mus musculus
aacaatggcataccctgaggtcccg

SEQ ID NO: 26482 - DNA, 25 bp, Mus musculus
aacaatggcatagcctgaggtcccg

SEQ ID NO: 26483 - DNA, 25 bp, Mus musculus
aacaatggccagatgttgcctaggc

SEQ ID NO: 26484 - DNA, 25 bp, Mus musculus
aacaatggccagttgttgcctaggc

SEQ ID NO: 26485 - DNA, 25 bp, Mus musculus
aacaatggctcccagattctctgtt

SEQ ID NO: 26486 - DNA, 25 bp, Mus musculus
aacaatggctccgagattctctgtt

SEQ ID NO: 26487 - DNA, 25 bp, Mus musculus
aacaatgggaacattcagtgtgaac

SEQ ID NO: 26488 - DNA, 25 bp, Mus musculus
aacaatgggaactttcagtgtgaac

SEQ ID NO: 26489 - DNA, 25 bp, Mus musculus
aacaatgggaagacaagcacatcac

SEQ ID NO: 26490 - DNA, 25 bp, Mus musculus
aacaatgggaagtcaagcacatcac

SEQ ID NO: 26491 - DNA, 25 bp, Mus musculus
aacaatgggagtcctcagcttgcaa

SEQ ID NO: 26492 - DNA, 25 bp, Mus musculus
aacaatgggagtgctcagcttgcaa

SEQ ID NO: 26493 - DNA, 25 bp, Mus musculus
aacaatgggctcatctgtgtggaca

SEQ ID NO: 26494 - DNA, 25 bp, Mus musculus
aacaatgggctcttctgtgtggaca

SEQ ID NO: 26495 - DNA, 25 bp, Mus musculus
aacaatggtgggaatgaccatacca

SEQ ID NO: 26496 - DNA, 25 bp, Mus musculus
aacaatggtgggtatgaccatacca

SEQ ID NO: 26497 - DNA, 25 bp, Mus musculus
aacaatggtgtcactgcgttcatgt

SEQ ID NO: 26498 - DNA, 25 bp, Mus musculus
aacaatggtgtctctgcgttcatgt

SEQ ID NO: 26499 - DNA, 25 bp, Mus musculus
aacaatggtttgatgcaacaagcaa

SEQ ID NO: 26500 - DNA, 25 bp, Mus musculus
aacaatggtttgttgcaacaagcaa

SEQ ID NO: 26501 - DNA, 25 bp, Mus musculus
aacaatgtacagcagggcgttcctc

SEQ ID NO: 26502 - DNA, 25 bp, Mus musculus
aacaatgtacaggagggcgttcctc

SEQ ID NO: 26503 - DNA, 25 bp, Mus musculus
aacaatgtagtgatccttcctcttc

SEQ ID NO: 26504 - DNA, 25 bp, Mus musculus
aacaatgtagtgttccttcctcttc

SEQ ID NO: 26505 - DNA, 25 bp, Mus musculus
aacaatgtgaagagctttagctttc

SEQ ID NO: 26506 - DNA, 25 bp, Mus musculus
aacaatgtgaagtgctttagctttc

SEQ ID NO: 26507 - DNA, 25 bp, Mus musculus
aacaatgtgatcatgatccgccttc

SEQ ID NO: 26508 - DNA, 25 bp, Mus musculus
aacaatgtgatcttgatccgccttc

SEQ ID NO: 26509 - DNA, 25 bp, Mus musculus
aacaatgtgctgcagtccctcatgt

SEQ ID NO: 26510 - DNA, 25 bp, Mus musculus
aacaatgtgctggagtccctcatgt

SEQ ID NO: 26511 - DNA, 25 bp, Mus musculus
aacaatgtgcttcggcttttgaaga

SEQ ID NO: 26512 - DNA, 25 bp, Mus musculus
aacaatgtgcttgggcttttgaaga

SEQ ID NO: 26513 - DNA, 25 bp, Mus musculus
aacaatgtgttcacaaccagcatga

SEQ ID NO: 26514 - DNA, 25 bp, Mus musculus
aacaatgtgttctcaaccagcatga

SEQ ID NO: 26515 - DNA, 25 bp, Mus musculus
aacaatgtttgaactgtgctaactt

SEQ ID NO: 26516 - DNA, 25 bp, Mus musculus
aacaatgtttgatctgtgctaactt

SEQ ID NO: 26517 - DNA, 25 bp, Mus musculus
aacaatgtttgcattccactggcat

SEQ ID NO: 26518 - DNA, 25 bp, Mus musculus
aacaatgtttgctttccactggcat

SEQ ID NO: 26519 - DNA, 25 bp, Mus musculus
aacaatgttttcagactgagagcaa

SEQ ID NO: 26520 - DNA, 25 bp, Mus musculus
aacaatgttttctgactgagagcaa

SEQ ID NO: 26521 - DNA, 25 bp, Mus musculus
aacaattaaggcatggttgcaaggt

SEQ ID NO: 26522 - DNA, 25 bp, Mus musculus
aacaattaaggcttggttgcaaggt

SEQ ID NO: 26523 - DNA, 25 bp, Mus musculus
aacaattacctaacggagctgcaag

SEQ ID NO: 26524 - DNA, 25 bp, Mus musculus
aacaattacctatcggagctgcaag

SEQ ID NO: 26525 - DNA, 25 bp, Mus musculus
aacaattacctgctgccaactgaga

SEQ ID NO: 26526 - DNA, 25 bp, Mus musculus
aacaattacctggtgccaactgaga

SEQ ID NO: 26527 - DNA, 25 bp, Mus musculus
aacaattacttcaccgtaatatcta

SEQ ID NO: 26528 - DNA, 25 bp, Mus musculus
aacaattacttctccgtaatatcta

SEQ ID NO: 26529 - DNA, 25 bp, Mus musculus
aacaattaggcccaagctgctttgc

SEQ ID NO: 26530 - DNA, 25 bp, Mus musculus
aacaattaggccgaagctgctttgc

SEQ ID NO: 26531 - DNA, 25 bp, Mus musculus
aacaattagtgtccagttcaatcaa

SEQ ID NO: 26532 - DNA, 25 bp, Mus musculus
aacaattagtgtgcagttcaatcaa

SEQ ID NO: 26533 - DNA, 25 bp, Mus musculus
aacaattatattaactgtctggatt

SEQ ID NO: 26534 - DNA, 25 bp, Mus musculus
aacaattatattccacttcctgata

SEQ ID NO: 26535 - DNA, 25 bp, Mus musculus
aacaattatattgcacttcctgata

SEQ ID NO: 26536 - DNA, 25 bp, Mus musculus
aacaattatatttactgtctggatt

SEQ ID NO: 26537 - DNA, 25 bp, Mus musculus
aacaattcaaggcatttcgcagagg

SEQ ID NO: 26538 - DNA, 25 bp, Mus musculus
aacaattcaagggatttcgcagagg

SEQ ID NO: 26539 - DNA, 25 bp, Mus musculus
aacaattcaagtattagctcaggaa

SEQ ID NO: 26540 - DNA, 25 bp, Mus musculus
aacaattcaagttttagctcaggaa

SEQ ID NO: 26541 - DNA, 25 bp, Mus musculus
aacaattcacagaagtctcgggcat

SEQ ID NO: 26542 - DNA, 25 bp, Mus musculus
aacaattcacagtagtctcgggcat

SEQ ID NO: 26543 - DNA, 25 bp, Mus musculus
aacaattcagctaccatactactca

SEQ ID NO: 26544 - DNA, 25 bp, Mus musculus
aacaattcagcttccatactactca

SEQ ID NO: 26545 - DNA, 25 bp, Mus musculus
aacaattcaggcagttgcgctacca

SEQ ID NO: 26546 - DNA, 25 bp, Mus musculus
aacaattcaggctgttgcgctacca

SEQ ID NO: 26547 - DNA, 25 bp, Mus musculus
aacaattcatcaactaaatcatgga

SEQ ID NO: 26548 - DNA, 25 bp, Mus musculus
aacaattcatcatctaaatcatgga

SEQ ID NO: 26549 - DNA, 25 bp, Mus musculus
aacaattccactatacactatgagt

SEQ ID NO: 26550 - DNA, 25 bp, Mus musculus
aacaattccactttacactatgagt

SEQ ID NO: 26551 - DNA, 25 bp, Mus musculus
aacaattccatgaggcggcttcaaa

SEQ ID NO: 26552 - DNA, 25 bp, Mus musculus
aacaattccatgtggcggcttcaaa

SEQ ID NO: 26553 - DNA, 25 bp, Mus musculus
aacaattcctacctgttccctggag

SEQ ID NO: 26554 - DNA, 25 bp, Mus musculus
aacaattcctacgtgttccctggag

SEQ ID NO: 26555 - DNA, 25 bp, Mus musculus
aacaattcgtgtacactgttgtcac

SEQ ID NO: 26556 - DNA, 25 bp, Mus musculus
aacaattcgtgttcactgttgtcac

SEQ ID NO: 26557 - DNA, 25 bp, Mus musculus
aacaattctatcacaaaggtccaca

SEQ ID NO: 26558 - DNA, 25 bp, Mus musculus
aacaattctatctcaaaggtccaca

SEQ ID NO: 26559 - DNA, 25 bp, Mus musculus
aacaattcttatcctcggttcttgg

SEQ ID NO: 26560 - DNA, 25 bp, Mus musculus
aacaattcttatgctcggttcttgg

SEQ ID NO: 26561 - DNA, 25 bp, Mus musculus
aacaattgacatacatccttatata

SEQ ID NO: 26562 - DNA, 25 bp, Mus musculus
aacaattgacattcatccttatata

SEQ ID NO: 26563 - DNA, 25 bp, Mus musculus
aacaattgattcatcctcaggaggc

SEQ ID NO: 26564 - DNA, 25 bp, Mus musculus
aacaattgattcttcctcaggaggc

SEQ ID NO: 26565 - DNA, 25 bp, Mus musculus
aacaattgctcaacttttccttctt

SEQ ID NO: 26566 - DNA, 25 bp, Mus musculus
aacaattgctcatcttttccttctt

SEQ ID NO: 26567 - DNA, 25 bp, Mus musculus
aacaattgctgcacattgtgcaaca

SEQ ID NO: 26568 - DNA, 25 bp, Mus musculus
aacaattgctgctcattgtgcaaca

SEQ ID NO: 26569 - DNA, 25 bp, Mus musculus
aacaattggccgagtcatcttctta

SEQ ID NO: 26570 - DNA, 25 bp, Mus musculus
aacaattggccgtgtcatcttctta

SEQ ID NO: 26571 - DNA, 25 bp, Mus musculus
aacaattggtaaagctcactgtgat

SEQ ID NO: 26572 - DNA, 25 bp, Mus musculus
aacaattggtaatgctcactgtgat

SEQ ID NO: 26573 - DNA, 25 bp, Mus musculus
aacaattgtgtgacctctgacctag

SEQ ID NO: 26574 - DNA, 25 bp, Mus musculus
aacaattgtgtgtcctctgacctag

SEQ ID NO: 26575 - DNA, 25 bp, Mus musculus
aacaattgtgttacctgatttgaag

SEQ ID NO: 26576 - DNA, 25 bp, Mus musculus
aacaattgtgtttcctgatttgaag

SEQ ID NO: 26577 - DNA, 25 bp, Mus musculus
aacaattgttggagtgcatggcctt

SEQ ID NO: 26578 - DNA, 25 bp, Mus musculus
aacaattgttggtgtgcatggcctt

SEQ ID NO: 26579 - DNA, 25 bp, Mus musculus
aacaattgtttgaaccccatgttct

SEQ ID NO: 26580 - DNA, 25 bp, Mus musculus
aacaattgtttgagggcatcagtaa

SEQ ID NO: 26581 - DNA, 25 bp, Mus musculus
aacaattgtttgtaccccatgttct

SEQ ID NO: 26582 - DNA, 25 bp, Mus musculus
aacaattgtttgtgggcatcagtaa

SEQ ID NO: 26583 - DNA, 25 bp, Mus musculus
aacaatttagagaccctggcagatt

SEQ ID NO: 26584 - DNA, 25 bp, Mus musculus
aacaatttagagtccctggcagatt

SEQ ID NO: 26585 - DNA, 25 bp, Mus musculus
aacaatttaggacgtgccgtggtct

SEQ ID NO: 26586 - DNA, 25 bp, Mus musculus
aacaatttaggaggtgccgtggtct

SEQ ID NO: 26587 - DNA, 25 bp, Mus musculus
aacaatttccatagccctccttttg

SEQ ID NO: 26588 - DNA, 25 bp, Mus musculus
aacaatttccattgccctccttttg

SEQ ID NO: 26589 - DNA, 25 bp, Mus musculus
aacaatttcctgaattttaagcatt

SEQ ID NO: 26590 - DNA, 25 bp, Mus musculus
aacaatttcctgtattttaagcatt

SEQ ID NO: 26591 - DNA, 25 bp, Mus musculus
aacaatttctaaattatccccacag

SEQ ID NO: 26592 - DNA, 25 bp, Mus musculus
aacaatttctaatttatccccacag

SEQ ID NO: 26593 - DNA, 25 bp, Mus musculus
aacaatttgcctatctacttatgag

SEQ ID NO: 26594 - DNA, 25 bp, Mus musculus
aacaatttgcctttctacttatgag

SEQ ID NO: 26595 - DNA, 25 bp, Mus musculus
aacaatttgctcatactgaatctta

SEQ ID NO: 26596 - DNA, 25 bp, Mus musculus
aacaatttgctcttactgaatctta

SEQ ID NO: 26597 - DNA, 25 bp, Mus musculus
aacacaaaatgtcttggtattcctc

SEQ ID NO: 26598 - DNA, 25 bp, Mus musculus
aacacaaaatgtgttggtattcctc

SEQ ID NO: 26599 - DNA, 25 bp, Mus musculus
aacacaaacaggcttgcgtgctcca

SEQ ID NO: 26600 - DNA, 25 bp, Mus musculus
aacacaaacagggttgcgtgctcca

SEQ ID NO: 26601 - DNA, 25 bp, Mus musculus
aacacaaacctccaagtgacgcttg

SEQ ID NO: 26602 - DNA, 25 bp, Mus musculus
aacacaaacctcgaagtgacgcttg

SEQ ID NO: 26603 - DNA, 25 bp, Mus musculus
aacacaaagactcgccgggtactct

SEQ ID NO: 26604 - DNA, 25 bp, Mus musculus
aacacaaagactggccgggtactct

SEQ ID NO: 26605 - DNA, 25 bp, Mus musculus
aacacaaagctcacagcgctttgcc

SEQ ID NO: 26606 - DNA, 25 bp, Mus musculus
aacacaaagctctcagcgctttgcc

SEQ ID NO: 26607 - DNA, 25 bp, Mus musculus
aacacaaatgaaagggaggctctgc

SEQ ID NO: 26608 - DNA, 25 bp, Mus musculus
aacacaaatgaatgggaggctctgc

SEQ ID NO: 26609 - DNA, 25 bp, Mus musculus
aacacaacagttacttagcttcatg

SEQ ID NO: 26610 - DNA, 25 bp, Mus musculus
aacacaacagtttcttagcttcatg

SEQ ID NO: 26611 - DNA, 25 bp, Mus musculus
aacacaacattactctttcccctgt

SEQ ID NO: 26612 - DNA, 25 bp, Mus musculus
aacacaacattagtctttcccctgt

SEQ ID NO: 26613 - DNA, 25 bp, Mus musculus
aacacaacccgcaaggacagtgaat

SEQ ID NO: 26614 - DNA, 25 bp, Mus musculus
aacacaacccgctaggacagtgaat

SEQ ID NO: 26615 - DNA, 25 bp, Mus musculus
aacacaaccgccattgctgaagcct

SEQ ID NO: 26616 - DNA, 25 bp, Mus musculus
aacacaaccgcctttgctgaagcct

SEQ ID NO: 26617 - DNA, 25 bp, Mus musculus
aacacaacgtggcttacagctcacc

SEQ ID NO: 26618 - DNA, 25 bp, Mus musculus
aacacaacgtgggttacagctcacc

SEQ ID NO: 26619 - DNA, 25 bp, Mus musculus
aacacaactactcacaagatgccgc

SEQ ID NO: 26620 - DNA, 25 bp, Mus musculus
aacacaactactgacaagatgccgc

SEQ ID NO: 26621 - DNA, 25 bp, Mus musculus
aacacaagagatactctctgcaccc

SEQ ID NO: 26622 - DNA, 25 bp, Mus musculus
aacacaagagattctctctgcaccc

SEQ ID NO: 26623 - DNA, 25 bp, Mus musculus
aacacaagccaccaatgatcctcag

SEQ ID NO: 26624 - DNA, 25 bp, Mus musculus
aacacaagccacgaatgatcctcag

SEQ ID NO: 26625 - DNA, 25 bp, Mus musculus
aacacaagcggcctttacaatcctt

SEQ ID NO: 26626 - DNA, 25 bp, Mus musculus
aacacaagcggcgtttacaatcctt

SEQ ID NO: 26627 - DNA, 25 bp, Mus musculus
aacacaaggcttcaccgtggagctt

SEQ ID NO: 26628 - DNA, 25 bp, Mus musculus
aacacaaggcttgaccgtggagctt

SEQ ID NO: 26629 - DNA, 25 bp, Mus musculus
aacacaagggccagacttgtcacca

SEQ ID NO: 26630 - DNA, 25 bp, Mus musculus
aacacaagggcctgacttgtcacca

SEQ ID NO: 26631 - DNA, 25 bp, Mus musculus
aacacaaggtgcagctgggcatcaa

SEQ ID NO: 26632 - DNA, 25 bp, Mus musculus
aacacaaggtgctgctgggcatcaa

SEQ ID NO: 26633 - DNA, 25 bp, Mus musculus
aacacaagtattcgtcccacatcct

SEQ ID NO: 26634 - DNA, 25 bp, Mus musculus
aacacaagtattggtcccacatcct

SEQ ID NO: 26635 - DNA, 25 bp, Mus musculus
aacacaagtctaagtcccgatcaag

SEQ ID NO: 26636 - DNA, 25 bp, Mus musculus
aacacaagtctatgtcccgatcaag

SEQ ID NO: 26637 - DNA, 25 bp, Mus musculus
aacacaatggatatacaggtagcta

SEQ ID NO: 26638 - DNA, 25 bp, Mus musculus
aacacaatggatttacaggtagcta

SEQ ID NO: 26639 - DNA, 25 bp, Mus musculus
aacacaatggctacacgggtggatg

SEQ ID NO: 26640 - DNA, 25 bp, Mus musculus
aacacaatggcttcacgggtggatg

SEQ ID NO: 26641 - DNA, 25 bp, Mus musculus
aacacaatgtaccacttctcctgtg

SEQ ID NO: 26642 - DNA, 25 bp, Mus musculus
aacacaatgtacgacttctcctgtg

SEQ ID NO: 26643 - DNA, 25 bp, Mus musculus
aacacaattatcatggggccgagga

SEQ ID NO: 26644 - DNA, 25 bp, Mus musculus
aacacaattatcttggggccgagga

SEQ ID NO: 26645 - DNA, 25 bp, Mus musculus
aacacaattcacatcttccttagca

SEQ ID NO: 26646 - DNA, 25 bp, Mus musculus
aacacaattcacttcttccttagca

SEQ ID NO: 26647 - DNA, 25 bp, Mus musculus
aacacaattcttaccagacattgaa

SEQ ID NO: 26648 - DNA, 25 bp, Mus musculus
aacacaattctttccagacattgaa

SEQ ID NO: 26649 - DNA, 25 bp, Mus musculus
aacacaattgatatgctgcagtttg

SEQ ID NO: 26650 - DNA, 25 bp, Mus musculus
aacacaattgatttgctgcagtttg

SEQ ID NO: 26651 - DNA, 25 bp, Mus musculus
aacacaattggcatcttgacattca

SEQ ID NO: 26652 - DNA, 25 bp, Mus musculus
aacacaattggcttcttgacattca

SEQ ID NO: 26653 - DNA, 25 bp, Mus musculus
aacacaattgttatgcttggacttt

SEQ ID NO: 26654 - DNA, 25 bp, Mus musculus
aacacaattgttttgcttggacttt

SEQ ID NO: 26655 - DNA, 25 bp, Mus musculus
aacacacaaaacacgcaggcaatcc

SEQ ID NO: 26656 - DNA, 25 bp, Mus musculus
aacacacaaaactcgcaggcaatcc

SEQ ID NO: 26657 - DNA, 25 bp, Mus musculus
aacacacaagcaaccttcagttcac

SEQ ID NO: 26658 - DNA, 25 bp, Mus musculus
aacacacaagcatccttcagttcac

SEQ ID NO: 26659 - DNA, 25 bp, Mus musculus
aacacacaaggactttacacactgc

SEQ ID NO: 26660 - DNA, 25 bp, Mus musculus
aacacacaaggagtttacacactgc

SEQ ID NO: 26661 - DNA, 25 bp, Mus musculus
aacacacacagtaaatcgggctccc

SEQ ID NO: 26662 - DNA, 25 bp, Mus musculus
aacacacacagttaatcgggctccc

SEQ ID NO: 26663 - DNA, 25 bp, Mus musculus
aacacacaccataagctttacacaa

SEQ ID NO: 26664 - DNA, 25 bp, Mus musculus
aacacacaccattagctttacacaa

SEQ ID NO: 26665 - DNA, 25 bp, Mus musculus
aacacacaccccagcatggagggat

SEQ ID NO: 26666 - DNA, 25 bp, Mus musculus
aacacacacccctgcatggagggat

SEQ ID NO: 26667 - DNA, 25 bp, Mus musculus
aacacacaccgaatgcaatgagctg

SEQ ID NO: 26668 - DNA, 25 bp, Mus musculus
aacacacaccgattgcaatgagctg

SEQ ID NO: 26669 - DNA, 25 bp, Mus musculus
aacacacacctaaagccatgctgta

SEQ ID NO: 26670 - DNA, 25 bp, Mus musculus
aacacacacctatagccatgctgta

SEQ ID NO: 26671 - DNA, 25 bp, Mus musculus
aacacacagaagagcttccttaaag

SEQ ID NO: 26672 - DNA, 25 bp, Mus musculus
aacacacagaagtgcttccttaaag

SEQ ID NO: 26673 - DNA, 25 bp, Mus musculus
aacacacagatactgctggagagat

SEQ ID NO: 26674 - DNA, 25 bp, Mus musculus
aacacacagatagtgctggagagat

SEQ ID NO: 26675 - DNA, 25 bp, Mus musculus
aacacacaggaactctgagagagaa

SEQ ID NO: 26676 - DNA, 25 bp, Mus musculus
aacacacaggaagtctgagagagaa

SEQ ID NO: 26677 - DNA, 25 bp, Mus musculus
aacacacagggccattactggtgct

SEQ ID NO: 26678 - DNA, 25 bp, Mus musculus
aacacacagggcgattactggtgct

SEQ ID NO: 26679 - DNA, 25 bp, Mus musculus
aacacacagggtaaactgttcacaa

SEQ ID NO: 26680 - DNA, 25 bp, Mus musculus
aacacacagggttaactgttcacaa

SEQ ID NO: 26681 - DNA, 25 bp, Mus musculus
aacacacaggtcaagttgtccacaa

SEQ ID NO: 26682 - DNA, 25 bp, Mus musculus
aacacacaggtctagttgtccacaa

SEQ ID NO: 26683 - DNA, 25 bp, Mus musculus
aacacacagttcagttgtatcagtt

SEQ ID NO: 26684 - DNA, 25 bp, Mus musculus
aacacacagttcatccacctcgtca

SEQ ID NO: 26685 - DNA, 25 bp, Mus musculus
aacacacagttctgttgtatcagtt

SEQ ID NO: 26686 - DNA, 25 bp, Mus musculus
aacacacagttcttccacctcgtca

SEQ ID NO: 26687 - DNA, 25 bp, Mus musculus
aacacacagttgctgattagtacag

SEQ ID NO: 26688 - DNA, 25 bp, Mus musculus
aacacacagttggtgattagtacag

SEQ ID NO: 26689 - DNA, 25 bp, Mus musculus
aacacacatcccctgcttgtagatt

SEQ ID NO: 26690 - DNA, 25 bp, Mus musculus
aacacacatcccgtgcttgtagatt

SEQ ID NO: 26691 - DNA, 25 bp, Mus musculus
aacacacatgcgaatagtagaccaa

SEQ ID NO: 26692 - DNA, 25 bp, Mus musculus
aacacacatgcgtatagtagaccaa

SEQ ID NO: 26693 - DNA, 25 bp, Mus musculus
aacacacatggaacaggcacacgct

SEQ ID NO: 26694 - DNA, 25 bp, Mus musculus
aacacacatggatcaggcacacgct

SEQ ID NO: 26695 - DNA, 25 bp, Mus musculus
aacacacatttgacgaagtctgtac

SEQ ID NO: 26696 - DNA, 25 bp, Mus musculus
aacacacatttgtcgaagtctgtac

SEQ ID NO: 26697 - DNA, 25 bp, Mus musculus
aacacaccaagtacgtgcgggacat

SEQ ID NO: 26698 - DNA, 25 bp, Mus musculus
aacacaccaagttcgtgcgggacat

SEQ ID NO: 26699 - DNA, 25 bp, Mus musculus
aacacaccagacaaactccagaaaa

SEQ ID NO: 26700 - DNA, 25 bp, Mus musculus
aacacaccagactaactccagaaaa

SEQ ID NO: 26701 - DNA, 25 bp, Mus musculus
aacacaccagataaactgtccccag

SEQ ID NO: 26702 - DNA, 25 bp, Mus musculus
aacacaccagattaactgtccccag

SEQ ID NO: 26703 - DNA, 25 bp, Mus musculus
aacacaccagttcatgatttccata

SEQ ID NO: 26704 - DNA, 25 bp, Mus musculus
aacacaccagttgatgatttccata

SEQ ID NO: 26705 - DNA, 25 bp, Mus musculus
aacacaccattcctctggcagagtg

SEQ ID NO: 26706 - DNA, 25 bp, Mus musculus
aacacaccattcgtctggcagagtg

SEQ ID NO: 26707 - DNA, 25 bp, Mus musculus
aacacacccaccaatttacttcgca

SEQ ID NO: 26708 - DNA, 25 bp, Mus musculus
aacacacccacctatttacttcgca

SEQ ID NO: 26709 - DNA, 25 bp, Mus musculus
aacacacccactcgctaaggacaaa

SEQ ID NO: 26710 - DNA, 25 bp, Mus musculus
aacacacccactggctaaggacaaa

SEQ ID NO: 26711 - DNA, 25 bp, Mus musculus
aacacacctgacactacaaatctac

SEQ ID NO: 26712 - DNA, 25 bp, Mus musculus
aacacacctgactctacaaatctac

SEQ ID NO: 26713 - DNA, 25 bp, Mus musculus
aacacacggatgaccactcctcatt

SEQ ID NO: 26714 - DNA, 25 bp, Mus musculus
aacacacggatgtccactcctcatt

SEQ ID NO: 26715 - DNA, 25 bp, Mus musculus
aacacacgttaacagacactcgaga

SEQ ID NO: 26716 - DNA, 25 bp, Mus musculus
aacacacgttaagagacactcgaga

SEQ ID NO: 26717 - DNA, 25 bp, Mus musculus
aacacactaaacatttccagctgag

SEQ ID NO: 26718 - DNA, 25 bp, Mus musculus
aacacactaaacttttccagctgag

SEQ ID NO: 26719 - DNA, 25 bp, Mus musculus
aacacactaaagctccagatctcct

SEQ ID NO: 26720 - DNA, 25 bp, Mus musculus
aacacactaaaggtccagatctcct

SEQ ID NO: 26721 - DNA, 25 bp, Mus musculus
aacacactacacacgaatcttttca

SEQ ID NO: 26722 - DNA, 25 bp, Mus musculus
aacacactacactcgaatcttttca

SEQ ID NO: 26723 - DNA, 25 bp, Mus musculus
aacacactactcaacaataccttgg

SEQ ID NO: 26724 - DNA, 25 bp, Mus musculus
aacacactactctacaataccttgg

SEQ ID NO: 26725 - DNA, 25 bp, Mus musculus
aacacactatacagttgcgtccaac

SEQ ID NO: 26726 - DNA, 25 bp, Mus musculus
aacacactatactgttgcgtccaac

SEQ ID NO: 26727 - DNA, 25 bp, Mus musculus
aacacactcacgagtgatgccctga

SEQ ID NO: 26728 - DNA, 25 bp, Mus musculus
aacacactcacgtgtgatgccctga

SEQ ID NO: 26729 - DNA, 25 bp, Mus musculus
aacacactcataatcctttgtcatt

SEQ ID NO: 26730 - DNA, 25 bp, Mus musculus
aacacactcatattcctttgtcatt

SEQ ID NO: 26731 - DNA, 25 bp, Mus musculus
aacacactgaaacggtagcagcgtt

SEQ ID NO: 26732 - DNA, 25 bp, Mus musculus
aacacactgaaagggtagcagcgtt

SEQ ID NO: 26733 - DNA, 25 bp, Mus musculus
aacacactgaccaggcctaggtatg

SEQ ID NO: 26734 - DNA, 25 bp, Mus musculus
aacacactgacctggcctaggtatg

SEQ ID NO: 26735 - DNA, 25 bp, Mus musculus
aacacactgcaacctggacttgtga

SEQ ID NO: 26736 - DNA, 25 bp, Mus musculus
aacacactgcaagctggacttgtga

SEQ ID NO: 26737 - DNA, 25 bp, Mus musculus
aacacactgccaagtcttaatgaat

SEQ ID NO: 26738 - DNA, 25 bp, Mus musculus
aacacactgccatgtcttaatgaat

SEQ ID NO: 26739 - DNA, 25 bp, Mus musculus
aacacactgtccaatggctgggctg

SEQ ID NO: 26740 - DNA, 25 bp, Mus musculus
aacacactgtcctatggctgggctg

SEQ ID NO: 26741 - DNA, 25 bp, Mus musculus
aacacactgtgccacccagagcaat

SEQ ID NO: 26742 - DNA, 25 bp, Mus musculus
aacacactgtgcgacccagagcaat

SEQ ID NO: 26743 - DNA, 25 bp, Mus musculus
aacacactgttcaccctttgtattc

SEQ ID NO: 26744 - DNA, 25 bp, Mus musculus
aacacactgttcattagtcattcaa

SEQ ID NO: 26745 - DNA, 25 bp, Mus musculus
aacacactgttcattatgtaaggta

SEQ ID NO: 26746 - DNA, 25 bp, Mus musculus
aacacactgttctccctttgtattc

SEQ ID NO: 26747 - DNA, 25 bp, Mus musculus
aacacactgttctttagtcattcaa

SEQ ID NO: 26748 - DNA, 25 bp, Mus musculus
aacacactgttctttatgtaaggta

SEQ ID NO: 26749 - DNA, 25 bp, Mus musculus
aacacacttactcaaagggagcgta

SEQ ID NO: 26750 - DNA, 25 bp, Mus musculus
aacacacttactgaaagggagcgta

SEQ ID NO: 26751 - DNA, 25 bp, Mus musculus
aacacacttgcgatataaacctgaa

SEQ ID NO: 26752 - DNA, 25 bp, Mus musculus
aacacacttgcgttataaacctgaa

SEQ ID NO: 26753 - DNA, 25 bp, Mus musculus
aacacacttgtccttgtctcacaac

SEQ ID NO: 26754 - DNA, 25 bp, Mus musculus
aacacacttgtcgttgtctcacaac

SEQ ID NO: 26755 - DNA, 25 bp, Mus musculus
aacacacttgttctgcagcatacat

SEQ ID NO: 26756 - DNA, 25 bp, Mus musculus
aacacacttgttgtgcagcatacat

SEQ ID NO: 26757 - DNA, 25 bp, Mus musculus
aacacactttctcgtgatacccaag

SEQ ID NO: 26758 - DNA, 25 bp, Mus musculus
aacacactttctggtgatacccaag

SEQ ID NO: 26759 - DNA, 25 bp, Mus musculus
aacacacttttgaccactgagcttt

SEQ ID NO: 26760 - DNA, 25 bp, Mus musculus
aacacacttttgtccactgagcttt

SEQ ID NO: 26761 - DNA, 25 bp, Mus musculus
aacacagaacacattcaggcctcca

SEQ ID NO: 26762 - DNA, 25 bp, Mus musculus
aacacagaacactttcaggcctcca

SEQ ID NO: 26763 - DNA, 25 bp, Mus musculus
aacacagaagcacctgtgctcagca

SEQ ID NO: 26764 - DNA, 25 bp, Mus musculus
aacacagaagcagctgtgctcagca

SEQ ID NO: 26765 - DNA, 25 bp, Mus musculus
aacacagaagctccagcagcggtgg

SEQ ID NO: 26766 - DNA, 25 bp, Mus musculus
aacacagaagctgcagcagcggtgg

SEQ ID NO: 26767 - DNA, 25 bp, Mus musculus
aacacagaaggacccatctcttgat

SEQ ID NO: 26768 - DNA, 25 bp, Mus musculus
aacacagaaggagccatctcttgat

SEQ ID NO: 26769 - DNA, 25 bp, Mus musculus
aacacagacattagcatccccgaat

SEQ ID NO: 26770 - DNA, 25 bp, Mus musculus
aacacagacattatgcccatcttgt

SEQ ID NO: 26771 - DNA, 25 bp, Mus musculus
aacacagacatttgcatccccgaat

SEQ ID NO: 26772 - DNA, 25 bp, Mus musculus
aacacagacattttgcccatcttgt

SEQ ID NO: 26773 - DNA, 25 bp, Mus musculus
aacacagaccccatcaagtttgaga

SEQ ID NO: 26774 - DNA, 25 bp, Mus musculus
aacacagaccccttcaagtttgaga

SEQ ID NO: 26775 - DNA, 25 bp, Mus musculus
aacacagacccgcacaaaaaggcat

SEQ ID NO: 26776 - DNA, 25 bp, Mus musculus
aacacagacccggacaaaaaggcat

SEQ ID NO: 26777 - DNA, 25 bp, Mus musculus
aacacagacgtacggcacagcagct

SEQ ID NO: 26778 - DNA, 25 bp, Mus musculus
aacacagacgtagggcacagcagct

SEQ ID NO: 26779 - DNA, 25 bp, Mus musculus
aacacagactaacgctgatcttcaa

SEQ ID NO: 26780 - DNA, 25 bp, Mus musculus
aacacagactaaggctgatcttcaa

SEQ ID NO: 26781 - DNA, 25 bp, Mus musculus
aacacagactgtccctgtgggagga

SEQ ID NO: 26782 - DNA, 25 bp, Mus musculus
aacacagactgtgcctgtgggagga

SEQ ID NO: 26783 - DNA, 25 bp, Mus musculus
aacacagagctactttggcagtact

SEQ ID NO: 26784 - DNA, 25 bp, Mus musculus
aacacagagctagtttggcagtact

SEQ ID NO: 26785 - DNA, 25 bp, Mus musculus
aacacagagctgctctagtttatca

SEQ ID NO: 26786 - DNA, 25 bp, Mus musculus
aacacagagctggtctagtttatca

SEQ ID NO: 26787 - DNA, 25 bp, Mus musculus
aacacagaggctaactatagaaatc

SEQ ID NO: 26788 - DNA, 25 bp, Mus musculus
aacacagaggcttactatagaaatc

SEQ ID NO: 26789 - DNA, 25 bp, Mus musculus
aacacagatccacatgtcgcagcat

SEQ ID NO: 26790 - DNA, 25 bp, Mus musculus
aacacagatccagatgtcgcagcat

SEQ ID NO: 26791 - DNA, 25 bp, Mus musculus
aacacagatctgcatggccatgtaa

SEQ ID NO: 26792 - DNA, 25 bp, Mus musculus
aacacagatctggatggccatgtaa

SEQ ID NO: 26793 - DNA, 25 bp, Mus musculus
aacacagatggcatcaccttgcaac

SEQ ID NO: 26794 - DNA, 25 bp, Mus musculus
aacacagatggcttcaccttgcaac

SEQ ID NO: 26795 - DNA, 25 bp, Mus musculus
aacacagcaaaccagggtcagccag

SEQ ID NO: 26796 - DNA, 25 bp, Mus musculus
aacacagcaaacgagggtcagccag

SEQ ID NO: 26797 - DNA, 25 bp, Mus musculus
aacacagcaatgatcccacatcatc

SEQ ID NO: 26798 - DNA, 25 bp, Mus musculus
aacacagcaatgttcccacatcatc

SEQ ID NO: 26799 - DNA, 25 bp, Mus musculus
aacacagcacttaaattcccatgag

SEQ ID NO: 26800 - DNA, 25 bp, Mus musculus
aacacagcacttccatatcccatgt

SEQ ID NO: 26801 - DNA, 25 bp, Mus musculus
aacacagcacttgcatatcccatgt

SEQ ID NO: 26802 - DNA, 25 bp, Mus musculus
aacacagcactttaattcccatgag

SEQ ID NO: 26803 - DNA, 25 bp, Mus musculus
aacacagcagaaccacacgagtatt

SEQ ID NO: 26804 - DNA, 25 bp, Mus musculus
aacacagcagaagcacacgagtatt

SEQ ID NO: 26805 - DNA, 25 bp, Mus musculus
aacacagcagagatttagtcggaac

SEQ ID NO: 26806 - DNA, 25 bp, Mus musculus
aacacagcagagttttagtcggaac

SEQ ID NO: 26807 - DNA, 25 bp, Mus musculus
aacacagcagctattccttgacggt

SEQ ID NO: 26808 - DNA, 25 bp, Mus musculus
aacacagcagcttttccttgacggt

SEQ ID NO: 26809 - DNA, 25 bp, Mus musculus
aacacagcagtgatagcaggtcacg

SEQ ID NO: 26810 - DNA, 25 bp, Mus musculus
aacacagcagtgttagcaggtcacg

SEQ ID NO: 26811 - DNA, 25 bp, Mus musculus
aacacagcatcgatctcttctcttt

SEQ ID NO: 26812 - DNA, 25 bp, Mus musculus
aacacagcatcgttctcttctcttt

SEQ ID NO: 26813 - DNA, 25 bp, Mus musculus
aacacagcattgactgaggccaagt

SEQ ID NO: 26814 - DNA, 25 bp, Mus musculus
aacacagcattgtctgaggccaagt

SEQ ID NO: 26815 - DNA, 25 bp, Mus musculus
aacacagccaagctcgaccgggaga

SEQ ID NO: 26816 - DNA, 25 bp, Mus musculus
aacacagccaaggtcgaccgggaga

SEQ ID NO: 26817 - DNA, 25 bp, Mus musculus
aacacagccacccaagcaaagttga

SEQ ID NO: 26818 - DNA, 25 bp, Mus musculus
aacacagccaccgaagcaaagttga

SEQ ID NO: 26819 - DNA, 25 bp, Mus musculus
aacacagcccctcctgggtgacata

SEQ ID NO: 26820 - DNA, 25 bp, Mus musculus
aacacagcccctgctgggtgacata

SEQ ID NO: 26821 - DNA, 25 bp, Mus musculus
aacacagccttcagcacaggtccgt

SEQ ID NO: 26822 - DNA, 25 bp, Mus musculus
aacacagccttctgcacaggtccgt

SEQ ID NO: 26823 - DNA, 25 bp, Mus musculus
aacacagccttgatagatcccagct

SEQ ID NO: 26824 - DNA, 25 bp, Mus musculus
aacacagccttgttagatcccagct

SEQ ID NO: 26825 - DNA, 25 bp, Mus musculus
aacacagcctttccattgtggcaaa

SEQ ID NO: 26826 - DNA, 25 bp, Mus musculus
aacacagcctttctagctaacgggt

SEQ ID NO: 26827 - DNA, 25 bp, Mus musculus
aacacagcctttgcattgtggcaaa

SEQ ID NO: 26828 - DNA, 25 bp, Mus musculus
aacacagcctttgtagctaacgggt

SEQ ID NO: 26829 - DNA, 25 bp, Mus musculus
aacacagcgacgatgctggactggc

SEQ ID NO: 26830 - DNA, 25 bp, Mus musculus
aacacagcgacgttgctggactggc

SEQ ID NO: 26831 - DNA, 25 bp, Mus musculus
aacacagctaaaaagtgtgcttgtg

SEQ ID NO: 26832 - DNA, 25 bp, Mus musculus
aacacagctaaatagtgtgcttgtg

SEQ ID NO: 26833 - DNA, 25 bp, Mus musculus
aacacagctatacctaacgcacata

SEQ ID NO: 26834 - DNA, 25 bp, Mus musculus
aacacagctatagctaacgcacata

SEQ ID NO: 26835 - DNA, 25 bp, Mus musculus
aacacagctcctatcttcaaagtct

SEQ ID NO: 26836 - DNA, 25 bp, Mus musculus
aacacagctcctttcttcaaagtct

SEQ ID NO: 26837 - DNA, 25 bp, Mus musculus
aacacagctcgaattctcaagacag

SEQ ID NO: 26838 - DNA, 25 bp, Mus musculus
aacacagctcgatttctcaagacag

SEQ ID NO: 26839 - DNA, 25 bp, Mus musculus
aacacagctctgattcatcaggtat

SEQ ID NO: 26840 - DNA, 25 bp, Mus musculus
aacacagctctgtttcatcaggtat

SEQ ID NO: 26841 - DNA, 25 bp, Mus musculus
aacacagctgtgataggacctggag

SEQ ID NO: 26842 - DNA, 25 bp, Mus musculus
aacacagctgtgttaggacctggag

SEQ ID NO: 26843 - DNA, 25 bp, Mus musculus
aacacagcttggattgtactacgga

SEQ ID NO: 26844 - DNA, 25 bp, Mus musculus
aacacagcttggtttgtactacgga

SEQ ID NO: 26845 - DNA, 25 bp, Mus musculus
aacacagcttttatactatgccgcc

SEQ ID NO: 26846 - DNA, 25 bp, Mus musculus
aacacagcttttttactatgccgcc

SEQ ID NO: 26847 - DNA, 25 bp, Mus musculus
aacacaggaaggagaccaggcagag

SEQ ID NO: 26848 - DNA, 25 bp, Mus musculus
aacacaggaaggtgaccaggcagag

SEQ ID NO: 26849 - DNA, 25 bp, Mus musculus
aacacaggaagtccggtggtccttg

SEQ ID NO: 26850 - DNA, 25 bp, Mus musculus
aacacaggaagtgcggtggtccttg

SEQ ID NO: 26851 - DNA, 25 bp, Mus musculus
aacacaggacgaaagcacagagctc

SEQ ID NO: 26852 - DNA, 25 bp, Mus musculus
aacacaggacgatagcacagagctc

SEQ ID NO: 26853 - DNA, 25 bp, Mus musculus
aacacaggagaccttcgagtcagcc

SEQ ID NO: 26854 - DNA, 25 bp, Mus musculus
aacacaggagacgttcgagtcagcc

SEQ ID NO: 26855 - DNA, 25 bp, Mus musculus
aacacaggatcaaccaagctgttgt

SEQ ID NO: 26856 - DNA, 25 bp, Mus musculus
aacacaggatcatccaagctgttgt

SEQ ID NO: 26857 - DNA, 25 bp, Mus musculus
aacacaggatcgactttgaactcag

SEQ ID NO: 26858 - DNA, 25 bp, Mus musculus
aacacaggatcgtctttgaactcag

SEQ ID NO: 26859 - DNA, 25 bp, Mus musculus
aacacaggcagtacaggccttctcg

SEQ ID NO: 26860 - DNA, 25 bp, Mus musculus
aacacaggcagttcaggccttctcg

SEQ ID NO: 26861 - DNA, 25 bp, Mus musculus
aacacaggccacagtttgggagcaa

SEQ ID NO: 26862 - DNA, 25 bp, Mus musculus
aacacaggccactgtttgggagcaa

SEQ ID NO: 26863 - DNA, 25 bp, Mus musculus
aacacaggccgtagttctgtactgt

SEQ ID NO: 26864 - DNA, 25 bp, Mus musculus
aacacaggccgttgttctgtactgt

SEQ ID NO: 26865 - DNA, 25 bp, Mus musculus
aacacaggctccaaacagaatcttg

SEQ ID NO: 26866 - DNA, 25 bp, Mus musculus
aacacaggctcctaacagaatcttg

SEQ ID NO: 26867 - DNA, 25 bp, Mus musculus
aacacaggctgtaaacaagttggca

SEQ ID NO: 26868 - DNA, 25 bp, Mus musculus
aacacaggctgtaggatcgcggatc

SEQ ID NO: 26869 - DNA, 25 bp, Mus musculus
aacacaggctgttaacaagttggca

SEQ ID NO: 26870 - DNA, 25 bp, Mus musculus
aacacaggctgttggatcgcggatc

SEQ ID NO: 26871 - DNA, 25 bp, Mus musculus
aacacaggcttcagggccaattaca

SEQ ID NO: 26872 - DNA, 25 bp, Mus musculus
aacacaggcttccagtgactcactt

SEQ ID NO: 26873 - DNA, 25 bp, Mus musculus
aacacaggcttcgagtgactcactt

SEQ ID NO: 26874 - DNA, 25 bp, Mus musculus
aacacaggcttctgggccaattaca

SEQ ID NO: 26875 - DNA, 25 bp, Mus musculus
aacacagggcatcttcggttccttt

SEQ ID NO: 26876 - DNA, 25 bp, Mus musculus
aacacagggcatgttcggttccttt

SEQ ID NO: 26877 - DNA, 25 bp, Mus musculus
aacacagggcctaacacatgctaga

SEQ ID NO: 26878 - DNA, 25 bp, Mus musculus
aacacagggccttacacatgctaga

SEQ ID NO: 26879 - DNA, 25 bp, Mus musculus
aacacagggctaatgatcagtctaa

SEQ ID NO: 26880 - DNA, 25 bp, Mus musculus
aacacagggctattgatcagtctaa

SEQ ID NO: 26881 - DNA, 25 bp, Mus musculus
aacacagggctgaaagatagtaact

SEQ ID NO: 26882 - DNA, 25 bp, Mus musculus
aacacagggctgctttcgagtggaa

SEQ ID NO: 26883 - DNA, 25 bp, Mus musculus
aacacagggctggtttcgagtggaa

SEQ ID NO: 26884 - DNA, 25 bp, Mus musculus
aacacagggctgtaagatagtaact

SEQ ID NO: 26885 - DNA, 25 bp, Mus musculus
aacacagggtcacccactgaggttc

SEQ ID NO: 26886 - DNA, 25 bp, Mus musculus
aacacagggtcagccactgaggttc

SEQ ID NO: 26887 - DNA, 25 bp, Mus musculus
aacacaggtacccatttgccttcct

SEQ ID NO: 26888 - DNA, 25 bp, Mus musculus
aacacaggtaccgatttgccttcct

SEQ ID NO: 26889 - DNA, 25 bp, Mus musculus
aacacaggtgaaaggcatagaaaat

SEQ ID NO: 26890 - DNA, 25 bp, Mus musculus
aacacaggtgaatggcatagaaaat

SEQ ID NO: 26891 - DNA, 25 bp, Mus musculus
aacacaggtggaaacaggacttcaa

SEQ ID NO: 26892 - DNA, 25 bp, Mus musculus
aacacaggtggatacaggacttcaa

SEQ ID NO: 26893 - DNA, 25 bp, Mus musculus
aacacagtaggcactggccatgcct

SEQ ID NO: 26894 - DNA, 25 bp, Mus musculus
aacacagtaggccaagctttagagc

SEQ ID NO: 26895 - DNA, 25 bp, Mus musculus
aacacagtaggcgaagctttagagc

SEQ ID NO: 26896 - DNA, 25 bp, Mus musculus
aacacagtaggctctggccatgcct

SEQ ID NO: 26897 - DNA, 25 bp, Mus musculus
aacacagtaggtagctatcctcctc

SEQ ID NO: 26898 - DNA, 25 bp, Mus musculus
aacacagtaggttgctatcctcctc

SEQ ID NO: 26899 - DNA, 25 bp, Mus musculus
aacacagtcacaatcctcatgtact

SEQ ID NO: 26900 - DNA, 25 bp, Mus musculus
aacacagtcacattcctcatgtact

SEQ ID NO: 26901 - DNA, 25 bp, Mus musculus
aacacagtcagtctcacaggccaaa

SEQ ID NO: 26902 - DNA, 25 bp, Mus musculus
aacacagtcagtgtcacaggccaaa

SEQ ID NO: 26903 - DNA, 25 bp, Mus musculus
aacacagtcctccagcaaaacagat

SEQ ID NO: 26904 - DNA, 25 bp, Mus musculus
aacacagtcctcgagcaaaacagat

SEQ ID NO: 26905 - DNA, 25 bp, Mus musculus
aacacagtcctgatctgctgtttgt

SEQ ID NO: 26906 - DNA, 25 bp, Mus musculus
aacacagtcctgttctgctgtttgt

SEQ ID NO: 26907 - DNA, 25 bp, Mus musculus
aacacagtcttcaggaggcggaggc

SEQ ID NO: 26908 - DNA, 25 bp, Mus musculus
aacacagtcttcattaaggccagca

SEQ ID NO: 26909 - DNA, 25 bp, Mus musculus
aacacagtcttctggaggcggaggc

SEQ ID NO: 26910 - DNA, 25 bp, Mus musculus
aacacagtcttctttaaggccagca

SEQ ID NO: 26911 - DNA, 25 bp, Mus musculus
aacacagtgacacatccctcggtga

SEQ ID NO: 26912 - DNA, 25 bp, Mus musculus
aacacagtgacagatccctcggtga

SEQ ID NO: 26913 - DNA, 25 bp, Mus musculus
aacacagtgactatatttcccaagt

SEQ ID NO: 26914 - DNA, 25 bp, Mus musculus
aacacagtgactttatttcccaagt

SEQ ID NO: 26915 - DNA, 25 bp, Mus musculus
aacacagtgataaaaaccctctccc

SEQ ID NO: 26916 - DNA, 25 bp, Mus musculus
aacacagtgatataaaccctctccc

SEQ ID NO: 26917 - DNA, 25 bp, Mus musculus
aacacagtgatcaccaactcttcac

SEQ ID NO: 26918 - DNA, 25 bp, Mus musculus
aacacagtgatctccaactcttcac

SEQ ID NO: 26919 - DNA, 25 bp, Mus musculus
aacacagtgcctacgagtatatacg

SEQ ID NO: 26920 - DNA, 25 bp, Mus musculus
aacacagtgccttcgagtatatacg

SEQ ID NO: 26921 - DNA, 25 bp, Mus musculus
aacacagtgtaacccgctgtcaata

SEQ ID NO: 26922 - DNA, 25 bp, Mus musculus
aacacagtgtaagccgctgtcaata

SEQ ID NO: 26923 - DNA, 25 bp, Mus musculus
aacacagtgtttaaagacccaggct

SEQ ID NO: 26924 - DNA, 25 bp, Mus musculus
aacacagtgtttcctttactctgaa

SEQ ID NO: 26925 - DNA, 25 bp, Mus musculus
aacacagtgtttgctttactctgaa

SEQ ID NO: 26926 - DNA, 25 bp, Mus musculus
aacacagtgttttaagacccaggct

SEQ ID NO: 26927 - DNA, 25 bp, Mus musculus
aacacagttccaacctgaggacaga

SEQ ID NO: 26928 - DNA, 25 bp, Mus musculus
aacacagttccatcctgaggacaga

SEQ ID NO: 26929 - DNA, 25 bp, Mus musculus
aacacagttcctctaagatagccac

SEQ ID NO: 26930 - DNA, 25 bp, Mus musculus
aacacagttcctgtaagatagccac

SEQ ID NO: 26931 - DNA, 25 bp, Mus musculus
aacacagttcttacctgctgaccta

SEQ ID NO: 26932 - DNA, 25 bp, Mus musculus
aacacagttctttcctgctgaccta

SEQ ID NO: 26933 - DNA, 25 bp, Mus musculus
aacacagttgccaaacttgtcagct

SEQ ID NO: 26934 - DNA, 25 bp, Mus musculus
aacacagttgcctaacttgtcagct

SEQ ID NO: 26935 - DNA, 25 bp, Mus musculus
aacacagttgtacctacagccgctt

SEQ ID NO: 26936 - DNA, 25 bp, Mus musculus
aacacagttgtagctacagccgctt

SEQ ID NO: 26937 - DNA, 25 bp, Mus musculus
aacacataaatgctccccagctcag

SEQ ID NO: 26938 - DNA, 25 bp, Mus musculus
aacacataaatggtccccagctcag

SEQ ID NO: 26939 - DNA, 25 bp, Mus musculus
aacacataacttaaatatgcagtgg

SEQ ID NO: 26940 - DNA, 25 bp, Mus musculus
aacacataactttaatatgcagtgg

SEQ ID NO: 26941 - DNA, 25 bp, Mus musculus
aacacatacacacttaccctattgt

SEQ ID NO: 26942 - DNA, 25 bp, Mus musculus
aacacatacacagttaccctattgt

SEQ ID NO: 26943 - DNA, 25 bp, Mus musculus
aacacatacagcaacactacttgag

SEQ ID NO: 26944 - DNA, 25 bp, Mus musculus
aacacatacagctacactacttgag

SEQ ID NO: 26945 - DNA, 25 bp, Mus musculus
aacacatacctgctttggtgcctgt

SEQ ID NO: 26946 - DNA, 25 bp, Mus musculus
aacacatacctggtttggtgcctgt

SEQ ID NO: 26947 - DNA, 25 bp, Mus musculus
aacacatacgccacgcgacgttgga

SEQ ID NO: 26948 - DNA, 25 bp, Mus musculus
aacacatacgcctcgcgacgttgga

SEQ ID NO: 26949 - DNA, 25 bp, Mus musculus
aacacatacggtcgcgaggtgctga

SEQ ID NO: 26950 - DNA, 25 bp, Mus musculus
aacacatacggtggcgaggtgctga

SEQ ID NO: 26951 - DNA, 25 bp, Mus musculus
aacacatacgtcatcggcctgctgg

SEQ ID NO: 26952 - DNA, 25 bp, Mus musculus
aacacatacgtcttcggcctgctgg

SEQ ID NO: 26953 - DNA, 25 bp, Mus musculus
aacacatagagaatccttgctggag

SEQ ID NO: 26954 - DNA, 25 bp, Mus musculus
aacacatagagattccttgctggag

SEQ ID NO: 26955 - DNA, 25 bp, Mus musculus
aacacatagctgatgtacaatgaag

SEQ ID NO: 26956 - DNA, 25 bp, Mus musculus
aacacatagctgttgtacaatgaag

SEQ ID NO: 26957 - DNA, 25 bp, Mus musculus
aacacataggtcagacttccctcta

SEQ ID NO: 26958 - DNA, 25 bp, Mus musculus
aacacataggtctgacttccctcta

SEQ ID NO: 26959 - DNA, 25 bp, Mus musculus
aacacataggttcatgcaggtgatg

SEQ ID NO: 26960 - DNA, 25 bp, Mus musculus
aacacataggttgatgcaggtgatg

SEQ ID NO: 26961 - DNA, 25 bp, Mus musculus
aacacatataatcatcatacttctg

SEQ ID NO: 26962 - DNA, 25 bp, Mus musculus
aacacatataatgatcatacttctg

SEQ ID NO: 26963 - DNA, 25 bp, Mus musculus
aacacatattcacaaggcagcttct

SEQ ID NO: 26964 - DNA, 25 bp, Mus musculus
aacacatattcagaaggcagcttct

SEQ ID NO: 26965 - DNA, 25 bp, Mus musculus
aacacatcaccacagaagagccaag

SEQ ID NO: 26966 - DNA, 25 bp, Mus musculus
aacacatcaccagagaagagccaag

SEQ ID NO: 26967 - DNA, 25 bp, Mus musculus
aacacatccactcagaggccaaatg

SEQ ID NO: 26968 - DNA, 25 bp, Mus musculus
aacacatccactgagaggccaaatg

SEQ ID NO: 26969 - DNA, 25 bp, Mus musculus
aacacatcccaacgctctgtgtgag

SEQ ID NO: 26970 - DNA, 25 bp, Mus musculus
aacacatcccaaggctctgtgtgag

SEQ ID NO: 26971 - DNA, 25 bp, Mus musculus
aacacatcccagaatttcttcatca

SEQ ID NO: 26972 - DNA, 25 bp, Mus musculus
aacacatcccagtatttcttcatca

SEQ ID NO: 26973 - DNA, 25 bp, Mus musculus
aacacatcccatactggacatggtg

SEQ ID NO: 26974 - DNA, 25 bp, Mus musculus
aacacatcccattctggacatggtg

SEQ ID NO: 26975 - DNA, 25 bp, Mus musculus
aacacatcccgcctggctcaggaga

SEQ ID NO: 26976 - DNA, 25 bp, Mus musculus
aacacatcccgcgtggctcaggaga

SEQ ID NO: 26977 - DNA, 25 bp, Mus musculus
aacacatctagtattggttccctca

SEQ ID NO: 26978 - DNA, 25 bp, Mus musculus
aacacatctagttttggttccctca

SEQ ID NO: 26979 - DNA, 25 bp, Mus musculus
aacacatctgtaattagcttgcctg

SEQ ID NO: 26980 - DNA, 25 bp, Mus musculus
aacacatctgtaattcagctgcttt

SEQ ID NO: 26981 - DNA, 25 bp, Mus musculus
aacacatctgtatttagcttgcctg

SEQ ID NO: 26982 - DNA, 25 bp, Mus musculus
aacacatctgtatttcagctgcttt

SEQ ID NO: 26983 - DNA, 25 bp, Mus musculus
aacacatctgttattctgcctacct

SEQ ID NO: 26984 - DNA, 25 bp, Mus musculus
aacacatctgtttttctgcctacct

SEQ ID NO: 26985 - DNA, 25 bp, Mus musculus
aacacatctttcaagtatttttctg

SEQ ID NO: 26986 - DNA, 25 bp, Mus musculus
aacacatctttctagtatttttctg

SEQ ID NO: 26987 - DNA, 25 bp, Mus musculus
aacacatgaaccatgcaaggccgtt

SEQ ID NO: 26988 - DNA, 25 bp, Mus musculus
aacacatgaaccttgcaaggccgtt

SEQ ID NO: 26989 - DNA, 25 bp, Mus musculus
aacacatgaaggagtgtttccttaa

SEQ ID NO: 26990 - DNA, 25 bp, Mus musculus
aacacatgaaggtgtgtttccttaa

SEQ ID NO: 26991 - DNA, 25 bp, Mus musculus
aacacatgaattaggctcaaggacc

SEQ ID NO: 26992 - DNA, 25 bp, Mus musculus
aacacatgaatttggctcaaggacc

SEQ ID NO: 26993 - DNA, 25 bp, Mus musculus
aacacatgaccgcaagtcggaagac

SEQ ID NO: 26994 - DNA, 25 bp, Mus musculus
aacacatgaccggaagtcggaagac

SEQ ID NO: 26995 - DNA, 25 bp, Mus musculus
aacacatgccagagagcaggcatcc

SEQ ID NO: 26996 - DNA, 25 bp, Mus musculus
aacacatgccagtgagcaggcatcc

SEQ ID NO: 26997 - DNA, 25 bp, Mus musculus
aacacatgcccaaacactagacaca

SEQ ID NO: 26998 - DNA, 25 bp, Mus musculus
aacacatgcccatacactagacaca

SEQ ID NO: 26999 - DNA, 25 bp, Mus musculus
aacacatgccttacatttgactgcc

SEQ ID NO: 27000 - DNA, 25 bp, Mus musculus
aacacatgcctttcatttgactgcc

SEQ ID NO: 27001 - DNA, 25 bp, Mus musculus
aacacatgcgccagctgctaatgga

SEQ ID NO: 27002 - DNA, 25 bp, Mus musculus
aacacatgcgcctgctgctaatgga

SEQ ID NO: 27003 - DNA, 25 bp, Mus musculus
aacacatgctcgatggcaggttcat

SEQ ID NO: 27004 - DNA, 25 bp, Mus musculus
aacacatgctcgttggcaggttcat

SEQ ID NO: 27005 - DNA, 25 bp, Mus musculus
aacacatggctcattgtagccttga

SEQ ID NO: 27006 - DNA, 25 bp, Mus musculus
aacacatggctctttgtagccttga

SEQ ID NO: 27007 - DNA, 25 bp, Mus musculus
aacacatggtatcgactcaccagcc

SEQ ID NO: 27008 - DNA, 25 bp, Mus musculus
aacacatggtatggactcaccagcc

SEQ ID NO: 27009 - DNA, 25 bp, Mus musculus
aacacatgtgagagtggctctccct

SEQ ID NO: 27010 - DNA, 25 bp, Mus musculus
aacacatgtgagtgtggctctccct

SEQ ID NO: 27011 - DNA, 25 bp, Mus musculus
aacacatgtgtgacctccttacaga

SEQ ID NO: 27012 - DNA, 25 bp, Mus musculus
aacacatgtgtgtcctccttacaga

SEQ ID NO: 27013 - DNA, 25 bp, Mus musculus
aacacattaaagaagctacgctcac

SEQ ID NO: 27014 - DNA, 25 bp, Mus musculus
aacacattaaagtagctacgctcac

SEQ ID NO: 27015 - DNA, 25 bp, Mus musculus
aacacattaaggagccaggtccctc

SEQ ID NO: 27016 - DNA, 25 bp, Mus musculus
aacacattaaggtgccaggtccctc

SEQ ID NO: 27017 - DNA, 25 bp, Mus musculus
aacacattagtgcttgtactgcaga

SEQ ID NO: 27018 - DNA, 25 bp, Mus musculus
aacacattagtggttgtactgcaga

SEQ ID NO: 27019 - DNA, 25 bp, Mus musculus
aacacattcagcagctgggtgtcca

SEQ ID NO: 27020 - DNA, 25 bp, Mus musculus
aacacattcagctgctgggtgtcca

SEQ ID NO: 27021 - DNA, 25 bp, Mus musculus
aacacattcattccagtatctacat

SEQ ID NO: 27022 - DNA, 25 bp, Mus musculus
aacacattcattgcagtatctacat

SEQ ID NO: 27023 - DNA, 25 bp, Mus musculus
aacacattcccaagacgcaggctgt

SEQ ID NO: 27024 - DNA, 25 bp, Mus musculus
aacacattcccatgacgcaggctgt

SEQ ID NO: 27025 - DNA, 25 bp, Mus musculus
aacacattccttcggacagagcctg

SEQ ID NO: 27026 - DNA, 25 bp, Mus musculus
aacacattccttgggacagagcctg

SEQ ID NO: 27027 - DNA, 25 bp, Mus musculus
aacacattcgagctactgatttgac

SEQ ID NO: 27028 - DNA, 25 bp, Mus musculus
aacacattcgaggtactgatttgac

SEQ ID NO: 27029 - DNA, 25 bp, Mus musculus
aacacattctaacacagttcttttt

SEQ ID NO: 27030 - DNA, 25 bp, Mus musculus
aacacattctaagacagttcttttt

SEQ ID NO: 27031 - DNA, 25 bp, Mus musculus
aacacattctgtcgtctctaatcct

SEQ ID NO: 27032 - DNA, 25 bp, Mus musculus
aacacattctgtggtctctaatcct

SEQ ID NO: 27033 - DNA, 25 bp, Mus musculus
aacacattgaagacctcagggcttt

SEQ ID NO: 27034 - DNA, 25 bp, Mus musculus
aacacattgaagtcctcagggcttt

SEQ ID NO: 27035 - DNA, 25 bp, Mus musculus
aacacattgactaggagttcctggg

SEQ ID NO: 27036 - DNA, 25 bp, Mus musculus
aacacattgacttggagttcctggg

SEQ ID NO: 27037 - DNA, 25 bp, Mus musculus
aacacattgttaatcattgaatggc

SEQ ID NO: 27038 - DNA, 25 bp, Mus musculus
aacacattgttattcattgaatggc

SEQ ID NO: 27039 - DNA, 25 bp, Mus musculus
aacacatttaggagcccacctcatg

SEQ ID NO: 27040 - DNA, 25 bp, Mus musculus
aacacatttaggtgcccacctcatg

SEQ ID NO: 27041 - DNA, 25 bp, Mus musculus
aacacatttcttagacctctataga

SEQ ID NO: 27042 - DNA, 25 bp, Mus musculus
aacacatttctttgacctctataga

SEQ ID NO: 27043 - DNA, 25 bp, Mus musculus
aacacattttcacaagtcgtgggta

SEQ ID NO: 27044 - DNA, 25 bp, Mus musculus
aacacattttcagaagtcgtgggta

SEQ ID NO: 27045 - DNA, 25 bp, Mus musculus
aacacattttgcaacatggcctggt

SEQ ID NO: 27046 - DNA, 25 bp, Mus musculus
aacacattttgctacatggcctggt

SEQ ID NO: 27047 - DNA, 25 bp, Mus musculus
aacaccaaaaccaatacattctgca

SEQ ID NO: 27048 - DNA, 25 bp, Mus musculus
aacaccaaaacctatacattctgca

SEQ ID NO: 27049 - DNA, 25 bp, Mus musculus
aacaccaaacgtatgggctccattt

SEQ ID NO: 27050 - DNA, 25 bp, Mus musculus
aacaccaaacgtttgggctccattt

SEQ ID NO: 27051 - DNA, 25 bp, Mus musculus
aacaccaaactgaaggccagagcct

SEQ ID NO: 27052 - DNA, 25 bp, Mus musculus
aacaccaaactgtaggccagagcct

SEQ ID NO: 27053 - DNA, 25 bp, Mus musculus
aacaccaaaggcatcgggactcctg

SEQ ID NO: 27054 - DNA, 25 bp, Mus musculus
aacaccaaaggccacctggcgagaa

SEQ ID NO: 27055 - DNA, 25 bp, Mus musculus
aacaccaaaggcgacctggcgagaa

SEQ ID NO: 27056 - DNA, 25 bp, Mus musculus
aacaccaaaggcttcgggactcctg

SEQ ID NO: 27057 - DNA, 25 bp, Mus musculus
aacaccaacaaaatgtgcctcacac

SEQ ID NO: 27058 - DNA, 25 bp, Mus musculus
aacaccaacaaattgtgcctcacac

SEQ ID NO: 27059 - DNA, 25 bp, Mus musculus
aacaccaacacgctcaacaggaaaa

SEQ ID NO: 27060 - DNA, 25 bp, Mus musculus
aacaccaacacggtcaacaggaaaa

SEQ ID NO: 27061 - DNA, 25 bp, Mus musculus
aacaccaaccagagcttgaacgatg

SEQ ID NO: 27062 - DNA, 25 bp, Mus musculus
aacaccaaccagtgcttgaacgatg

SEQ ID NO: 27063 - DNA, 25 bp, Mus musculus
aacaccaacttacgccatgatcaga

SEQ ID NO: 27064 - DNA, 25 bp, Mus musculus
aacaccaacttaggccatgatcaga

SEQ ID NO: 27065 - DNA, 25 bp, Mus musculus
aacaccaagaccagcccctatgttt

SEQ ID NO: 27066 - DNA, 25 bp, Mus musculus
aacaccaagacctgcccctatgttt

SEQ ID NO: 27067 - DNA, 25 bp, Mus musculus
aacaccaagcagattacagcaaata

SEQ ID NO: 27068 - DNA, 25 bp, Mus musculus
aacaccaagcagtttacagcaaata

SEQ ID NO: 27069 - DNA, 25 bp, Mus musculus
aacaccaagcgaaggaaacggtgct

SEQ ID NO: 27070 - DNA, 25 bp, Mus musculus
aacaccaagcgatggaaacggtgct

SEQ ID NO: 27071 - DNA, 25 bp, Mus musculus
aacaccaaggctagcagagaccaat

SEQ ID NO: 27072 - DNA, 25 bp, Mus musculus
aacaccaaggcttgcagagaccaat

SEQ ID NO: 27073 - DNA, 25 bp, Mus musculus
aacaccaagtaaaccacactggaga

SEQ ID NO: 27074 - DNA, 25 bp, Mus musculus
aacaccaagtaatccacactggaga

SEQ ID NO: 27075 - DNA, 25 bp, Mus musculus
aacaccaagttgagggactccagtc

SEQ ID NO: 27076 - DNA, 25 bp, Mus musculus
aacaccaagttgtgggactccagtc

SEQ ID NO: 27077 - DNA, 25 bp, Mus musculus
aacaccaatatcatctcacatgtca

SEQ ID NO: 27078 - DNA, 25 bp, Mus musculus
aacaccaatatcttctcacatgtca

SEQ ID NO: 27079 - DNA, 25 bp, Mus musculus
aacaccaatcacagacagtatcatg

SEQ ID NO: 27080 - DNA, 25 bp, Mus musculus
aacaccaatcactgacagtatcatg

SEQ ID NO: 27081 - DNA, 25 bp, Mus musculus
aacaccaatgaccagtctgtcgtag

SEQ ID NO: 27082 - DNA, 25 bp, Mus musculus
aacaccaatgacgagtctgtcgtag

SEQ ID NO: 27083 - DNA, 25 bp, Mus musculus
aacaccaatgtaactgtctgcaccg

SEQ ID NO: 27084 - DNA, 25 bp, Mus musculus
aacaccaatgtatctgtctgcaccg

SEQ ID NO: 27085 - DNA, 25 bp, Mus musculus
aacaccaatgtgatccctcacttct

SEQ ID NO: 27086 - DNA, 25 bp, Mus musculus
aacaccaatgtgttccctcacttct

SEQ ID NO: 27087 - DNA, 25 bp, Mus musculus
aacaccaattggaggcactagtgac

SEQ ID NO: 27088 - DNA, 25 bp, Mus musculus
aacaccaattggtggcactagtgac

SEQ ID NO: 27089 - DNA, 25 bp, Mus musculus
aacaccacaaacaaccagaatagct

SEQ ID NO: 27090 - DNA, 25 bp, Mus musculus
aacaccacaaactaccagaatagct

SEQ ID NO: 27091 - DNA, 25 bp, Mus musculus
aacaccacactgactttgtaggagg

SEQ ID NO: 27092 - DNA, 25 bp, Mus musculus
aacaccacactgtctttgtaggagg

SEQ ID NO: 27093 - DNA, 25 bp, Mus musculus
aacaccacagcaatcgcagaggcct

SEQ ID NO: 27094 - DNA, 25 bp, Mus musculus
aacaccacagcattcgcagaggcct

SEQ ID NO: 27095 - DNA, 25 bp, Mus musculus
aacaccaccagtccaatagcagctg

SEQ ID NO: 27096 - DNA, 25 bp, Mus musculus
aacaccaccagtgcaatagcagctg

SEQ ID NO: 27097 - DNA, 25 bp, Mus musculus
aacaccacgcttccggatgtgattg

SEQ ID NO: 27098 - DNA, 25 bp, Mus musculus
aacaccacgcttgcggatgtgattg

SEQ ID NO: 27099 - DNA, 25 bp, Mus musculus
aacaccacgtctatgaggtacctgg

SEQ ID NO: 27100 - DNA, 25 bp, Mus musculus
aacaccacgtctttgaggtacctgg

SEQ ID NO: 27101 - DNA, 25 bp, Mus musculus
aacaccactgtgcaaatggttgtca

SEQ ID NO: 27102 - DNA, 25 bp, Mus musculus
aacaccactgtggaaatggttgtca

SEQ ID NO: 27103 - DNA, 25 bp, Mus musculus
aacaccagactgctttttgttaagt

SEQ ID NO: 27104 - DNA, 25 bp, Mus musculus
aacaccagactggtttttgttaagt

SEQ ID NO: 27105 - DNA, 25 bp, Mus musculus
aacaccagaggtacttggctgttcc

SEQ ID NO: 27106 - DNA, 25 bp, Mus musculus
aacaccagaggtagacagttctaac

SEQ ID NO: 27107 - DNA, 25 bp, Mus musculus
aacaccagaggttcttggctgttcc

SEQ ID NO: 27108 - DNA, 25 bp, Mus musculus
aacaccagaggttgacagttctaac

SEQ ID NO: 27109 - DNA, 25 bp, Mus musculus
aacaccagagttctgtctatggcat

SEQ ID NO: 27110 - DNA, 25 bp, Mus musculus
aacaccagagttgtgtctatggcat

SEQ ID NO: 27111 - DNA, 25 bp, Mus musculus
aacaccagcaagaccgctctgttgg

SEQ ID NO: 27112 - DNA, 25 bp, Mus musculus
aacaccagcaagtccgctctgttgg

SEQ ID NO: 27113 - DNA, 25 bp, Mus musculus
aacaccagccagattaggaacaaga

SEQ ID NO: 27114 - DNA, 25 bp, Mus musculus
aacaccagccagtttaggaacaaga

SEQ ID NO: 27115 - DNA, 25 bp, Mus musculus
aacaccaggactagctagcaccggt

SEQ ID NO: 27116 - DNA, 25 bp, Mus musculus
aacaccaggacttgctagcaccggt

SEQ ID NO: 27117 - DNA, 25 bp, Mus musculus
aacaccagggttcggcatcaattcc

SEQ ID NO: 27118 - DNA, 25 bp, Mus musculus
aacaccagggttgggcatcaattcc

SEQ ID NO: 27119 - DNA, 25 bp, Mus musculus
aacaccaggtatatctgatgttcag

SEQ ID NO: 27120 - DNA, 25 bp, Mus musculus
aacaccaggtatttctgatgttcag

SEQ ID NO: 27121 - DNA, 25 bp, Mus musculus
aacaccaggtgtctggcgcaccagg

SEQ ID NO: 27122 - DNA, 25 bp, Mus musculus
aacaccaggtgtgtggcgcaccagg

SEQ ID NO: 27123 - DNA, 25 bp, Mus musculus
aacaccaggttcatggatatcgata

SEQ ID NO: 27124 - DNA, 25 bp, Mus musculus
aacaccaggttcttggatatcgata

SEQ ID NO: 27125 - DNA, 25 bp, Mus musculus
aacaccagtagcctcattctattga

SEQ ID NO: 27126 - DNA, 25 bp, Mus musculus
aacaccagtagcgtcattctattga

SEQ ID NO: 27127 - DNA, 25 bp, Mus musculus
aacaccagtagtcaccttcagttcc

SEQ ID NO: 27128 - DNA, 25 bp, Mus musculus
aacaccagtagtgaccttcagttcc

SEQ ID NO: 27129 - DNA, 25 bp, Mus musculus
aacaccagtgtaatgctggcagcta

SEQ ID NO: 27130 - DNA, 25 bp, Mus musculus
aacaccagtgtattgctggcagcta

SEQ ID NO: 27131 - DNA, 25 bp, Mus musculus
aacaccagttctacagggactgctg

SEQ ID NO: 27132 - DNA, 25 bp, Mus musculus
aacaccagttcttcagggactgctg

SEQ ID NO: 27133 - DNA, 25 bp, Mus musculus
aacaccagttgccattgctcattgc

SEQ ID NO: 27134 - DNA, 25 bp, Mus musculus
aacaccagttgcgattgctcattgc

SEQ ID NO: 27135 - DNA, 25 bp, Mus musculus
aacaccatactcaaggaaccactta

SEQ ID NO: 27136 - DNA, 25 bp, Mus musculus
aacaccatactctaggaaccactta

SEQ ID NO: 27137 - DNA, 25 bp, Mus musculus
aacaccataggtcatgaagccctaa

SEQ ID NO: 27138 - DNA, 25 bp, Mus musculus
aacaccataggtgatgaagccctaa

SEQ ID NO: 27139 - DNA, 25 bp, Mus musculus
aacaccatatttactgctgacaggc

SEQ ID NO: 27140 - DNA, 25 bp, Mus musculus
aacaccatatttctgcattttttct

SEQ ID NO: 27141 - DNA, 25 bp, Mus musculus
aacaccatatttgtgcattttttct

SEQ ID NO: 27142 - DNA, 25 bp, Mus musculus
aacaccatattttctgctgacaggc

SEQ ID NO: 27143 - DNA, 25 bp, Mus musculus
aacaccatcaaacgcctctggatta

SEQ ID NO: 27144 - DNA, 25 bp, Mus musculus
aacaccatcaaaggcctctggatta

SEQ ID NO: 27145 - DNA, 25 bp, Mus musculus
aacaccatcccaacgtagaaaagaa

SEQ ID NO: 27146 - DNA, 25 bp, Mus musculus
aacaccatcccatcgtagaaaagaa

SEQ ID NO: 27147 - DNA, 25 bp, Mus musculus
aacaccatccgcagagttcatgaag

SEQ ID NO: 27148 - DNA, 25 bp, Mus musculus
aacaccatccgctgagttcatgaag

SEQ ID NO: 27149 - DNA, 25 bp, Mus musculus
aacaccatcctgatgagattcagat

SEQ ID NO: 27150 - DNA, 25 bp, Mus musculus
aacaccatcctgttgagattcagat

SEQ ID NO: 27151 - DNA, 25 bp, Mus musculus
aacaccatcgtgactaggagtgacg

SEQ ID NO: 27152 - DNA, 25 bp, Mus musculus
aacaccatcgtgtctaggagtgacg

SEQ ID NO: 27153 - DNA, 25 bp, Mus musculus
aacaccatctgtagtagctaggatt

SEQ ID NO: 27154 - DNA, 25 bp, Mus musculus
aacaccatctgttgtagctaggatt

SEQ ID NO: 27155 - DNA, 25 bp, Mus musculus
aacaccatgaagctctgcgtgtctg

SEQ ID NO: 27156 - DNA, 25 bp, Mus musculus
aacaccatgaaggtctgcgtgtctg

SEQ ID NO: 27157 - DNA, 25 bp, Mus musculus
aacaccatgagaaggacctcggagg

SEQ ID NO: 27158 - DNA, 25 bp, Mus musculus
aacaccatgagatggacctcggagg

SEQ ID NO: 27159 - DNA, 25 bp, Mus musculus
aacaccatgagcactatctgaaggg

SEQ ID NO: 27160 - DNA, 25 bp, Mus musculus
aacaccatgagctctatctgaaggg

SEQ ID NO: 27161 - DNA, 25 bp, Mus musculus
aacaccatgatgagtacatgtgttc

SEQ ID NO: 27162 - DNA, 25 bp, Mus musculus
aacaccatgatgtgtacatgtgttc

SEQ ID NO: 27163 - DNA, 25 bp, Mus musculus
aacaccatgctcaggttttgctggg

SEQ ID NO: 27164 - DNA, 25 bp, Mus musculus
aacaccatgctctggttttgctggg

SEQ ID NO: 27165 - DNA, 25 bp, Mus musculus
aacaccatggcaaagtcaggaggta

SEQ ID NO: 27166 - DNA, 25 bp, Mus musculus
aacaccatggcatagtcaggaggta

SEQ ID NO: 27167 - DNA, 25 bp, Mus musculus
aacaccattgctactgatgctgttc

SEQ ID NO: 27168 - DNA, 25 bp, Mus musculus
aacaccattgctccaaactaagcat

SEQ ID NO: 27169 - DNA, 25 bp, Mus musculus
aacaccattgctgcaaactaagcat

SEQ ID NO: 27170 - DNA, 25 bp, Mus musculus
aacaccattgcttctgatgctgttc

SEQ ID NO: 27171 - DNA, 25 bp, Mus musculus
aacaccattgtcactttgaatgcta

SEQ ID NO: 27172 - DNA, 25 bp, Mus musculus
aacaccattgtctctttgaatgcta

SEQ ID NO: 27173 - DNA, 25 bp, Mus musculus
aacaccatttttaagggctggctca

SEQ ID NO: 27174 - DNA, 25 bp, Mus musculus
aacaccattttttagggctggctca

SEQ ID NO: 27175 - DNA, 25 bp, Mus musculus
aacacccaaagaaattcttgatatg

SEQ ID NO: 27176 - DNA, 25 bp, Mus musculus
aacacccaaagatattcttgatatg

SEQ ID NO: 27177 - DNA, 25 bp, Mus musculus
aacacccaagctagtgaattgattg

SEQ ID NO: 27178 - DNA, 25 bp, Mus musculus
aacacccaagcttgtgaattgattg

SEQ ID NO: 27179 - DNA, 25 bp, Mus musculus
aacacccaagttcagctttggaggt

SEQ ID NO: 27180 - DNA, 25 bp, Mus musculus
aacacccaagttgagctttggaggt

SEQ ID NO: 27181 - DNA, 25 bp, Mus musculus
aacacccacccgctgacagagtgag

SEQ ID NO: 27182 - DNA, 25 bp, Mus musculus
aacacccacccggtgacagagtgag

SEQ ID NO: 27183 - DNA, 25 bp, Mus musculus
aacacccacctcagatctaggtgta

SEQ ID NO: 27184 - DNA, 25 bp, Mus musculus
aacacccacctctgatctaggtgta

SEQ ID NO: 27185 - DNA, 25 bp, Mus musculus
aacacccacctgagcagttggcctt

SEQ ID NO: 27186 - DNA, 25 bp, Mus musculus
aacacccacctgagccatagaggga

SEQ ID NO: 27187 - DNA, 25 bp, Mus musculus
aacacccacctgtgcagttggcctt

SEQ ID NO: 27188 - DNA, 25 bp, Mus musculus
aacacccacctgtgccatagaggga

SEQ ID NO: 27189 - DNA, 25 bp, Mus musculus
aacacccactaaactgagcaggctt

SEQ ID NO: 27190 - DNA, 25 bp, Mus musculus
aacacccactaatctgagcaggctt

SEQ ID NO: 27191 - DNA, 25 bp, Mus musculus
aacacccactgtatgagcgtgtgct

SEQ ID NO: 27192 - DNA, 25 bp, Mus musculus
aacacccactgtttgagcgtgtgct

SEQ ID NO: 27193 - DNA, 25 bp, Mus musculus
aacacccagaccactagagaaggat

SEQ ID NO: 27194 - DNA, 25 bp, Mus musculus
aacacccagacctctagagaaggat

SEQ ID NO: 27195 - DNA, 25 bp, Mus musculus
aacacccagagtcaaggcaggcttt

SEQ ID NO: 27196 - DNA, 25 bp, Mus musculus
aacacccagagtgaaggcaggcttt

SEQ ID NO: 27197 - DNA, 25 bp, Mus musculus
aacacccaggcccttagaggagcta

SEQ ID NO: 27198 - DNA, 25 bp, Mus musculus
aacacccaggccgttagaggagcta

SEQ ID NO: 27199 - DNA, 25 bp, Mus musculus
aacacccagggcagtcttctgattt

SEQ ID NO: 27200 - DNA, 25 bp, Mus musculus
aacacccagggcatgaaatcagaca

SEQ ID NO: 27201 - DNA, 25 bp, Mus musculus
aacacccagggctgtcttctgattt

SEQ ID NO: 27202 - DNA, 25 bp, Mus musculus
aacacccagggcttgaaatcagaca

SEQ ID NO: 27203 - DNA, 25 bp, Mus musculus
aacacccatcacagctttagaaacg

SEQ ID NO: 27204 - DNA, 25 bp, Mus musculus
aacacccatcactgctttagaaacg

SEQ ID NO: 27205 - DNA, 25 bp, Mus musculus
aacacccatgttacacaaggacttg

SEQ ID NO: 27206 - DNA, 25 bp, Mus musculus
aacacccatgttatcagaaatggca

SEQ ID NO: 27207 - DNA, 25 bp, Mus musculus
aacacccatgtttcacaaggacttg

SEQ ID NO: 27208 - DNA, 25 bp, Mus musculus
aacacccatgttttcagaaatggca

SEQ ID NO: 27209 - DNA, 25 bp, Mus musculus
aacacccatttgctcctcaaggaat

SEQ ID NO: 27210 - DNA, 25 bp, Mus musculus
aacacccatttggtcctcaaggaat

SEQ ID NO: 27211 - DNA, 25 bp, Mus musculus
aacaccccaaaacagctggctgcaa

SEQ ID NO: 27212 - DNA, 25 bp, Mus musculus
aacaccccaaaagagctggctgcaa

SEQ ID NO: 27213 - DNA, 25 bp, Mus musculus
aacaccccagacacagatgtaactg

SEQ ID NO: 27214 - DNA, 25 bp, Mus musculus
aacaccccagactcagatgtaactg

SEQ ID NO: 27215 - DNA, 25 bp, Mus musculus
aacaccccatgaagaaaacactcct

SEQ ID NO: 27216 - DNA, 25 bp, Mus musculus
aacaccccatgatgaaaacactcct

SEQ ID NO: 27217 - DNA, 25 bp, Mus musculus
aacacccccacaatgtgaatttagg

SEQ ID NO: 27218 - DNA, 25 bp, Mus musculus
aacacccccacattgtgaatttagg

SEQ ID NO: 27219 - DNA, 25 bp, Mus musculus
aacaccccgcggacacgtgctatgg

SEQ ID NO: 27220 - DNA, 25 bp, Mus musculus
aacaccccgcggtcacgtgctatgg

SEQ ID NO: 27221 - DNA, 25 bp, Mus musculus
aacacccctatgcaaatgcaggcat

SEQ ID NO: 27222 - DNA, 25 bp, Mus musculus
aacacccctatggaaatgcaggcat

SEQ ID NO: 27223 - DNA, 25 bp, Mus musculus
aacacccctgagctactaggttcat

SEQ ID NO: 27224 - DNA, 25 bp, Mus musculus
aacacccctgaggtactaggttcat

SEQ ID NO: 27225 - DNA, 25 bp, Mus musculus
aacacccgcatccttggaataaatt

SEQ ID NO: 27226 - DNA, 25 bp, Mus musculus
aacacccgcatcgttggaataaatt

SEQ ID NO: 27227 - DNA, 25 bp, Mus musculus
aacacccggtggagtctttctgaat

SEQ ID NO: 27228 - DNA, 25 bp, Mus musculus
aacacccggtggtgtctttctgaat

SEQ ID NO: 27229 - DNA, 25 bp, Mus musculus
aacaccctagtccacagagtgattg

SEQ ID NO: 27230 - DNA, 25 bp, Mus musculus
aacaccctagtcgacagagtgattg

SEQ ID NO: 27231 - DNA, 25 bp, Mus musculus
aacaccctatttcctgggtctagag

SEQ ID NO: 27232 - DNA, 25 bp, Mus musculus
aacaccctatttgctgggtctagag

SEQ ID NO: 27233 - DNA, 25 bp, Mus musculus
aacaccctccagagggacttgtcca

SEQ ID NO: 27234 - DNA, 25 bp, Mus musculus
aacaccctccagtgggacttgtcca

SEQ ID NO: 27235 - DNA, 25 bp, Mus musculus
aacaccctcgtgagtgtgcagaaag

SEQ ID NO: 27236 - DNA, 25 bp, Mus musculus
aacaccctcgtgtgtgtgcagaaag

SEQ ID NO: 27237 - DNA, 25 bp, Mus musculus
aacaccctcttcagaatcatgcgag

SEQ ID NO: 27238 - DNA, 25 bp, Mus musculus
aacaccctcttctgaatcatgcgag

SEQ ID NO: 27239 - DNA, 25 bp, Mus musculus
aacaccctgactaaggcagcttaca

SEQ ID NO: 27240 - DNA, 25 bp, Mus musculus
aacaccctgacttaggcagcttaca

SEQ ID NO: 27241 - DNA, 25 bp, Mus musculus
aacaccctgattcggcctgatggag

SEQ ID NO: 27242 - DNA, 25 bp, Mus musculus
aacaccctgattgggcctgatggag

SEQ ID NO: 27243 - DNA, 25 bp, Mus musculus
aacaccctgcctcatattgtcttca

SEQ ID NO: 27244 - DNA, 25 bp, Mus musculus
aacaccctgcctgatattgtcttca

SEQ ID NO: 27245 - DNA, 25 bp, Mus musculus
aacaccctggaccaagtgctaacag

SEQ ID NO: 27246 - DNA, 25 bp, Mus musculus
aacaccctggacgaagtgctaacag

SEQ ID NO: 27247 - DNA, 25 bp, Mus musculus
aacaccctggatcctctgaaatttg

SEQ ID NO: 27248 - DNA, 25 bp, Mus musculus
aacaccctggatgctctgaaatttg

SEQ ID NO: 27249 - DNA, 25 bp, Mus musculus
aacaccctgggcatgcatttttagg

SEQ ID NO: 27250 - DNA, 25 bp, Mus musculus
aacaccctgggcttgcatttttagg

SEQ ID NO: 27251 - DNA, 25 bp, Mus musculus
aacaccctggttcagtagtcttcgg

SEQ ID NO: 27252 - DNA, 25 bp, Mus musculus
aacaccctggttgagtagtcttcgg

SEQ ID NO: 27253 - DNA, 25 bp, Mus musculus
aacacccttatcaaatgctgtcctt

SEQ ID NO: 27254 - DNA, 25 bp, Mus musculus
aacacccttatcagctttgtggaca

SEQ ID NO: 27255 - DNA, 25 bp, Mus musculus
aacacccttatctaatgctgtcctt

SEQ ID NO: 27256 - DNA, 25 bp, Mus musculus
aacacccttatctgctttgtggaca

SEQ ID NO: 27257 - DNA, 25 bp, Mus musculus
aacacccttccacattgcgtgggac

SEQ ID NO: 27258 - DNA, 25 bp, Mus musculus
aacacccttccagattgcgtgggac

SEQ ID NO: 27259 - DNA, 25 bp, Mus musculus
aacaccctttcactgggaagccttg

SEQ ID NO: 27260 - DNA, 25 bp, Mus musculus
aacaccctttcagtgggaagccttg

SEQ ID NO: 27261 - DNA, 25 bp, Mus musculus
aacacccttttcacagtgaaactag

SEQ ID NO: 27262 - DNA, 25 bp, Mus musculus
aacacccttttctcagtgaaactag

SEQ ID NO: 27263 - DNA, 25 bp, Mus musculus
aacaccgaaacgatgctggaggagc

SEQ ID NO: 27264 - DNA, 25 bp, Mus musculus
aacaccgaaacgttgctggaggagc

SEQ ID NO: 27265 - DNA, 25 bp, Mus musculus
aacaccgaatccacccagtagtgtt

SEQ ID NO: 27266 - DNA, 25 bp, Mus musculus
aacaccgaatcctcccagtagtgtt

SEQ ID NO: 27267 - DNA, 25 bp, Mus musculus
aacaccgactaaaggtctccacaca

SEQ ID NO: 27268 - DNA, 25 bp, Mus musculus
aacaccgactaatggtctccacaca

SEQ ID NO: 27269 - DNA, 25 bp, Mus musculus
aacaccgagatacattttgtcacct

SEQ ID NO: 27270 - DNA, 25 bp, Mus musculus
aacaccgagatagattttgtcacct

SEQ ID NO: 27271 - DNA, 25 bp, Mus musculus
aacaccgaggagctccagtcgtagc

SEQ ID NO: 27272 - DNA, 25 bp, Mus musculus
aacaccgaggaggtccagtcgtagc

SEQ ID NO: 27273 - DNA, 25 bp, Mus musculus
aacaccgagtggctcatgaatgcag

SEQ ID NO: 27274 - DNA, 25 bp, Mus musculus
aacaccgagtgggtcatgaatgcag

SEQ ID NO: 27275 - DNA, 25 bp, Mus musculus
aacaccgattgcctctgcataaacc

SEQ ID NO: 27276 - DNA, 25 bp, Mus musculus
aacaccgattgcgtctgcataaacc

SEQ ID NO: 27277 - DNA, 25 bp, Mus musculus
aacaccgcaaagagaccctgatgga

SEQ ID NO: 27278 - DNA, 25 bp, Mus musculus
aacaccgcaaagtgaccctgatgga

SEQ ID NO: 27279 - DNA, 25 bp, Mus musculus
aacaccgcagtcatcatgtagaaca

SEQ ID NO: 27280 - DNA, 25 bp, Mus musculus
aacaccgcagtcttcatgtagaaca

SEQ ID NO: 27281 - DNA, 25 bp, Mus musculus
aacaccgccaacaaaatcatattct

SEQ ID NO: 27282 - DNA, 25 bp, Mus musculus
aacaccgccaactaaatcatattct

SEQ ID NO: 27283 - DNA, 25 bp, Mus musculus
aacaccgcgaacactagctaagtac

SEQ ID NO: 27284 - DNA, 25 bp, Mus musculus
aacaccgcgaactctagctaagtac

SEQ ID NO: 27285 - DNA, 25 bp, Mus musculus
aacaccgctagactagaacctgtca

SEQ ID NO: 27286 - DNA, 25 bp, Mus musculus
aacaccgctagagtagaacctgtca

SEQ ID NO: 27287 - DNA, 25 bp, Mus musculus
aacaccggactcaagtgggagcaag

SEQ ID NO: 27288 - DNA, 25 bp, Mus musculus
aacaccggactctagtgggagcaag

SEQ ID NO: 27289 - DNA, 25 bp, Mus musculus
aacaccggagaaactttaacagcac

SEQ ID NO: 27290 - DNA, 25 bp, Mus musculus
aacaccggagaatctttaacagcac

SEQ ID NO: 27291 - DNA, 25 bp, Mus musculus
aacaccggctatactccgagaggtt

SEQ ID NO: 27292 - DNA, 25 bp, Mus musculus
aacaccggctattctccgagaggtt

SEQ ID NO: 27293 - DNA, 25 bp, Mus musculus
aacaccgggcctcagtgagcgcttt

SEQ ID NO: 27294 - DNA, 25 bp, Mus musculus
aacaccgggcctgagtgagcgcttt

SEQ ID NO: 27295 - DNA, 25 bp, Mus musculus
aacaccggtgagatcccttgtattc

SEQ ID NO: 27296 - DNA, 25 bp, Mus musculus
aacaccggtgagttcccttgtattc

SEQ ID NO: 27297 - DNA, 25 bp, Mus musculus
aacaccggtttcctgtaactagcat

SEQ ID NO: 27298 - DNA, 25 bp, Mus musculus
aacaccggtttcgtgtaactagcat

SEQ ID NO: 27299 - DNA, 25 bp, Mus musculus
aacaccgtatagattttatcactgt

SEQ ID NO: 27300 - DNA, 25 bp, Mus musculus
aacaccgtatagtttttatcactgt

SEQ ID NO: 27301 - DNA, 25 bp, Mus musculus
aacaccgtcctcatctgtatggtga

SEQ ID NO: 27302 - DNA, 25 bp, Mus musculus
aacaccgtcctcttctgtatggtga

SEQ ID NO: 27303 - DNA, 25 bp, Mus musculus
aacaccgtctggacctcacggcttt

SEQ ID NO: 27304 - DNA, 25 bp, Mus musculus
aacaccgtctggtcctcacggcttt

SEQ ID NO: 27305 - DNA, 25 bp, Mus musculus
aacaccgtgaagacatccactatga

SEQ ID NO: 27306 - DNA, 25 bp, Mus musculus
aacaccgtgaagtcatccactatga

SEQ ID NO: 27307 - DNA, 25 bp, Mus musculus
aacaccgtgcagcacagatgtgtgt

SEQ ID NO: 27308 - DNA, 25 bp, Mus musculus
aacaccgtgcaggacagatgtgtgt

SEQ ID NO: 27309 - DNA, 25 bp, Mus musculus
aacaccgtgccgcagtattagcaat

SEQ ID NO: 27310 - DNA, 25 bp, Mus musculus
aacaccgtgccggagtattagcaat

SEQ ID NO: 27311 - DNA, 25 bp, Mus musculus
aacaccgtggttataggcaaggcta

SEQ ID NO: 27312 - DNA, 25 bp, Mus musculus
aacaccgtggttttaggcaaggcta

SEQ ID NO: 27313 - DNA, 25 bp, Mus musculus
aacaccgtgtaaccattatttccat

SEQ ID NO: 27314 - DNA, 25 bp, Mus musculus
aacaccgtgtaagcattatttccat

SEQ ID NO: 27315 - DNA, 25 bp, Mus musculus
aacacctacatcacctacggaagga

SEQ ID NO: 27316 - DNA, 25 bp, Mus musculus
aacacctacatctcctacggaagga

SEQ ID NO: 27317 - DNA, 25 bp, Mus musculus
aacacctaccagaatctttctagag

SEQ ID NO: 27318 - DNA, 25 bp, Mus musculus
aacacctaccagtatctttctagag

SEQ ID NO: 27319 - DNA, 25 bp, Mus musculus
aacacctacctgcaatgggaggaca

SEQ ID NO: 27320 - DNA, 25 bp, Mus musculus
aacacctacctggaatgggaggaca

SEQ ID NO: 27321 - DNA, 25 bp, Mus musculus
aacacctaccttacagggtggtcag

SEQ ID NO: 27322 - DNA, 25 bp, Mus musculus
aacacctacctttcagggtggtcag

SEQ ID NO: 27323 - DNA, 25 bp, Mus musculus
aacacctacgtgaacccatggtggg

SEQ ID NO: 27324 - DNA, 25 bp, Mus musculus
aacacctacgtgtacccatggtggg

SEQ ID NO: 27325 - DNA, 25 bp, Mus musculus
aacacctagtgtcccagattgtcta

SEQ ID NO: 27326 - DNA, 25 bp, Mus musculus
aacacctagtgtgccagattgtcta

SEQ ID NO: 27327 - DNA, 25 bp, Mus musculus
aacacctataccacttaattctcaa

SEQ ID NO: 27328 - DNA, 25 bp, Mus musculus
aacacctatacctcttaattctcaa

SEQ ID NO: 27329 - DNA, 25 bp, Mus musculus
aacacctatgacatccatcggctgg

SEQ ID NO: 27330 - DNA, 25 bp, Mus musculus
aacacctatgacttccatcggctgg

SEQ ID NO: 27331 - DNA, 25 bp, Mus musculus
aacacctatggtagtcaatgactgg

SEQ ID NO: 27332 - DNA, 25 bp, Mus musculus
aacacctatggttgtcaatgactgg

SEQ ID NO: 27333 - DNA, 25 bp, Mus musculus
aacacctatttccacatggcactgg

SEQ ID NO: 27334 - DNA, 25 bp, Mus musculus
aacacctatttcgacatggcactgg

SEQ ID NO: 27335 - DNA, 25 bp, Mus musculus
aacacctcacaactgaagcttcatt

SEQ ID NO: 27336 - DNA, 25 bp, Mus musculus
aacacctcacaagtgaagcttcatt

SEQ ID NO: 27337 - DNA, 25 bp, Mus musculus
aacacctcagccattacattctaaa

SEQ ID NO: 27338 - DNA, 25 bp, Mus musculus
aacacctcagccatttatctacgaa

SEQ ID NO: 27339 - DNA, 25 bp, Mus musculus
aacacctcagcctttacattctaaa

SEQ ID NO: 27340 - DNA, 25 bp, Mus musculus
aacacctcagccttttatctacgaa

SEQ ID NO: 27341 - DNA, 25 bp, Mus musculus
aacacctcagtacaacagtgatctt

SEQ ID NO: 27342 - DNA, 25 bp, Mus musculus
aacacctcagtagaacagtgatctt

SEQ ID NO: 27343 - DNA, 25 bp, Mus musculus
aacacctcagtgaaacttggacatt

SEQ ID NO: 27344 - DNA, 25 bp, Mus musculus
aacacctcagtgtaacttggacatt

SEQ ID NO: 27345 - DNA, 25 bp, Mus musculus
aacacctccacgagcattctggcga

SEQ ID NO: 27346 - DNA, 25 bp, Mus musculus
aacacctccacgtgcattctggcga

SEQ ID NO: 27347 - DNA, 25 bp, Mus musculus
aacacctccactatgcaaagtccag

SEQ ID NO: 27348 - DNA, 25 bp, Mus musculus
aacacctccactttgcaaagtccag

SEQ ID NO: 27349 - DNA, 25 bp, Mus musculus
aacacctcctgccatggtcttttta

SEQ ID NO: 27350 - DNA, 25 bp, Mus musculus
aacacctcctgcgatggtcttttta

SEQ ID NO: 27351 - DNA, 25 bp, Mus musculus
aacacctcgagtctcaagtgctgga

SEQ ID NO: 27352 - DNA, 25 bp, Mus musculus
aacacctcgagtgtcaagtgctgga

SEQ ID NO: 27353 - DNA, 25 bp, Mus musculus
aacacctcgctgaatcttaacatct

SEQ ID NO: 27354 - DNA, 25 bp, Mus musculus
aacacctcgctgtatcttaacatct

SEQ ID NO: 27355 - DNA, 25 bp, Mus musculus
aacacctcggccaaagctgggcaga

SEQ ID NO: 27356 - DNA, 25 bp, Mus musculus
aacacctcggcctaagctgggcaga

SEQ ID NO: 27357 - DNA, 25 bp, Mus musculus
aacacctctagtccaaggagccaag

SEQ ID NO: 27358 - DNA, 25 bp, Mus musculus
aacacctctagtctcaagtatttga

SEQ ID NO: 27359 - DNA, 25 bp, Mus musculus
aacacctctagtgcaaggagccaag

SEQ ID NO: 27360 - DNA, 25 bp, Mus musculus
aacacctctagtgtcaagtatttga

SEQ ID NO: 27361 - DNA, 25 bp, Mus musculus
aacacctctctgcttagtatcgaag

SEQ ID NO: 27362 - DNA, 25 bp, Mus musculus
aacacctctctggttagtatcgaag

SEQ ID NO: 27363 - DNA, 25 bp, Mus musculus
aacacctctgacaccattgttctct

SEQ ID NO: 27364 - DNA, 25 bp, Mus musculus
aacacctctgacacctatgcagata

SEQ ID NO: 27365 - DNA, 25 bp, Mus musculus
aacacctctgactccattgttctct

SEQ ID NO: 27366 - DNA, 25 bp, Mus musculus
aacacctctgactcctatgcagata

SEQ ID NO: 27367 - DNA, 25 bp, Mus musculus
aacacctctggacaaaaactcacgt

SEQ ID NO: 27368 - DNA, 25 bp, Mus musculus
aacacctctggagaaaaactcacgt

SEQ ID NO: 27369 - DNA, 25 bp, Mus musculus
aacacctctttcatttgatgtctgt

SEQ ID NO: 27370 - DNA, 25 bp, Mus musculus
aacacctctttcttttgatgtctgt

SEQ ID NO: 27371 - DNA, 25 bp, Mus musculus
aacacctgaaaacactgtctccttt

SEQ ID NO: 27372 - DNA, 25 bp, Mus musculus
aacacctgaaaagactgtctccttt

SEQ ID NO: 27373 - DNA, 25 bp, Mus musculus
aacacctgaaagcaacgcctagcaa

SEQ ID NO: 27374 - DNA, 25 bp, Mus musculus
aacacctgaaaggaacgcctagcaa

SEQ ID NO: 27375 - DNA, 25 bp, Mus musculus
aacacctgacatagaaatttatgaa

SEQ ID NO: 27376 - DNA, 25 bp, Mus musculus
aacacctgacatatatttgaccaaa

SEQ ID NO: 27377 - DNA, 25 bp, Mus musculus
aacacctgacattgaaatttatgaa

SEQ ID NO: 27378 - DNA, 25 bp, Mus musculus
aacacctgacatttatttgaccaaa

SEQ ID NO: 27379 - DNA, 25 bp, Mus musculus
aacacctgcagacacagtatcagaa

SEQ ID NO: 27380 - DNA, 25 bp, Mus musculus
aacacctgcagagacagtatcagaa

SEQ ID NO: 27381 - DNA, 25 bp, Mus musculus
aacacctgcatgatcatttgtctta

SEQ ID NO: 27382 - DNA, 25 bp, Mus musculus
aacacctgcatgttcatttgtctta

SEQ ID NO: 27383 - DNA, 25 bp, Mus musculus
aacacctgcctaactcagagcattg

SEQ ID NO: 27384 - DNA, 25 bp, Mus musculus
aacacctgcctatctcagagcattg

SEQ ID NO: 27385 - DNA, 25 bp, Mus musculus
aacacctgcggaacttagccaaggg

SEQ ID NO: 27386 - DNA, 25 bp, Mus musculus
aacacctgcggatcttagccaaggg

SEQ ID NO: 27387 - DNA, 25 bp, Mus musculus
aacacctggagtcgctttgtgtgtc

SEQ ID NO: 27388 - DNA, 25 bp, Mus musculus
aacacctggagtggctttgtgtgtc

SEQ ID NO: 27389 - DNA, 25 bp, Mus musculus
aacacctggctcatacatgggagga

SEQ ID NO: 27390 - DNA, 25 bp, Mus musculus
aacacctggctcttacatgggagga

SEQ ID NO: 27391 - DNA, 25 bp, Mus musculus
aacacctgggagagtgcatttctgt

SEQ ID NO: 27392 - DNA, 25 bp, Mus musculus
aacacctgggagtgtgcatttctgt

SEQ ID NO: 27393 - DNA, 25 bp, Mus musculus
aacacctgggccagtctttactgag

SEQ ID NO: 27394 - DNA, 25 bp, Mus musculus
aacacctgggcctgtctttactgag

SEQ ID NO: 27395 - DNA, 25 bp, Mus musculus
aacacctgtcctctgtctcagggtg

SEQ ID NO: 27396 - DNA, 25 bp, Mus musculus
aacacctgtcctgtgtctcagggtg

SEQ ID NO: 27397 - DNA, 25 bp, Mus musculus
aacacctgtcttctgcctgtttgta

SEQ ID NO: 27398 - DNA, 25 bp, Mus musculus
aacacctgtcttgtgcctgtttgta

SEQ ID NO: 27399 - DNA, 25 bp, Mus musculus
aacacctgtgaaaggtactgcacac

SEQ ID NO: 27400 - DNA, 25 bp, Mus musculus
aacacctgtgaatggtactgcacac

SEQ ID NO: 27401 - DNA, 25 bp, Mus musculus
aacacctgtggtctctaagagtcca

SEQ ID NO: 27402 - DNA, 25 bp, Mus musculus
aacacctgtggtgtctaagagtcca

SEQ ID NO: 27403 - DNA, 25 bp, Mus musculus
aacacctgtgtaaatcatatctgta

SEQ ID NO: 27404 - DNA, 25 bp, Mus musculus
aacacctgtgtatatcatatctgta

SEQ ID NO: 27405 - DNA, 25 bp, Mus musculus
aacacctgtgtgatagaggccagct

SEQ ID NO: 27406 - DNA, 25 bp, Mus musculus
aacacctgtgtgttagaggccagct

SEQ ID NO: 27407 - DNA, 25 bp, Mus musculus
aacacctgttctcatggaggcaccc

SEQ ID NO: 27408 - DNA, 25 bp, Mus musculus
aacacctgttctgatggaggcaccc

SEQ ID NO: 27409 - DNA, 25 bp, Mus musculus
aacacctgttggcaaaatgaccctg

SEQ ID NO: 27410 - DNA, 25 bp, Mus musculus
aacacctgttgggaaaatgaccctg

SEQ ID NO: 27411 - DNA, 25 bp, Mus musculus
aacaccttatctaacaaaatctggc

SEQ ID NO: 27412 - DNA, 25 bp, Mus musculus
aacaccttatcttacaaaatctggc

SEQ ID NO: 27413 - DNA, 25 bp, Mus musculus
aacaccttattcagagggcacgctg

SEQ ID NO: 27414 - DNA, 25 bp, Mus musculus
aacaccttattctgagggcacgctg

SEQ ID NO: 27415 - DNA, 25 bp, Mus musculus
aacaccttccgacctgtggtgagac

SEQ ID NO: 27416 - DNA, 25 bp, Mus musculus
aacaccttccgagctgtggtgagac

SEQ ID NO: 27417 - DNA, 25 bp, Mus musculus
aacaccttccggactttacatgaat

SEQ ID NO: 27418 - DNA, 25 bp, Mus musculus
aacaccttccggtctttacatgaat

SEQ ID NO: 27419 - DNA, 25 bp, Mus musculus
aacaccttcgttcatctgtggtact

SEQ ID NO: 27420 - DNA, 25 bp, Mus musculus
aacaccttcgttgatctgtggtact

SEQ ID NO: 27421 - DNA, 25 bp, Mus musculus
aacaccttctttagggtctgacttg

SEQ ID NO: 27422 - DNA, 25 bp, Mus musculus
aacaccttcttttgggtctgacttg

SEQ ID NO: 27423 - DNA, 25 bp, Mus musculus
aacaccttgcaactcgctgtcacaa

SEQ ID NO: 27424 - DNA, 25 bp, Mus musculus
aacaccttgcaagtcgctgtcacaa

SEQ ID NO: 27425 - DNA, 25 bp, Mus musculus
aacaccttggccagaatttgtcctt

SEQ ID NO: 27426 - DNA, 25 bp, Mus musculus
aacaccttggcctgaatttgtcctt

SEQ ID NO: 27427 - DNA, 25 bp, Mus musculus
aacaccttgggtagttctgtttgtg

SEQ ID NO: 27428 - DNA, 25 bp, Mus musculus
aacaccttgggttgttctgtttgtg

SEQ ID NO: 27429 - DNA, 25 bp, Mus musculus
aacaccttgtggacttgaggctcag

SEQ ID NO: 27430 - DNA, 25 bp, Mus musculus
aacaccttgtggagaaggttccaag

SEQ ID NO: 27431 - DNA, 25 bp, Mus musculus
aacaccttgtggcataagactgact

SEQ ID NO: 27432 - DNA, 25 bp, Mus musculus
aacaccttgtgggataagactgact

SEQ ID NO: 27433 - DNA, 25 bp, Mus musculus
aacaccttgtggtcttgaggctcag

SEQ ID NO: 27434 - DNA, 25 bp, Mus musculus
aacaccttgtggtgaaggttccaag

SEQ ID NO: 27435 - DNA, 25 bp, Mus musculus
aacacctttaataggtcaacacgat

SEQ ID NO: 27436 - DNA, 25 bp, Mus musculus
aacacctttaattggtcaacacgat

SEQ ID NO: 27437 - DNA, 25 bp, Mus musculus
aacacctttacacatttattgccat

SEQ ID NO: 27438 - DNA, 25 bp, Mus musculus
aacacctttacagatttattgccat

SEQ ID NO: 27439 - DNA, 25 bp, Mus musculus
aacacctttggcaaatcatacttga

SEQ ID NO: 27440 - DNA, 25 bp, Mus musculus
aacacctttggctaatcatacttga

SEQ ID NO: 27441 - DNA, 25 bp, Mus musculus
aacacctttgttagattttgatcct

SEQ ID NO: 27442 - DNA, 25 bp, Mus musculus
aacacctttgttccacattcagaaa

SEQ ID NO: 27443 - DNA, 25 bp, Mus musculus
aacacctttgttgcacattcagaaa

SEQ ID NO: 27444 - DNA, 25 bp, Mus musculus
aacacctttgtttgattttgatcct

SEQ ID NO: 27445 - DNA, 25 bp, Mus musculus
aacacgaaaagccaccctggtgctg

SEQ ID NO: 27446 - DNA, 25 bp, Mus musculus
aacacgaaaagcgaccctggtgctg

SEQ ID NO: 27447 - DNA, 25 bp, Mus musculus
aacacgacacttccttaagctggtt

SEQ ID NO: 27448 - DNA, 25 bp, Mus musculus
aacacgacacttgcttaagctggtt

SEQ ID NO: 27449 - DNA, 25 bp, Mus musculus
aacacgactatgcacaacggctata

SEQ ID NO: 27450 - DNA, 25 bp, Mus musculus
aacacgactatggacaacggctata

SEQ ID NO: 27451 - DNA, 25 bp, Mus musculus
aacacgagatttatggtcccctgca

SEQ ID NO: 27452 - DNA, 25 bp, Mus musculus
aacacgagatttttggtcccctgca

SEQ ID NO: 27453 - DNA, 25 bp, Mus musculus
aacacgagcatgataccgaggccaa

SEQ ID NO: 27454 - DNA, 25 bp, Mus musculus
aacacgagcatgttaccgaggccaa

SEQ ID NO: 27455 - DNA, 25 bp, Mus musculus
aacacgagcccgcatttgccaagtc

SEQ ID NO: 27456 - DNA, 25 bp, Mus musculus
aacacgagcccggatttgccaagtc

SEQ ID NO: 27457 - DNA, 25 bp, Mus musculus
aacacgagctggacttgtgttgctg

SEQ ID NO: 27458 - DNA, 25 bp, Mus musculus
aacacgagctggtcttgtgttgctg

SEQ ID NO: 27459 - DNA, 25 bp, Mus musculus
aacacgagtcgaatgacccgagcag

SEQ ID NO: 27460 - DNA, 25 bp, Mus musculus
aacacgagtcgattgacccgagcag

SEQ ID NO: 27461 - DNA, 25 bp, Mus musculus
aacacgatagtactgtccctctttt

SEQ ID NO: 27462 - DNA, 25 bp, Mus musculus
aacacgatagtagtgtccctctttt

SEQ ID NO: 27463 - DNA, 25 bp, Mus musculus
aacacgatatctctatgaacccctg

SEQ ID NO: 27464 - DNA, 25 bp, Mus musculus
aacacgatatctgtatgaacccctg

SEQ ID NO: 27465 - DNA, 25 bp, Mus musculus
aacacgatgggcagggtgtcagata

SEQ ID NO: 27466 - DNA, 25 bp, Mus musculus
aacacgatgggctgggtgtcagata

SEQ ID NO: 27467 - DNA, 25 bp, Mus musculus
aacacgattggacccttgagcgtcg

SEQ ID NO: 27468 - DNA, 25 bp, Mus musculus
aacacgattggagccttgagcgtcg

SEQ ID NO: 27469 - DNA, 25 bp, Mus musculus
aacacgcaagggagataaccctcgt

SEQ ID NO: 27470 - DNA, 25 bp, Mus musculus
aacacgcaagggtgataaccctcgt

SEQ ID NO: 27471 - DNA, 25 bp, Mus musculus
aacacgcaccagaacaccaaggtgt

SEQ ID NO: 27472 - DNA, 25 bp, Mus musculus
aacacgcaccagtacaccaaggtgt

SEQ ID NO: 27473 - DNA, 25 bp, Mus musculus
aacacgcactcacactgactaaagt

SEQ ID NO: 27474 - DNA, 25 bp, Mus musculus
aacacgcactcagactgactaaagt

SEQ ID NO: 27475 - DNA, 25 bp, Mus musculus
aacacgccaagaagcatctcggctt

SEQ ID NO: 27476 - DNA, 25 bp, Mus musculus
aacacgccaagatgcatctcggctt

SEQ ID NO: 27477 - DNA, 25 bp, Mus musculus
aacacgccagtgatctactgcgaaa

SEQ ID NO: 27478 - DNA, 25 bp, Mus musculus
aacacgccagtgttctactgcgaaa

SEQ ID NO: 27479 - DNA, 25 bp, Mus musculus
aacacgcccacaaaggccataaata

SEQ ID NO: 27480 - DNA, 25 bp, Mus musculus
aacacgcccacataggccataaata

SEQ ID NO: 27481 - DNA, 25 bp, Mus musculus
aacacgcgacagaacggcttctcgg

SEQ ID NO: 27482 - DNA, 25 bp, Mus musculus
aacacgcgacagtacggcttctcgg

SEQ ID NO: 27483 - DNA, 25 bp, Mus musculus
aacacgcgttccagcctggctgagg

SEQ ID NO: 27484 - DNA, 25 bp, Mus musculus
aacacgcgttcctgcctggctgagg

SEQ ID NO: 27485 - DNA, 25 bp, Mus musculus
aacacgctatcaatactccttcttt

SEQ ID NO: 27486 - DNA, 25 bp, Mus musculus
aacacgctatcattactccttcttt

SEQ ID NO: 27487 - DNA, 25 bp, Mus musculus
aacacgctggcgctcaatgctgatg

SEQ ID NO: 27488 - DNA, 25 bp, Mus musculus
aacacgctggcggtcaatgctgatg

SEQ ID NO: 27489 - DNA, 25 bp, Mus musculus
aacacgctgttacacgagttcctgc

SEQ ID NO: 27490 - DNA, 25 bp, Mus musculus
aacacgctgttagacgagttcctgc

SEQ ID NO: 27491 - DNA, 25 bp, Mus musculus
aacacgcttcaaactgcagacaacg

SEQ ID NO: 27492 - DNA, 25 bp, Mus musculus
aacacgcttcaatctgcagacaacg

SEQ ID NO: 27493 - DNA, 25 bp, Mus musculus
aacacgctttctatagtacctggta

SEQ ID NO: 27494 - DNA, 25 bp, Mus musculus
aacacgctttctttagtacctggta

SEQ ID NO: 27495 - DNA, 25 bp, Mus musculus
aacacggaacctcgcaagactcaga

SEQ ID NO: 27496 - DNA, 25 bp, Mus musculus
aacacggaacctggcaagactcaga

SEQ ID NO: 27497 - DNA, 25 bp, Mus musculus
aacacggaaggtcaacttgatctgc

SEQ ID NO: 27498 - DNA, 25 bp, Mus musculus
aacacggaaggtgaacttgatctgc

SEQ ID NO: 27499 - DNA, 25 bp, Mus musculus
aacacggacagtaataccctggctt

SEQ ID NO: 27500 - DNA, 25 bp, Mus musculus
aacacggacagttataccctggctt

SEQ ID NO: 27501 - DNA, 25 bp, Mus musculus
aacacggacccgctgactgatgctg

SEQ ID NO: 27502 - DNA, 25 bp, Mus musculus
aacacggacccggtgactgatgctg

SEQ ID NO: 27503 - DNA, 25 bp, Mus musculus
aacacggagatgaccactgcagcag

SEQ ID NO: 27504 - DNA, 25 bp, Mus musculus
aacacggagatgtccactgcagcag

SEQ ID NO: 27505 - DNA, 25 bp, Mus musculus
aacacggaggctccaagcactacaa

SEQ ID NO: 27506 - DNA, 25 bp, Mus musculus
aacacggaggctgcaagcactacaa

SEQ ID NO: 27507 - DNA, 25 bp, Mus musculus
aacacggagggccagcctatgagat

SEQ ID NO: 27508 - DNA, 25 bp, Mus musculus
aacacggagggcgagcctatgagat

SEQ ID NO: 27509 - DNA, 25 bp, Mus musculus
aacacggccacgctgatttccacag

SEQ ID NO: 27510 - DNA, 25 bp, Mus musculus
aacacggccacggtgatttccacag

SEQ ID NO: 27511 - DNA, 25 bp, Mus musculus
aacacggccaggaaggctatctgga

SEQ ID NO: 27512 - DNA, 25 bp, Mus musculus
aacacggccaggtaggctatctgga

SEQ ID NO: 27513 - DNA, 25 bp, Mus musculus
aacacggctttgagggcgacagact

SEQ ID NO: 27514 - DNA, 25 bp, Mus musculus
aacacggctttgtgggcgacagact

SEQ ID NO: 27515 - DNA, 25 bp, Mus musculus
aacacgggaaagcaacacaggtctg

SEQ ID NO: 27516 - DNA, 25 bp, Mus musculus
aacacgggaaaggaacacaggtctg

SEQ ID NO: 27517 - DNA, 25 bp, Mus musculus
aacacgggaatgctactgcacttgc

SEQ ID NO: 27518 - DNA, 25 bp, Mus musculus
aacacgggaatggtactgcacttgc

SEQ ID NO: 27519 - DNA, 25 bp, Mus musculus
aacacgggagctaaagaaacttcag

SEQ ID NO: 27520 - DNA, 25 bp, Mus musculus
aacacgggagcttaagaaacttcag

SEQ ID NO: 27521 - DNA, 25 bp, Mus musculus
aacacgggcatgacagaagcagtat

SEQ ID NO: 27522 - DNA, 25 bp, Mus musculus
aacacgggcatgtcagaagcagtat

SEQ ID NO: 27523 - DNA, 25 bp, Mus musculus
aacacgggcgacacggacagacggc

SEQ ID NO: 27524 - DNA, 25 bp, Mus musculus
aacacgggcgactcggacagacggc

SEQ ID NO: 27525 - DNA, 25 bp, Mus musculus
aacacgggctatcgtggtagcacac

SEQ ID NO: 27526 - DNA, 25 bp, Mus musculus
aacacgggctatggtggtagcacac

SEQ ID NO: 27527 - DNA, 25 bp, Mus musculus
aacacgggctgcaaacctaatcttt

SEQ ID NO: 27528 - DNA, 25 bp, Mus musculus
aacacgggctgctaacctaatcttt

SEQ ID NO: 27529 - DNA, 25 bp, Mus musculus
aacacgggcttaccaatccagatca

SEQ ID NO: 27530 - DNA, 25 bp, Mus musculus
aacacgggcttagcaatccagatca

SEQ ID NO: 27531 - DNA, 25 bp, Mus musculus
aacacgggttcaatgggctgccgca

SEQ ID NO: 27532 - DNA, 25 bp, Mus musculus
aacacgggttcattgggctgccgca

SEQ ID NO: 27533 - DNA, 25 bp, Mus musculus
aacacgggttctcgctatgttcaag

SEQ ID NO: 27534 - DNA, 25 bp, Mus musculus
aacacgggttctggctatgttcaag

SEQ ID NO: 27535 - DNA, 25 bp, Mus musculus
aacacggtaactcattgctgttctg

SEQ ID NO: 27536 - DNA, 25 bp, Mus musculus
aacacggtaactgattgctgttctg

SEQ ID NO: 27537 - DNA, 25 bp, Mus musculus
aacacggtcacccagtctgcttctg

SEQ ID NO: 27538 - DNA, 25 bp, Mus musculus
aacacggtcaccgagtctgcttctg

SEQ ID NO: 27539 - DNA, 25 bp, Mus musculus
aacacggtgaagactaggccgcggc

SEQ ID NO: 27540 - DNA, 25 bp, Mus musculus
aacacggtgaagtctaggccgcggc

SEQ ID NO: 27541 - DNA, 25 bp, Mus musculus
aacacggtgagactggctgcgccaa

SEQ ID NO: 27542 - DNA, 25 bp, Mus musculus
aacacggtgagagtggctgcgccaa

SEQ ID NO: 27543 - DNA, 25 bp, Mus musculus
aacacggtgttgacatggactgcgc

SEQ ID NO: 27544 - DNA, 25 bp, Mus musculus
aacacggtgttgtcatggactgcgc

SEQ ID NO: 27545 - DNA, 25 bp, Mus musculus
aacacggttcggaaagctcttgctt

SEQ ID NO: 27546 - DNA, 25 bp, Mus musculus
aacacggttcggtaagctcttgctt

SEQ ID NO: 27547 - DNA, 25 bp, Mus musculus
aacacggttgcaaaccatgccaagc

SEQ ID NO: 27548 - DNA, 25 bp, Mus musculus
aacacggttgcataccatgccaagc

SEQ ID NO: 27549 - DNA, 25 bp, Mus musculus
aacacggttttcaacttcagagctt

SEQ ID NO: 27550 - DNA, 25 bp, Mus musculus
aacacggttttctacttcagagctt

SEQ ID NO: 27551 - DNA, 25 bp, Mus musculus
aacacgtaggtgaccttgagagcca

SEQ ID NO: 27552 - DNA, 25 bp, Mus musculus
aacacgtaggtgtccttgagagcca

SEQ ID NO: 27553 - DNA, 25 bp, Mus musculus
aacacgtagttgagagccatctaat

SEQ ID NO: 27554 - DNA, 25 bp, Mus musculus
aacacgtagttgtgagccatctaat

SEQ ID NO: 27555 - DNA, 25 bp, Mus musculus
aacacgtattatcaagcaactgact

SEQ ID NO: 27556 - DNA, 25 bp, Mus musculus
aacacgtattatgaagcaactgact

SEQ ID NO: 27557 - DNA, 25 bp, Mus musculus
aacacgtcagtcatgggtcacacta

SEQ ID NO: 27558 - DNA, 25 bp, Mus musculus
aacacgtcagtcttgggtcacacta

SEQ ID NO: 27559 - DNA, 25 bp, Mus musculus
aacacgtcccgtcgattgcttgact

SEQ ID NO: 27560 - DNA, 25 bp, Mus musculus
aacacgtcccgtggattgcttgact

SEQ ID NO: 27561 - DNA, 25 bp, Mus musculus
aacacgtccttgatcgtgccgctga

SEQ ID NO: 27562 - DNA, 25 bp, Mus musculus
aacacgtccttgttcgtgccgctga

SEQ ID NO: 27563 - DNA, 25 bp, Mus musculus
aacacgtctatgaaacctgaggctc

SEQ ID NO: 27564 - DNA, 25 bp, Mus musculus
aacacgtctatgtaacctgaggctc

SEQ ID NO: 27565 - DNA, 25 bp, Mus musculus
aacacgtctgtgactatatgtatat

SEQ ID NO: 27566 - DNA, 25 bp, Mus musculus
aacacgtctgtgtctatatgtatat

SEQ ID NO: 27567 - DNA, 25 bp, Mus musculus
aacacgtgacaaacctgccttggtt

SEQ ID NO: 27568 - DNA, 25 bp, Mus musculus
aacacgtgacaatcctgccttggtt

SEQ ID NO: 27569 - DNA, 25 bp, Mus musculus
aacacgtgcttccacaactgggctt

SEQ ID NO: 27570 - DNA, 25 bp, Mus musculus
aacacgtgcttcgacaactgggctt

SEQ ID NO: 27571 - DNA, 25 bp, Mus musculus
aacacgtggcgtcccttcgatggcc

SEQ ID NO: 27572 - DNA, 25 bp, Mus musculus
aacacgtggcgtgccttcgatggcc

SEQ ID NO: 27573 - DNA, 25 bp, Mus musculus
aacacgtgtcgcacggtgaggagct

SEQ ID NO: 27574 - DNA, 25 bp, Mus musculus
aacacgtgtcgctcggtgaggagct

SEQ ID NO: 27575 - DNA, 25 bp, Mus musculus
aacacgttagagcacgtttcaggat

SEQ ID NO: 27576 - DNA, 25 bp, Mus musculus
aacacgttagaggacgtttcaggat

SEQ ID NO: 27577 - DNA, 25 bp, Mus musculus
aacacgttctggatcttcggtgcaa

SEQ ID NO: 27578 - DNA, 25 bp, Mus musculus
aacacgttctggttcttcggtgcaa

SEQ ID NO: 27579 - DNA, 25 bp, Mus musculus
aacacgttgcaaccctcctggatta

SEQ ID NO: 27580 - DNA, 25 bp, Mus musculus
aacacgttgcaagcctcctggatta

SEQ ID NO: 27581 - DNA, 25 bp, Mus musculus
aacactaaacgacagcagagcccag

SEQ ID NO: 27582 - DNA, 25 bp, Mus musculus
aacactaaacgagagcagagcccag

SEQ ID NO: 27583 - DNA, 25 bp, Mus musculus
aacactaaaggaataacccatctgt

SEQ ID NO: 27584 - DNA, 25 bp, Mus musculus
aacactaaaggattaacccatctgt

SEQ ID NO: 27585 - DNA, 25 bp, Mus musculus
aacactaaagtccaacatgtgactg

SEQ ID NO: 27586 - DNA, 25 bp, Mus musculus
aacactaaagtcgaacatgtgactg

SEQ ID NO: 27587 - DNA, 25 bp, Mus musculus
aacactaaatggagatgtcccaaac

SEQ ID NO: 27588 - DNA, 25 bp, Mus musculus
aacactaaatggtgatgtcccaaac

SEQ ID NO: 27589 - DNA, 25 bp, Mus musculus
aacactaaatgtcggctggactcaa

SEQ ID NO: 27590 - DNA, 25 bp, Mus musculus
aacactaaatgtgggctggactcaa

SEQ ID NO: 27591 - DNA, 25 bp, Mus musculus
aacactaaccttctttatctggcct

SEQ ID NO: 27592 - DNA, 25 bp, Mus musculus
aacactaaccttgtttatctggcct

SEQ ID NO: 27593 - DNA, 25 bp, Mus musculus
aacactaagatgaccttatccctga

SEQ ID NO: 27594 - DNA, 25 bp, Mus musculus
aacactaagatgtccttatccctga

SEQ ID NO: 27595 - DNA, 25 bp, Mus musculus
aacactaatgttactcaggtatata

SEQ ID NO: 27596 - DNA, 25 bp, Mus musculus
aacactaatgtttctcaggtatata

SEQ ID NO: 27597 - DNA, 25 bp, Mus musculus
aacactacaggtagtccaggtgtaa

SEQ ID NO: 27598 - DNA, 25 bp, Mus musculus
aacactacaggtcccgactgtggga

SEQ ID NO: 27599 - DNA, 25 bp, Mus musculus
aacactacaggtgccgactgtggga

SEQ ID NO: 27600 - DNA, 25 bp, Mus musculus
aacactacaggttgtccaggtgtaa

SEQ ID NO: 27601 - DNA, 25 bp, Mus musculus
aacactacagtcctggttgaattga

SEQ ID NO: 27602 - DNA, 25 bp, Mus musculus
aacactacagtcgtggttgaattga

SEQ ID NO: 27603 - DNA, 25 bp, Mus musculus
aacactacatggcactagctgggtg

SEQ ID NO: 27604 - DNA, 25 bp, Mus musculus
aacactacatgggactagctgggtg

SEQ ID NO: 27605 - DNA, 25 bp, Mus musculus
aacactaccaaaccaccaagcagaa

SEQ ID NO: 27606 - DNA, 25 bp, Mus musculus
aacactaccaaaccaggaccattct

SEQ ID NO: 27607 - DNA, 25 bp, Mus musculus
aacactaccaaagcaccaagcagaa

SEQ ID NO: 27608 - DNA, 25 bp, Mus musculus
aacactaccaaagcaggaccattct

SEQ ID NO: 27609 - DNA, 25 bp, Mus musculus
aacactaccaccaataggctttcta

SEQ ID NO: 27610 - DNA, 25 bp, Mus musculus
aacactaccacctataggctttcta

SEQ ID NO: 27611 - DNA, 25 bp, Mus musculus
aacactacccaaaattgtgctagag

SEQ ID NO: 27612 - DNA, 25 bp, Mus musculus
aacactacccaatattgtgctagag

SEQ ID NO: 27613 - DNA, 25 bp, Mus musculus
aacactacctctatttgctaatcaa

SEQ ID NO: 27614 - DNA, 25 bp, Mus musculus
aacactacctctttttgctaatcaa

SEQ ID NO: 27615 - DNA, 25 bp, Mus musculus
aacactaccttgcagaaagatgaaa

SEQ ID NO: 27616 - DNA, 25 bp, Mus musculus
aacactaccttggagaaagatgaaa

SEQ ID NO: 27617 - DNA, 25 bp, Mus musculus
aacactacgcatcaaaaatactaag

SEQ ID NO: 27618 - DNA, 25 bp, Mus musculus
aacactacgcatgaaaaatactaag

SEQ ID NO: 27619 - DNA, 25 bp, Mus musculus
aacactactctaagttaacctcacc

SEQ ID NO: 27620 - DNA, 25 bp, Mus musculus
aacactactctatgttaacctcacc

SEQ ID NO: 27621 - DNA, 25 bp, Mus musculus
aacactactgagcttctgccaccgt

SEQ ID NO: 27622 - DNA, 25 bp, Mus musculus
aacactactgaggttctgccaccgt

SEQ ID NO: 27623 - DNA, 25 bp, Mus musculus
aacactagaggcagaccgtcctgtg

SEQ ID NO: 27624 - DNA, 25 bp, Mus musculus
aacactagaggctgaccgtcctgtg

SEQ ID NO: 27625 - DNA, 25 bp, Mus musculus
aacactagaggtcgctaactctgaa

SEQ ID NO: 27626 - DNA, 25 bp, Mus musculus
aacactagaggtggctaactctgaa

SEQ ID NO: 27627 - DNA, 25 bp, Mus musculus
aacactagctagagtcattcgagaa

SEQ ID NO: 27628 - DNA, 25 bp, Mus musculus
aacactagctagtgtcattcgagaa

SEQ ID NO: 27629 - DNA, 25 bp, Mus musculus
aacactagctatctgcgcagacacg

SEQ ID NO: 27630 - DNA, 25 bp, Mus musculus
aacactagctatgtgcgcagacacg

SEQ ID NO: 27631 - DNA, 25 bp, Mus musculus
aacactagggatctgtgcatgcccc

SEQ ID NO: 27632 - DNA, 25 bp, Mus musculus
aacactagggatgtgtgcatgcccc

SEQ ID NO: 27633 - DNA, 25 bp, Mus musculus
aacactaggtgcattaaggccagaa

SEQ ID NO: 27634 - DNA, 25 bp, Mus musculus
aacactaggtgctttaaggccagaa

SEQ ID NO: 27635 - DNA, 25 bp, Mus musculus
aacactatccttcgtgtgcctggca

SEQ ID NO: 27636 - DNA, 25 bp, Mus musculus
aacactatccttggtgtgcctggca

SEQ ID NO: 27637 - DNA, 25 bp, Mus musculus
aacactatgagacaggccgtgctga

SEQ ID NO: 27638 - DNA, 25 bp, Mus musculus
aacactatgagagaggccgtgctga

SEQ ID NO: 27639 - DNA, 25 bp, Mus musculus
aacactatgattcactttggtatgt

SEQ ID NO: 27640 - DNA, 25 bp, Mus musculus
aacactatgattgactttggtatgt

SEQ ID NO: 27641 - DNA, 25 bp, Mus musculus
aacactatgcacatctgtactttga

SEQ ID NO: 27642 - DNA, 25 bp, Mus musculus
aacactatgcacttctgtactttga

SEQ ID NO: 27643 - DNA, 25 bp, Mus musculus
aacactattataacacttccattta

SEQ ID NO: 27644 - DNA, 25 bp, Mus musculus
aacactattatatcacttccattta

SEQ ID NO: 27645 - DNA, 25 bp, Mus musculus
aacactattcaactacctctctatg

SEQ ID NO: 27646 - DNA, 25 bp, Mus musculus
aacactattcaagtacctctctatg

SEQ ID NO: 27647 - DNA, 25 bp, Mus musculus
aacactattgtgaatgatattaaga

SEQ ID NO: 27648 - DNA, 25 bp, Mus musculus
aacactattgtgtatgatattaaga

SEQ ID NO: 27649 - DNA, 25 bp, Mus musculus
aacactcaaaagcagactcggtttt

SEQ ID NO: 27650 - DNA, 25 bp, Mus musculus
aacactcaaaaggagactcggtttt

SEQ ID NO: 27651 - DNA, 25 bp, Mus musculus
aacactcaacataggcagccttgct

SEQ ID NO: 27652 - DNA, 25 bp, Mus musculus
aacactcaacatatcacttgtacat

SEQ ID NO: 27653 - DNA, 25 bp, Mus musculus
aacactcaacattggcagccttgct

SEQ ID NO: 27654 - DNA, 25 bp, Mus musculus
aacactcaacatttcacttgtacat

SEQ ID NO: 27655 - DNA, 25 bp, Mus musculus
aacactcaagagctgcctggtatga

SEQ ID NO: 27656 - DNA, 25 bp, Mus musculus
aacactcaagaggtgcctggtatga

SEQ ID NO: 27657 - DNA, 25 bp, Mus musculus
aacactcacaggcagaggcttgcag

SEQ ID NO: 27658 - DNA, 25 bp, Mus musculus
aacactcacagggagaggcttgcag

SEQ ID NO: 27659 - DNA, 25 bp, Mus musculus
aacactcacatgacgccagcaatga

SEQ ID NO: 27660 - DNA, 25 bp, Mus musculus
aacactcacatgtcgccagcaatga

SEQ ID NO: 27661 - DNA, 25 bp, Mus musculus
aacactcacctacgctgcgtcaatg

SEQ ID NO: 27662 - DNA, 25 bp, Mus musculus
aacactcacctaggctgcgtcaatg

SEQ ID NO: 27663 - DNA, 25 bp, Mus musculus
aacactcactgcacaagcgcttgag

SEQ ID NO: 27664 - DNA, 25 bp, Mus musculus
aacactcactgctcaagcgcttgag

SEQ ID NO: 27665 - DNA, 25 bp, Mus musculus
aacactcactggacgcctggtgggt

SEQ ID NO: 27666 - DNA, 25 bp, Mus musculus
aacactcactggtcgcctggtgggt

SEQ ID NO: 27667 - DNA, 25 bp, Mus musculus
aacactcagaacacgttgcaattca

SEQ ID NO: 27668 - DNA, 25 bp, Mus musculus
aacactcagaactcgttgcaattca

SEQ ID NO: 27669 - DNA, 25 bp, Mus musculus
aacactcagaggctaggatttagac

SEQ ID NO: 27670 - DNA, 25 bp, Mus musculus
aacactcagagggtaggatttagac

SEQ ID NO: 27671 - DNA, 25 bp, Mus musculus
aacactcaggcaatgttatgcatac

SEQ ID NO: 27672 - DNA, 25 bp, Mus musculus
aacactcaggcattgttatgcatac

SEQ ID NO: 27673 - DNA, 25 bp, Mus musculus
aacactcaggccatttcctcatagt

SEQ ID NO: 27674 - DNA, 25 bp, Mus musculus
aacactcaggccttttcctcatagt

SEQ ID NO: 27675 - DNA, 25 bp, Mus musculus
aacactcagggcaaattgcttccca

SEQ ID NO: 27676 - DNA, 25 bp, Mus musculus
aacactcagggctaattgcttccca

SEQ ID NO: 27677 - DNA, 25 bp, Mus musculus
aacactcaggtgctttcagatttca

SEQ ID NO: 27678 - DNA, 25 bp, Mus musculus
aacactcaggtggtttcagatttca

SEQ ID NO: 27679 - DNA, 25 bp, Mus musculus
aacactcaggttatacaggcataat

SEQ ID NO: 27680 - DNA, 25 bp, Mus musculus
aacactcaggttttacaggcataat

SEQ ID NO: 27681 - DNA, 25 bp, Mus musculus
aacactcataaaacttcactgccct

SEQ ID NO: 27682 - DNA, 25 bp, Mus musculus
aacactcataaatcttcactgccct

SEQ ID NO: 27683 - DNA, 25 bp, Mus musculus
aacactcatctgaaatgggctggca

SEQ ID NO: 27684 - DNA, 25 bp, Mus musculus
aacactcatctgtaatgggctggca

SEQ ID NO: 27685 - DNA, 25 bp, Mus musculus
aacactcatgctatcaatacctgtc

SEQ ID NO: 27686 - DNA, 25 bp, Mus musculus
aacactcatgctttcaatacctgtc

SEQ ID NO: 27687 - DNA, 25 bp, Mus musculus
aacactcatggcaacaccaggagta

SEQ ID NO: 27688 - DNA, 25 bp, Mus musculus
aacactcatggctacaccaggagta

SEQ ID NO: 27689 - DNA, 25 bp, Mus musculus
aacactcattgtatctatcaggaag

SEQ ID NO: 27690 - DNA, 25 bp, Mus musculus
aacactcattgtttctatcaggaag

SEQ ID NO: 27691 - DNA, 25 bp, Mus musculus
aacactcattttcgcagcaaggctt

SEQ ID NO: 27692 - DNA, 25 bp, Mus musculus
aacactcattttggcagcaaggctt

SEQ ID NO: 27693 - DNA, 25 bp, Mus musculus
aacactccaagtatgtactctcagg

SEQ ID NO: 27694 - DNA, 25 bp, Mus musculus
aacactccaagtttgtactctcagg

SEQ ID NO: 27695 - DNA, 25 bp, Mus musculus
aacactccacgtcgctgtattggaa

SEQ ID NO: 27696 - DNA, 25 bp, Mus musculus
aacactccacgtggctgtattggaa

SEQ ID NO: 27697 - DNA, 25 bp, Mus musculus
aacactccatggcttgtttctggct

SEQ ID NO: 27698 - DNA, 25 bp, Mus musculus
aacactccatgggttgtttctggct

SEQ ID NO: 27699 - DNA, 25 bp, Mus musculus
aacactcccaagatacatgccagta

SEQ ID NO: 27700 - DNA, 25 bp, Mus musculus
aacactcccaagttacatgccagta

SEQ ID NO: 27701 - DNA, 25 bp, Mus musculus
aacactcccgaaacttggccaatga

SEQ ID NO: 27702 - DNA, 25 bp, Mus musculus
aacactcccgaatcttggccaatga

SEQ ID NO: 27703 - DNA, 25 bp, Mus musculus
aacactcctaacatacctggaaggg

SEQ ID NO: 27704 - DNA, 25 bp, Mus musculus
aacactcctaacttacctggaaggg

SEQ ID NO: 27705 - DNA, 25 bp, Mus musculus
aacactcctctgcagtttgagcttt

SEQ ID NO: 27706 - DNA, 25 bp, Mus musculus
aacactcctctggagtttgagcttt

SEQ ID NO: 27707 - DNA, 25 bp, Mus musculus
aacactcctgtccaagaatctcaga

SEQ ID NO: 27708 - DNA, 25 bp, Mus musculus
aacactcctgtcgaagaatctcaga

SEQ ID NO: 27709 - DNA, 25 bp, Mus musculus
aacactcgctgacgcaggctctgca

SEQ ID NO: 27710 - DNA, 25 bp, Mus musculus
aacactcgctgaggcaggctctgca

SEQ ID NO: 27711 - DNA, 25 bp, Mus musculus
aacactctaaacagctaattcacaa

SEQ ID NO: 27712 - DNA, 25 bp, Mus musculus
aacactctaaactgctaattcacaa

SEQ ID NO: 27713 - DNA, 25 bp, Mus musculus
aacactctaaagattggctgaagac

SEQ ID NO: 27714 - DNA, 25 bp, Mus musculus
aacactctaaagtttggctgaagac

SEQ ID NO: 27715 - DNA, 25 bp, Mus musculus
aacactctacttcggaatttgctgc

SEQ ID NO: 27716 - DNA, 25 bp, Mus musculus
aacactctacttgggaatttgctgc

SEQ ID NO: 27717 - DNA, 25 bp, Mus musculus
aacactctccaaatgaacttaatct

SEQ ID NO: 27718 - DNA, 25 bp, Mus musculus
aacactctccaattgaacttaatct

SEQ ID NO: 27719 - DNA, 25 bp, Mus musculus
aacactctctatagctcacggcagt

SEQ ID NO: 27720 - DNA, 25 bp, Mus musculus
aacactctctatctattccttatta

SEQ ID NO: 27721 - DNA, 25 bp, Mus musculus
aacactctctatgtattccttatta

SEQ ID NO: 27722 - DNA, 25 bp, Mus musculus
aacactctctattgctcacggcagt

SEQ ID NO: 27723 - DNA, 25 bp, Mus musculus
aacactctctggctactttgtacat

SEQ ID NO: 27724 - DNA, 25 bp, Mus musculus
aacactctctgggtactttgtacat

SEQ ID NO: 27725 - DNA, 25 bp, Mus musculus
aacactctgaagcacttggacctga

SEQ ID NO: 27726 - DNA, 25 bp, Mus musculus
aacactctgaaggacttggacctga

SEQ ID NO: 27727 - DNA, 25 bp, Mus musculus
aacactctgcttcttaggccgggtg

SEQ ID NO: 27728 - DNA, 25 bp, Mus musculus
aacactctgcttgttaggccgggtg

SEQ ID NO: 27729 - DNA, 25 bp, Mus musculus
aacactctggcacttacagaatgag

SEQ ID NO: 27730 - DNA, 25 bp, Mus musculus
aacactctggcagttacagaatgag

SEQ ID NO: 27731 - DNA, 25 bp, Mus musculus
aacactctggtgagattcatccctc

SEQ ID NO: 27732 - DNA, 25 bp, Mus musculus
aacactctggtgtgattcatccctc

SEQ ID NO: 27733 - DNA, 25 bp, Mus musculus
aacactctgtgtcatgaccggtggt

SEQ ID NO: 27734 - DNA, 25 bp, Mus musculus
aacactctgtgtgatgaccggtggt

SEQ ID NO: 27735 - DNA, 25 bp, Mus musculus
aacactcttatcagcttaccagatc

SEQ ID NO: 27736 - DNA, 25 bp, Mus musculus
aacactcttatctgcttaccagatc

SEQ ID NO: 27737 - DNA, 25 bp, Mus musculus
aacactcttcacagactaaggctga

SEQ ID NO: 27738 - DNA, 25 bp, Mus musculus
aacactcttcactgactaaggctga

SEQ ID NO: 27739 - DNA, 25 bp, Mus musculus
aacactcttctcagactatgtcaca

SEQ ID NO: 27740 - DNA, 25 bp, Mus musculus
aacactcttctctgactatgtcaca

SEQ ID NO: 27741 - DNA, 25 bp, Mus musculus
aacactcttgacatatttggaggag

SEQ ID NO: 27742 - DNA, 25 bp, Mus musculus
aacactcttgacttatttggaggag

SEQ ID NO: 27743 - DNA, 25 bp, Mus musculus
aacactcttgagacattggctgagg

SEQ ID NO: 27744 - DNA, 25 bp, Mus musculus
aacactcttgagtcattggctgagg

SEQ ID NO: 27745 - DNA, 25 bp, Mus musculus
aacactctttacagttgagccatct

SEQ ID NO: 27746 - DNA, 25 bp, Mus musculus
aacactctttactgttgagccatct

SEQ ID NO: 27747 - DNA, 25 bp, Mus musculus
aacactctttccagtagtagccagg

SEQ ID NO: 27748 - DNA, 25 bp, Mus musculus
aacactctttcctgtagtagccagg

SEQ ID NO: 27749 - DNA, 25 bp, Mus musculus
aacactgaagatctaactgaagaat

SEQ ID NO: 27750 - DNA, 25 bp, Mus musculus
aacactgaagatgtaactgaagaat

SEQ ID NO: 27751 - DNA, 25 bp, Mus musculus
aacactgaagtaatccctccacaga

SEQ ID NO: 27752 - DNA, 25 bp, Mus musculus
aacactgaagtattccctccacaga

SEQ ID NO: 27753 - DNA, 25 bp, Mus musculus
aacactgaagtcaactctggtacac

SEQ ID NO: 27754 - DNA, 25 bp, Mus musculus
aacactgaagtctactctggtacac

SEQ ID NO: 27755 - DNA, 25 bp, Mus musculus
aacactgaatctcagttcccgattc

SEQ ID NO: 27756 - DNA, 25 bp, Mus musculus
aacactgaatctgagttcccgattc

SEQ ID NO: 27757 - DNA, 25 bp, Mus musculus
aacactgaattccaaaagcctcata

SEQ ID NO: 27758 - DNA, 25 bp, Mus musculus
aacactgaattcgaaaagcctcata

SEQ ID NO: 27759 - DNA, 25 bp, Mus musculus
aacactgacaggcatcaagtttgtg

SEQ ID NO: 27760 - DNA, 25 bp, Mus musculus
aacactgacagggatcaagtttgtg

SEQ ID NO: 27761 - DNA, 25 bp, Mus musculus
aacactgaccagctgctgatgggag

SEQ ID NO: 27762 - DNA, 25 bp, Mus musculus
aacactgaccaggtgctgatgggag

SEQ ID NO: 27763 - DNA, 25 bp, Mus musculus
aacactgactgcaccgcgatggtct

SEQ ID NO: 27764 - DNA, 25 bp, Mus musculus
aacactgactgctccgcgatggtct

SEQ ID NO: 27765 - DNA, 25 bp, Mus musculus
aacactgactttaatccagttcttt

SEQ ID NO: 27766 - DNA, 25 bp, Mus musculus
aacactgacttttatccagttcttt

SEQ ID NO: 27767 - DNA, 25 bp, Mus musculus
aacactgagagcctgggtttctgca

SEQ ID NO: 27768 - DNA, 25 bp, Mus musculus
aacactgagagcgtgggtttctgca

SEQ ID NO: 27769 - DNA, 25 bp, Mus musculus
aacactgagccaaactgctcttctt

SEQ ID NO: 27770 - DNA, 25 bp, Mus musculus
aacactgagccatactgctcttctt

SEQ ID NO: 27771 - DNA, 25 bp, Mus musculus
aacactgagcttatgttcccatcag

SEQ ID NO: 27772 - DNA, 25 bp, Mus musculus
aacactgagcttttgttcccatcag

SEQ ID NO: 27773 - DNA, 25 bp, Mus musculus
aacactgaggaaatagacgggcaaa

SEQ ID NO: 27774 - DNA, 25 bp, Mus musculus
aacactgaggaattagacgggcaaa

SEQ ID NO: 27775 - DNA, 25 bp, Mus musculus
aacactgaggagatccgtgaccagt

SEQ ID NO: 27776 - DNA, 25 bp, Mus musculus
aacactgaggagttccgtgaccagt

SEQ ID NO: 27777 - DNA, 25 bp, Mus musculus
aacactgaggtcaaacccagggcct

SEQ ID NO: 27778 - DNA, 25 bp, Mus musculus
aacactgaggtctaacccagggcct

SEQ ID NO: 27779 - DNA, 25 bp, Mus musculus
aacactgagtgtaccaaggccaagc

SEQ ID NO: 27780 - DNA, 25 bp, Mus musculus
aacactgagtgttccaaggccaagc

SEQ ID NO: 27781 - DNA, 25 bp, Mus musculus
aacactgataagaggcggctgcccc

SEQ ID NO: 27782 - DNA, 25 bp, Mus musculus
aacactgataagtggcggctgcccc

SEQ ID NO: 27783 - DNA, 25 bp, Mus musculus
aacactgatataagtatgtacgcac

SEQ ID NO: 27784 - DNA, 25 bp, Mus musculus
aacactgatatatgtatgtacgcac

SEQ ID NO: 27785 - DNA, 25 bp, Mus musculus
aacactgatgcgattggcaggtgat

SEQ ID NO: 27786 - DNA, 25 bp, Mus musculus
aacactgatgcgtttggcaggtgat

SEQ ID NO: 27787 - DNA, 25 bp, Mus musculus
aacactgatggactcgagcaaactt

SEQ ID NO: 27788 - DNA, 25 bp, Mus musculus
aacactgatggagtcgagcaaactt

SEQ ID NO: 27789 - DNA, 25 bp, Mus musculus
aacactgattctattcatctgatga

SEQ ID NO: 27790 - DNA, 25 bp, Mus musculus
aacactgattcttttcatctgatga

SEQ ID NO: 27791 - DNA, 25 bp, Mus musculus
aacactgattgcaggtgatcttccc

SEQ ID NO: 27792 - DNA, 25 bp, Mus musculus
aacactgattgctggtgatcttccc

SEQ ID NO: 27793 - DNA, 25 bp, Mus musculus
aacactgcacgaagttaagctgaca

SEQ ID NO: 27794 - DNA, 25 bp, Mus musculus
aacactgcacgatgttaagctgaca

SEQ ID NO: 27795 - DNA, 25 bp, Mus musculus
aacactgcagccagctgtgcaattt

SEQ ID NO: 27796 - DNA, 25 bp, Mus musculus
aacactgcagccatcggacggtcga

SEQ ID NO: 27797 - DNA, 25 bp, Mus musculus
aacactgcagcctgctgtgcaattt

SEQ ID NO: 27798 - DNA, 25 bp, Mus musculus
aacactgcagccttcggacggtcga

SEQ ID NO: 27799 - DNA, 25 bp, Mus musculus
aacactgcagttaaccatgggacac

SEQ ID NO: 27800 - DNA, 25 bp, Mus musculus
aacactgcagtttaccatgggacac

SEQ ID NO: 27801 - DNA, 25 bp, Mus musculus
aacactgcatataggctggttctag

SEQ ID NO: 27802 - DNA, 25 bp, Mus musculus
aacactgcatattggctggttctag

SEQ ID NO: 27803 - DNA, 25 bp, Mus musculus
aacactgccagcattgttggccagg

SEQ ID NO: 27804 - DNA, 25 bp, Mus musculus
aacactgccagctttgttggccagg

SEQ ID NO: 27805 - DNA, 25 bp, Mus musculus
aacactgccaggatgctgaaagcct

SEQ ID NO: 27806 - DNA, 25 bp, Mus musculus
aacactgccaggttgctgaaagcct

SEQ ID NO: 27807 - DNA, 25 bp, Mus musculus
aacactgcccaaatgtgatgttgtc

SEQ ID NO: 27808 - DNA, 25 bp, Mus musculus
aacactgcccaattgtgatgttgtc

SEQ ID NO: 27809 - DNA, 25 bp, Mus musculus
aacactgcccggaggccgaagggat

SEQ ID NO: 27810 - DNA, 25 bp, Mus musculus
aacactgcccggtggccgaagggat

SEQ ID NO: 27811 - DNA, 25 bp, Mus musculus
aacactgcgagcagtggagcacact

SEQ ID NO: 27812 - DNA, 25 bp, Mus musculus
aacactgcgagctgtggagcacact

SEQ ID NO: 27813 - DNA, 25 bp, Mus musculus
aacactgcggccataatgtctgatc

SEQ ID NO: 27814 - DNA, 25 bp, Mus musculus
aacactgcggccttaatgtctgatc

SEQ ID NO: 27815 - DNA, 25 bp, Mus musculus
aacactgcgtttcactgggtgtcgc

SEQ ID NO: 27816 - DNA, 25 bp, Mus musculus
aacactgcgtttgactgggtgtcgc

SEQ ID NO: 27817 - DNA, 25 bp, Mus musculus
aacactgctctacaagaggtgctga

SEQ ID NO: 27818 - DNA, 25 bp, Mus musculus
aacactgctctagaagaggtgctga

SEQ ID NO: 27819 - DNA, 25 bp, Mus musculus
aacactgctgagacttgactatgta

SEQ ID NO: 27820 - DNA, 25 bp, Mus musculus
aacactgctgagtcttgactatgta

SEQ ID NO: 27821 - DNA, 25 bp, Mus musculus
aacactgctgatccgtttgcagctt

SEQ ID NO: 27822 - DNA, 25 bp, Mus musculus
aacactgctgatgcgtttgcagctt

SEQ ID NO: 27823 - DNA, 25 bp, Mus musculus
aacactgctgcaccactgggtagag

SEQ ID NO: 27824 - DNA, 25 bp, Mus musculus
aacactgctgcagcactgggtagag

SEQ ID NO: 27825 - DNA, 25 bp, Mus musculus
aacactgctgccaaaggaaaacgta

SEQ ID NO: 27826 - DNA, 25 bp, Mus musculus
aacactgctgcctaaggaaaacgta

SEQ ID NO: 27827 - DNA, 25 bp, Mus musculus
aacactgctgtgataagctgttcat

SEQ ID NO: 27828 - DNA, 25 bp, Mus musculus
aacactgctgtgattcatgtatagc

SEQ ID NO: 27829 - DNA, 25 bp, Mus musculus
aacactgctgtgttaagctgttcat

SEQ ID NO: 27830 - DNA, 25 bp, Mus musculus
aacactgctgtgtttcatgtatagc

SEQ ID NO: 27831 - DNA, 25 bp, Mus musculus
aacactgcttacaggtttcttttgt

SEQ ID NO: 27832 - DNA, 25 bp, Mus musculus
aacactgcttactggtttcttttgt

SEQ ID NO: 27833 - DNA, 25 bp, Mus musculus
aacactgcttagatggtgggcctgc

SEQ ID NO: 27834 - DNA, 25 bp, Mus musculus
aacactgcttagttggtgggcctgc

SEQ ID NO: 27835 - DNA, 25 bp, Mus musculus
aacactgcttgcagacttcatctct

SEQ ID NO: 27836 - DNA, 25 bp, Mus musculus
aacactgcttgctgacttcatctct

SEQ ID NO: 27837 - DNA, 25 bp, Mus musculus
aacactgctttcaggtgcattgagg

SEQ ID NO: 27838 - DNA, 25 bp, Mus musculus
aacactgctttctggtgcattgagg

SEQ ID NO: 27839 - DNA, 25 bp, Mus musculus
aacactgctttgaatgctacggcta

SEQ ID NO: 27840 - DNA, 25 bp, Mus musculus
aacactgctttgtatgctacggcta

SEQ ID NO: 27841 - DNA, 25 bp, Mus musculus
aacactggaaccaatgccgggccaa

SEQ ID NO: 27842 - DNA, 25 bp, Mus musculus
aacactggaacctatgccgggccaa

SEQ ID NO: 27843 - DNA, 25 bp, Mus musculus
aacactggaacgacctcacagggat

SEQ ID NO: 27844 - DNA, 25 bp, Mus musculus
aacactggaacgtcctcacagggat

SEQ ID NO: 27845 - DNA, 25 bp, Mus musculus
aacactggacagacttgctggagac

SEQ ID NO: 27846 - DNA, 25 bp, Mus musculus
aacactggacagtcttgctggagac

SEQ ID NO: 27847 - DNA, 25 bp, Mus musculus
aacactggacctcggaagaatgaga

SEQ ID NO: 27848 - DNA, 25 bp, Mus musculus
aacactggacctgggaagaatgaga

SEQ ID NO: 27849 - DNA, 25 bp, Mus musculus
aacactggactcaagttcaaccctg

SEQ ID NO: 27850 - DNA, 25 bp, Mus musculus
aacactggactctagttcaaccctg

SEQ ID NO: 27851 - DNA, 25 bp, Mus musculus
aacactggactgctgctgttgtagc

SEQ ID NO: 27852 - DNA, 25 bp, Mus musculus
aacactggactggtgctgttgtagc

SEQ ID NO: 27853 - DNA, 25 bp, Mus musculus
aacactggatctacaacaccgaggc

SEQ ID NO: 27854 - DNA, 25 bp, Mus musculus
aacactggatcttcaacaccgaggc

SEQ ID NO: 27855 - DNA, 25 bp, Mus musculus
aacactggatggctgtccgtaaaat

SEQ ID NO: 27856 - DNA, 25 bp, Mus musculus
aacactggatgggtgtccgtaaaat

SEQ ID NO: 27857 - DNA, 25 bp, Mus musculus
aacactggcagcatgcccgaagttc

SEQ ID NO: 27858 - DNA, 25 bp, Mus musculus
aacactggcagcttgcccgaagttc

SEQ ID NO: 27859 - DNA, 25 bp, Mus musculus
aacactggccagagatggcggtata

SEQ ID NO: 27860 - DNA, 25 bp, Mus musculus
aacactggccagtgatggcggtata

SEQ ID NO: 27861 - DNA, 25 bp, Mus musculus
aacactggccggcacaatatgacga

SEQ ID NO: 27862 - DNA, 25 bp, Mus musculus
aacactggccgggacaatatgacga

SEQ ID NO: 27863 - DNA, 25 bp, Mus musculus
aacactggccttcattcttattttt

SEQ ID NO: 27864 - DNA, 25 bp, Mus musculus
aacactggccttgattcttattttt

SEQ ID NO: 27865 - DNA, 25 bp, Mus musculus
aacactggctctcgcgatgagtcat

SEQ ID NO: 27866 - DNA, 25 bp, Mus musculus
aacactggctctggcgatgagtcat

SEQ ID NO: 27867 - DNA, 25 bp, Mus musculus
aacactggctgaccattggaatcac

SEQ ID NO: 27868 - DNA, 25 bp, Mus musculus
aacactggctgagcattggaatcac

SEQ ID NO: 27869 - DNA, 25 bp, Mus musculus
aacactggctgcacagggcttggta

SEQ ID NO: 27870 - DNA, 25 bp, Mus musculus
aacactggctgctcagggcttggta

SEQ ID NO: 27871 - DNA, 25 bp, Mus musculus
aacactggctgtaagtgctgactcg

SEQ ID NO: 27872 - DNA, 25 bp, Mus musculus
aacactggctgttagtgctgactcg

SEQ ID NO: 27873 - DNA, 25 bp, Mus musculus
aacactgggaaaattctatcactgt

SEQ ID NO: 27874 - DNA, 25 bp, Mus musculus
aacactgggaaatttctatcactgt

SEQ ID NO: 27875 - DNA, 25 bp, Mus musculus
aacactgggctcattcctgtttggt

SEQ ID NO: 27876 - DNA, 25 bp, Mus musculus
aacactgggctctttcctgtttggt

SEQ ID NO: 27877 - DNA, 25 bp, Mus musculus
aacactgggtgcagtagtgtccatc

SEQ ID NO: 27878 - DNA, 25 bp, Mus musculus
aacactgggtgctgtagtgtccatc

SEQ ID NO: 27879 - DNA, 25 bp, Mus musculus
aacactggtatgacatgtctgagca

SEQ ID NO: 27880 - DNA, 25 bp, Mus musculus
aacactggtatgtcatgtctgagca

SEQ ID NO: 27881 - DNA, 25 bp, Mus musculus
aacactggtccaaagcctgtactaa

SEQ ID NO: 27882 - DNA, 25 bp, Mus musculus
aacactggtccatagcctgtactaa

SEQ ID NO: 27883 - DNA, 25 bp, Mus musculus
aacactggtcgcctgtctcgaggag

SEQ ID NO: 27884 - DNA, 25 bp, Mus musculus
aacactggtcgcgtgtctcgaggag

SEQ ID NO: 27885 - DNA, 25 bp, Mus musculus
aacactggtcgtatagagccaagca

SEQ ID NO: 27886 - DNA, 25 bp, Mus musculus
aacactggtcgtttagagccaagca

SEQ ID NO: 27887 - DNA, 25 bp, Mus musculus
aacactggtctacaacctttagatg

SEQ ID NO: 27888 - DNA, 25 bp, Mus musculus
aacactggtctagaacctttagatg

SEQ ID NO: 27889 - DNA, 25 bp, Mus musculus
aacactggtctgaggcatccttggt

SEQ ID NO: 27890 - DNA, 25 bp, Mus musculus
aacactggtctgtggcatccttggt

SEQ ID NO: 27891 - DNA, 25 bp, Mus musculus
aacactggtgtgagagagcaaggca

SEQ ID NO: 27892 - DNA, 25 bp, Mus musculus
aacactggtgtgtgagagcaaggca

SEQ ID NO: 27893 - DNA, 25 bp, Mus musculus
aacactggttccatcgttcattgtc

SEQ ID NO: 27894 - DNA, 25 bp, Mus musculus
aacactggttcccaagtttccatgg

SEQ ID NO: 27895 - DNA, 25 bp, Mus musculus
aacactggttccgaagtttccatgg

SEQ ID NO: 27896 - DNA, 25 bp, Mus musculus
aacactggttccttcgttcattgtc

SEQ ID NO: 27897 - DNA, 25 bp, Mus musculus
aacactgtaatcagtccgcagccaa

SEQ ID NO: 27898 - DNA, 25 bp, Mus musculus
aacactgtaatctgtccgcagccaa

SEQ ID NO: 27899 - DNA, 25 bp, Mus musculus
aacactgtaatgctcgtatttggga

SEQ ID NO: 27900 - DNA, 25 bp, Mus musculus
aacactgtaatggtcgtatttggga

SEQ ID NO: 27901 - DNA, 25 bp, Mus musculus
aacactgtacatctggagttgctcc

SEQ ID NO: 27902 - DNA, 25 bp, Mus musculus
aacactgtacatgtggagttgctcc

SEQ ID NO: 27903 - DNA, 25 bp, Mus musculus
aacactgtacctaatgcattatctt

SEQ ID NO: 27904 - DNA, 25 bp, Mus musculus
aacactgtaccttatgcattatctt

SEQ ID NO: 27905 - DNA, 25 bp, Mus musculus
aacactgtagtcatcatacctgcag

SEQ ID NO: 27906 - DNA, 25 bp, Mus musculus
aacactgtagtcttcatacctgcag

SEQ ID NO: 27907 - DNA, 25 bp, Mus musculus
aacactgtatttagggatctgctta

SEQ ID NO: 27908 - DNA, 25 bp, Mus musculus
aacactgtattttgggatctgctta

SEQ ID NO: 27909 - DNA, 25 bp, Mus musculus
aacactgtcaaactctgtgtacttt

SEQ ID NO: 27910 - DNA, 25 bp, Mus musculus
aacactgtcaaagtctgtgtacttt

SEQ ID NO: 27911 - DNA, 25 bp, Mus musculus
aacactgtgatactccaacagctaa

SEQ ID NO: 27912 - DNA, 25 bp, Mus musculus
aacactgtgatagtccaacagctaa

SEQ ID NO: 27913 - DNA, 25 bp, Mus musculus
aacactgtgattctacagagcagat

SEQ ID NO: 27914 - DNA, 25 bp, Mus musculus
aacactgtgattgtacagagcagat

SEQ ID NO: 27915 - DNA, 25 bp, Mus musculus
aacactgtggaaatttgactcaaaa

SEQ ID NO: 27916 - DNA, 25 bp, Mus musculus
aacactgtggaattttgactcaaaa

SEQ ID NO: 27917 - DNA, 25 bp, Mus musculus
aacactgtggcccttatgatgagct

SEQ ID NO: 27918 - DNA, 25 bp, Mus musculus
aacactgtggccgttatgatgagct

SEQ ID NO: 27919 - DNA, 25 bp, Mus musculus
aacactgtgggtctaagttctctgc

SEQ ID NO: 27920 - DNA, 25 bp, Mus musculus
aacactgtgggtgtaagttctctgc

SEQ ID NO: 27921 - DNA, 25 bp, Mus musculus
aacactgtggtgagaactctgaggc

SEQ ID NO: 27922 - DNA, 25 bp, Mus musculus
aacactgtggtgtgaactctgaggc

SEQ ID NO: 27923 - DNA, 25 bp, Mus musculus
aacactgtgtgtcaccacgtaactg

SEQ ID NO: 27924 - DNA, 25 bp, Mus musculus
aacactgtgtgtgaccacgtaactg

SEQ ID NO: 27925 - DNA, 25 bp, Mus musculus
aacactgtgtttcttcctcatgcaa

SEQ ID NO: 27926 - DNA, 25 bp, Mus musculus
aacactgtgtttgttcctcatgcaa

SEQ ID NO: 27927 - DNA, 25 bp, Mus musculus
aacactgttccaaagagagacaact

SEQ ID NO: 27928 - DNA, 25 bp, Mus musculus
aacactgttccatagagagacaact

SEQ ID NO: 27929 - DNA, 25 bp, Mus musculus
aacactgttctcaaagatgggacta

SEQ ID NO: 27930 - DNA, 25 bp, Mus musculus
aacactgttctctaagatgggacta

SEQ ID NO: 27931 - DNA, 25 bp, Mus musculus
aacactgttgacaaagaatcacaat

SEQ ID NO: 27932 - DNA, 25 bp, Mus musculus
aacactgttgactaagaatcacaat

SEQ ID NO: 27933 - DNA, 25 bp, Mus musculus
aacactgttgcactttgattcatac

SEQ ID NO: 27934 - DNA, 25 bp, Mus musculus
aacactgttgcagtttgattcatac

SEQ ID NO: 27935 - DNA, 25 bp, Mus musculus
aacactgttgccctgtggtgctatg

SEQ ID NO: 27936 - DNA, 25 bp, Mus musculus
aacactgttgccgtgtggtgctatg

SEQ ID NO: 27937 - DNA, 25 bp, Mus musculus
aacactgttgctacctaacgttcca

SEQ ID NO: 27938 - DNA, 25 bp, Mus musculus
aacactgttgcttcctaacgttcca

SEQ ID NO: 27939 - DNA, 25 bp, Mus musculus
aacactgttgtcattgctgtaacta

SEQ ID NO: 27940 - DNA, 25 bp, Mus musculus
aacactgttgtctttgctgtaacta

SEQ ID NO: 27941 - DNA, 25 bp, Mus musculus
aacacttaacacagattgtctaaga

SEQ ID NO: 27942 - DNA, 25 bp, Mus musculus
aacacttaacactgattgtctaaga

SEQ ID NO: 27943 - DNA, 25 bp, Mus musculus
aacacttaatgtactcctatggccc

SEQ ID NO: 27944 - DNA, 25 bp, Mus musculus
aacacttaatgttctcctatggccc

SEQ ID NO: 27945 - DNA, 25 bp, Mus musculus
aacacttactctatccattgtcaag

SEQ ID NO: 27946 - DNA, 25 bp, Mus musculus
aacacttactctttccattgtcaag

SEQ ID NO: 27947 - DNA, 25 bp, Mus musculus
aacacttagagcagccaggcatttg

SEQ ID NO: 27948 - DNA, 25 bp, Mus musculus
aacacttagagctgccaggcatttg

SEQ ID NO: 27949 - DNA, 25 bp, Mus musculus
aacacttagctgaaagcctctccta

SEQ ID NO: 27950 - DNA, 25 bp, Mus musculus
aacacttagctgtaagcctctccta

SEQ ID NO: 27951 - DNA, 25 bp, Mus musculus
aacacttaggacaggattatggacc

SEQ ID NO: 27952 - DNA, 25 bp, Mus musculus
aacacttaggactggattatggacc

SEQ ID NO: 27953 - DNA, 25 bp, Mus musculus
aacacttaggatactcatatttgag

SEQ ID NO: 27954 - DNA, 25 bp, Mus musculus
aacacttaggattctcatatttgag

SEQ ID NO: 27955 - DNA, 25 bp, Mus musculus
aacacttagtggacctgcatacgca

SEQ ID NO: 27956 - DNA, 25 bp, Mus musculus
aacacttagtggtcctgcatacgca

SEQ ID NO: 27957 - DNA, 25 bp, Mus musculus
aacacttataaaacctgcctattga

SEQ ID NO: 27958 - DNA, 25 bp, Mus musculus
aacacttataaatcctgcctattga

SEQ ID NO: 27959 - DNA, 25 bp, Mus musculus
aacacttcaaaaaactcttaggcat

SEQ ID NO: 27960 - DNA, 25 bp, Mus musculus
aacacttcaaaatactcttaggcat

SEQ ID NO: 27961 - DNA, 25 bp, Mus musculus
aacacttcacatcctcatgtcaaat

SEQ ID NO: 27962 - DNA, 25 bp, Mus musculus
aacacttcacatgctcatgtcaaat

SEQ ID NO: 27963 - DNA, 25 bp, Mus musculus
aacacttcataaatcctgttctgaa

SEQ ID NO: 27964 - DNA, 25 bp, Mus musculus
aacacttcataattcctgttctgaa

SEQ ID NO: 27965 - DNA, 25 bp, Mus musculus
aacacttcatgtatgcagagaatcc

SEQ ID NO: 27966 - DNA, 25 bp, Mus musculus
aacacttcatgtttgcagagaatcc

SEQ ID NO: 27967 - DNA, 25 bp, Mus musculus
aacacttccaacagctggtggcctg

SEQ ID NO: 27968 - DNA, 25 bp, Mus musculus
aacacttccaactgctggtggcctg

SEQ ID NO: 27969 - DNA, 25 bp, Mus musculus
aacacttccacaattatgcccagga

SEQ ID NO: 27970 - DNA, 25 bp, Mus musculus
aacacttccacatttatgcccagga

SEQ ID NO: 27971 - DNA, 25 bp, Mus musculus
aacacttccactctctggctggaat

SEQ ID NO: 27972 - DNA, 25 bp, Mus musculus
aacacttccactgtctggctggaat

SEQ ID NO: 27973 - DNA, 25 bp, Mus musculus
aacacttcctagcacctgttgtact

SEQ ID NO: 27974 - DNA, 25 bp, Mus musculus
aacacttcctaggacctgttgtact

SEQ ID NO: 27975 - DNA, 25 bp, Mus musculus
aacacttcctgcacattgctttagg

SEQ ID NO: 27976 - DNA, 25 bp, Mus musculus
aacacttcctgctcattgctttagg

SEQ ID NO: 27977 - DNA, 25 bp, Mus musculus
aacacttcggaaagtggcttatact

SEQ ID NO: 27978 - DNA, 25 bp, Mus musculus
aacacttcggaatgtggcttatact

SEQ ID NO: 27979 - DNA, 25 bp, Mus musculus
aacacttcgttcagatcttgagaga

SEQ ID NO: 27980 - DNA, 25 bp, Mus musculus
aacacttcgttctgatcttgagaga

SEQ ID NO: 27981 - DNA, 25 bp, Mus musculus
aacacttcgttgagttcttgctctc

SEQ ID NO: 27982 - DNA, 25 bp, Mus musculus
aacacttcgttgtgttcttgctctc

SEQ ID NO: 27983 - DNA, 25 bp, Mus musculus
aacacttctagacctttgtggtcca

SEQ ID NO: 27984 - DNA, 25 bp, Mus musculus
aacacttctagagctttgtggtcca

SEQ ID NO: 27985 - DNA, 25 bp, Mus musculus
aacacttctcctcctgacggatatg

SEQ ID NO: 27986 - DNA, 25 bp, Mus musculus
aacacttctcctgctgacggatatg

SEQ ID NO: 27987 - DNA, 25 bp, Mus musculus
aacacttctctaaataccagggcct

SEQ ID NO: 27988 - DNA, 25 bp, Mus musculus
aacacttctctatataccagggcct

SEQ ID NO: 27989 - DNA, 25 bp, Mus musculus
aacacttcttgaagagggattcctc

SEQ ID NO: 27990 - DNA, 25 bp, Mus musculus
aacacttcttgaatggctttgcaga

SEQ ID NO: 27991 - DNA, 25 bp, Mus musculus
aacacttcttgatgagggattcctc

SEQ ID NO: 27992 - DNA, 25 bp, Mus musculus
aacacttcttgattggctttgcaga

SEQ ID NO: 27993 - DNA, 25 bp, Mus musculus
aacacttgaaacagtgctgtgtctg

SEQ ID NO: 27994 - DNA, 25 bp, Mus musculus
aacacttgaaactgtgctgtgtctg

SEQ ID NO: 27995 - DNA, 25 bp, Mus musculus
aacacttgactaacaggctgactgg

SEQ ID NO: 27996 - DNA, 25 bp, Mus musculus
aacacttgactatcaggctgactgg

SEQ ID NO: 27997 - DNA, 25 bp, Mus musculus
aacacttgatttacttgaagaggac

SEQ ID NO: 27998 - DNA, 25 bp, Mus musculus
aacacttgattttcttgaagaggac

SEQ ID NO: 27999 - DNA, 25 bp, Mus musculus
aacacttgccttagcagactcagtt

SEQ ID NO: 28000 - DNA, 25 bp, Mus musculus
aacacttgcctttgcagactcagtt

SEQ ID NO: 28001 - DNA, 25 bp, Mus musculus
aacacttgctctcagtagcctagtc

SEQ ID NO: 28002 - DNA, 25 bp, Mus musculus
aacacttgctctgagtagcctagtc

SEQ ID NO: 28003 - DNA, 25 bp, Mus musculus
aacacttgcttaacaccaactgata

SEQ ID NO: 28004 - DNA, 25 bp, Mus musculus
aacacttgcttatcaccaactgata

SEQ ID NO: 28005 - DNA, 25 bp, Mus musculus
aacacttggattcgcctaactgacc

SEQ ID NO: 28006 - DNA, 25 bp, Mus musculus
aacacttggattggcctaactgacc

SEQ ID NO: 28007 - DNA, 25 bp, Mus musculus
aacacttggcatagaatcgaagcaa

SEQ ID NO: 28008 - DNA, 25 bp, Mus musculus
aacacttggcattgaatcgaagcaa

SEQ ID NO: 28009 - DNA, 25 bp, Mus musculus
aacacttggcgccagacattgacgt

SEQ ID NO: 28010 - DNA, 25 bp, Mus musculus
aacacttggcgcgagacattgacgt

SEQ ID NO: 28011 - DNA, 25 bp, Mus musculus
aacacttggcttcttaatacatcca

SEQ ID NO: 28012 - DNA, 25 bp, Mus musculus
aacacttggcttgttaatacatcca

SEQ ID NO: 28013 - DNA, 25 bp, Mus musculus
aacacttgggccatcgtggtggcgt

SEQ ID NO: 28014 - DNA, 25 bp, Mus musculus
aacacttgggccttcgtggtggcgt

SEQ ID NO: 28015 - DNA, 25 bp, Mus musculus
aacacttgggctcaagcagtaggcc

SEQ ID NO: 28016 - DNA, 25 bp, Mus musculus
aacacttgggctgaagcagtaggcc

SEQ ID NO: 28017 - DNA, 25 bp, Mus musculus
aacacttggtccaccagtcagtttt

SEQ ID NO: 28018 - DNA, 25 bp, Mus musculus
aacacttggtcctccagtcagtttt

SEQ ID NO: 28019 - DNA, 25 bp, Mus musculus
aacacttggtgtaggctcttggtca

SEQ ID NO: 28020 - DNA, 25 bp, Mus musculus
aacacttggtgttggctcttggtca

SEQ ID NO: 28021 - DNA, 25 bp, Mus musculus
aacacttgtcctagaccctcgggct

SEQ ID NO: 28022 - DNA, 25 bp, Mus musculus
aacacttgtccttgaccctcgggct

SEQ ID NO: 28023 - DNA, 25 bp, Mus musculus
aacacttgtgagcagttcgcttcct

SEQ ID NO: 28024 - DNA, 25 bp, Mus musculus
aacacttgtgaggagttcgcttcct

SEQ ID NO: 28025 - DNA, 25 bp, Mus musculus
aacacttgtgcaaatctgtcttgat

SEQ ID NO: 28026 - DNA, 25 bp, Mus musculus
aacacttgtgcatatctgtcttgat

SEQ ID NO: 28027 - DNA, 25 bp, Mus musculus
aacacttgtgtacaacattccttaa

SEQ ID NO: 28028 - DNA, 25 bp, Mus musculus
aacacttgtgtagaacattccttaa

SEQ ID NO: 28029 - DNA, 25 bp, Mus musculus
aacacttgttgcaggcagtatgcct

SEQ ID NO: 28030 - DNA, 25 bp, Mus musculus
aacacttgttgctggcagtatgcct

SEQ ID NO: 28031 - DNA, 25 bp, Mus musculus
aacactttatccaaagcttcagtaa

SEQ ID NO: 28032 - DNA, 25 bp, Mus musculus
aacactttatcctaagcttcagtaa

SEQ ID NO: 28033 - DNA, 25 bp, Mus musculus
aacactttatttcggctcatggcac

SEQ ID NO: 28034 - DNA, 25 bp, Mus musculus
aacactttatttgggctcatggcac

SEQ ID NO: 28035 - DNA, 25 bp, Mus musculus
aacactttcaatcgagtttcttagt

SEQ ID NO: 28036 - DNA, 25 bp, Mus musculus
aacactttcaatggagtttcttagt

SEQ ID NO: 28037 - DNA, 25 bp, Mus musculus
aacactttcagcaagcgttttctta

SEQ ID NO: 28038 - DNA, 25 bp, Mus musculus
aacactttcagcatggcttctggag

SEQ ID NO: 28039 - DNA, 25 bp, Mus musculus
aacactttcagctagcgttttctta

SEQ ID NO: 28040 - DNA, 25 bp, Mus musculus
aacactttcagcttggcttctggag

SEQ ID NO: 28041 - DNA, 25 bp, Mus musculus
aacactttcgcaacctgttcaggaa

SEQ ID NO: 28042 - DNA, 25 bp, Mus musculus
aacactttcgcatcctgttcaggaa

SEQ ID NO: 28043 - DNA, 25 bp, Mus musculus
aacactttctgccactggtcagctt

SEQ ID NO: 28044 - DNA, 25 bp, Mus musculus
aacactttctgcgactggtcagctt

SEQ ID NO: 28045 - DNA, 25 bp, Mus musculus
aacactttgaatattctgctaggcg

SEQ ID NO: 28046 - DNA, 25 bp, Mus musculus
aacactttgaattttctgctaggcg

SEQ ID NO: 28047 - DNA, 25 bp, Mus musculus
aacactttgggaagctgctaaggca

SEQ ID NO: 28048 - DNA, 25 bp, Mus musculus
aacactttgggatgctgctaaggca

SEQ ID NO: 28049 - DNA, 25 bp, Mus musculus
aacacttttgaaatggaataattag

SEQ ID NO: 28050 - DNA, 25 bp, Mus musculus
aacacttttgaattggaataattag

SEQ ID NO: 28051 - DNA, 25 bp, Mus musculus
aacactttttaaagatttgtcttga

SEQ ID NO: 28052 - DNA, 25 bp, Mus musculus
aacactttttaatgatttgtcttga

SEQ ID NO: 28053 - DNA, 25 bp, Mus musculus
aacagaaaacccagcagcacacagc

SEQ ID NO: 28054 - DNA, 25 bp, Mus musculus
aacagaaaaccctgcagcacacagc

SEQ ID NO: 28055 - DNA, 25 bp, Mus musculus
aacagaaaagagatggcagccccaa

SEQ ID NO: 28056 - DNA, 25 bp, Mus musculus
aacagaaaagagttggcagccccaa

SEQ ID NO: 28057 - DNA, 25 bp, Mus musculus
aacagaaaaggcaggcatatattat

SEQ ID NO: 28058 - DNA, 25 bp, Mus musculus
aacagaaaaggctggcatatattat

SEQ ID NO: 28059 - DNA, 25 bp, Mus musculus
aacagaaacgcacagggttcctctc

SEQ ID NO: 28060 - DNA, 25 bp, Mus musculus
aacagaaacgcagagggttcctctc

SEQ ID NO: 28061 - DNA, 25 bp, Mus musculus
aacagaaacgtcaaattaactgcaa

SEQ ID NO: 28062 - DNA, 25 bp, Mus musculus
aacagaaacgtctaattaactgcaa

SEQ ID NO: 28063 - DNA, 25 bp, Mus musculus
aacagaaactgcagttggtgctggc

SEQ ID NO: 28064 - DNA, 25 bp, Mus musculus
aacagaaactgctgttggtgctggc

SEQ ID NO: 28065 - DNA, 25 bp, Mus musculus
aacagaaaggcactttctcctgccc

SEQ ID NO: 28066 - DNA, 25 bp, Mus musculus
aacagaaaggcagtttctcctgccc

SEQ ID NO: 28067 - DNA, 25 bp, Mus musculus
aacagaaatcgaaacgcccatgact

SEQ ID NO: 28068 - DNA, 25 bp, Mus musculus
aacagaaatcgatacgcccatgact

SEQ ID NO: 28069 - DNA, 25 bp, Mus musculus
aacagaaatctgcactgctagttat

SEQ ID NO: 28070 - DNA, 25 bp, Mus musculus
aacagaaatctggactgctagttat

SEQ ID NO: 28071 - DNA, 25 bp, Mus musculus
aacagaaatttgacagcatcagtga

SEQ ID NO: 28072 - DNA, 25 bp, Mus musculus
aacagaaatttgtcagcatcagtga

SEQ ID NO: 28073 - DNA, 25 bp, Mus musculus
aacagaacaagccataggaaccaaa

SEQ ID NO: 28074 - DNA, 25 bp, Mus musculus
aacagaacaagcgataggaaccaaa

SEQ ID NO: 28075 - DNA, 25 bp, Mus musculus
aacagaacaccaatatattttccac

SEQ ID NO: 28076 - DNA, 25 bp, Mus musculus
aacagaacaccattatattttccac

SEQ ID NO: 28077 - DNA, 25 bp, Mus musculus
aacagaacagatctggccaccctgt

SEQ ID NO: 28078 - DNA, 25 bp, Mus musculus
aacagaacagatgtggccaccctgt

SEQ ID NO: 28079 - DNA, 25 bp, Mus musculus
aacagaacagctacaggttatggaa

SEQ ID NO: 28080 - DNA, 25 bp, Mus musculus
aacagaacagcttcaggttatggaa

SEQ ID NO: 28081 - DNA, 25 bp, Mus musculus
aacagaacagggaaagcggccgctt

SEQ ID NO: 28082 - DNA, 25 bp, Mus musculus
aacagaacagggtaagcggccgctt

SEQ ID NO: 28083 - DNA, 25 bp, Mus musculus
aacagaacagttaccacttgggcta

SEQ ID NO: 28084 - DNA, 25 bp, Mus musculus
aacagaacagtttccacttgggcta

SEQ ID NO: 28085 - DNA, 25 bp, Mus musculus
aacagaaccattcccaaggcttaga

SEQ ID NO: 28086 - DNA, 25 bp, Mus musculus
aacagaaccattgccaaggcttaga

SEQ ID NO: 28087 - DNA, 25 bp, Mus musculus
aacagaaccccacatctggatacgg

SEQ ID NO: 28088 - DNA, 25 bp, Mus musculus
aacagaaccccagatctggatacgg

SEQ ID NO: 28089 - DNA, 25 bp, Mus musculus
aacagaacccggaagcagcgagaag

SEQ ID NO: 28090 - DNA, 25 bp, Mus musculus
aacagaacccggtagcagcgagaag

SEQ ID NO: 28091 - DNA, 25 bp, Mus musculus
aacagaacgggtcgctagaccaaca

SEQ ID NO: 28092 - DNA, 25 bp, Mus musculus
aacagaacgggtggctagaccaaca

SEQ ID NO: 28093 - DNA, 25 bp, Mus musculus
aacagaactcacatcagaccatctc

SEQ ID NO: 28094 - DNA, 25 bp, Mus musculus
aacagaactcacttcagaccatctc

SEQ ID NO: 28095 - DNA, 25 bp, Mus musculus
aacagaactcttagcttcttgtcta

SEQ ID NO: 28096 - DNA, 25 bp, Mus musculus
aacagaactctttgcttcttgtcta

SEQ ID NO: 28097 - DNA, 25 bp, Mus musculus
aacagaactgcccagactgtttcca

SEQ ID NO: 28098 - DNA, 25 bp, Mus musculus
aacagaactgccgagactgtttcca

SEQ ID NO: 28099 - DNA, 25 bp, Mus musculus
aacagaactggacgaggtaagacca

SEQ ID NO: 28100 - DNA, 25 bp, Mus musculus
aacagaactggaggaggtaagacca

SEQ ID NO: 28101 - DNA, 25 bp, Mus musculus
aacagaactgtacacggttgttcag

SEQ ID NO: 28102 - DNA, 25 bp, Mus musculus
aacagaactgtagacggttgttcag

SEQ ID NO: 28103 - DNA, 25 bp, Mus musculus
aacagaactttgagtctcctctttg

SEQ ID NO: 28104 - DNA, 25 bp, Mus musculus
aacagaactttgtgtctcctctttg

SEQ ID NO: 28105 - DNA, 25 bp, Mus musculus
aacagaagacggcttccacggcaaa

SEQ ID NO: 28106 - DNA, 25 bp, Mus musculus
aacagaagacgggttccacggcaaa

SEQ ID NO: 28107 - DNA, 25 bp, Mus musculus
aacagaagagggatctaccggaact

SEQ ID NO: 28108 - DNA, 25 bp, Mus musculus
aacagaagagggttctaccggaact

SEQ ID NO: 28109 - DNA, 25 bp, Mus musculus
aacagaagcagcctaggcagccctt

SEQ ID NO: 28110 - DNA, 25 bp, Mus musculus
aacagaagcagcgtaggcagccctt

SEQ ID NO: 28111 - DNA, 25 bp, Mus musculus
aacagaagccagactttaggcatca

SEQ ID NO: 28112 - DNA, 25 bp, Mus musculus
aacagaagccagtctttaggcatca

SEQ ID NO: 28113 - DNA, 25 bp, Mus musculus
aacagaagcctcagtttatcccaca

SEQ ID NO: 28114 - DNA, 25 bp, Mus musculus
aacagaagcctctgtttatcccaca

SEQ ID NO: 28115 - DNA, 25 bp, Mus musculus
aacagaagctccctgagtgactctc

SEQ ID NO: 28116 - DNA, 25 bp, Mus musculus
aacagaagctccgtgagtgactctc

SEQ ID NO: 28117 - DNA, 25 bp, Mus musculus
aacagaagctctcaggaacccaggc

SEQ ID NO: 28118 - DNA, 25 bp, Mus musculus
aacagaagctctgaggaacccaggc

SEQ ID NO: 28119 - DNA, 25 bp, Mus musculus
aacagaagctggatgcttgcaaaac

SEQ ID NO: 28120 - DNA, 25 bp, Mus musculus
aacagaagctggctcgggagtttaa

SEQ ID NO: 28121 - DNA, 25 bp, Mus musculus
aacagaagctgggtcgggagtttaa

SEQ ID NO: 28122 - DNA, 25 bp, Mus musculus
aacagaagctggttgcttgcaaaac

SEQ ID NO: 28123 - DNA, 25 bp, Mus musculus
aacagaaggagcactcaaaggcgct

SEQ ID NO: 28124 - DNA, 25 bp, Mus musculus
aacagaaggagctctcaaaggcgct

SEQ ID NO: 28125 - DNA, 25 bp, Mus musculus
aacagaaggtggatctacagtcctt

SEQ ID NO: 28126 - DNA, 25 bp, Mus musculus
aacagaaggtggttctacagtcctt

SEQ ID NO: 28127 - DNA, 25 bp, Mus musculus
aacagaagtcctccgtgtggtcagc

SEQ ID NO: 28128 - DNA, 25 bp, Mus musculus
aacagaagtcctgcgtgtggtcagc

SEQ ID NO: 28129 - DNA, 25 bp, Mus musculus
aacagaagtggcactgccaatcaaa

SEQ ID NO: 28130 - DNA, 25 bp, Mus musculus
aacagaagtggctctgccaatcaaa

SEQ ID NO: 28131 - DNA, 25 bp, Mus musculus
aacagaagttctcaccagcctcaca

SEQ ID NO: 28132 - DNA, 25 bp, Mus musculus
aacagaagttctgaccagcctcaca

SEQ ID NO: 28133 - DNA, 25 bp, Mus musculus
aacagaagttggagcctcctttacg

SEQ ID NO: 28134 - DNA, 25 bp, Mus musculus
aacagaagttggtgcctcctttacg

SEQ ID NO: 28135 - DNA, 25 bp, Mus musculus
aacagaagttgtcgctcacccttta

SEQ ID NO: 28136 - DNA, 25 bp, Mus musculus
aacagaagttgtggctcacccttta

SEQ ID NO: 28137 - DNA, 25 bp, Mus musculus
aacagaataaccatgccctgagaag

SEQ ID NO: 28138 - DNA, 25 bp, Mus musculus
aacagaataaccttgccctgagaag

SEQ ID NO: 28139 - DNA, 25 bp, Mus musculus
aacagaatagcaacctgcacctgcc

SEQ ID NO: 28140 - DNA, 25 bp, Mus musculus
aacagaatagcatcctgcacctgcc

SEQ ID NO: 28141 - DNA, 25 bp, Mus musculus
aacagaatcaacaaccctggaccct

SEQ ID NO: 28142 - DNA, 25 bp, Mus musculus
aacagaatcaactaccctggaccct

SEQ ID NO: 28143 - DNA, 25 bp, Mus musculus
aacagaatcaatctccacctcagca

SEQ ID NO: 28144 - DNA, 25 bp, Mus musculus
aacagaatcaatgtccacctcagca

SEQ ID NO: 28145 - DNA, 25 bp, Mus musculus
aacagaatcacccagatactacctc

SEQ ID NO: 28146 - DNA, 25 bp, Mus musculus
aacagaatcaccgagatactacctc

SEQ ID NO: 28147 - DNA, 25 bp, Mus musculus
aacagaatccacatgagtagtacat

SEQ ID NO: 28148 - DNA, 25 bp, Mus musculus
aacagaatccacttgagtagtacat

SEQ ID NO: 28149 - DNA, 25 bp, Mus musculus
aacagaatcctacagtcactcctgc

SEQ ID NO: 28150 - DNA, 25 bp, Mus musculus
aacagaatcctagagtcactcctgc

SEQ ID NO: 28151 - DNA, 25 bp, Mus musculus
aacagaatcgccacttgggtccaga

SEQ ID NO: 28152 - DNA, 25 bp, Mus musculus
aacagaatcgcctcttgggtccaga

SEQ ID NO: 28153 - DNA, 25 bp, Mus musculus
aacagaatcggcaggacttggtgaa

SEQ ID NO: 28154 - DNA, 25 bp, Mus musculus
aacagaatcggctggacttggtgaa

SEQ ID NO: 28155 - DNA, 25 bp, Mus musculus
aacagaatctacacacaatgacaaa

SEQ ID NO: 28156 - DNA, 25 bp, Mus musculus
aacagaatctactcacaatgacaaa

SEQ ID NO: 28157 - DNA, 25 bp, Mus musculus
aacagaatctccagacaccatattt

SEQ ID NO: 28158 - DNA, 25 bp, Mus musculus
aacagaatctcctgacaccatattt

SEQ ID NO: 28159 - DNA, 25 bp, Mus musculus
aacagaatctgaaccgggtcatcga

SEQ ID NO: 28160 - DNA, 25 bp, Mus musculus
aacagaatctgatccgggtcatcga

SEQ ID NO: 28161 - DNA, 25 bp, Mus musculus
aacagaatcttcaaatccccaggga

SEQ ID NO: 28162 - DNA, 25 bp, Mus musculus
aacagaatcttctaatccccaggga

SEQ ID NO: 28163 - DNA, 25 bp, Mus musculus
aacagaatgcttctgctctttctca

SEQ ID NO: 28164 - DNA, 25 bp, Mus musculus
aacagaatgcttgtgctctttctca

SEQ ID NO: 28165 - DNA, 25 bp, Mus musculus
aacagaatgtagactttgcttttaa

SEQ ID NO: 28166 - DNA, 25 bp, Mus musculus
aacagaatgtagtctttgcttttaa

SEQ ID NO: 28167 - DNA, 25 bp, Mus musculus
aacagaatgtgaagctggatcttac

SEQ ID NO: 28168 - DNA, 25 bp, Mus musculus
aacagaatgtgatgctggatcttac

SEQ ID NO: 28169 - DNA, 25 bp, Mus musculus
aacagaattgttactctgccacttc

SEQ ID NO: 28170 - DNA, 25 bp, Mus musculus
aacagaattgtttctctgccacttc

SEQ ID NO: 28171 - DNA, 25 bp, Mus musculus
aacagaatttgtatgcccggcctgt

SEQ ID NO: 28172 - DNA, 25 bp, Mus musculus
aacagaatttgtttgcccggcctgt

SEQ ID NO: 28173 - DNA, 25 bp, Mus musculus
aacagacaaccaatggctgggccaa

SEQ ID NO: 28174 - DNA, 25 bp, Mus musculus
aacagacaaccattggctgggccaa

SEQ ID NO: 28175 - DNA, 25 bp, Mus musculus
aacagacaactcaaccattcaacac

SEQ ID NO: 28176 - DNA, 25 bp, Mus musculus
aacagacaactctaccattcaacac

SEQ ID NO: 28177 - DNA, 25 bp, Mus musculus
aacagacaagctccttctgggttgt

SEQ ID NO: 28178 - DNA, 25 bp, Mus musculus
aacagacaagctgcttctgggttgt

SEQ ID NO: 28179 - DNA, 25 bp, Mus musculus
aacagacaagggaccccaggaatca

SEQ ID NO: 28180 - DNA, 25 bp, Mus musculus
aacagacaagggtccccaggaatca

SEQ ID NO: 28181 - DNA, 25 bp, Mus musculus
aacagacacagactctcctgggaca

SEQ ID NO: 28182 - DNA, 25 bp, Mus musculus
aacagacacagagtctcctgggaca

SEQ ID NO: 28183 - DNA, 25 bp, Mus musculus
aacagacacagcatcttcatggaac

SEQ ID NO: 28184 - DNA, 25 bp, Mus musculus
aacagacacagcctctttgatcaga

SEQ ID NO: 28185 - DNA, 25 bp, Mus musculus
aacagacacagcgtctttgatcaga

SEQ ID NO: 28186 - DNA, 25 bp, Mus musculus
aacagacacagcttcttcatggaac

SEQ ID NO: 28187 - DNA, 25 bp, Mus musculus
aacagacacagtccgaggcctcgtg

SEQ ID NO: 28188 - DNA, 25 bp, Mus musculus
aacagacacagtgcgaggcctcgtg

SEQ ID NO: 28189 - DNA, 25 bp, Mus musculus
aacagacaccaaactcccaaggaag

SEQ ID NO: 28190 - DNA, 25 bp, Mus musculus
aacagacaccaatctcccaaggaag

SEQ ID NO: 28191 - DNA, 25 bp, Mus musculus
aacagacacctacctaaccttgaag

SEQ ID NO: 28192 - DNA, 25 bp, Mus musculus
aacagacacctagctaaccttgaag

SEQ ID NO: 28193 - DNA, 25 bp, Mus musculus
aacagacacgttagtaggcatttgc

SEQ ID NO: 28194 - DNA, 25 bp, Mus musculus
aacagacacgtttgtaggcatttgc

SEQ ID NO: 28195 - DNA, 25 bp, Mus musculus
aacagacactaacattatccaaatg

SEQ ID NO: 28196 - DNA, 25 bp, Mus musculus
aacagacactaagattatccaaatg

SEQ ID NO: 28197 - DNA, 25 bp, Mus musculus
aacagacactcacactggtcatgta

SEQ ID NO: 28198 - DNA, 25 bp, Mus musculus
aacagacactcagactggtcatgta

SEQ ID NO: 28199 - DNA, 25 bp, Mus musculus
aacagacactgcactgatgcaggct

SEQ ID NO: 28200 - DNA, 25 bp, Mus musculus
aacagacactgctctgatgcaggct

SEQ ID NO: 28201 - DNA, 25 bp, Mus musculus
aacagacagaccaccttagaaccag

SEQ ID NO: 28202 - DNA, 25 bp, Mus musculus
aacagacagacctccttagaaccag

SEQ ID NO: 28203 - DNA, 25 bp, Mus musculus
aacagacagactaagtttcctaggg

SEQ ID NO: 28204 - DNA, 25 bp, Mus musculus
aacagacagacttagtttcctaggg

SEQ ID NO: 28205 - DNA, 25 bp, Mus musculus
aacagacagagtaccagcggagaca

SEQ ID NO: 28206 - DNA, 25 bp, Mus musculus
aacagacagagttccagcggagaca

SEQ ID NO: 28207 - DNA, 25 bp, Mus musculus
aacagacagcttcacccttccttga

SEQ ID NO: 28208 - DNA, 25 bp, Mus musculus
aacagacagcttgacccttccttga

SEQ ID NO: 28209 - DNA, 25 bp, Mus musculus
aacagacaggcactcctaggagaca

SEQ ID NO: 28210 - DNA, 25 bp, Mus musculus
aacagacaggcagtcctaggagaca

SEQ ID NO: 28211 - DNA, 25 bp, Mus musculus
aacagacagggtcaggccttgacta

SEQ ID NO: 28212 - DNA, 25 bp, Mus musculus
aacagacagggtgaggccttgacta

SEQ ID NO: 28213 - DNA, 25 bp, Mus musculus
aacagacatagcattgctcctgctt

SEQ ID NO: 28214 - DNA, 25 bp, Mus musculus
aacagacatagctttgctcctgctt

SEQ ID NO: 28215 - DNA, 25 bp, Mus musculus
aacagacatgagagcatcccattcc

SEQ ID NO: 28216 - DNA, 25 bp, Mus musculus
aacagacatgagtgcatcccattcc

SEQ ID NO: 28217 - DNA, 25 bp, Mus musculus
aacagacattatattcctcaacaaa

SEQ ID NO: 28218 - DNA, 25 bp, Mus musculus
aacagacattattttcctcaacaaa

SEQ ID NO: 28219 - DNA, 25 bp, Mus musculus
aacagacatttaaggcgcacgcctc

SEQ ID NO: 28220 - DNA, 25 bp, Mus musculus
aacagacatttatggcgcacgcctc

SEQ ID NO: 28221 - DNA, 25 bp, Mus musculus
aacagacatttcagaaccctctctc

SEQ ID NO: 28222 - DNA, 25 bp, Mus musculus
aacagacatttctgaaccctctctc

SEQ ID NO: 28223 - DNA, 25 bp, Mus musculus
aacagacattttcctacctggtcag

SEQ ID NO: 28224 - DNA, 25 bp, Mus musculus
aacagacattttgctacctggtcag

SEQ ID NO: 28225 - DNA, 25 bp, Mus musculus
aacagaccagaacgtgagctctcac

SEQ ID NO: 28226 - DNA, 25 bp, Mus musculus
aacagaccagaaggtgagctctcac

SEQ ID NO: 28227 - DNA, 25 bp, Mus musculus
aacagaccagacagaggcccattcc

SEQ ID NO: 28228 - DNA, 25 bp, Mus musculus
aacagaccagactgaggcccattcc

SEQ ID NO: 28229 - DNA, 25 bp, Mus musculus
aacagaccagatacggctgtgggag

SEQ ID NO: 28230 - DNA, 25 bp, Mus musculus
aacagaccagattcggctgtgggag

SEQ ID NO: 28231 - DNA, 25 bp, Mus musculus
aacagaccagggaatcggtggattt

SEQ ID NO: 28232 - DNA, 25 bp, Mus musculus
aacagaccagggtatcggtggattt

SEQ ID NO: 28233 - DNA, 25 bp, Mus musculus
aacagaccagttcactttccaaaat

SEQ ID NO: 28234 - DNA, 25 bp, Mus musculus
aacagaccagttgactttccaaaat

SEQ ID NO: 28235 - DNA, 25 bp, Mus musculus
aacagaccatttcttttaaaggcat

SEQ ID NO: 28236 - DNA, 25 bp, Mus musculus
aacagaccatttgttttaaaggcat

SEQ ID NO: 28237 - DNA, 25 bp, Mus musculus
aacagacccaagatcgagcagatcg

SEQ ID NO: 28238 - DNA, 25 bp, Mus musculus
aacagacccaagttcgagcagatcg

SEQ ID NO: 28239 - DNA, 25 bp, Mus musculus
aacagacccagtccagggacgccag

SEQ ID NO: 28240 - DNA, 25 bp, Mus musculus
aacagacccagtgcagggacgccag

SEQ ID NO: 28241 - DNA, 25 bp, Mus musculus
aacagaccccacaacattcaataaa

SEQ ID NO: 28242 - DNA, 25 bp, Mus musculus
aacagaccccactacattcaataaa

SEQ ID NO: 28243 - DNA, 25 bp, Mus musculus
aacagacctggaaccctgagtccta

SEQ ID NO: 28244 - DNA, 25 bp, Mus musculus
aacagacctggatccctgagtccta

SEQ ID NO: 28245 - DNA, 25 bp, Mus musculus
aacagaccttgccaagttgaccttt

SEQ ID NO: 28246 - DNA, 25 bp, Mus musculus
aacagaccttgcgaagttgaccttt

SEQ ID NO: 28247 - DNA, 25 bp, Mus musculus
aacagacgccacatgaaattttact

SEQ ID NO: 28248 - DNA, 25 bp, Mus musculus
aacagacgccacttgaaattttact

SEQ ID NO: 28249 - DNA, 25 bp, Mus musculus
aacagactaagaatcggcgtgggta

SEQ ID NO: 28250 - DNA, 25 bp, Mus musculus
aacagactaagattcggcgtgggta

SEQ ID NO: 28251 - DNA, 25 bp, Mus musculus
aacagactactcagtaccattccac

SEQ ID NO: 28252 - DNA, 25 bp, Mus musculus
aacagactactctgtaccattccac

SEQ ID NO: 28253 - DNA, 25 bp, Mus musculus
aacagactagatccgggtgttgtgc

SEQ ID NO: 28254 - DNA, 25 bp, Mus musculus
aacagactagatgcgggtgttgtgc

SEQ ID NO: 28255 - DNA, 25 bp, Mus musculus
aacagactatgtactgagctccata

SEQ ID NO: 28256 - DNA, 25 bp, Mus musculus
aacagactatgttctgagctccata

SEQ ID NO: 28257 - DNA, 25 bp, Mus musculus
aacagactcacaagggttttccctc

SEQ ID NO: 28258 - DNA, 25 bp, Mus musculus
aacagactcacatgggttttccctc

SEQ ID NO: 28259 - DNA, 25 bp, Mus musculus
aacagactcaggcgatgtgctttat

SEQ ID NO: 28260 - DNA, 25 bp, Mus musculus
aacagactcaggggatgtgctttat

SEQ ID NO: 28261 - DNA, 25 bp, Mus musculus
aacagactctagatatcaagccaag

SEQ ID NO: 28262 - DNA, 25 bp, Mus musculus
aacagactctagttatcaagccaag

SEQ ID NO: 28263 - DNA, 25 bp, Mus musculus
aacagactgattcatgccatgcatt

SEQ ID NO: 28264 - DNA, 25 bp, Mus musculus
aacagactgattgatgccatgcatt

SEQ ID NO: 28265 - DNA, 25 bp, Mus musculus
aacagactgcggatttgttcttccg

SEQ ID NO: 28266 - DNA, 25 bp, Mus musculus
aacagactgcggttttgttcttccg

SEQ ID NO: 28267 - DNA, 25 bp, Mus musculus
aacagactgggtccagcttcgtctg

SEQ ID NO: 28268 - DNA, 25 bp, Mus musculus
aacagactgggtgcagcttcgtctg

SEQ ID NO: 28269 - DNA, 25 bp, Mus musculus
aacagactggtgaggtcatcttcag

SEQ ID NO: 28270 - DNA, 25 bp, Mus musculus
aacagactggtgtggtcatcttcag

SEQ ID NO: 28271 - DNA, 25 bp, Mus musculus
aacagactgtgaccaaggtcctgtt

SEQ ID NO: 28272 - DNA, 25 bp, Mus musculus
aacagactgtgagcaaggtcctgtt

SEQ ID NO: 28273 - DNA, 25 bp, Mus musculus
aacagacttccaagggaatgatagc

SEQ ID NO: 28274 - DNA, 25 bp, Mus musculus
aacagacttccatgggaatgatagc

SEQ ID NO: 28275 - DNA, 25 bp, Mus musculus
aacagacttcctcctgctggtgttg

SEQ ID NO: 28276 - DNA, 25 bp, Mus musculus
aacagacttcctgctgctggtgttg

SEQ ID NO: 28277 - DNA, 25 bp, Mus musculus
aacagacttctgaaagttgcatgct

SEQ ID NO: 28278 - DNA, 25 bp, Mus musculus
aacagacttctgtaagttgcatgct

SEQ ID NO: 28279 - DNA, 25 bp, Mus musculus
aacagacttgttagggagtggcctc

SEQ ID NO: 28280 - DNA, 25 bp, Mus musculus
aacagacttgtttgggagtggcctc

SEQ ID NO: 28281 - DNA, 25 bp, Mus musculus
aacagacttttcaaatgacggcaat

SEQ ID NO: 28282 - DNA, 25 bp, Mus musculus
aacagacttttctaatgacggcaat

SEQ ID NO: 28283 - DNA, 25 bp, Mus musculus
aacagagaagaactgggctagccaa

SEQ ID NO: 28284 - DNA, 25 bp, Mus musculus
aacagagaagaagtgggctagccaa

SEQ ID NO: 28285 - DNA, 25 bp, Mus musculus
aacagagacagaatttaaagaccag

SEQ ID NO: 28286 - DNA, 25 bp, Mus musculus
aacagagacagattttaaagaccag

SEQ ID NO: 28287 - DNA, 25 bp, Mus musculus
aacagagacctgatcgtgtcgttct

SEQ ID NO: 28288 - DNA, 25 bp, Mus musculus
aacagagacctgttcgtgtcgttct

SEQ ID NO: 28289 - DNA, 25 bp, Mus musculus
aacagagagagacatcccggctctt

SEQ ID NO: 28290 - DNA, 25 bp, Mus musculus
aacagagagagagatcccggctctt

SEQ ID NO: 28291 - DNA, 25 bp, Mus musculus
aacagagagcagacatgtacccagt

SEQ ID NO: 28292 - DNA, 25 bp, Mus musculus
aacagagagcagtcatgtacccagt

SEQ ID NO: 28293 - DNA, 25 bp, Mus musculus
aacagagagcatatgccggcactgc

SEQ ID NO: 28294 - DNA, 25 bp, Mus musculus
aacagagagcatttgccggcactgc

SEQ ID NO: 28295 - DNA, 25 bp, Mus musculus
aacagagagccactcagcttttaga

SEQ ID NO: 28296 - DNA, 25 bp, Mus musculus
aacagagagccagtcagcttttaga

SEQ ID NO: 28297 - DNA, 25 bp, Mus musculus
aacagagaggagctggtgccttctt

SEQ ID NO: 28298 - DNA, 25 bp, Mus musculus
aacagagaggaggtggtgccttctt

SEQ ID NO: 28299 - DNA, 25 bp, Mus musculus
aacagagaggcaatcgtgccacaga

SEQ ID NO: 28300 - DNA, 25 bp, Mus musculus
aacagagaggcattcgtgccacaga

SEQ ID NO: 28301 - DNA, 25 bp, Mus musculus
aacagagagggaaccctgcagcagg

SEQ ID NO: 28302 - DNA, 25 bp, Mus musculus
aacagagagggatccctgcagcagg

SEQ ID NO: 28303 - DNA, 25 bp, Mus musculus
aacagagagggcatggcagttaaga

SEQ ID NO: 28304 - DNA, 25 bp, Mus musculus
aacagagagggcttggcagttaaga

SEQ ID NO: 28305 - DNA, 25 bp, Mus musculus
aacagagatactctaattttactca

SEQ ID NO: 28306 - DNA, 25 bp, Mus musculus
aacagagatactgtaattttactca

SEQ ID NO: 28307 - DNA, 25 bp, Mus musculus
aacagagatcctagccgggtgtggt

SEQ ID NO: 28308 - DNA, 25 bp, Mus musculus
aacagagatccttgccgggtgtggt

SEQ ID NO: 28309 - DNA, 25 bp, Mus musculus
aacagagatgttcccggtgataaaa

SEQ ID NO: 28310 - DNA, 25 bp, Mus musculus
aacagagatgttgccggtgataaaa

SEQ ID NO: 28311 - DNA, 25 bp, Mus musculus
aacagagattatcacctttcctatc

SEQ ID NO: 28312 - DNA, 25 bp, Mus musculus
aacagagattatgacctttcctatc

SEQ ID NO: 28313 - DNA, 25 bp, Mus musculus
aacagagcactcatagggtcggtgg

SEQ ID NO: 28314 - DNA, 25 bp, Mus musculus
aacagagcactcttagggtcggtgg

SEQ ID NO: 28315 - DNA, 25 bp, Mus musculus
aacagagcagacaccttggatccag

SEQ ID NO: 28316 - DNA, 25 bp, Mus musculus
aacagagcagactccttggatccag

SEQ ID NO: 28317 - DNA, 25 bp, Mus musculus
aacagagcagcgatgagttgtcaga

SEQ ID NO: 28318 - DNA, 25 bp, Mus musculus
aacagagcagcgttgagttgtcaga

SEQ ID NO: 28319 - DNA, 25 bp, Mus musculus
aacagagcccagagttgctgagtac

SEQ ID NO: 28320 - DNA, 25 bp, Mus musculus
aacagagcccagtgttgctgagtac

SEQ ID NO: 28321 - DNA, 25 bp, Mus musculus
aacagagcccgcatgaggcaactac

SEQ ID NO: 28322 - DNA, 25 bp, Mus musculus
aacagagcccgcttgaggcaactac

SEQ ID NO: 28323 - DNA, 25 bp, Mus musculus
aacagagccctccaggcggacatgc

SEQ ID NO: 28324 - DNA, 25 bp, Mus musculus
aacagagccctcgaggcggacatgc

SEQ ID NO: 28325 - DNA, 25 bp, Mus musculus
aacagagcctacagatttttagtta

SEQ ID NO: 28326 - DNA, 25 bp, Mus musculus
aacagagcctactgatttttagtta

SEQ ID NO: 28327 - DNA, 25 bp, Mus musculus
aacagagcctcaagtcaggttattt

SEQ ID NO: 28328 - DNA, 25 bp, Mus musculus
aacagagcctcacatacccagagat

SEQ ID NO: 28329 - DNA, 25 bp, Mus musculus
aacagagcctcagatacccagagat

SEQ ID NO: 28330 - DNA, 25 bp, Mus musculus
aacagagcctcatgtcaggttattt

SEQ ID NO: 28331 - DNA, 25 bp, Mus musculus
aacagagcctctataggagcagcaa

SEQ ID NO: 28332 - DNA, 25 bp, Mus musculus
aacagagcctctttaggagcagcaa

SEQ ID NO: 28333 - DNA, 25 bp, Mus musculus
aacagagcctttaagaccagccttc

SEQ ID NO: 28334 - DNA, 25 bp, Mus musculus
aacagagcctttctcagtggttgct

SEQ ID NO: 28335 - DNA, 25 bp, Mus musculus
aacagagcctttgtcagtggttgct

SEQ ID NO: 28336 - DNA, 25 bp, Mus musculus
aacagagccttttagaccagccttc

SEQ ID NO: 28337 - DNA, 25 bp, Mus musculus
aacagagcgattcgctcggcttcga

SEQ ID NO: 28338 - DNA, 25 bp, Mus musculus
aacagagcgattggctcggcttcga

SEQ ID NO: 28339 - DNA, 25 bp, Mus musculus
aacagagcgctgagaagccgccaga

SEQ ID NO: 28340 - DNA, 25 bp, Mus musculus
aacagagcgctgtgaagccgccaga

SEQ ID NO: 28341 - DNA, 25 bp, Mus musculus
aacagagcggtcagcagtgccgaga

SEQ ID NO: 28342 - DNA, 25 bp, Mus musculus
aacagagcggtctgcagtgccgaga

SEQ ID NO: 28343 - DNA, 25 bp, Mus musculus
aacagagctgttagagacttcaaga

SEQ ID NO: 28344 - DNA, 25 bp, Mus musculus
aacagagctgtttgagacttcaaga

SEQ ID NO: 28345 - DNA, 25 bp, Mus musculus
aacagagcttctatgacagggtccc

SEQ ID NO: 28346 - DNA, 25 bp, Mus musculus
aacagagcttctttgacagggtccc

SEQ ID NO: 28347 - DNA, 25 bp, Mus musculus
aacagagcttggaatcgccgtattt

SEQ ID NO: 28348 - DNA, 25 bp, Mus musculus
aacagagcttggtatcgccgtattt

SEQ ID NO: 28349 - DNA, 25 bp, Mus musculus
aacagaggaagcaattcagccaggg

SEQ ID NO: 28350 - DNA, 25 bp, Mus musculus
aacagaggaagctattcagccaggg

SEQ ID NO: 28351 - DNA, 25 bp, Mus musculus
aacagaggaattaattatgcacaga

SEQ ID NO: 28352 - DNA, 25 bp, Mus musculus
aacagaggaatttattatgcacaga

SEQ ID NO: 28353 - DNA, 25 bp, Mus musculus
aacagaggacagaagcttggctttg

SEQ ID NO: 28354 - DNA, 25 bp, Mus musculus
aacagaggacagtagcttggctttg

SEQ ID NO: 28355 - DNA, 25 bp, Mus musculus
aacagaggcactcggacatctcgtc

SEQ ID NO: 28356 - DNA, 25 bp, Mus musculus
aacagaggcactgggacatctcgtc

SEQ ID NO: 28357 - DNA, 25 bp, Mus musculus
aacagaggcagacatatcgttgtgt

SEQ ID NO: 28358 - DNA, 25 bp, Mus musculus
aacagaggcagagatatcgttgtgt

SEQ ID NO: 28359 - DNA, 25 bp, Mus musculus
aacagaggccagaagcggagtttta

SEQ ID NO: 28360 - DNA, 25 bp, Mus musculus
aacagaggccagtagcggagtttta

SEQ ID NO: 28361 - DNA, 25 bp, Mus musculus
aacagaggccatcgcgtacgtcttc

SEQ ID NO: 28362 - DNA, 25 bp, Mus musculus
aacagaggccatggcgtacgtcttc

SEQ ID NO: 28363 - DNA, 25 bp, Mus musculus
aacagaggctgcaatcaccatcctt

SEQ ID NO: 28364 - DNA, 25 bp, Mus musculus
aacagaggctgctatcaccatcctt

SEQ ID NO: 28365 - DNA, 25 bp, Mus musculus
aacagagggccacctgtctgaggaa

SEQ ID NO: 28366 - DNA, 25 bp, Mus musculus
aacagagggccagctgtctgaggaa

SEQ ID NO: 28367 - DNA, 25 bp, Mus musculus
aacagaggtgttagctgtcttcaga

SEQ ID NO: 28368 - DNA, 25 bp, Mus musculus
aacagaggtgtttgctgtcttcaga

SEQ ID NO: 28369 - DNA, 25 bp, Mus musculus
aacagaggtttcacacggaatccgt

SEQ ID NO: 28370 - DNA, 25 bp, Mus musculus
aacagaggtttctcacggaatccgt

SEQ ID NO: 28371 - DNA, 25 bp, Mus musculus
aacagagtagagaccaggcacagct

SEQ ID NO: 28372 - DNA, 25 bp, Mus musculus
aacagagtagagtccaggcacagct

SEQ ID NO: 28373 - DNA, 25 bp, Mus musculus
aacagagtagtaaggctaccaatat

SEQ ID NO: 28374 - DNA, 25 bp, Mus musculus
aacagagtagtatggctaccaatat

SEQ ID NO: 28375 - DNA, 25 bp, Mus musculus
aacagagtcagcaccttggctgtgc

SEQ ID NO: 28376 - DNA, 25 bp, Mus musculus
aacagagtcagctccttggctgtgc

SEQ ID NO: 28377 - DNA, 25 bp, Mus musculus
aacagagtccagaccaatggtccct

SEQ ID NO: 28378 - DNA, 25 bp, Mus musculus
aacagagtccagtccaatggtccct

SEQ ID NO: 28379 - DNA, 25 bp, Mus musculus
aacagagtctgtatgaaggaaggag

SEQ ID NO: 28380 - DNA, 25 bp, Mus musculus
aacagagtctgtcactaatgtcaca

SEQ ID NO: 28381 - DNA, 25 bp, Mus musculus
aacagagtctgtcattcaccgggct

SEQ ID NO: 28382 - DNA, 25 bp, Mus musculus
aacagagtctgtgactaatgtcaca

SEQ ID NO: 28383 - DNA, 25 bp, Mus musculus
aacagagtctgtgattcaccgggct

SEQ ID NO: 28384 - DNA, 25 bp, Mus musculus
aacagagtctgtttgaaggaaggag

SEQ ID NO: 28385 - DNA, 25 bp, Mus musculus
aacagagtcttacactgagtccaag

SEQ ID NO: 28386 - DNA, 25 bp, Mus musculus
aacagagtcttagactgagtccaag

SEQ ID NO: 28387 - DNA, 25 bp, Mus musculus
aacagagtggacctggaagcctact

SEQ ID NO: 28388 - DNA, 25 bp, Mus musculus
aacagagtggacgtggaagcctact

SEQ ID NO: 28389 - DNA, 25 bp, Mus musculus
aacagagtggttagatctgcctcgg

SEQ ID NO: 28390 - DNA, 25 bp, Mus musculus
aacagagtggtttgatctgcctcgg

SEQ ID NO: 28391 - DNA, 25 bp, Mus musculus
aacagagttcctacattgtcttaaa

SEQ ID NO: 28392 - DNA, 25 bp, Mus musculus
aacagagttccttcattgtcttaaa

SEQ ID NO: 28393 - DNA, 25 bp, Mus musculus
aacagagttcgacccgcagtggttc

SEQ ID NO: 28394 - DNA, 25 bp, Mus musculus
aacagagttcgagccgcagtggttc

SEQ ID NO: 28395 - DNA, 25 bp, Mus musculus
aacagagttctacagagtcgtggat

SEQ ID NO: 28396 - DNA, 25 bp, Mus musculus
aacagagttctagagagtcgtggat

SEQ ID NO: 28397 - DNA, 25 bp, Mus musculus
aacagagttgagcaacctcctcatc

SEQ ID NO: 28398 - DNA, 25 bp, Mus musculus
aacagagttgaggaacctcctcatc

SEQ ID NO: 28399 - DNA, 25 bp, Mus musculus
aacagagttgcacgccagacatggt

SEQ ID NO: 28400 - DNA, 25 bp, Mus musculus
aacagagttgcaggccagacatggt

SEQ ID NO: 28401 - DNA, 25 bp, Mus musculus
aacagagtttgtcgcctggcagaat

SEQ ID NO: 28402 - DNA, 25 bp, Mus musculus
aacagagtttgtggcctggcagaat

SEQ ID NO: 28403 - DNA, 25 bp, Mus musculus
aacagatacatccttatggcttttc

SEQ ID NO: 28404 - DNA, 25 bp, Mus musculus
aacagatacatcgttatggcttttc

SEQ ID NO: 28405 - DNA, 25 bp, Mus musculus
aacagatacccaagtgtggctgaca

SEQ ID NO: 28406 - DNA, 25 bp, Mus musculus
aacagatacccatgtgtggctgaca

SEQ ID NO: 28407 - DNA, 25 bp, Mus musculus
aacagatacgctatccaagtgcttt

SEQ ID NO: 28408 - DNA, 25 bp, Mus musculus
aacagatacgctttccaagtgcttt

SEQ ID NO: 28409 - DNA, 25 bp, Mus musculus
aacagatagcacaccaagctgtggt

SEQ ID NO: 28410 - DNA, 25 bp, Mus musculus
aacagatagcactccaagctgtggt

SEQ ID NO: 28411 - DNA, 25 bp, Mus musculus
aacagatagcgcctccacgctgctg

SEQ ID NO: 28412 - DNA, 25 bp, Mus musculus
aacagatagcgcgtccacgctgctg

SEQ ID NO: 28413 - DNA, 25 bp, Mus musculus
aacagatattctagctcccgctaaa

SEQ ID NO: 28414 - DNA, 25 bp, Mus musculus
aacagatattcttgctcccgctaaa

SEQ ID NO: 28415 - DNA, 25 bp, Mus musculus
aacagatcacaactgctcctggtgg

SEQ ID NO: 28416 - DNA, 25 bp, Mus musculus
aacagatcacaagtgctcctggtgg

SEQ ID NO: 28417 - DNA, 25 bp, Mus musculus
aacagatcacataactctgctctcc

SEQ ID NO: 28418 - DNA, 25 bp, Mus musculus
aacagatcacattactctgctctcc

SEQ ID NO: 28419 - DNA, 25 bp, Mus musculus
aacagatcagacacccactttagta

SEQ ID NO: 28420 - DNA, 25 bp, Mus musculus
aacagatcagactcccactttagta

SEQ ID NO: 28421 - DNA, 25 bp, Mus musculus
aacagatcaggaaccttgcacttta

SEQ ID NO: 28422 - DNA, 25 bp, Mus musculus
aacagatcaggatccttgcacttta

SEQ ID NO: 28423 - DNA, 25 bp, Mus musculus
aacagatcataaacagttctttcct

SEQ ID NO: 28424 - DNA, 25 bp, Mus musculus
aacagatcataatcagttctttcct

SEQ ID NO: 28425 - DNA, 25 bp, Mus musculus
aacagatccactaccgggtcgagtc

SEQ ID NO: 28426 - DNA, 25 bp, Mus musculus
aacagatccacttccgggtcgagtc

SEQ ID NO: 28427 - DNA, 25 bp, Mus musculus
aacagatcccggcagtaccagctga

SEQ ID NO: 28428 - DNA, 25 bp, Mus musculus
aacagatcccgggagtaccagctga

SEQ ID NO: 28429 - DNA, 25 bp, Mus musculus
aacagatccctacaaccagagattc

SEQ ID NO: 28430 - DNA, 25 bp, Mus musculus
aacagatccctagaaccagagattc

SEQ ID NO: 28431 - DNA, 25 bp, Mus musculus
aacagatcctctagcttgactttaa

SEQ ID NO: 28432 - DNA, 25 bp, Mus musculus
aacagatcctcttgcttgactttaa

SEQ ID NO: 28433 - DNA, 25 bp, Mus musculus
aacagatcgaggaggtttacctaca

SEQ ID NO: 28434 - DNA, 25 bp, Mus musculus
aacagatcgaggtggtttacctaca

SEQ ID NO: 28435 - DNA, 25 bp, Mus musculus
aacagatcgtccattgccagagaat

SEQ ID NO: 28436 - DNA, 25 bp, Mus musculus
aacagatcgtcctttgccagagaat

SEQ ID NO: 28437 - DNA, 25 bp, Mus musculus
aacagatctacaactcaaatccctc

SEQ ID NO: 28438 - DNA, 25 bp, Mus musculus
aacagatctacatctcaaatccctc

SEQ ID NO: 28439 - DNA, 25 bp, Mus musculus
aacagatctatcatatatgcttata

SEQ ID NO: 28440 - DNA, 25 bp, Mus musculus
aacagatctatcttatatgcttata

SEQ ID NO: 28441 - DNA, 25 bp, Mus musculus
aacagatctgcaatcactgcttgcc

SEQ ID NO: 28442 - DNA, 25 bp, Mus musculus
aacagatctgcattcactgcttgcc

SEQ ID NO: 28443 - DNA, 25 bp, Mus musculus
aacagatctgcgcttccagagtgca

SEQ ID NO: 28444 - DNA, 25 bp, Mus musculus
aacagatctgcggttccagagtgca

SEQ ID NO: 28445 - DNA, 25 bp, Mus musculus
aacagatcttaacatctcctttgag

SEQ ID NO: 28446 - DNA, 25 bp, Mus musculus
aacagatcttaagatctcctttgag

SEQ ID NO: 28447 - DNA, 25 bp, Mus musculus
aacagatcttagacagtgcttggaa

SEQ ID NO: 28448 - DNA, 25 bp, Mus musculus
aacagatcttagtcagtgcttggaa

SEQ ID NO: 28449 - DNA, 25 bp, Mus musculus
aacagatctttgagtgtcacataaa

SEQ ID NO: 28450 - DNA, 25 bp, Mus musculus
aacagatctttgtgtgtcacataaa

SEQ ID NO: 28451 - DNA, 25 bp, Mus musculus
aacagatgacacaccatggatttgg

SEQ ID NO: 28452 - DNA, 25 bp, Mus musculus
aacagatgacactccatggatttgg

SEQ ID NO: 28453 - DNA, 25 bp, Mus musculus
aacagatgagacagactacagagct

SEQ ID NO: 28454 - DNA, 25 bp, Mus musculus
aacagatgagactgactacagagct

SEQ ID NO: 28455 - DNA, 25 bp, Mus musculus
aacagatgcaacactggatccatgt

SEQ ID NO: 28456 - DNA, 25 bp, Mus musculus
aacagatgcaactctggatccatgt

SEQ ID NO: 28457 - DNA, 25 bp, Mus musculus
aacagatgcaatacctggactccat

SEQ ID NO: 28458 - DNA, 25 bp, Mus musculus
aacagatgcaattcctggactccat

SEQ ID NO: 28459 - DNA, 25 bp, Mus musculus
aacagatgcagcattgcggacactc

SEQ ID NO: 28460 - DNA, 25 bp, Mus musculus
aacagatgcagctttgcggacactc

SEQ ID NO: 28461 - DNA, 25 bp, Mus musculus
aacagatgcctgagtggtttgaatg

SEQ ID NO: 28462 - DNA, 25 bp, Mus musculus
aacagatgcctgtgtggtttgaatg

SEQ ID NO: 28463 - DNA, 25 bp, Mus musculus
aacagatgcgcgagagcctggccca

SEQ ID NO: 28464 - DNA, 25 bp, Mus musculus
aacagatgcgcgtgagcctggccca

SEQ ID NO: 28465 - DNA, 25 bp, Mus musculus
aacagatgctggctttactctgcgc

SEQ ID NO: 28466 - DNA, 25 bp, Mus musculus
aacagatgctgggtttactctgcgc

SEQ ID NO: 28467 - DNA, 25 bp, Mus musculus
aacagatgcttgactcggtgagcct

SEQ ID NO: 28468 - DNA, 25 bp, Mus musculus
aacagatgcttgtctcggtgagcct

SEQ ID NO: 28469 - DNA, 25 bp, Mus musculus
aacagatggacacctgaacaacaaa

SEQ ID NO: 28470 - DNA, 25 bp, Mus musculus
aacagatggacagctgaacaacaaa

SEQ ID NO: 28471 - DNA, 25 bp, Mus musculus
aacagatggataagaccaaggtggc

SEQ ID NO: 28472 - DNA, 25 bp, Mus musculus
aacagatggatatgaccaaggtggc

SEQ ID NO: 28473 - DNA, 25 bp, Mus musculus
aacagatggctgaaagagaccttag

SEQ ID NO: 28474 - DNA, 25 bp, Mus musculus
aacagatggctgtaagagaccttag

SEQ ID NO: 28475 - DNA, 25 bp, Mus musculus
aacagatggcttctgggatgtgacc

SEQ ID NO: 28476 - DNA, 25 bp, Mus musculus
aacagatggcttgtgggatgtgacc

SEQ ID NO: 28477 - DNA, 25 bp, Mus musculus
aacagatgggaaactcggctgagaa

SEQ ID NO: 28478 - DNA, 25 bp, Mus musculus
aacagatgggaatctcggctgagaa

SEQ ID NO: 28479 - DNA, 25 bp, Mus musculus
aacagatgggagacctgtctttccg

SEQ ID NO: 28480 - DNA, 25 bp, Mus musculus
aacagatgggagtcctgtctttccg

SEQ ID NO: 28481 - DNA, 25 bp, Mus musculus
aacagatgggcaatgactcaggaca

SEQ ID NO: 28482 - DNA, 25 bp, Mus musculus
aacagatgggcattgactcaggaca

SEQ ID NO: 28483 - DNA, 25 bp, Mus musculus
aacagatgggctaagggcacgcccc

SEQ ID NO: 28484 - DNA, 25 bp, Mus musculus
aacagatgggcttagggcacgcccc

SEQ ID NO: 28485 - DNA, 25 bp, Mus musculus
aacagatgggtgcttcctggacact

SEQ ID NO: 28486 - DNA, 25 bp, Mus musculus
aacagatgggtggttcctggacact

SEQ ID NO: 28487 - DNA, 25 bp, Mus musculus
aacagatggtcaatgatgtccttca

SEQ ID NO: 28488 - DNA, 25 bp, Mus musculus
aacagatggtcattgatgtccttca

SEQ ID NO: 28489 - DNA, 25 bp, Mus musculus
aacagatgtaccatggcttttaatg

SEQ ID NO: 28490 - DNA, 25 bp, Mus musculus
aacagatgtaccttggcttttaatg

SEQ ID NO: 28491 - DNA, 25 bp, Mus musculus
aacagatgtataccttggtcctcat

SEQ ID NO: 28492 - DNA, 25 bp, Mus musculus
aacagatgtatagcttggtcctcat

SEQ ID NO: 28493 - DNA, 25 bp, Mus musculus
aacagatgtcagatgcgaaggcaaa

SEQ ID NO: 28494 - DNA, 25 bp, Mus musculus
aacagatgtcagttgcgaaggcaaa

SEQ ID NO: 28495 - DNA, 25 bp, Mus musculus
aacagatgtcatccacgggaccttg

SEQ ID NO: 28496 - DNA, 25 bp, Mus musculus
aacagatgtcatgcacgggaccttg

SEQ ID NO: 28497 - DNA, 25 bp, Mus musculus
aacagatgtctacagccctgggtgt

SEQ ID NO: 28498 - DNA, 25 bp, Mus musculus
aacagatgtctagagccctgggtgt

SEQ ID NO: 28499 - DNA, 25 bp, Mus musculus
aacagatgtgtgatgctcttgcctg

SEQ ID NO: 28500 - DNA, 25 bp, Mus musculus
aacagatgtgtgttgctcttgcctg

SEQ ID NO: 28501 - DNA, 25 bp, Mus musculus
aacagatgtgttcctttggaaaata

SEQ ID NO: 28502 - DNA, 25 bp, Mus musculus
aacagatgtgttgctttggaaaata

SEQ ID NO: 28503 - DNA, 25 bp, Mus musculus
aacagattaaccactgtatctacaa

SEQ ID NO: 28504 - DNA, 25 bp, Mus musculus
aacagattaacctctgtatctacaa

SEQ ID NO: 28505 - DNA, 25 bp, Mus musculus
aacagattccagattgtatttcgct

SEQ ID NO: 28506 - DNA, 25 bp, Mus musculus
aacagattccagtttgtatttcgct

SEQ ID NO: 28507 - DNA, 25 bp, Mus musculus
aacagattcctgcaagggcgattct

SEQ ID NO: 28508 - DNA, 25 bp, Mus musculus
aacagattcctggaagggcgattct

SEQ ID NO: 28509 - DNA, 25 bp, Mus musculus
aacagattcgtcatctgagagcttg

SEQ ID NO: 28510 - DNA, 25 bp, Mus musculus
aacagattcgtcttctgagagcttg

SEQ ID NO: 28511 - DNA, 25 bp, Mus musculus
aacagattctctaagggctattcag

SEQ ID NO: 28512 - DNA, 25 bp, Mus musculus
aacagattctcttagggctattcag

SEQ ID NO: 28513 - DNA, 25 bp, Mus musculus
aacagattctggagacaaactaaat

SEQ ID NO: 28514 - DNA, 25 bp, Mus musculus
aacagattctggtgacaaactaaat

SEQ ID NO: 28515 - DNA, 25 bp, Mus musculus
aacagattcttaccgtttccacaag

SEQ ID NO: 28516 - DNA, 25 bp, Mus musculus
aacagattcttagcgtttccacaag

SEQ ID NO: 28517 - DNA, 25 bp, Mus musculus
aacagattcttcatgcctttttagc

SEQ ID NO: 28518 - DNA, 25 bp, Mus musculus
aacagattcttcttgcctttttagc

SEQ ID NO: 28519 - DNA, 25 bp, Mus musculus
aacagattgccaagagacgtaggct

SEQ ID NO: 28520 - DNA, 25 bp, Mus musculus
aacagattgccatgagacgtaggct

SEQ ID NO: 28521 - DNA, 25 bp, Mus musculus
aacagattgcggaggccatcacaga

SEQ ID NO: 28522 - DNA, 25 bp, Mus musculus
aacagattgcggtggccatcacaga

SEQ ID NO: 28523 - DNA, 25 bp, Mus musculus
aacagattggctatggaccattagc

SEQ ID NO: 28524 - DNA, 25 bp, Mus musculus
aacagattggctttggaccattagc

SEQ ID NO: 28525 - DNA, 25 bp, Mus musculus
aacagattggttcgcactgtgcctg

SEQ ID NO: 28526 - DNA, 25 bp, Mus musculus
aacagattggttggcactgtgcctg

SEQ ID NO: 28527 - DNA, 25 bp, Mus musculus
aacagatttatcagaggttgcagct

SEQ ID NO: 28528 - DNA, 25 bp, Mus musculus
aacagatttatctgaggttgcagct

SEQ ID NO: 28529 - DNA, 25 bp, Mus musculus
aacagatttcccatcagacccggca

SEQ ID NO: 28530 - DNA, 25 bp, Mus musculus
aacagatttcccttcagacccggca

SEQ ID NO: 28531 - DNA, 25 bp, Mus musculus
aacagatttcttagccctggacagg

SEQ ID NO: 28532 - DNA, 25 bp, Mus musculus
aacagatttctttgccctggacagg

SEQ ID NO: 28533 - DNA, 25 bp, Mus musculus
aacagatttgacattccattttatg

SEQ ID NO: 28534 - DNA, 25 bp, Mus musculus
aacagatttgactttccattttatg

SEQ ID NO: 28535 - DNA, 25 bp, Mus musculus
aacagcaaactcaagggacagcctt

SEQ ID NO: 28536 - DNA, 25 bp, Mus musculus
aacagcaaactctagggacagcctt

SEQ ID NO: 28537 - DNA, 25 bp, Mus musculus
aacagcaaagtaattatggaccaat

SEQ ID NO: 28538 - DNA, 25 bp, Mus musculus
aacagcaaagtatttatggaccaat

SEQ ID NO: 28539 - DNA, 25 bp, Mus musculus
aacagcaacacacaaggctgcttgt

SEQ ID NO: 28540 - DNA, 25 bp, Mus musculus
aacagcaacacagaaggctgcttgt

SEQ ID NO: 28541 - DNA, 25 bp, Mus musculus
aacagcaaccaactagcttttagca

SEQ ID NO: 28542 - DNA, 25 bp, Mus musculus
aacagcaaccaagtagcttttagca

SEQ ID NO: 28543 - DNA, 25 bp, Mus musculus
aacagcaactctcaagccctggagg

SEQ ID NO: 28544 - DNA, 25 bp, Mus musculus
aacagcaactctgaagccctggagg

SEQ ID NO: 28545 - DNA, 25 bp, Mus musculus
aacagcaagatactagttctttgat

SEQ ID NO: 28546 - DNA, 25 bp, Mus musculus
aacagcaagatagtagttctttgat

SEQ ID NO: 28547 - DNA, 25 bp, Mus musculus
aacagcaagttcaatgtcggcagaa

SEQ ID NO: 28548 - DNA, 25 bp, Mus musculus
aacagcaagttctatgtcggcagaa

SEQ ID NO: 28549 - DNA, 25 bp, Mus musculus
aacagcaagtttccccaggtgcttt

SEQ ID NO: 28550 - DNA, 25 bp, Mus musculus
aacagcaagtttgcccaggtgcttt

SEQ ID NO: 28551 - DNA, 25 bp, Mus musculus
aacagcaatatcagccgccccattg

SEQ ID NO: 28552 - DNA, 25 bp, Mus musculus
aacagcaatatctgccgccccattg

SEQ ID NO: 28553 - DNA, 25 bp, Mus musculus
aacagcaatgagaactcgcctctga

SEQ ID NO: 28554 - DNA, 25 bp, Mus musculus
aacagcaatgagtactcgcctctga

SEQ ID NO: 28555 - DNA, 25 bp, Mus musculus
aacagcaatgtcatccaaggtcgtc

SEQ ID NO: 28556 - DNA, 25 bp, Mus musculus
aacagcaatgtcttccaaggtcgtc

SEQ ID NO: 28557 - DNA, 25 bp, Mus musculus
aacagcacaagtatgttcctaaagt

SEQ ID NO: 28558 - DNA, 25 bp, Mus musculus
aacagcacaagtttgttcctaaagt

SEQ ID NO: 28559 - DNA, 25 bp, Mus musculus
aacagcacacatccaccactgtagg

SEQ ID NO: 28560 - DNA, 25 bp, Mus musculus
aacagcacacatgcaccactgtagg

SEQ ID NO: 28561 - DNA, 25 bp, Mus musculus
aacagcacagcaaaggtacaacagg

SEQ ID NO: 28562 - DNA, 25 bp, Mus musculus
aacagcacagcataggtacaacagg

SEQ ID NO: 28563 - DNA, 25 bp, Mus musculus
aacagcacagggatctttaacagtg

SEQ ID NO: 28564 - DNA, 25 bp, Mus musculus
aacagcacagggttctttaacagtg

SEQ ID NO: 28565 - DNA, 25 bp, Mus musculus
aacagcacatagcagacagaccagt

SEQ ID NO: 28566 - DNA, 25 bp, Mus musculus
aacagcacataggagacagaccagt

SEQ ID NO: 28567 - DNA, 25 bp, Mus musculus
aacagcacattacttccagaagaag

SEQ ID NO: 28568 - DNA, 25 bp, Mus musculus
aacagcacattagttccagaagaag

SEQ ID NO: 28569 - DNA, 25 bp, Mus musculus
aacagcacattgagcattcctaaat

SEQ ID NO: 28570 - DNA, 25 bp, Mus musculus
aacagcacattgtgcattcctaaat

SEQ ID NO: 28571 - DNA, 25 bp, Mus musculus
aacagcacatttcaagccgaaggca

SEQ ID NO: 28572 - DNA, 25 bp, Mus musculus
aacagcacatttgaagccgaaggca

SEQ ID NO: 28573 - DNA, 25 bp, Mus musculus
aacagcaccgacctgcctctgtaga

SEQ ID NO: 28574 - DNA, 25 bp, Mus musculus
aacagcaccgacgtgcctctgtaga

SEQ ID NO: 28575 - DNA, 25 bp, Mus musculus
aacagcaccgatatgattacactag

SEQ ID NO: 28576 - DNA, 25 bp, Mus musculus
aacagcaccgatttgattacactag

SEQ ID NO: 28577 - DNA, 25 bp, Mus musculus
aacagcaccggaccctttcacaaat

SEQ ID NO: 28578 - DNA, 25 bp, Mus musculus
aacagcaccggagcctttcacaaat

SEQ ID NO: 28579 - DNA, 25 bp, Mus musculus
aacagcaccggcaccccagagtggg

SEQ ID NO: 28580 - DNA, 25 bp, Mus musculus
aacagcaccggctccccagagtggg

SEQ ID NO: 28581 - DNA, 25 bp, Mus musculus
aacagcacctacctcgaagatttga

SEQ ID NO: 28582 - DNA, 25 bp, Mus musculus
aacagcacctacgtcgaagatttga

SEQ ID NO: 28583 - DNA, 25 bp, Mus musculus
aacagcacctggaagtaagacacca

SEQ ID NO: 28584 - DNA, 25 bp, Mus musculus
aacagcacctggtagtaagacacca

SEQ ID NO: 28585 - DNA, 25 bp, Mus musculus
aacagcacggatcttggaggcccat

SEQ ID NO: 28586 - DNA, 25 bp, Mus musculus
aacagcacggatgttggaggcccat

SEQ ID NO: 28587 - DNA, 25 bp, Mus musculus
aacagcacgggcaaccatgggccat

SEQ ID NO: 28588 - DNA, 25 bp, Mus musculus
aacagcacgggctaccatgggccat

SEQ ID NO: 28589 - DNA, 25 bp, Mus musculus
aacagcactaaacgctgggcgagct

SEQ ID NO: 28590 - DNA, 25 bp, Mus musculus
aacagcactaaaggctgggcgagct

SEQ ID NO: 28591 - DNA, 25 bp, Mus musculus
aacagcactctgacttctaacaaga

SEQ ID NO: 28592 - DNA, 25 bp, Mus musculus
aacagcactctgtcttctaacaaga

SEQ ID NO: 28593 - DNA, 25 bp, Mus musculus
aacagcactggaagggatcctggag

SEQ ID NO: 28594 - DNA, 25 bp, Mus musculus
aacagcactggatgggatcctggag

SEQ ID NO: 28595 - DNA, 25 bp, Mus musculus
aacagcacttgacgtggccctctgg

SEQ ID NO: 28596 - DNA, 25 bp, Mus musculus
aacagcacttgaggtggccctctgg

SEQ ID NO: 28597 - DNA, 25 bp, Mus musculus
aacagcactttcaggctacatttta

SEQ ID NO: 28598 - DNA, 25 bp, Mus musculus
aacagcactttctggctacatttta

SEQ ID NO: 28599 - DNA, 25 bp, Mus musculus
aacagcagaaacacttagggtcagc

SEQ ID NO: 28600 - DNA, 25 bp, Mus musculus
aacagcagaaactcttagggtcagc

SEQ ID NO: 28601 - DNA, 25 bp, Mus musculus
aacagcagagctcatcaggaagagg

SEQ ID NO: 28602 - DNA, 25 bp, Mus musculus
aacagcagagctgatcaggaagagg

SEQ ID NO: 28603 - DNA, 25 bp, Mus musculus
aacagcagaggtcaccactgccagg

SEQ ID NO: 28604 - DNA, 25 bp, Mus musculus
aacagcagaggtgaccactgccagg

SEQ ID NO: 28605 - DNA, 25 bp, Mus musculus
aacagcagagtcatccgaagccagg

SEQ ID NO: 28606 - DNA, 25 bp, Mus musculus
aacagcagagtcttccgaagccagg

SEQ ID NO: 28607 - DNA, 25 bp, Mus musculus
aacagcagcaacaaatcaagggaag

SEQ ID NO: 28608 - DNA, 25 bp, Mus musculus
aacagcagcaactaatcaagggaag

SEQ ID NO: 28609 - DNA, 25 bp, Mus musculus
aacagcagcaatcatggagtggagc

SEQ ID NO: 28610 - DNA, 25 bp, Mus musculus
aacagcagcaatgatggagtggagc

SEQ ID NO: 28611 - DNA, 25 bp, Mus musculus
aacagcagcaccatggacttgactc

SEQ ID NO: 28612 - DNA, 25 bp, Mus musculus
aacagcagcaccttggacttgactc

SEQ ID NO: 28613 - DNA, 25 bp, Mus musculus
aacagcagcagcacgactgggacag

SEQ ID NO: 28614 - DNA, 25 bp, Mus musculus
aacagcagcagctcgactgggacag

SEQ ID NO: 28615 - DNA, 25 bp, Mus musculus
aacagcagcctacccgggttagaat

SEQ ID NO: 28616 - DNA, 25 bp, Mus musculus
aacagcagcctagccgggttagaat

SEQ ID NO: 28617 - DNA, 25 bp, Mus musculus
aacagcagcctgcaagtcagcaagt

SEQ ID NO: 28618 - DNA, 25 bp, Mus musculus
aacagcagcctggaagtcagcaagt

SEQ ID NO: 28619 - DNA, 25 bp, Mus musculus
aacagcagcggcaacaggaggccaa

SEQ ID NO: 28620 - DNA, 25 bp, Mus musculus
aacagcagcggctacaggaggccaa

SEQ ID NO: 28621 - DNA, 25 bp, Mus musculus
aacagcagcggtcgttcatctggag

SEQ ID NO: 28622 - DNA, 25 bp, Mus musculus
aacagcagcggtggttcatctggag

SEQ ID NO: 28623 - DNA, 25 bp, Mus musculus
aacagcagcgtacagaggccctgcg

SEQ ID NO: 28624 - DNA, 25 bp, Mus musculus
aacagcagcgtagagaggccctgcg

SEQ ID NO: 28625 - DNA, 25 bp, Mus musculus
aacagcagcgttacataggaagaga

SEQ ID NO: 28626 - DNA, 25 bp, Mus musculus
aacagcagcgtttcataggaagaga

SEQ ID NO: 28627 - DNA, 25 bp, Mus musculus
aacagcaggtatctttagacccaat

SEQ ID NO: 28628 - DNA, 25 bp, Mus musculus
aacagcaggtatgtttagacccaat

SEQ ID NO: 28629 - DNA, 25 bp, Mus musculus
aacagcaggtggaatttaggccttg

SEQ ID NO: 28630 - DNA, 25 bp, Mus musculus
aacagcaggtggtatttaggccttg

SEQ ID NO: 28631 - DNA, 25 bp, Mus musculus
aacagcaggtgtacgaagtccagtt

SEQ ID NO: 28632 - DNA, 25 bp, Mus musculus
aacagcaggtgttcgaagtccagtt

SEQ ID NO: 28633 - DNA, 25 bp, Mus musculus
aacagcagtggcactgtccctatga

SEQ ID NO: 28634 - DNA, 25 bp, Mus musculus
aacagcagtggctctgtccctatga

SEQ ID NO: 28635 - DNA, 25 bp, Mus musculus
aacagcagtgtaaccatctggtcag

SEQ ID NO: 28636 - DNA, 25 bp, Mus musculus
aacagcagtgtacatgttcttaatt

SEQ ID NO: 28637 - DNA, 25 bp, Mus musculus
aacagcagtgtagatgttcttaatt

SEQ ID NO: 28638 - DNA, 25 bp, Mus musculus
aacagcagtgtatccatctggtcag

SEQ ID NO: 28639 - DNA, 25 bp, Mus musculus
aacagcagtgtcaaccctattattt

SEQ ID NO: 28640 - DNA, 25 bp, Mus musculus
aacagcagtgtctaccctattattt

SEQ ID NO: 28641 - DNA, 25 bp, Mus musculus
aacagcagtgttagacccattagaa

SEQ ID NO: 28642 - DNA, 25 bp, Mus musculus
aacagcagtgtttgacccattagaa

SEQ ID NO: 28643 - DNA, 25 bp, Mus musculus
aacagcagttagatcctggttctga

SEQ ID NO: 28644 - DNA, 25 bp, Mus musculus
aacagcagttagttcctggttctga

SEQ ID NO: 28645 - DNA, 25 bp, Mus musculus
aacagcataaccactgttccctact

SEQ ID NO: 28646 - DNA, 25 bp, Mus musculus
aacagcataacctctgttccctact

SEQ ID NO: 28647 - DNA, 25 bp, Mus musculus
aacagcatacaaacctggctaatgg

SEQ ID NO: 28648 - DNA, 25 bp, Mus musculus
aacagcatacaatcctggctaatgg

SEQ ID NO: 28649 - DNA, 25 bp, Mus musculus
aacagcatatgcagtctttccacat

SEQ ID NO: 28650 - DNA, 25 bp, Mus musculus
aacagcatatgctgtctttccacat

SEQ ID NO: 28651 - DNA, 25 bp, Mus musculus
aacagcatcaagaattcctacccga

SEQ ID NO: 28652 - DNA, 25 bp, Mus musculus
aacagcatcaagtattcctacccga

SEQ ID NO: 28653 - DNA, 25 bp, Mus musculus
aacagcatcagcatcacagcttgat

SEQ ID NO: 28654 - DNA, 25 bp, Mus musculus
aacagcatcagcttcacagcttgat

SEQ ID NO: 28655 - DNA, 25 bp, Mus musculus
aacagcatcctaactagtcacctga

SEQ ID NO: 28656 - DNA, 25 bp, Mus musculus
aacagcatcctatctagtcacctga

SEQ ID NO: 28657 - DNA, 25 bp, Mus musculus
aacagcatcctcagaatagacccta

SEQ ID NO: 28658 - DNA, 25 bp, Mus musculus
aacagcatcctctgaatagacccta

SEQ ID NO: 28659 - DNA, 25 bp, Mus musculus
aacagcatcgctaacattccagagc

SEQ ID NO: 28660 - DNA, 25 bp, Mus musculus
aacagcatcgcttacattccagagc

SEQ ID NO: 28661 - DNA, 25 bp, Mus musculus
aacagcatctctcgtcattgccatg

SEQ ID NO: 28662 - DNA, 25 bp, Mus musculus
aacagcatctctggtcattgccatg

SEQ ID NO: 28663 - DNA, 25 bp, Mus musculus
aacagcatctgccagacgtgtcaag

SEQ ID NO: 28664 - DNA, 25 bp, Mus musculus
aacagcatctgcgagacgtgtcaag

SEQ ID NO: 28665 - DNA, 25 bp, Mus musculus
aacagcatcttacccatcttaacca

SEQ ID NO: 28666 - DNA, 25 bp, Mus musculus
aacagcatcttagccatcttaacca

SEQ ID NO: 28667 - DNA, 25 bp, Mus musculus
aacagcatgaacacactcacactgg

SEQ ID NO: 28668 - DNA, 25 bp, Mus musculus
aacagcatgaactcactcacactgg

SEQ ID NO: 28669 - DNA, 25 bp, Mus musculus
aacagcatgaagacctagcccagca

SEQ ID NO: 28670 - DNA, 25 bp, Mus musculus
aacagcatgaagagtggacctgatg

SEQ ID NO: 28671 - DNA, 25 bp, Mus musculus
aacagcatgaagtcctagcccagca

SEQ ID NO: 28672 - DNA, 25 bp, Mus musculus
aacagcatgaagtgtggacctgatg

SEQ ID NO: 28673 - DNA, 25 bp, Mus musculus
aacagcatgcctctgacggcccggg

SEQ ID NO: 28674 - DNA, 25 bp, Mus musculus
aacagcatgcctgtgacggcccggg

SEQ ID NO: 28675 - DNA, 25 bp, Mus musculus
aacagcatgctcatgttcttccagc

SEQ ID NO: 28676 - DNA, 25 bp, Mus musculus
aacagcatgctcttgttcttccagc

SEQ ID NO: 28677 - DNA, 25 bp, Mus musculus
aacagcatgcttagtttcctcatga

SEQ ID NO: 28678 - DNA, 25 bp, Mus musculus
aacagcatgctttgtttcctcatga

SEQ ID NO: 28679 - DNA, 25 bp, Mus musculus
aacagcatggccacgcagttgtgta

SEQ ID NO: 28680 - DNA, 25 bp, Mus musculus
aacagcatggcctcgcagttgtgta

SEQ ID NO: 28681 - DNA, 25 bp, Mus musculus
aacagcatgggaagacactgtggga

SEQ ID NO: 28682 - DNA, 25 bp, Mus musculus
aacagcatgggatgacactgtggga

SEQ ID NO: 28683 - DNA, 25 bp, Mus musculus
aacagcatgggcaccctattaagga

SEQ ID NO: 28684 - DNA, 25 bp, Mus musculus
aacagcatgggctccctattaagga

SEQ ID NO: 28685 - DNA, 25 bp, Mus musculus
aacagcattgctcgcactctagtga

SEQ ID NO: 28686 - DNA, 25 bp, Mus musculus
aacagcattgctggcactctagtga

SEQ ID NO: 28687 - DNA, 25 bp, Mus musculus
aacagcattgtcaggtctatggccc

SEQ ID NO: 28688 - DNA, 25 bp, Mus musculus
aacagcattgtctggtctatggccc

SEQ ID NO: 28689 - DNA, 25 bp, Mus musculus
aacagcattgtgctttctcctaacg

SEQ ID NO: 28690 - DNA, 25 bp, Mus musculus
aacagcattgtggtttctcctaacg

SEQ ID NO: 28691 - DNA, 25 bp, Mus musculus
aacagcattgttacaccacttatca

SEQ ID NO: 28692 - DNA, 25 bp, Mus musculus
aacagcattgtttcaccacttatca

SEQ ID NO: 28693 - DNA, 25 bp, Mus musculus
aacagcatttcacagcggctgtgtg

SEQ ID NO: 28694 - DNA, 25 bp, Mus musculus
aacagcatttcactttactgcaagt

SEQ ID NO: 28695 - DNA, 25 bp, Mus musculus
aacagcatttcagagcggctgtgtg

SEQ ID NO: 28696 - DNA, 25 bp, Mus musculus
aacagcatttcagtttactgcaagt

SEQ ID NO: 28697 - DNA, 25 bp, Mus musculus
aacagcattttcctaaatcttgatg

SEQ ID NO: 28698 - DNA, 25 bp, Mus musculus
aacagcattttcgtaaatcttgatg

SEQ ID NO: 28699 - DNA, 25 bp, Mus musculus
aacagccaaatcctactgactgaag

SEQ ID NO: 28700 - DNA, 25 bp, Mus musculus
aacagccaaatcgtactgactgaag

SEQ ID NO: 28701 - DNA, 25 bp, Mus musculus
aacagccaaccacagtccagatttt

SEQ ID NO: 28702 - DNA, 25 bp, Mus musculus
aacagccaaccagagtccagatttt

SEQ ID NO: 28703 - DNA, 25 bp, Mus musculus
aacagccaagcacatccaggaattc

SEQ ID NO: 28704 - DNA, 25 bp, Mus musculus
aacagccaagcagatccaggaattc

SEQ ID NO: 28705 - DNA, 25 bp, Mus musculus
aacagccaagtgctgccacagacat

SEQ ID NO: 28706 - DNA, 25 bp, Mus musculus
aacagccaagtggtgccacagacat

SEQ ID NO: 28707 - DNA, 25 bp, Mus musculus
aacagccaatgaacacaggaagtta

SEQ ID NO: 28708 - DNA, 25 bp, Mus musculus
aacagccaatgatcacaggaagtta

SEQ ID NO: 28709 - DNA, 25 bp, Mus musculus
aacagccacaagctgcaggttcaag

SEQ ID NO: 28710 - DNA, 25 bp, Mus musculus
aacagccacaaggtgcaggttcaag

SEQ ID NO: 28711 - DNA, 25 bp, Mus musculus
aacagccacagtagtcatgcctgat

SEQ ID NO: 28712 - DNA, 25 bp, Mus musculus
aacagccacagttgtcatgcctgat

SEQ ID NO: 28713 - DNA, 25 bp, Mus musculus
aacagccactgtatgatcaaggtca

SEQ ID NO: 28714 - DNA, 25 bp, Mus musculus
aacagccactgtcctattgtttgag

SEQ ID NO: 28715 - DNA, 25 bp, Mus musculus
aacagccactgtgctattgtttgag

SEQ ID NO: 28716 - DNA, 25 bp, Mus musculus
aacagccactgtttgatcaaggtca

SEQ ID NO: 28717 - DNA, 25 bp, Mus musculus
aacagccagcatctactttctcttg

SEQ ID NO: 28718 - DNA, 25 bp, Mus musculus
aacagccagcatgtactttctcttg

SEQ ID NO: 28719 - DNA, 25 bp, Mus musculus
aacagccagccgcacatgttgatgg

SEQ ID NO: 28720 - DNA, 25 bp, Mus musculus
aacagccagccggacatgttgatgg

SEQ ID NO: 28721 - DNA, 25 bp, Mus musculus
aacagccagtcaaacaccatcatat

SEQ ID NO: 28722 - DNA, 25 bp, Mus musculus
aacagccagtcatacaccatcatat

SEQ ID NO: 28723 - DNA, 25 bp, Mus musculus
aacagccagtgacgtttgggccttc

SEQ ID NO: 28724 - DNA, 25 bp, Mus musculus
aacagccagtgaggtttgggccttc

SEQ ID NO: 28725 - DNA, 25 bp, Mus musculus
aacagccatcaacgtttccactttt

SEQ ID NO: 28726 - DNA, 25 bp, Mus musculus
aacagccatcaaggtttccactttt

SEQ ID NO: 28727 - DNA, 25 bp, Mus musculus
aacagccatgagagtatgcaattgt

SEQ ID NO: 28728 - DNA, 25 bp, Mus musculus
aacagccatgagtgtatgcaattgt

SEQ ID NO: 28729 - DNA, 25 bp, Mus musculus
aacagcccacaactgatgcttcttg

SEQ ID NO: 28730 - DNA, 25 bp, Mus musculus
aacagcccacaagtgatgcttcttg

SEQ ID NO: 28731 - DNA, 25 bp, Mus musculus
aacagcccagcaagtgtggaggcac

SEQ ID NO: 28732 - DNA, 25 bp, Mus musculus
aacagcccagcatgtgtggaggcac

SEQ ID NO: 28733 - DNA, 25 bp, Mus musculus
aacagccccacacggaagcctggga

SEQ ID NO: 28734 - DNA, 25 bp, Mus musculus
aacagccccacagggaagcctggga

SEQ ID NO: 28735 - DNA, 25 bp, Mus musculus
aacagccccagtcgcggagctgaga

SEQ ID NO: 28736 - DNA, 25 bp, Mus musculus
aacagccccagtcttgaagtctata

SEQ ID NO: 28737 - DNA, 25 bp, Mus musculus
aacagccccagtggcggagctgaga

SEQ ID NO: 28738 - DNA, 25 bp, Mus musculus
aacagccccagtgttgaagtctata

SEQ ID NO: 28739 - DNA, 25 bp, Mus musculus
aacagcccgaatcatctttgtgagt

SEQ ID NO: 28740 - DNA, 25 bp, Mus musculus
aacagcccgaatgatctttgtgagt

SEQ ID NO: 28741 - DNA, 25 bp, Mus musculus
aacagcccgcgtaatgattctacca

SEQ ID NO: 28742 - DNA, 25 bp, Mus musculus
aacagcccgcgttatgattctacca

SEQ ID NO: 28743 - DNA, 25 bp, Mus musculus
aacagcccgctgattgcatacaggg

SEQ ID NO: 28744 - DNA, 25 bp, Mus musculus
aacagcccgctgtttgcatacaggg

SEQ ID NO: 28745 - DNA, 25 bp, Mus musculus
aacagccctaggcatcctggcagga

SEQ ID NO: 28746 - DNA, 25 bp, Mus musculus
aacagccctagggatcctggcagga

SEQ ID NO: 28747 - DNA, 25 bp, Mus musculus
aacagccctataagaacgccgctcg

SEQ ID NO: 28748 - DNA, 25 bp, Mus musculus
aacagccctatatgaacgccgctcg

SEQ ID NO: 28749 - DNA, 25 bp, Mus musculus
aacagccctctgcaatttgactctg

SEQ ID NO: 28750 - DNA, 25 bp, Mus musculus
aacagccctctggaatttgactctg

SEQ ID NO: 28751 - DNA, 25 bp, Mus musculus
aacagccctgaaagctctggtgcta

SEQ ID NO: 28752 - DNA, 25 bp, Mus musculus
aacagccctgaatgctctggtgcta

SEQ ID NO: 28753 - DNA, 25 bp, Mus musculus
aacagccctgatctagtgaccagcc

SEQ ID NO: 28754 - DNA, 25 bp, Mus musculus
aacagccctgatgtagtgaccagcc

SEQ ID NO: 28755 - DNA, 25 bp, Mus musculus
aacagccctggcagagtcaggtctt

SEQ ID NO: 28756 - DNA, 25 bp, Mus musculus
aacagccctggctgagtcaggtctt

SEQ ID NO: 28757 - DNA, 25 bp, Mus musculus
aacagccgaacaaccagcagctgcg

SEQ ID NO: 28758 - DNA, 25 bp, Mus musculus
aacagccgaacatccagcagctgcg

SEQ ID NO: 28759 - DNA, 25 bp, Mus musculus
aacagccgagggactttccagtgta

SEQ ID NO: 28760 - DNA, 25 bp, Mus musculus
aacagccgagggtctttccagtgta

SEQ ID NO: 28761 - DNA, 25 bp, Mus musculus
aacagccggacgagtagcaaagcga

SEQ ID NO: 28762 - DNA, 25 bp, Mus musculus
aacagccggacgtgtagcaaagcga

SEQ ID NO: 28763 - DNA, 25 bp, Mus musculus
aacagccggctgcacgattgcaaat

SEQ ID NO: 28764 - DNA, 25 bp, Mus musculus
aacagccggctggacgattgcaaat

SEQ ID NO: 28765 - DNA, 25 bp, Mus musculus
aacagccgtgaccactttagaatga

SEQ ID NO: 28766 - DNA, 25 bp, Mus musculus
aacagccgtgacgactttagaatga

SEQ ID NO: 28767 - DNA, 25 bp, Mus musculus
aacagcctagagctccagcgttaga

SEQ ID NO: 28768 - DNA, 25 bp, Mus musculus
aacagcctagaggtccagcgttaga

SEQ ID NO: 28769 - DNA, 25 bp, Mus musculus
aacagcctagatccatctctgctat

SEQ ID NO: 28770 - DNA, 25 bp, Mus musculus
aacagcctagatgcatctctgctat

SEQ ID NO: 28771 - DNA, 25 bp, Mus musculus
aacagcctatcaagaatctggtcat

SEQ ID NO: 28772 - DNA, 25 bp, Mus musculus
aacagcctatcatgaatctggtcat

SEQ ID NO: 28773 - DNA, 25 bp, Mus musculus
aacagcctcgtgcttgtagctttta

SEQ ID NO: 28774 - DNA, 25 bp, Mus musculus
aacagcctcgtggttgtagctttta

SEQ ID NO: 28775 - DNA, 25 bp, Mus musculus
aacagcctgattcacatgcggagca

SEQ ID NO: 28776 - DNA, 25 bp, Mus musculus
aacagcctgattgacatgcggagca

SEQ ID NO: 28777 - DNA, 25 bp, Mus musculus
aacagcctggctccagaggtaggta

SEQ ID NO: 28778 - DNA, 25 bp, Mus musculus
aacagcctggctgcagaggtaggta

SEQ ID NO: 28779 - DNA, 25 bp, Mus musculus
aacagcctgggaccgggatctgcaa

SEQ ID NO: 28780 - DNA, 25 bp, Mus musculus
aacagcctgggagcgggatctgcaa

SEQ ID NO: 28781 - DNA, 25 bp, Mus musculus
aacagcctggtgaagaggctcgcgt

SEQ ID NO: 28782 - DNA, 25 bp, Mus musculus
aacagcctggtgaagccactgcggg

SEQ ID NO: 28783 - DNA, 25 bp, Mus musculus
aacagcctggtgtagaggctcgcgt

SEQ ID NO: 28784 - DNA, 25 bp, Mus musculus
aacagcctggtgtagccactgcggg

SEQ ID NO: 28785 - DNA, 25 bp, Mus musculus
aacagcctgtggatcggatacgatg

SEQ ID NO: 28786 - DNA, 25 bp, Mus musculus
aacagcctgtggttcggatacgatg

SEQ ID NO: 28787 - DNA, 25 bp, Mus musculus
aacagcctgtttctagaattcgtta

SEQ ID NO: 28788 - DNA, 25 bp, Mus musculus
aacagcctgtttgtagaattcgtta

SEQ ID NO: 28789 - DNA, 25 bp, Mus musculus
aacagccttcagatcataatcgcta

SEQ ID NO: 28790 - DNA, 25 bp, Mus musculus
aacagccttcagttcataatcgcta

SEQ ID NO: 28791 - DNA, 25 bp, Mus musculus
aacagccttcttaactgacttgtgc

SEQ ID NO: 28792 - DNA, 25 bp, Mus musculus
aacagccttctttactgacttgtgc

SEQ ID NO: 28793 - DNA, 25 bp, Mus musculus
aacagcctttgtaactgagcgagga

SEQ ID NO: 28794 - DNA, 25 bp, Mus musculus
aacagcctttgttactgagcgagga

SEQ ID NO: 28795 - DNA, 25 bp, Mus musculus
aacagcgaaactcgacacccttggg

SEQ ID NO: 28796 - DNA, 25 bp, Mus musculus
aacagcgaaactggacacccttggg

SEQ ID NO: 28797 - DNA, 25 bp, Mus musculus
aacagcgaacagatacatcccagca

SEQ ID NO: 28798 - DNA, 25 bp, Mus musculus
aacagcgaacagttacatcccagca

SEQ ID NO: 28799 - DNA, 25 bp, Mus musculus
aacagcgaaggtagtgttcctggag

SEQ ID NO: 28800 - DNA, 25 bp, Mus musculus
aacagcgaaggttgtgttcctggag

SEQ ID NO: 28801 - DNA, 25 bp, Mus musculus
aacagcgacaatcatttttcagcaa

SEQ ID NO: 28802 - DNA, 25 bp, Mus musculus
aacagcgacaatgatttttcagcaa

SEQ ID NO: 28803 - DNA, 25 bp, Mus musculus
aacagcgacagaagattgtgcaggc

SEQ ID NO: 28804 - DNA, 25 bp, Mus musculus
aacagcgacagatgattgtgcaggc

SEQ ID NO: 28805 - DNA, 25 bp, Mus musculus
aacagcgacagtccggcaatggcaa

SEQ ID NO: 28806 - DNA, 25 bp, Mus musculus
aacagcgacagtgcggcaatggcaa

SEQ ID NO: 28807 - DNA, 25 bp, Mus musculus
aacagcgaccaaaagcaaacaatca

SEQ ID NO: 28808 - DNA, 25 bp, Mus musculus
aacagcgaccaatagcaaacaatca

SEQ ID NO: 28809 - DNA, 25 bp, Mus musculus
aacagcgactcacgagcgttttgga

SEQ ID NO: 28810 - DNA, 25 bp, Mus musculus
aacagcgactcaggagcgttttgga

SEQ ID NO: 28811 - DNA, 25 bp, Mus musculus
aacagcgagagacgttgccccagga

SEQ ID NO: 28812 - DNA, 25 bp, Mus musculus
aacagcgagagaggttgccccagga

SEQ ID NO: 28813 - DNA, 25 bp, Mus musculus
aacagcgagctgataccaccttcct

SEQ ID NO: 28814 - DNA, 25 bp, Mus musculus
aacagcgagctgttaccaccttcct

SEQ ID NO: 28815 - DNA, 25 bp, Mus musculus
aacagcgaggaacctttgtttcagg

SEQ ID NO: 28816 - DNA, 25 bp, Mus musculus
aacagcgaggaagctttgtttcagg

SEQ ID NO: 28817 - DNA, 25 bp, Mus musculus
aacagcgatggcatttgcctgcgtt

SEQ ID NO: 28818 - DNA, 25 bp, Mus musculus
aacagcgatggcttttgcctgcgtt

SEQ ID NO: 28819 - DNA, 25 bp, Mus musculus
aacagcgcacctccacaaggtttta

SEQ ID NO: 28820 - DNA, 25 bp, Mus musculus
aacagcgcacctgcacaaggtttta

SEQ ID NO: 28821 - DNA, 25 bp, Mus musculus
aacagcgcatgaaggtccgggctgc

SEQ ID NO: 28822 - DNA, 25 bp, Mus musculus
aacagcgcatgatggtccgggctgc

SEQ ID NO: 28823 - DNA, 25 bp, Mus musculus
aacagcgctacaccaggctggctga

SEQ ID NO: 28824 - DNA, 25 bp, Mus musculus
aacagcgctacagcaggctggctga

SEQ ID NO: 28825 - DNA, 25 bp, Mus musculus
aacagcggcaccagaagcggcggct

SEQ ID NO: 28826 - DNA, 25 bp, Mus musculus
aacagcggcacctgaagcggcggct

SEQ ID NO: 28827 - DNA, 25 bp, Mus musculus
aacagcggtgtgctttttataccta

SEQ ID NO: 28828 - DNA, 25 bp, Mus musculus
aacagcggtgtggtttttataccta

SEQ ID NO: 28829 - DNA, 25 bp, Mus musculus
aacagcggttatcgctttgggaagc

SEQ ID NO: 28830 - DNA, 25 bp, Mus musculus
aacagcggttatggctttgggaagc

SEQ ID NO: 28831 - DNA, 25 bp, Mus musculus
aacagcgtagatccagtagcgtagt

SEQ ID NO: 28832 - DNA, 25 bp, Mus musculus
aacagcgtagatgcagtagcgtagt

SEQ ID NO: 28833 - DNA, 25 bp, Mus musculus
aacagcgtatgtaagtagtagccat

SEQ ID NO: 28834 - DNA, 25 bp, Mus musculus
aacagcgtatgttagtagtagccat

SEQ ID NO: 28835 - DNA, 25 bp, Mus musculus
aacagcgtattcatttatggactct

SEQ ID NO: 28836 - DNA, 25 bp, Mus musculus
aacagcgtattcttttatggactct

SEQ ID NO: 28837 - DNA, 25 bp, Mus musculus
aacagcgtcatcagtggctgcatca

SEQ ID NO: 28838 - DNA, 25 bp, Mus musculus
aacagcgtcatctgtggctgcatca

SEQ ID NO: 28839 - DNA, 25 bp, Mus musculus
aacagcgtctctcataatggtgtca

SEQ ID NO: 28840 - DNA, 25 bp, Mus musculus
aacagcgtctctgataatggtgtca

SEQ ID NO: 28841 - DNA, 25 bp, Mus musculus
aacagcgtcttcagtctgttcattt

SEQ ID NO: 28842 - DNA, 25 bp, Mus musculus
aacagcgtcttctgtctgttcattt

SEQ ID NO: 28843 - DNA, 25 bp, Mus musculus
aacagcgtgcgtctaaactcaaaga

SEQ ID NO: 28844 - DNA, 25 bp, Mus musculus
aacagcgtgcgtgtaaactcaaaga

SEQ ID NO: 28845 - DNA, 25 bp, Mus musculus
aacagcgtgttcagataagttaaca

SEQ ID NO: 28846 - DNA, 25 bp, Mus musculus
aacagcgtgttctgataagttaaca

SEQ ID NO: 28847 - DNA, 25 bp, Mus musculus
aacagcgttgccactgacagctgga

SEQ ID NO: 28848 - DNA, 25 bp, Mus musculus
aacagcgttgcctctgacagctgga

SEQ ID NO: 28849 - DNA, 25 bp, Mus musculus
aacagcgttggcctgaaacccattg

SEQ ID NO: 28850 - DNA, 25 bp, Mus musculus
aacagcgttggcgtgaaacccattg

SEQ ID NO: 28851 - DNA, 25 bp, Mus musculus
aacagcgttgtcactgtccattctt

SEQ ID NO: 28852 - DNA, 25 bp, Mus musculus
aacagcgttgtctctgtccattctt

SEQ ID NO: 28853 - DNA, 25 bp, Mus musculus
aacagctaaactaggcctgtcaggc

SEQ ID NO: 28854 - DNA, 25 bp, Mus musculus
aacagctaaacttggcctgtcaggc

SEQ ID NO: 28855 - DNA, 25 bp, Mus musculus
aacagctacagaagcccttatcgct

SEQ ID NO: 28856 - DNA, 25 bp, Mus musculus
aacagctacagaccactgtttctaa

SEQ ID NO: 28857 - DNA, 25 bp, Mus musculus
aacagctacagagcactgtttctaa

SEQ ID NO: 28858 - DNA, 25 bp, Mus musculus
aacagctacagatgcccttatcgct

SEQ ID NO: 28859 - DNA, 25 bp, Mus musculus
aacagctacattatcaacttaagtt

SEQ ID NO: 28860 - DNA, 25 bp, Mus musculus
aacagctacattttcaacttaagtt

SEQ ID NO: 28861 - DNA, 25 bp, Mus musculus
aacagctacctcacgcatagtttat

SEQ ID NO: 28862 - DNA, 25 bp, Mus musculus
aacagctacctctcgcatagtttat

SEQ ID NO: 28863 - DNA, 25 bp, Mus musculus
aacagctacgcaaatcatggcaaca

SEQ ID NO: 28864 - DNA, 25 bp, Mus musculus
aacagctacgcatatcatggcaaca

SEQ ID NO: 28865 - DNA, 25 bp, Mus musculus
aacagctacgccaggatggtggtcc

SEQ ID NO: 28866 - DNA, 25 bp, Mus musculus
aacagctacgcctggatggtggtcc

SEQ ID NO: 28867 - DNA, 25 bp, Mus musculus
aacagctacgtcagtggccaataca

SEQ ID NO: 28868 - DNA, 25 bp, Mus musculus
aacagctacgtctgtggccaataca

SEQ ID NO: 28869 - DNA, 25 bp, Mus musculus
aacagctactgaattctacaatgga

SEQ ID NO: 28870 - DNA, 25 bp, Mus musculus
aacagctactgatttctacaatgga

SEQ ID NO: 28871 - DNA, 25 bp, Mus musculus
aacagctataccctgggagggcact

SEQ ID NO: 28872 - DNA, 25 bp, Mus musculus
aacagctataccgtgggagggcact

SEQ ID NO: 28873 - DNA, 25 bp, Mus musculus
aacagctatcagaatgccttcagtc

SEQ ID NO: 28874 - DNA, 25 bp, Mus musculus
aacagctatcagtatgccttcagtc

SEQ ID NO: 28875 - DNA, 25 bp, Mus musculus
aacagctatggcctctgtctgatcg

SEQ ID NO: 28876 - DNA, 25 bp, Mus musculus
aacagctatggcgtctgtctgatcg

SEQ ID NO: 28877 - DNA, 25 bp, Mus musculus
aacagctatggtcatctgataaaac

SEQ ID NO: 28878 - DNA, 25 bp, Mus musculus
aacagctatggtgatctgataaaac

SEQ ID NO: 28879 - DNA, 25 bp, Mus musculus
aacagctatgttacggcttgtagtg

SEQ ID NO: 28880 - DNA, 25 bp, Mus musculus
aacagctatgtttcggcttgtagtg

SEQ ID NO: 28881 - DNA, 25 bp, Mus musculus
aacagctattgaatatctacgcata

SEQ ID NO: 28882 - DNA, 25 bp, Mus musculus
aacagctattgattatctacgcata

SEQ ID NO: 28883 - DNA, 25 bp, Mus musculus
aacagctattggagttgcttcaaga

SEQ ID NO: 28884 - DNA, 25 bp, Mus musculus
aacagctattggtgttgcttcaaga

SEQ ID NO: 28885 - DNA, 25 bp, Mus musculus
aacagctatttgactcaacaccatt

SEQ ID NO: 28886 - DNA, 25 bp, Mus musculus
aacagctatttgtctcaacaccatt

SEQ ID NO: 28887 - DNA, 25 bp, Mus musculus
aacagctcaactctgttcagatgct

SEQ ID NO: 28888 - DNA, 25 bp, Mus musculus
aacagctcaactgtgttcagatgct

SEQ ID NO: 28889 - DNA, 25 bp, Mus musculus
aacagctcaataagtgttatcggct

SEQ ID NO: 28890 - DNA, 25 bp, Mus musculus
aacagctcaatatgtgttatcggct

SEQ ID NO: 28891 - DNA, 25 bp, Mus musculus
aacagctcaatcagatcccttgggc

SEQ ID NO: 28892 - DNA, 25 bp, Mus musculus
aacagctcaatctgatcccttgggc

SEQ ID NO: 28893 - DNA, 25 bp, Mus musculus
aacagctcagtacttaggatagggc

SEQ ID NO: 28894 - DNA, 25 bp, Mus musculus
aacagctcagtagttaggatagggc

SEQ ID NO: 28895 - DNA, 25 bp, Mus musculus
aacagctcagttcggcaagggccgt

SEQ ID NO: 28896 - DNA, 25 bp, Mus musculus
aacagctcagttgggcaagggccgt

SEQ ID NO: 28897 - DNA, 25 bp, Mus musculus
aacagctcatcaatgaagatcccta

SEQ ID NO: 28898 - DNA, 25 bp, Mus musculus
aacagctcatcattgaagatcccta

SEQ ID NO: 28899 - DNA, 25 bp, Mus musculus
aacagctccaagattatcagaaaaa

SEQ ID NO: 28900 - DNA, 25 bp, Mus musculus
aacagctccaagtttatcagaaaaa

SEQ ID NO: 28901 - DNA, 25 bp, Mus musculus
aacagctcccaaactttattttatg

SEQ ID NO: 28902 - DNA, 25 bp, Mus musculus
aacagctcccaatctttattttatg

SEQ ID NO: 28903 - DNA, 25 bp, Mus musculus
aacagctcccatacggatgtgttca

SEQ ID NO: 28904 - DNA, 25 bp, Mus musculus
aacagctcccattcggatgtgttca

SEQ ID NO: 28905 - DNA, 25 bp, Mus musculus
aacagctccctgaggcagacatcag

SEQ ID NO: 28906 - DNA, 25 bp, Mus musculus
aacagctccctgtggcagacatcag

SEQ ID NO: 28907 - DNA, 25 bp, Mus musculus
aacagctcctagacttttcagctag

SEQ ID NO: 28908 - DNA, 25 bp, Mus musculus
aacagctcctagtcttttcagctag

SEQ ID NO: 28909 - DNA, 25 bp, Mus musculus
aacagctcgaaaaggctcccagtat

SEQ ID NO: 28910 - DNA, 25 bp, Mus musculus
aacagctcgaaatggctcccagtat

SEQ ID NO: 28911 - DNA, 25 bp, Mus musculus
aacagctcggagacaatcaaaaaac

SEQ ID NO: 28912 - DNA, 25 bp, Mus musculus
aacagctcggagcatctgcacgcag

SEQ ID NO: 28913 - DNA, 25 bp, Mus musculus
aacagctcggaggatctgcacgcag

SEQ ID NO: 28914 - DNA, 25 bp, Mus musculus
aacagctcggagtcaatcaaaaaac

SEQ ID NO: 28915 - DNA, 25 bp, Mus musculus
aacagctctaaaccatacttttcaa

SEQ ID NO: 28916 - DNA, 25 bp, Mus musculus
aacagctctaaacggcagcacacac

SEQ ID NO: 28917 - DNA, 25 bp, Mus musculus
aacagctctaaagcatacttttcaa

SEQ ID NO: 28918 - DNA, 25 bp, Mus musculus
aacagctctaaagggcagcacacac

SEQ ID NO: 28919 - DNA, 25 bp, Mus musculus
aacagctctactagcaaacgttcat

SEQ ID NO: 28920 - DNA, 25 bp, Mus musculus
aacagctctacttgcaaacgttcat

SEQ ID NO: 28921 - DNA, 25 bp, Mus musculus
aacagctctagcatcccatgaatgg

SEQ ID NO: 28922 - DNA, 25 bp, Mus musculus
aacagctctagcttcccatgaatgg

SEQ ID NO: 28923 - DNA, 25 bp, Mus musculus
aacagctctcggatttagcgccatc

SEQ ID NO: 28924 - DNA, 25 bp, Mus musculus
aacagctctcggttttagcgccatc

SEQ ID NO: 28925 - DNA, 25 bp, Mus musculus
aacagctctgaaccggtttgctgcc

SEQ ID NO: 28926 - DNA, 25 bp, Mus musculus
aacagctctgaagcggtttgctgcc

SEQ ID NO: 28927 - DNA, 25 bp, Mus musculus
aacagctctgacagtgtgccatcgg

SEQ ID NO: 28928 - DNA, 25 bp, Mus musculus
aacagctctgactgtgtgccatcgg

SEQ ID NO: 28929 - DNA, 25 bp, Mus musculus
aacagctctgtgacctttttgttgt

SEQ ID NO: 28930 - DNA, 25 bp, Mus musculus
aacagctctgtgtcctttttgttgt

SEQ ID NO: 28931 - DNA, 25 bp, Mus musculus
aacagctctgttccgtaactgtcct

SEQ ID NO: 28932 - DNA, 25 bp, Mus musculus
aacagctctgttcttcatggagtca

SEQ ID NO: 28933 - DNA, 25 bp, Mus musculus
aacagctctgttgcgtaactgtcct

SEQ ID NO: 28934 - DNA, 25 bp, Mus musculus
aacagctctgttgttcatggagtca

SEQ ID NO: 28935 - DNA, 25 bp, Mus musculus
aacagctcttacaaaggtactagtt

SEQ ID NO: 28936 - DNA, 25 bp, Mus musculus
aacagctcttactaaggtactagtt

SEQ ID NO: 28937 - DNA, 25 bp, Mus musculus
aacagctgaactcggtcaacctcct

SEQ ID NO: 28938 - DNA, 25 bp, Mus musculus
aacagctgaactgggtcaacctcct

SEQ ID NO: 28939 - DNA, 25 bp, Mus musculus
aacagctgaattactttctctttat

SEQ ID NO: 28940 - DNA, 25 bp, Mus musculus
aacagctgaatttctttctctttat

SEQ ID NO: 28941 - DNA, 25 bp, Mus musculus
aacagctgactacaaacagatcccc

SEQ ID NO: 28942 - DNA, 25 bp, Mus musculus
aacagctgactactgatgaaggaat

SEQ ID NO: 28943 - DNA, 25 bp, Mus musculus
aacagctgactagaaacagatcccc

SEQ ID NO: 28944 - DNA, 25 bp, Mus musculus
aacagctgactagtgatgaaggaat

SEQ ID NO: 28945 - DNA, 25 bp, Mus musculus
aacagctgagtaattccaacccttc

SEQ ID NO: 28946 - DNA, 25 bp, Mus musculus
aacagctgagtatttccaacccttc

SEQ ID NO: 28947 - DNA, 25 bp, Mus musculus
aacagctgagttcaccaggcagcca

SEQ ID NO: 28948 - DNA, 25 bp, Mus musculus
aacagctgagttgaccaggcagcca

SEQ ID NO: 28949 - DNA, 25 bp, Mus musculus
aacagctgatggacacatgagagac

SEQ ID NO: 28950 - DNA, 25 bp, Mus musculus
aacagctgatggtcacatgagagac

SEQ ID NO: 28951 - DNA, 25 bp, Mus musculus
aacagctgcaaacaggccccgtgaa

SEQ ID NO: 28952 - DNA, 25 bp, Mus musculus
aacagctgcaaagaggccccgtgaa

SEQ ID NO: 28953 - DNA, 25 bp, Mus musculus
aacagctgcaatcgaccggtgccca

SEQ ID NO: 28954 - DNA, 25 bp, Mus musculus
aacagctgcaatggaccggtgccca

SEQ ID NO: 28955 - DNA, 25 bp, Mus musculus
aacagctgcatcaacgtcaacaaaa

SEQ ID NO: 28956 - DNA, 25 bp, Mus musculus
aacagctgcatcatatattgtcata

SEQ ID NO: 28957 - DNA, 25 bp, Mus musculus
aacagctgcatctacgtcaacaaaa

SEQ ID NO: 28958 - DNA, 25 bp, Mus musculus
aacagctgcatcttatattgtcata

SEQ ID NO: 28959 - DNA, 25 bp, Mus musculus
aacagctgcatgcttcatgcttctt

SEQ ID NO: 28960 - DNA, 25 bp, Mus musculus
aacagctgcatggttcatgcttctt

SEQ ID NO: 28961 - DNA, 25 bp, Mus musculus
aacagctgccttagatggcatcttg

SEQ ID NO: 28962 - DNA, 25 bp, Mus musculus
aacagctgcctttgatggcatcttg

SEQ ID NO: 28963 - DNA, 25 bp, Mus musculus
aacagctgcgacagaaggttcccag

SEQ ID NO: 28964 - DNA, 25 bp, Mus musculus
aacagctgcgactgaaggttcccag

SEQ ID NO: 28965 - DNA, 25 bp, Mus musculus
aacagctgctggaagtctaggtccc

SEQ ID NO: 28966 - DNA, 25 bp, Mus musculus
aacagctgctggtagtctaggtccc

SEQ ID NO: 28967 - DNA, 25 bp, Mus musculus
aacagctgctttctggaagtttctg

SEQ ID NO: 28968 - DNA, 25 bp, Mus musculus
aacagctgctttgtggaagtttctg

SEQ ID NO: 28969 - DNA, 25 bp, Mus musculus
aacagctggagactgcctactgcta

SEQ ID NO: 28970 - DNA, 25 bp, Mus musculus
aacagctggagagtgcctactgcta

SEQ ID NO: 28971 - DNA, 25 bp, Mus musculus
aacagctggatacattttgtcaatc

SEQ ID NO: 28972 - DNA, 25 bp, Mus musculus
aacagctggatagattttgtcaatc

SEQ ID NO: 28973 - DNA, 25 bp, Mus musculus
aacagctggcacagggtacctaggt

SEQ ID NO: 28974 - DNA, 25 bp, Mus musculus
aacagctggcactgggtacctaggt

SEQ ID NO: 28975 - DNA, 25 bp, Mus musculus
aacagctggcagaagtctggcgcga

SEQ ID NO: 28976 - DNA, 25 bp, Mus musculus
aacagctggcagtagtctggcgcga

SEQ ID NO: 28977 - DNA, 25 bp, Mus musculus
aacagctggccgagtctgtgtaccg

SEQ ID NO: 28978 - DNA, 25 bp, Mus musculus
aacagctggccgtgtctgtgtaccg

SEQ ID NO: 28979 - DNA, 25 bp, Mus musculus
aacagctgggagaaccggcagacat

SEQ ID NO: 28980 - DNA, 25 bp, Mus musculus
aacagctgggagtaccggcagacat

SEQ ID NO: 28981 - DNA, 25 bp, Mus musculus
aacagctggttgagatttgcttcat

SEQ ID NO: 28982 - DNA, 25 bp, Mus musculus
aacagctggttgtgatttgcttcat

SEQ ID NO: 28983 - DNA, 25 bp, Mus musculus
aacagctgtatgagtctttgatggc

SEQ ID NO: 28984 - DNA, 25 bp, Mus musculus
aacagctgtatgtgtctttgatggc

SEQ ID NO: 28985 - DNA, 25 bp, Mus musculus
aacagctgtccaacagtgagcttgt

SEQ ID NO: 28986 - DNA, 25 bp, Mus musculus
aacagctgtccatcagtgagcttgt

SEQ ID NO: 28987 - DNA, 25 bp, Mus musculus
aacagctgtccccagtgtctgtggt

SEQ ID NO: 28988 - DNA, 25 bp, Mus musculus
aacagctgtcccgagtgtctgtggt

SEQ ID NO: 28989 - DNA, 25 bp, Mus musculus
aacagctgtcctcaggttgtgatgt

SEQ ID NO: 28990 - DNA, 25 bp, Mus musculus
aacagctgtcctgaggttgtgatgt

SEQ ID NO: 28991 - DNA, 25 bp, Mus musculus
aacagctgtgagacaagtcctgagg

SEQ ID NO: 28992 - DNA, 25 bp, Mus musculus
aacagctgtgagtcaagtcctgagg

SEQ ID NO: 28993 - DNA, 25 bp, Mus musculus
aacagctgtgctcccagcgcttcga

SEQ ID NO: 28994 - DNA, 25 bp, Mus musculus
aacagctgtgctcttttaaatagtc

SEQ ID NO: 28995 - DNA, 25 bp, Mus musculus
aacagctgtgctgccagcgcttcga

SEQ ID NO: 28996 - DNA, 25 bp, Mus musculus
aacagctgtgctgttttaaatagtc

SEQ ID NO: 28997 - DNA, 25 bp, Mus musculus
aacagctgtgggaagtgtcaggcat

SEQ ID NO: 28998 - DNA, 25 bp, Mus musculus
aacagctgtgggtagtgtcaggcat

SEQ ID NO: 28999 - DNA, 25 bp, Mus musculus
aacagctgtgtgacagcctcatcag

SEQ ID NO: 29000 - DNA, 25 bp, Mus musculus
aacagctgtgtgtcagcctcatcag

SEQ ID NO: 29001 - DNA, 25 bp, Mus musculus
aacagctgtttgagaagttctggaa

SEQ ID NO: 29002 - DNA, 25 bp, Mus musculus
aacagctgtttgcacgctacctgaa

SEQ ID NO: 29003 - DNA, 25 bp, Mus musculus
aacagctgtttggacgctacctgaa

SEQ ID NO: 29004 - DNA, 25 bp, Mus musculus
aacagctgtttgtgaagttctggaa

SEQ ID NO: 29005 - DNA, 25 bp, Mus musculus
aacagcttactacctgtcttgctat

SEQ ID NO: 29006 - DNA, 25 bp, Mus musculus
aacagcttactagctgtcttgctat

SEQ ID NO: 29007 - DNA, 25 bp, Mus musculus
aacagcttagctcagggttcgtatc

SEQ ID NO: 29008 - DNA, 25 bp, Mus musculus
aacagcttagctgagggttcgtatc

SEQ ID NO: 29009 - DNA, 25 bp, Mus musculus
aacagcttatcaacttctgccacat

SEQ ID NO: 29010 - DNA, 25 bp, Mus musculus
aacagcttatcatcttctgccacat

SEQ ID NO: 29011 - DNA, 25 bp, Mus musculus
aacagcttcagaatcttcagcacca

SEQ ID NO: 29012 - DNA, 25 bp, Mus musculus
aacagcttcagattcttcagcacca

SEQ ID NO: 29013 - DNA, 25 bp, Mus musculus
aacagcttcagcctcatgagaatgg

SEQ ID NO: 29014 - DNA, 25 bp, Mus musculus
aacagcttcagcgtcatgagaatgg

SEQ ID NO: 29015 - DNA, 25 bp, Mus musculus
aacagcttccatcagacctatgaga

SEQ ID NO: 29016 - DNA, 25 bp, Mus musculus
aacagcttccatgagacctatgaga

SEQ ID NO: 29017 - DNA, 25 bp, Mus musculus
aacagcttcctgagtcagcctatat

SEQ ID NO: 29018 - DNA, 25 bp, Mus musculus
aacagcttcctgtgtcagcctatat

SEQ ID NO: 29019 - DNA, 25 bp, Mus musculus
aacagcttcggtatgtgatggaact

SEQ ID NO: 29020 - DNA, 25 bp, Mus musculus
aacagcttcggtttgtgatggaact

SEQ ID NO: 29021 - DNA, 25 bp, Mus musculus
aacagcttcgtacatatacccagga

SEQ ID NO: 29022 - DNA, 25 bp, Mus musculus
aacagcttcgtacatttgacaggag

SEQ ID NO: 29023 - DNA, 25 bp, Mus musculus
aacagcttcgtagatatacccagga

SEQ ID NO: 29024 - DNA, 25 bp, Mus musculus
aacagcttcgtagatttgacaggag

SEQ ID NO: 29025 - DNA, 25 bp, Mus musculus
aacagcttcgtgaccttgtttgagc

SEQ ID NO: 29026 - DNA, 25 bp, Mus musculus
aacagcttcgtgtccttgtttgagc

SEQ ID NO: 29027 - DNA, 25 bp, Mus musculus
aacagcttctgacgtgggtgacact

SEQ ID NO: 29028 - DNA, 25 bp, Mus musculus
aacagcttctgaggtgggtgacact

SEQ ID NO: 29029 - DNA, 25 bp, Mus musculus
aacagcttcttgcatagatgtgact

SEQ ID NO: 29030 - DNA, 25 bp, Mus musculus
aacagcttcttggatagatgtgact

SEQ ID NO: 29031 - DNA, 25 bp, Mus musculus
aacagcttgagcaagggtttggcta

SEQ ID NO: 29032 - DNA, 25 bp, Mus musculus
aacagcttgagctagggtttggcta

SEQ ID NO: 29033 - DNA, 25 bp, Mus musculus
aacagcttgccgcaggacgaccaga

SEQ ID NO: 29034 - DNA, 25 bp, Mus musculus
aacagcttgccggaggacgaccaga

SEQ ID NO: 29035 - DNA, 25 bp, Mus musculus
aacagcttgcggatgggcctttcca

SEQ ID NO: 29036 - DNA, 25 bp, Mus musculus
aacagcttgcggttgggcctttcca

SEQ ID NO: 29037 - DNA, 25 bp, Mus musculus
aacagcttgctacagaagttccact

SEQ ID NO: 29038 - DNA, 25 bp, Mus musculus
aacagcttgctagagaagttccact

SEQ ID NO: 29039 - DNA, 25 bp, Mus musculus
aacagcttgggtatgacttctttga

SEQ ID NO: 29040 - DNA, 25 bp, Mus musculus
aacagcttgggtttgacttctttga

SEQ ID NO: 29041 - DNA, 25 bp, Mus musculus
aacagcttgtgtatgcttggcacat

SEQ ID NO: 29042 - DNA, 25 bp, Mus musculus
aacagcttgtgtttgcttggcacat

SEQ ID NO: 29043 - DNA, 25 bp, Mus musculus
aacagctttaatccccaatttccct

SEQ ID NO: 29044 - DNA, 25 bp, Mus musculus
aacagctttaatgcccaatttccct

SEQ ID NO: 29045 - DNA, 25 bp, Mus musculus
aacagctttcacaatgtattgtcta

SEQ ID NO: 29046 - DNA, 25 bp, Mus musculus
aacagctttcaccagcagtcagaag

SEQ ID NO: 29047 - DNA, 25 bp, Mus musculus
aacagctttcacgagcagtcagaag

SEQ ID NO: 29048 - DNA, 25 bp, Mus musculus
aacagctttcactatgtattgtcta

SEQ ID NO: 29049 - DNA, 25 bp, Mus musculus
aacagctttcctagcaagaagtgcc

SEQ ID NO: 29050 - DNA, 25 bp, Mus musculus
aacagctttccttgcaagaagtgcc

SEQ ID NO: 29051 - DNA, 25 bp, Mus musculus
aacagctttctgctgcatcccgagt

SEQ ID NO: 29052 - DNA, 25 bp, Mus musculus
aacagctttctggtgcatcccgagt

SEQ ID NO: 29053 - DNA, 25 bp, Mus musculus
aacagctttgaaaaactccatagtg

SEQ ID NO: 29054 - DNA, 25 bp, Mus musculus
aacagctttgaataactccatagtg

SEQ ID NO: 29055 - DNA, 25 bp, Mus musculus
aacagcttttataagtgactctctt

SEQ ID NO: 29056 - DNA, 25 bp, Mus musculus
aacagcttttattagtgactctctt

SEQ ID NO: 29057 - DNA, 25 bp, Mus musculus
aacagcttttctcgagtgaccgtct

SEQ ID NO: 29058 - DNA, 25 bp, Mus musculus
aacagcttttctggagtgaccgtct

SEQ ID NO: 29059 - DNA, 25 bp, Mus musculus
aacaggaaacgcactctggcgccat

SEQ ID NO: 29060 - DNA, 25 bp, Mus musculus
aacaggaaacgctctctggcgccat

SEQ ID NO: 29061 - DNA, 25 bp, Mus musculus
aacaggaaacttctatgcttctata

SEQ ID NO: 29062 - DNA, 25 bp, Mus musculus
aacaggaaacttgtatgcttctata

SEQ ID NO: 29063 - DNA, 25 bp, Mus musculus
aacaggaaatacatagtgactgcca

SEQ ID NO: 29064 - DNA, 25 bp, Mus musculus
aacaggaaatacttagtgactgcca

SEQ ID NO: 29065 - DNA, 25 bp, Mus musculus
aacaggaacatgaattttacaagtg

SEQ ID NO: 29066 - DNA, 25 bp, Mus musculus
aacaggaacatgtattttacaagtg

SEQ ID NO: 29067 - DNA, 25 bp, Mus musculus
aacaggaagccaagggtctcagaaa

SEQ ID NO: 29068 - DNA, 25 bp, Mus musculus
aacaggaagccatgggtctcagaaa

SEQ ID NO: 29069 - DNA, 25 bp, Mus musculus
aacaggaagcccattctagcacagg

SEQ ID NO: 29070 - DNA, 25 bp, Mus musculus
aacaggaagccctttctagcacagg

SEQ ID NO: 29071 - DNA, 25 bp, Mus musculus
aacaggaagccgcatggttcgcaga

SEQ ID NO: 29072 - DNA, 25 bp, Mus musculus
aacaggaagccggatggttcgcaga

SEQ ID NO: 29073 - DNA, 25 bp, Mus musculus
aacaggaagctcatgagacactgag

SEQ ID NO: 29074 - DNA, 25 bp, Mus musculus
aacaggaagctcttgagacactgag

SEQ ID NO: 29075 - DNA, 25 bp, Mus musculus
aacaggaagggaagcaacggaatct

SEQ ID NO: 29076 - DNA, 25 bp, Mus musculus
aacaggaagggatgcaacggaatct

SEQ ID NO: 29077 - DNA, 25 bp, Mus musculus
aacaggaatatacgccctcctagtc

SEQ ID NO: 29078 - DNA, 25 bp, Mus musculus
aacaggaatataggccctcctagtc

SEQ ID NO: 29079 - DNA, 25 bp, Mus musculus
aacaggacacgaaagcccattgaga

SEQ ID NO: 29080 - DNA, 25 bp, Mus musculus
aacaggacacgatagcccattgaga

SEQ ID NO: 29081 - DNA, 25 bp, Mus musculus
aacaggacagagcatctaacagaca

SEQ ID NO: 29082 - DNA, 25 bp, Mus musculus
aacaggacagaggatctaacagaca

SEQ ID NO: 29083 - DNA, 25 bp, Mus musculus
aacaggacagctctgtgtagtgcta

SEQ ID NO: 29084 - DNA, 25 bp, Mus musculus
aacaggacagctgtgtgtagtgcta

SEQ ID NO: 29085 - DNA, 25 bp, Mus musculus
aacaggacatctcagccaacagcca

SEQ ID NO: 29086 - DNA, 25 bp, Mus musculus
aacaggacatctgagccaacagcca

SEQ ID NO: 29087 - DNA, 25 bp, Mus musculus
aacaggacccagctctcaggtgtgc

SEQ ID NO: 29088 - DNA, 25 bp, Mus musculus
aacaggacccaggtctcaggtgtgc

SEQ ID NO: 29089 - DNA, 25 bp, Mus musculus
aacaggacctacatcagagcccgag

SEQ ID NO: 29090 - DNA, 25 bp, Mus musculus
aacaggacctacttcagagcccgag

SEQ ID NO: 29091 - DNA, 25 bp, Mus musculus
aacaggacctggcacacacacggaa

SEQ ID NO: 29092 - DNA, 25 bp, Mus musculus
aacaggacctgggacacacacggaa

SEQ ID NO: 29093 - DNA, 25 bp, Mus musculus
aacaggacgactcgacctttcacta

SEQ ID NO: 29094 - DNA, 25 bp, Mus musculus
aacaggacgactggacctttcacta

SEQ ID NO: 29095 - DNA, 25 bp, Mus musculus
aacaggactattaccgtcgtgactc

SEQ ID NO: 29096 - DNA, 25 bp, Mus musculus
aacaggactatttccgtcgtgactc

SEQ ID NO: 29097 - DNA, 25 bp, Mus musculus
aacaggactcggaggagtgcgctac

SEQ ID NO: 29098 - DNA, 25 bp, Mus musculus
aacaggactcggtggagtgcgctac

SEQ ID NO: 29099 - DNA, 25 bp, Mus musculus
aacaggactgaaattgtaaatactt

SEQ ID NO: 29100 - DNA, 25 bp, Mus musculus
aacaggactgaatttgtaaatactt

SEQ ID NO: 29101 - DNA, 25 bp, Mus musculus
aacaggactgcgctgcttggaaaaa

SEQ ID NO: 29102 - DNA, 25 bp, Mus musculus
aacaggactgcggtgcttggaaaaa

SEQ ID NO: 29103 - DNA, 25 bp, Mus musculus
aacaggactgttatcgtcttctcag

SEQ ID NO: 29104 - DNA, 25 bp, Mus musculus
aacaggactgttttcgtcttctcag

SEQ ID NO: 29105 - DNA, 25 bp, Mus musculus
aacaggagacacaagcttgctaata

SEQ ID NO: 29106 - DNA, 25 bp, Mus musculus
aacaggagacactagcttgctaata

SEQ ID NO: 29107 - DNA, 25 bp, Mus musculus
aacaggagattgagagcaacccgat

SEQ ID NO: 29108 - DNA, 25 bp, Mus musculus
aacaggagattgtgagcaacccgat

SEQ ID NO: 29109 - DNA, 25 bp, Mus musculus
aacaggagcatgctgccctattgct

SEQ ID NO: 29110 - DNA, 25 bp, Mus musculus
aacaggagcatggtgccctattgct

SEQ ID NO: 29111 - DNA, 25 bp, Mus musculus
aacaggagcgtgacgggacgtctca

SEQ ID NO: 29112 - DNA, 25 bp, Mus musculus
aacaggagcgtgtcgggacgtctca

SEQ ID NO: 29113 - DNA, 25 bp, Mus musculus
aacaggagctgtacgcaggcatttt

SEQ ID NO: 29114 - DNA, 25 bp, Mus musculus
aacaggagctgttcgcaggcatttt

SEQ ID NO: 29115 - DNA, 25 bp, Mus musculus
aacaggaggcggatcttcgcaatgc

SEQ ID NO: 29116 - DNA, 25 bp, Mus musculus
aacaggaggcggttcttcgcaatgc

SEQ ID NO: 29117 - DNA, 25 bp, Mus musculus
aacaggaggctcagttatgtggctg

SEQ ID NO: 29118 - DNA, 25 bp, Mus musculus
aacaggaggctctgttatgtggctg

SEQ ID NO: 29119 - DNA, 25 bp, Mus musculus
aacaggagggctagggacttgctca

SEQ ID NO: 29120 - DNA, 25 bp, Mus musculus
aacaggagggcttgggacttgctca

SEQ ID NO: 29121 - DNA, 25 bp, Mus musculus
aacaggagtctcctggacaggaaaa

SEQ ID NO: 29122 - DNA, 25 bp, Mus musculus
aacaggagtctcgtggacaggaaaa

SEQ ID NO: 29123 - DNA, 25 bp, Mus musculus
aacaggagtctgactgcaagcctca

SEQ ID NO: 29124 - DNA, 25 bp, Mus musculus
aacaggagtctgtctgcaagcctca

SEQ ID NO: 29125 - DNA, 25 bp, Mus musculus
aacaggataatcatccagttccaag

SEQ ID NO: 29126 - DNA, 25 bp, Mus musculus
aacaggataatcttccagttccaag

SEQ ID NO: 29127 - DNA, 25 bp, Mus musculus
aacaggatacctccagccatgggtt

SEQ ID NO: 29128 - DNA, 25 bp, Mus musculus
aacaggatacctgcagccatgggtt

SEQ ID NO: 29129 - DNA, 25 bp, Mus musculus
aacaggatactaaccacatgtacaa

SEQ ID NO: 29130 - DNA, 25 bp, Mus musculus
aacaggatactatccacatgtacaa

SEQ ID NO: 29131 - DNA, 25 bp, Mus musculus
aacaggatacttacacagatgtgcc

SEQ ID NO: 29132 - DNA, 25 bp, Mus musculus
aacaggatactttcacagatgtgcc

SEQ ID NO: 29133 - DNA, 25 bp, Mus musculus
aacaggataggacctttgccatata

SEQ ID NO: 29134 - DNA, 25 bp, Mus musculus
aacaggataggagctttgccatata

SEQ ID NO: 29135 - DNA, 25 bp, Mus musculus
aacaggatatccactgcaggtgttt

SEQ ID NO: 29136 - DNA, 25 bp, Mus musculus
aacaggatatcctctgcaggtgttt

SEQ ID NO: 29137 - DNA, 25 bp, Mus musculus
aacaggatcaacatgcaggcactca

SEQ ID NO: 29138 - DNA, 25 bp, Mus musculus
aacaggatcaacttgcaggcactca

SEQ ID NO: 29139 - DNA, 25 bp, Mus musculus
aacaggatcacaactctgagcgcgt

SEQ ID NO: 29140 - DNA, 25 bp, Mus musculus
aacaggatcacatctctgagcgcgt

SEQ ID NO: 29141 - DNA, 25 bp, Mus musculus
aacaggatccttaggtgatcgccct

SEQ ID NO: 29142 - DNA, 25 bp, Mus musculus
aacaggatcctttggtgatcgccct

SEQ ID NO: 29143 - DNA, 25 bp, Mus musculus
aacaggatctgtacatgtatagcta

SEQ ID NO: 29144 - DNA, 25 bp, Mus musculus
aacaggatctgttcatgtatagcta

SEQ ID NO: 29145 - DNA, 25 bp, Mus musculus
aacaggatgagaagccggagcattc

SEQ ID NO: 29146 - DNA, 25 bp, Mus musculus
aacaggatgagatgccggagcattc

SEQ ID NO: 29147 - DNA, 25 bp, Mus musculus
aacaggatgccgatgactgtgccac

SEQ ID NO: 29148 - DNA, 25 bp, Mus musculus
aacaggatgccgttgactgtgccac

SEQ ID NO: 29149 - DNA, 25 bp, Mus musculus
aacaggatgcggcacccagaacgta

SEQ ID NO: 29150 - DNA, 25 bp, Mus musculus
aacaggatgcgggacccagaacgta

SEQ ID NO: 29151 - DNA, 25 bp, Mus musculus
aacaggatgtccaaacgagcagacg

SEQ ID NO: 29152 - DNA, 25 bp, Mus musculus
aacaggatgtcctaacgagcagacg

SEQ ID NO: 29153 - DNA, 25 bp, Mus musculus
aacaggatgtctagtgtatctgaga

SEQ ID NO: 29154 - DNA, 25 bp, Mus musculus
aacaggatgtcttgtgtatctgaga

SEQ ID NO: 29155 - DNA, 25 bp, Mus musculus
aacaggatgtttcagacaagctcat

SEQ ID NO: 29156 - DNA, 25 bp, Mus musculus
aacaggatgtttgagacaagctcat

SEQ ID NO: 29157 - DNA, 25 bp, Mus musculus
aacaggattccacgtacaagagctt

SEQ ID NO: 29158 - DNA, 25 bp, Mus musculus
aacaggattccaggtacaagagctt

SEQ ID NO: 29159 - DNA, 25 bp, Mus musculus
aacaggattgaaccgcttctaacaa

SEQ ID NO: 29160 - DNA, 25 bp, Mus musculus
aacaggattgaagcgcttctaacaa

SEQ ID NO: 29161 - DNA, 25 bp, Mus musculus
aacaggatttccctgacatgcctac

SEQ ID NO: 29162 - DNA, 25 bp, Mus musculus
aacaggatttccgtgacatgcctac

SEQ ID NO: 29163 - DNA, 25 bp, Mus musculus
aacaggcacctcacagaagtagatt

SEQ ID NO: 29164 - DNA, 25 bp, Mus musculus
aacaggcacctctcagaagtagatt

SEQ ID NO: 29165 - DNA, 25 bp, Mus musculus
aacaggcactgtatgggagccaaca

SEQ ID NO: 29166 - DNA, 25 bp, Mus musculus
aacaggcactgtttgggagccaaca

SEQ ID NO: 29167 - DNA, 25 bp, Mus musculus
aacaggcagaccatgatcctggaaa

SEQ ID NO: 29168 - DNA, 25 bp, Mus musculus
aacaggcagaccttgatcctggaaa

SEQ ID NO: 29169 - DNA, 25 bp, Mus musculus
aacaggcagactatatgttcgttta

SEQ ID NO: 29170 - DNA, 25 bp, Mus musculus
aacaggcagactttatgttcgttta

SEQ ID NO: 29171 - DNA, 25 bp, Mus musculus
aacaggcagagaacttgcagcgcaa

SEQ ID NO: 29172 - DNA, 25 bp, Mus musculus
aacaggcagagatcttgcagcgcaa

SEQ ID NO: 29173 - DNA, 25 bp, Mus musculus
aacaggcagcctcgtctctgtgagt

SEQ ID NO: 29174 - DNA, 25 bp, Mus musculus
aacaggcagcctggtctctgtgagt

SEQ ID NO: 29175 - DNA, 25 bp, Mus musculus
aacaggcagcttcagcggacagtct

SEQ ID NO: 29176 - DNA, 25 bp, Mus musculus
aacaggcagcttgagcggacagtct

SEQ ID NO: 29177 - DNA, 25 bp, Mus musculus
aacaggcataaacctctccgggtga

SEQ ID NO: 29178 - DNA, 25 bp, Mus musculus
aacaggcataaagctctccgggtga

SEQ ID NO: 29179 - DNA, 25 bp, Mus musculus
aacaggcatcatattttgaactcag

SEQ ID NO: 29180 - DNA, 25 bp, Mus musculus
aacaggcatcattttttgaactcag

SEQ ID NO: 29181 - DNA, 25 bp, Mus musculus
aacaggcatggcagtaagctcccat

SEQ ID NO: 29182 - DNA, 25 bp, Mus musculus
aacaggcatggctgtaagctcccat

SEQ ID NO: 29183 - DNA, 25 bp, Mus musculus
aacaggcattgcaacgggatcgaca

SEQ ID NO: 29184 - DNA, 25 bp, Mus musculus
aacaggcattgctacgggatcgaca

SEQ ID NO: 29185 - DNA, 25 bp, Mus musculus
aacaggcattgtaccagactcatcc

SEQ ID NO: 29186 - DNA, 25 bp, Mus musculus
aacaggcattgttccagactcatcc

SEQ ID NO: 29187 - DNA, 25 bp, Mus musculus
aacaggcattttcctacctggcttt

SEQ ID NO: 29188 - DNA, 25 bp, Mus musculus
aacaggcattttgctacctggcttt

SEQ ID NO: 29189 - DNA, 25 bp, Mus musculus
aacaggccaaaactcttttcacatt

SEQ ID NO: 29190 - DNA, 25 bp, Mus musculus
aacaggccaaaagtcttttcacatt

SEQ ID NO: 29191 - DNA, 25 bp, Mus musculus
aacaggccaaacatatttgcaagtg

SEQ ID NO: 29192 - DNA, 25 bp, Mus musculus
aacaggccaaacttatttgcaagtg

SEQ ID NO: 29193 - DNA, 25 bp, Mus musculus
aacaggccacacatgccaatgtctg

SEQ ID NO: 29194 - DNA, 25 bp, Mus musculus
aacaggccacacttgccaatgtctg

SEQ ID NO: 29195 - DNA, 25 bp, Mus musculus
aacaggccacagacaaattgctgta

SEQ ID NO: 29196 - DNA, 25 bp, Mus musculus
aacaggccacagtcaaattgctgta

SEQ ID NO: 29197 - DNA, 25 bp, Mus musculus
aacaggccacatcctcatgaagtga

SEQ ID NO: 29198 - DNA, 25 bp, Mus musculus
aacaggccacatgctcatgaagtga

SEQ ID NO: 29199 - DNA, 25 bp, Mus musculus
aacaggccactgctgtgtatataaa

SEQ ID NO: 29200 - DNA, 25 bp, Mus musculus
aacaggccactggtgtgtatataaa

SEQ ID NO: 29201 - DNA, 25 bp, Mus musculus
aacaggccagtgcagacttcgctga

SEQ ID NO: 29202 - DNA, 25 bp, Mus musculus
aacaggccagtggagacttcgctga

SEQ ID NO: 29203 - DNA, 25 bp, Mus musculus
aacaggccatttccgaagacacact

SEQ ID NO: 29204 - DNA, 25 bp, Mus musculus
aacaggccatttgcgaagacacact

SEQ ID NO: 29205 - DNA, 25 bp, Mus musculus
aacaggccctataccatgcggtaaa

SEQ ID NO: 29206 - DNA, 25 bp, Mus musculus
aacaggccctattccatgcggtaaa

SEQ ID NO: 29207 - DNA, 25 bp, Mus musculus
aacaggccctggctgttttctcggg

SEQ ID NO: 29208 - DNA, 25 bp, Mus musculus
aacaggccctgggtgttttctcggg

SEQ ID NO: 29209 - DNA, 25 bp, Mus musculus
aacaggccgttgagctcggaggcaa

SEQ ID NO: 29210 - DNA, 25 bp, Mus musculus
aacaggccgttgtgctcggaggcaa

SEQ ID NO: 29211 - DNA, 25 bp, Mus musculus
aacaggcctcaactgatacaagaag

SEQ ID NO: 29212 - DNA, 25 bp, Mus musculus
aacaggcctcaagtgatacaagaag

SEQ ID NO: 29213 - DNA, 25 bp, Mus musculus
aacaggcctctgacataggcattat

SEQ ID NO: 29214 - DNA, 25 bp, Mus musculus
aacaggcctctgtcataggcattat

SEQ ID NO: 29215 - DNA, 25 bp, Mus musculus
aacaggcctggcattgttggttcta

SEQ ID NO: 29216 - DNA, 25 bp, Mus musculus
aacaggcctggctttgttggttcta

SEQ ID NO: 29217 - DNA, 25 bp, Mus musculus
aacaggcctgtcaaactctgggaga

SEQ ID NO: 29218 - DNA, 25 bp, Mus musculus
aacaggcctgtctaactctgggaga

SEQ ID NO: 29219 - DNA, 25 bp, Mus musculus
aacaggccttgtctatgggatccta

SEQ ID NO: 29220 - DNA, 25 bp, Mus musculus
aacaggccttgtgtatgggatccta

SEQ ID NO: 29221 - DNA, 25 bp, Mus musculus
aacaggcctttaactgcttggcagt

SEQ ID NO: 29222 - DNA, 25 bp, Mus musculus
aacaggcctttatctgcttggcagt

SEQ ID NO: 29223 - DNA, 25 bp, Mus musculus
aacaggcgcagaagcgttagctcca

SEQ ID NO: 29224 - DNA, 25 bp, Mus musculus
aacaggcgcagatgcgttagctcca

SEQ ID NO: 29225 - DNA, 25 bp, Mus musculus
aacaggcgctacagaggcagcggta

SEQ ID NO: 29226 - DNA, 25 bp, Mus musculus
aacaggcgctactgaggcagcggta

SEQ ID NO: 29227 - DNA, 25 bp, Mus musculus
aacaggcgttgtcaaatgcatttgc

SEQ ID NO: 29228 - DNA, 25 bp, Mus musculus
aacaggcgttgtgaaatgcatttgc

SEQ ID NO: 29229 - DNA, 25 bp, Mus musculus
aacaggctacgtagttgctcttctt

SEQ ID NO: 29230 - DNA, 25 bp, Mus musculus
aacaggctacgttgttgctcttctt

SEQ ID NO: 29231 - DNA, 25 bp, Mus musculus
aacaggctagcacagatccacggtg

SEQ ID NO: 29232 - DNA, 25 bp, Mus musculus
aacaggctagcagagatccacggtg

SEQ ID NO: 29233 - DNA, 25 bp, Mus musculus
aacaggctagcccttctttatttag

SEQ ID NO: 29234 - DNA, 25 bp, Mus musculus
aacaggctagccgttctttatttag

SEQ ID NO: 29235 - DNA, 25 bp, Mus musculus
aacaggctagtccataacgctgctc

SEQ ID NO: 29236 - DNA, 25 bp, Mus musculus
aacaggctagtcgataacgctgctc

SEQ ID NO: 29237 - DNA, 25 bp, Mus musculus
aacaggctagtgcttcgggtgactc

SEQ ID NO: 29238 - DNA, 25 bp, Mus musculus
aacaggctagtggttcgggtgactc

SEQ ID NO: 29239 - DNA, 25 bp, Mus musculus
aacaggctatccctgtgcggcagca

SEQ ID NO: 29240 - DNA, 25 bp, Mus musculus
aacaggctatccgtgtgcggcagca

SEQ ID NO: 29241 - DNA, 25 bp, Mus musculus
aacaggctcaagacatcaaccagga

SEQ ID NO: 29242 - DNA, 25 bp, Mus musculus
aacaggctcaagagtgtactcaggt

SEQ ID NO: 29243 - DNA, 25 bp, Mus musculus
aacaggctcaagtcatcaaccagga

SEQ ID NO: 29244 - DNA, 25 bp, Mus musculus
aacaggctcaagtgtgtactcaggt

SEQ ID NO: 29245 - DNA, 25 bp, Mus musculus
aacaggctcatgagcggaagcccgt

SEQ ID NO: 29246 - DNA, 25 bp, Mus musculus
aacaggctcatgtgcggaagcccgt

SEQ ID NO: 29247 - DNA, 25 bp, Mus musculus
aacaggctccagacaacgagatatc

SEQ ID NO: 29248 - DNA, 25 bp, Mus musculus
aacaggctccagtcaacgagatatc

SEQ ID NO: 29249 - DNA, 25 bp, Mus musculus
aacaggctgatgcaggcagcctaac

SEQ ID NO: 29250 - DNA, 25 bp, Mus musculus
aacaggctgatggaggcagcctaac

SEQ ID NO: 29251 - DNA, 25 bp, Mus musculus
aacaggctgcataggtctcaagaaa

SEQ ID NO: 29252 - DNA, 25 bp, Mus musculus
aacaggctgcattggtctcaagaaa

SEQ ID NO: 29253 - DNA, 25 bp, Mus musculus
aacaggctgcctaccgggactttga

SEQ ID NO: 29254 - DNA, 25 bp, Mus musculus
aacaggctgccttccgggactttga

SEQ ID NO: 29255 - DNA, 25 bp, Mus musculus
aacaggctgctcatgactttcttta

SEQ ID NO: 29256 - DNA, 25 bp, Mus musculus
aacaggctgctcttgactttcttta

SEQ ID NO: 29257 - DNA, 25 bp, Mus musculus
aacaggctgggaaaactctcaggaa

SEQ ID NO: 29258 - DNA, 25 bp, Mus musculus
aacaggctgggaatcctttcagggt

SEQ ID NO: 29259 - DNA, 25 bp, Mus musculus
aacaggctgggataactctcaggaa

SEQ ID NO: 29260 - DNA, 25 bp, Mus musculus
aacaggctgggattcctttcagggt

SEQ ID NO: 29261 - DNA, 25 bp, Mus musculus
aacaggctggttaattctggtataa

SEQ ID NO: 29262 - DNA, 25 bp, Mus musculus
aacaggctggttcgcgatcacatcg

SEQ ID NO: 29263 - DNA, 25 bp, Mus musculus
aacaggctggttggcgatcacatcg

SEQ ID NO: 29264 - DNA, 25 bp, Mus musculus
aacaggctggtttattctggtataa

SEQ ID NO: 29265 - DNA, 25 bp, Mus musculus
aacaggctgtgacatactcttccaa

SEQ ID NO: 29266 - DNA, 25 bp, Mus musculus
aacaggctgtgagatactcttccaa

SEQ ID NO: 29267 - DNA, 25 bp, Mus musculus
aacaggctgtgcacgctggtgtcca

SEQ ID NO: 29268 - DNA, 25 bp, Mus musculus
aacaggctgtgctcgctggtgtcca

SEQ ID NO: 29269 - DNA, 25 bp, Mus musculus
aacaggctgttcatttctattggca

SEQ ID NO: 29270 - DNA, 25 bp, Mus musculus
aacaggctgttcttttctattggca

SEQ ID NO: 29271 - DNA, 25 bp, Mus musculus
aacaggcttatcagagtcacacact

SEQ ID NO: 29272 - DNA, 25 bp, Mus musculus
aacaggcttatctgagtcacacact

SEQ ID NO: 29273 - DNA, 25 bp, Mus musculus
aacaggcttcaactgtatccttaaa

SEQ ID NO: 29274 - DNA, 25 bp, Mus musculus
aacaggcttcaagtgtatccttaaa

SEQ ID NO: 29275 - DNA, 25 bp, Mus musculus
aacaggcttgccatgtacggtcatg

SEQ ID NO: 29276 - DNA, 25 bp, Mus musculus
aacaggcttgccttgtacggtcatg

SEQ ID NO: 29277 - DNA, 25 bp, Mus musculus
aacaggctttggatctctcagggaa

SEQ ID NO: 29278 - DNA, 25 bp, Mus musculus
aacaggctttggttctctcagggaa

SEQ ID NO: 29279 - DNA, 25 bp, Mus musculus
aacaggcttttcaagagaaactagt

SEQ ID NO: 29280 - DNA, 25 bp, Mus musculus
aacaggcttttcattgattatccag

SEQ ID NO: 29281 - DNA, 25 bp, Mus musculus
aacaggcttttctagagaaactagt

SEQ ID NO: 29282 - DNA, 25 bp, Mus musculus
aacaggcttttctttgattatccag

SEQ ID NO: 29283 - DNA, 25 bp, Mus musculus
aacaggcttttgctttgggctctgc

SEQ ID NO: 29284 - DNA, 25 bp, Mus musculus
aacaggcttttggtttgggctctgc

SEQ ID NO: 29285 - DNA, 25 bp, Mus musculus
aacagggaagcaacctactcgggat

SEQ ID NO: 29286 - DNA, 25 bp, Mus musculus
aacagggaagcatcctactcgggat

SEQ ID NO: 29287 - DNA, 25 bp, Mus musculus
aacagggacagaacactccgcagtg

SEQ ID NO: 29288 - DNA, 25 bp, Mus musculus
aacagggacagatcactccgcagtg

SEQ ID NO: 29289 - DNA, 25 bp, Mus musculus
aacagggacagtagggtctcctaag

SEQ ID NO: 29290 - DNA, 25 bp, Mus musculus
aacagggacagttgggtctcctaag

SEQ ID NO: 29291 - DNA, 25 bp, Mus musculus
aacagggacatgaggtgcaccgcct

SEQ ID NO: 29292 - DNA, 25 bp, Mus musculus
aacagggacatgtggtgcaccgcct

SEQ ID NO: 29293 - DNA, 25 bp, Mus musculus
aacagggacccaaggttctcttctg

SEQ ID NO: 29294 - DNA, 25 bp, Mus musculus
aacagggacccatggttctcttctg

SEQ ID NO: 29295 - DNA, 25 bp, Mus musculus
aacagggaccctcgtagaacattct

SEQ ID NO: 29296 - DNA, 25 bp, Mus musculus
aacagggaccctggtagaacattct

SEQ ID NO: 29297 - DNA, 25 bp, Mus musculus
aacagggacctgatcgacttctcca

SEQ ID NO: 29298 - DNA, 25 bp, Mus musculus
aacagggacctgttcgacttctcca

SEQ ID NO: 29299 - DNA, 25 bp, Mus musculus
aacagggactaactgcccttgcaga

SEQ ID NO: 29300 - DNA, 25 bp, Mus musculus
aacagggactaagtgcccttgcaga

SEQ ID NO: 29301 - DNA, 25 bp, Mus musculus
aacagggagagacctacaggagccc

SEQ ID NO: 29302 - DNA, 25 bp, Mus musculus
aacagggagagagctacaggagccc

SEQ ID NO: 29303 - DNA, 25 bp, Mus musculus
aacagggagcatcttaatcctttct

SEQ ID NO: 29304 - DNA, 25 bp, Mus musculus
aacagggagcatgttaatcctttct

SEQ ID NO: 29305 - DNA, 25 bp, Mus musculus
aacagggagctcctgaatgacctta

SEQ ID NO: 29306 - DNA, 25 bp, Mus musculus
aacagggagctcgtgaatgacctta

SEQ ID NO: 29307 - DNA, 25 bp, Mus musculus
aacagggaggctcgcataggcctca

SEQ ID NO: 29308 - DNA, 25 bp, Mus musculus
aacagggaggctggcataggcctca

SEQ ID NO: 29309 - DNA, 25 bp, Mus musculus
aacagggatctgctagcatccttca

SEQ ID NO: 29310 - DNA, 25 bp, Mus musculus
aacagggatctggtagcatccttca

SEQ ID NO: 29311 - DNA, 25 bp, Mus musculus
aacagggatgtcactttgagtgact

SEQ ID NO: 29312 - DNA, 25 bp, Mus musculus
aacagggatgtctctttgagtgact

SEQ ID NO: 29313 - DNA, 25 bp, Mus musculus
aacagggattgcagggagtctgcca

SEQ ID NO: 29314 - DNA, 25 bp, Mus musculus
aacagggattgctgggagtctgcca

SEQ ID NO: 29315 - DNA, 25 bp, Mus musculus
aacagggcacctctgatgtccatgt

SEQ ID NO: 29316 - DNA, 25 bp, Mus musculus
aacagggcacctgtgatgtccatgt

SEQ ID NO: 29317 - DNA, 25 bp, Mus musculus
aacagggcagacacagcagagcaat

SEQ ID NO: 29318 - DNA, 25 bp, Mus musculus
aacagggcagactcagcagagcaat

SEQ ID NO: 29319 - DNA, 25 bp, Mus musculus
aacagggcagggacgatcaagtcag

SEQ ID NO: 29320 - DNA, 25 bp, Mus musculus
aacagggcagggtcgatcaagtcag

SEQ ID NO: 29321 - DNA, 25 bp, Mus musculus
aacagggcagttcaggcattgagat

SEQ ID NO: 29322 - DNA, 25 bp, Mus musculus
aacagggcagttgaggcattgagat

SEQ ID NO: 29323 - DNA, 25 bp, Mus musculus
aacagggcatcgcaagaggcttttg

SEQ ID NO: 29324 - DNA, 25 bp, Mus musculus
aacagggcatcggaagaggcttttg

SEQ ID NO: 29325 - DNA, 25 bp, Mus musculus
aacagggcatgtatgtaacaatttg

SEQ ID NO: 29326 - DNA, 25 bp, Mus musculus
aacagggcatgtttgtaacaatttg

SEQ ID NO: 29327 - DNA, 25 bp, Mus musculus
aacagggccaaaacagaggtacata

SEQ ID NO: 29328 - DNA, 25 bp, Mus musculus
aacagggccaaatcagaggtacata

SEQ ID NO: 29329 - DNA, 25 bp, Mus musculus
aacagggccacactggttgttgcta

SEQ ID NO: 29330 - DNA, 25 bp, Mus musculus
aacagggccacagtggttgttgcta

SEQ ID NO: 29331 - DNA, 25 bp, Mus musculus
aacagggccaccaagaggctctgaa

SEQ ID NO: 29332 - DNA, 25 bp, Mus musculus
aacagggccacctagaggctctgaa

SEQ ID NO: 29333 - DNA, 25 bp, Mus musculus
aacagggcctatcacagacagcatt

SEQ ID NO: 29334 - DNA, 25 bp, Mus musculus
aacagggcctatgacagacagcatt

SEQ ID NO: 29335 - DNA, 25 bp, Mus musculus
aacagggcctctacctttgctactt

SEQ ID NO: 29336 - DNA, 25 bp, Mus musculus
aacagggcctcttcctttgctactt

SEQ ID NO: 29337 - DNA, 25 bp, Mus musculus
aacagggccttaagcaggttatgca

SEQ ID NO: 29338 - DNA, 25 bp, Mus musculus
aacagggccttatgcaggttatgca

SEQ ID NO: 29339 - DNA, 25 bp, Mus musculus
aacagggcgcaaagtctgcagagga

SEQ ID NO: 29340 - DNA, 25 bp, Mus musculus
aacagggcgcaatgtctgcagagga

SEQ ID NO: 29341 - DNA, 25 bp, Mus musculus
aacagggcgcttctgatcagcacaa

SEQ ID NO: 29342 - DNA, 25 bp, Mus musculus
aacagggcgcttgtgatcagcacaa

SEQ ID NO: 29343 - DNA, 25 bp, Mus musculus
aacagggctagacccaggaggccaa

SEQ ID NO: 29344 - DNA, 25 bp, Mus musculus
aacagggctagagccaggaggccaa

SEQ ID NO: 29345 - DNA, 25 bp, Mus musculus
aacagggctatgaggcctaccagaa

SEQ ID NO: 29346 - DNA, 25 bp, Mus musculus
aacagggctatgtggcctaccagaa

SEQ ID NO: 29347 - DNA, 25 bp, Mus musculus
aacagggctcaccagtcaagtgctt

SEQ ID NO: 29348 - DNA, 25 bp, Mus musculus
aacagggctcacgagtcaagtgctt

SEQ ID NO: 29349 - DNA, 25 bp, Mus musculus
aacagggctcctccgtacaggtcaa

SEQ ID NO: 29350 - DNA, 25 bp, Mus musculus
aacagggctcctgcgtacaggtcaa

SEQ ID NO: 29351 - DNA, 25 bp, Mus musculus
aacagggctcgactttggagcactt

SEQ ID NO: 29352 - DNA, 25 bp, Mus musculus
aacagggctcgagtttggagcactt

SEQ ID NO: 29353 - DNA, 25 bp, Mus musculus
aacagggctctccaattagcacagg

SEQ ID NO: 29354 - DNA, 25 bp, Mus musculus
aacagggctctcgaattagcacagg

SEQ ID NO: 29355 - DNA, 25 bp, Mus musculus
aacagggcttcacatacaaactgac

SEQ ID NO: 29356 - DNA, 25 bp, Mus musculus
aacagggcttcagatacaaactgac

SEQ ID NO: 29357 - DNA, 25 bp, Mus musculus
aacagggcttccatcctgtgacagt

SEQ ID NO: 29358 - DNA, 25 bp, Mus musculus
aacagggcttccttcctgtgacagt

SEQ ID NO: 29359 - DNA, 25 bp, Mus musculus
aacagggtatgtcgtcagcatgaac

SEQ ID NO: 29360 - DNA, 25 bp, Mus musculus
aacagggtatgtggtcagcatgaac

SEQ ID NO: 29361 - DNA, 25 bp, Mus musculus
aacagggtcaaccagcctgtggctg

SEQ ID NO: 29362 - DNA, 25 bp, Mus musculus
aacagggtcaacgagcctgtggctg

SEQ ID NO: 29363 - DNA, 25 bp, Mus musculus
aacagggtcaatagctaaaggagaa

SEQ ID NO: 29364 - DNA, 25 bp, Mus musculus
aacagggtcaattgctaaaggagaa

SEQ ID NO: 29365 - DNA, 25 bp, Mus musculus
aacagggtcacacctttcatcttga

SEQ ID NO: 29366 - DNA, 25 bp, Mus musculus
aacagggtcacagctttcatcttga

SEQ ID NO: 29367 - DNA, 25 bp, Mus musculus
aacagggtcagaatcatgaggctat

SEQ ID NO: 29368 - DNA, 25 bp, Mus musculus
aacagggtcagattcatgaggctat

SEQ ID NO: 29369 - DNA, 25 bp, Mus musculus
aacagggtccagcattcagcacaca

SEQ ID NO: 29370 - DNA, 25 bp, Mus musculus
aacagggtccaggattcagcacaca

SEQ ID NO: 29371 - DNA, 25 bp, Mus musculus
aacagggtccctaatgatcctggac

SEQ ID NO: 29372 - DNA, 25 bp, Mus musculus
aacagggtcccttatgatcctggac

SEQ ID NO: 29373 - DNA, 25 bp, Mus musculus
aacagggtcctgagcagttgcagtc

SEQ ID NO: 29374 - DNA, 25 bp, Mus musculus
aacagggtcctgtgcagttgcagtc

SEQ ID NO: 29375 - DNA, 25 bp, Mus musculus
aacagggtctcgctaattccagctg

SEQ ID NO: 29376 - DNA, 25 bp, Mus musculus
aacagggtctcggtaattccagctg

SEQ ID NO: 29377 - DNA, 25 bp, Mus musculus
aacagggtcttcacagtgtatgcaa

SEQ ID NO: 29378 - DNA, 25 bp, Mus musculus
aacagggtcttctcagtgtatgcaa

SEQ ID NO: 29379 - DNA, 25 bp, Mus musculus
aacagggtgaccatttgtcctctgc

SEQ ID NO: 29380 - DNA, 25 bp, Mus musculus
aacagggtgaccttttgtcctctgc

SEQ ID NO: 29381 - DNA, 25 bp, Mus musculus
aacagggtgaggacacgtggctcct

SEQ ID NO: 29382 - DNA, 25 bp, Mus musculus
aacagggtgaggtcacgtggctcct

SEQ ID NO: 29383 - DNA, 25 bp, Mus musculus
aacagggtgcacaatctcaagcggc

SEQ ID NO: 29384 - DNA, 25 bp, Mus musculus
aacagggtgcactatctcaagcggc

SEQ ID NO: 29385 - DNA, 25 bp, Mus musculus
aacagggtgctgaagttccggctga

SEQ ID NO: 29386 - DNA, 25 bp, Mus musculus
aacagggtgctgtagttccggctga

SEQ ID NO: 29387 - DNA, 25 bp, Mus musculus
aacagggtggacatcctggatccag

SEQ ID NO: 29388 - DNA, 25 bp, Mus musculus
aacagggtggacttcctggatccag

SEQ ID NO: 29389 - DNA, 25 bp, Mus musculus
aacagggtggttccatgcttaggat

SEQ ID NO: 29390 - DNA, 25 bp, Mus musculus
aacagggtggttgcatgcttaggat

SEQ ID NO: 29391 - DNA, 25 bp, Mus musculus
aacagggttgtcatcatatcataat

SEQ ID NO: 29392 - DNA, 25 bp, Mus musculus
aacagggttgtcttcatatcataat

SEQ ID NO: 29393 - DNA, 25 bp, Mus musculus
aacaggtaaggaccgtgctctggaa

SEQ ID NO: 29394 - DNA, 25 bp, Mus musculus
aacaggtaaggagcgtgctctggaa

SEQ ID NO: 29395 - DNA, 25 bp, Mus musculus
aacaggtacactactttgtggccat

SEQ ID NO: 29396 - DNA, 25 bp, Mus musculus
aacaggtacactaggcatggccggc

SEQ ID NO: 29397 - DNA, 25 bp, Mus musculus
aacaggtacacttctttgtggccat

SEQ ID NO: 29398 - DNA, 25 bp, Mus musculus
aacaggtacacttggcatggccggc

SEQ ID NO: 29399 - DNA, 25 bp, Mus musculus
aacaggtactctaacctctgagctg

SEQ ID NO: 29400 - DNA, 25 bp, Mus musculus
aacaggtactcttacctctgagctg

SEQ ID NO: 29401 - DNA, 25 bp, Mus musculus
aacaggtacttcaactatcccagga

SEQ ID NO: 29402 - DNA, 25 bp, Mus musculus
aacaggtacttctactatcccagga

SEQ ID NO: 29403 - DNA, 25 bp, Mus musculus
aacaggtagctgctttcgtgaagga

SEQ ID NO: 29404 - DNA, 25 bp, Mus musculus
aacaggtagctggtttcgtgaagga

SEQ ID NO: 29405 - DNA, 25 bp, Mus musculus
aacaggtatattcagctgcatgtac

SEQ ID NO: 29406 - DNA, 25 bp, Mus musculus
aacaggtatattgagctgcatgtac

SEQ ID NO: 29407 - DNA, 25 bp, Mus musculus
aacaggtattgccatcattcagtgg

SEQ ID NO: 29408 - DNA, 25 bp, Mus musculus
aacaggtattgcgatcattcagtgg

SEQ ID NO: 29409 - DNA, 25 bp, Mus musculus
aacaggtattttagtcgcagcgtgc

SEQ ID NO: 29410 - DNA, 25 bp, Mus musculus
aacaggtattttcttgtactggcat

SEQ ID NO: 29411 - DNA, 25 bp, Mus musculus
aacaggtattttgttgtactggcat

SEQ ID NO: 29412 - DNA, 25 bp, Mus musculus
aacaggtatttttgtcgcagcgtgc

SEQ ID NO: 29413 - DNA, 25 bp, Mus musculus
aacaggtcacaacatgggctgccag

SEQ ID NO: 29414 - DNA, 25 bp, Mus musculus
aacaggtcacaagatgggctgccag

SEQ ID NO: 29415 - DNA, 25 bp, Mus musculus
aacaggtcacagctggctatgaaca

SEQ ID NO: 29416 - DNA, 25 bp, Mus musculus
aacaggtcacaggtggctatgaaca

SEQ ID NO: 29417 - DNA, 25 bp, Mus musculus
aacaggtcactgagtaccggcttat

SEQ ID NO: 29418 - DNA, 25 bp, Mus musculus
aacaggtcactgtgtaccggcttat

SEQ ID NO: 29419 - DNA, 25 bp, Mus musculus
aacaggtcagaccattgttatgctt

SEQ ID NO: 29420 - DNA, 25 bp, Mus musculus
aacaggtcagacgattgttatgctt

SEQ ID NO: 29421 - DNA, 25 bp, Mus musculus
aacaggtcagttatttcatgcaaga

SEQ ID NO: 29422 - DNA, 25 bp, Mus musculus
aacaggtcagttttttcatgcaaga

SEQ ID NO: 29423 - DNA, 25 bp, Mus musculus
aacaggtcatacagcttggtcccag

SEQ ID NO: 29424 - DNA, 25 bp, Mus musculus
aacaggtcatactgcttggtcccag

SEQ ID NO: 29425 - DNA, 25 bp, Mus musculus
aacaggtccaccagggcatcaaggg

SEQ ID NO: 29426 - DNA, 25 bp, Mus musculus
aacaggtccacctgggcatcaaggg

SEQ ID NO: 29427 - DNA, 25 bp, Mus musculus
aacaggtccattattatgtgggtgc

SEQ ID NO: 29428 - DNA, 25 bp, Mus musculus
aacaggtccatttttatgtgggtgc

SEQ ID NO: 29429 - DNA, 25 bp, Mus musculus
aacaggtccggtcgcatcctgaccg

SEQ ID NO: 29430 - DNA, 25 bp, Mus musculus
aacaggtccggtggcatcctgaccg

SEQ ID NO: 29431 - DNA, 25 bp, Mus musculus
aacaggtcctacacctgtggctgga

SEQ ID NO: 29432 - DNA, 25 bp, Mus musculus
aacaggtcctactcctgtggctgga

SEQ ID NO: 29433 - DNA, 25 bp, Mus musculus
aacaggtcctgacttacttctccat

SEQ ID NO: 29434 - DNA, 25 bp, Mus musculus
aacaggtcctgagttacttctccat

SEQ ID NO: 29435 - DNA, 25 bp, Mus musculus
aacaggtcctgtatgttcaaagcag

SEQ ID NO: 29436 - DNA, 25 bp, Mus musculus
aacaggtcctgtttgttcaaagcag

SEQ ID NO: 29437 - DNA, 25 bp, Mus musculus
aacaggtccttgatttgatgtctag

SEQ ID NO: 29438 - DNA, 25 bp, Mus musculus
aacaggtccttgttttgatgtctag

SEQ ID NO: 29439 - DNA, 25 bp, Mus musculus
aacaggtcggggagcaggaatctcc

SEQ ID NO: 29440 - DNA, 25 bp, Mus musculus
aacaggtcggggtgcaggaatctcc

SEQ ID NO: 29441 - DNA, 25 bp, Mus musculus
aacaggtctaggacttagggcttgt

SEQ ID NO: 29442 - DNA, 25 bp, Mus musculus
aacaggtctaggtcttagggcttgt

SEQ ID NO: 29443 - DNA, 25 bp, Mus musculus
aacaggtctctccttttgtaaatct

SEQ ID NO: 29444 - DNA, 25 bp, Mus musculus
aacaggtctctcgttttgtaaatct

SEQ ID NO: 29445 - DNA, 25 bp, Mus musculus
aacaggtctgaactcaaaggctcca

SEQ ID NO: 29446 - DNA, 25 bp, Mus musculus
aacaggtctgaagtcaaaggctcca

SEQ ID NO: 29447 - DNA, 25 bp, Mus musculus
aacaggtctggtcgatgccaagcaa

SEQ ID NO: 29448 - DNA, 25 bp, Mus musculus
aacaggtctggtggatgccaagcaa

SEQ ID NO: 29449 - DNA, 25 bp, Mus musculus
aacaggtcttaacggagccacttct

SEQ ID NO: 29450 - DNA, 25 bp, Mus musculus
aacaggtcttaagggagccacttct

SEQ ID NO: 29451 - DNA, 25 bp, Mus musculus
aacaggtgaaggatatgaatacaac

SEQ ID NO: 29452 - DNA, 25 bp, Mus musculus
aacaggtgaaggttatgaatacaac

SEQ ID NO: 29453 - DNA, 25 bp, Mus musculus
aacaggtgacacctgctgggttgaa

SEQ ID NO: 29454 - DNA, 25 bp, Mus musculus
aacaggtgacacgtgctgggttgaa

SEQ ID NO: 29455 - DNA, 25 bp, Mus musculus
aacaggtgactcagggacagcacat

SEQ ID NO: 29456 - DNA, 25 bp, Mus musculus
aacaggtgactctgggacagcacat

SEQ ID NO: 29457 - DNA, 25 bp, Mus musculus
aacaggtgagttaccctcagctggg

SEQ ID NO: 29458 - DNA, 25 bp, Mus musculus
aacaggtgagtttccctcagctggg

SEQ ID NO: 29459 - DNA, 25 bp, Mus musculus
aacaggtgccttccagaatccagaa

SEQ ID NO: 29460 - DNA, 25 bp, Mus musculus
aacaggtgccttgcagaatccagaa

SEQ ID NO: 29461 - DNA, 25 bp, Mus musculus
aacaggtgcttgcagatattgctaa

SEQ ID NO: 29462 - DNA, 25 bp, Mus musculus
aacaggtgcttggagatattgctaa

SEQ ID NO: 29463 - DNA, 25 bp, Mus musculus
aacaggtggacacctctccaagtca

SEQ ID NO: 29464 - DNA, 25 bp, Mus musculus
aacaggtggacagctctccaagtca

SEQ ID NO: 29465 - DNA, 25 bp, Mus musculus
aacaggtggagcagtcacgaaagga

SEQ ID NO: 29466 - DNA, 25 bp, Mus musculus
aacaggtggagctgtcacgaaagga

SEQ ID NO: 29467 - DNA, 25 bp, Mus musculus
aacaggtggaggctagcaccactta

SEQ ID NO: 29468 - DNA, 25 bp, Mus musculus
aacaggtggagggtagcaccactta

SEQ ID NO: 29469 - DNA, 25 bp, Mus musculus
aacaggtggcctacaatgcaacata

SEQ ID NO: 29470 - DNA, 25 bp, Mus musculus
aacaggtggccttcaatgcaacata

SEQ ID NO: 29471 - DNA, 25 bp, Mus musculus
aacaggtgggatagttcctccagta

SEQ ID NO: 29472 - DNA, 25 bp, Mus musculus
aacaggtgggattgttcctccagta

SEQ ID NO: 29473 - DNA, 25 bp, Mus musculus
aacaggtgtcagactgaccagggat

SEQ ID NO: 29474 - DNA, 25 bp, Mus musculus
aacaggtgtcagtctgaccagggat

SEQ ID NO: 29475 - DNA, 25 bp, Mus musculus
aacaggtgtttcactatacccagcc

SEQ ID NO: 29476 - DNA, 25 bp, Mus musculus
aacaggtgtttctctatacccagcc

SEQ ID NO: 29477 - DNA, 25 bp, Mus musculus
aacaggttaatacttgcatgctcat

SEQ ID NO: 29478 - DNA, 25 bp, Mus musculus
aacaggttaatagttgcatgctcat

SEQ ID NO: 29479 - DNA, 25 bp, Mus musculus
aacaggttacacagcccaaggtcag

SEQ ID NO: 29480 - DNA, 25 bp, Mus musculus
aacaggttacactgcccaaggtcag

SEQ ID NO: 29481 - DNA, 25 bp, Mus musculus
aacaggttactcatccgtgtgtcca

SEQ ID NO: 29482 - DNA, 25 bp, Mus musculus
aacaggttactcttccgtgtgtcca

SEQ ID NO: 29483 - DNA, 25 bp, Mus musculus
aacaggttatcacgattgctggcaa

SEQ ID NO: 29484 - DNA, 25 bp, Mus musculus
aacaggttatcaggattgctggcaa

SEQ ID NO: 29485 - DNA, 25 bp, Mus musculus
aacaggttcacaaggccaggttgct

SEQ ID NO: 29486 - DNA, 25 bp, Mus musculus
aacaggttcacatggccaggttgct

SEQ ID NO: 29487 - DNA, 25 bp, Mus musculus
aacaggttcagcacatatataataa

SEQ ID NO: 29488 - DNA, 25 bp, Mus musculus
aacaggttcagctcatatataataa

SEQ ID NO: 29489 - DNA, 25 bp, Mus musculus
aacaggttccacacactggtggtga

SEQ ID NO: 29490 - DNA, 25 bp, Mus musculus
aacaggttccactcactggtggtga

SEQ ID NO: 29491 - DNA, 25 bp, Mus musculus
aacaggttcctcagttctatttcct

SEQ ID NO: 29492 - DNA, 25 bp, Mus musculus
aacaggttcctctgttctatttcct

SEQ ID NO: 29493 - DNA, 25 bp, Mus musculus
aacaggttcttgcagtgccgagaca

SEQ ID NO: 29494 - DNA, 25 bp, Mus musculus
aacaggttcttggagtgccgagaca

SEQ ID NO: 29495 - DNA, 25 bp, Mus musculus
aacaggttgaacagtgggcacaggc

SEQ ID NO: 29496 - DNA, 25 bp, Mus musculus
aacaggttgaactgtgggcacaggc

SEQ ID NO: 29497 - DNA, 25 bp, Mus musculus
aacaggttgattcggatggacgcca

SEQ ID NO: 29498 - DNA, 25 bp, Mus musculus
aacaggttgattgggatggacgcca

SEQ ID NO: 29499 - DNA, 25 bp, Mus musculus
aacaggttgctgagctttcacgaac

SEQ ID NO: 29500 - DNA, 25 bp, Mus musculus
aacaggttgctgtgctttcacgaac

SEQ ID NO: 29501 - DNA, 25 bp, Mus musculus
aacaggttggacaaatgggctctct

SEQ ID NO: 29502 - DNA, 25 bp, Mus musculus
aacaggttggactaatgggctctct

SEQ ID NO: 29503 - DNA, 25 bp, Mus musculus
aacaggttgggcagtagtcattcct

SEQ ID NO: 29504 - DNA, 25 bp, Mus musculus
aacaggttgggctgtagtcattcct

SEQ ID NO: 29505 - DNA, 25 bp, Mus musculus
aacaggttgttccatgccgtggata

SEQ ID NO: 29506 - DNA, 25 bp, Mus musculus
aacaggttgttcgatgccgtggata

SEQ ID NO: 29507 - DNA, 25 bp, Mus musculus
aacaggtttctcaccacacttttca

SEQ ID NO: 29508 - DNA, 25 bp, Mus musculus
aacaggtttctctccacacttttca

SEQ ID NO: 29509 - DNA, 25 bp, Mus musculus
aacaggtttcttcgtcataggtaca

SEQ ID NO: 29510 - DNA, 25 bp, Mus musculus
aacaggtttcttggtcataggtaca

SEQ ID NO: 29511 - DNA, 25 bp, Mus musculus
aacagtaaatgcatgggccccagag

SEQ ID NO: 29512 - DNA, 25 bp, Mus musculus
aacagtaaatgcttgggccccagag

SEQ ID NO: 29513 - DNA, 25 bp, Mus musculus
aacagtaaatggcagtagtgaccaa

SEQ ID NO: 29514 - DNA, 25 bp, Mus musculus
aacagtaaatgggagtagtgaccaa

SEQ ID NO: 29515 - DNA, 25 bp, Mus musculus
aacagtaacaaccaggcaccggcct

SEQ ID NO: 29516 - DNA, 25 bp, Mus musculus
aacagtaacaacgaggcaccggcct

SEQ ID NO: 29517 - DNA, 25 bp, Mus musculus
aacagtaacaatcccacttgtgaat

SEQ ID NO: 29518 - DNA, 25 bp, Mus musculus
aacagtaacaatgccacttgtgaat

SEQ ID NO: 29519 - DNA, 25 bp, Mus musculus
aacagtaaccctcctctttgttgtt

SEQ ID NO: 29520 - DNA, 25 bp, Mus musculus
aacagtaaccctgctctttgttgtt

SEQ ID NO: 29521 - DNA, 25 bp, Mus musculus
aacagtaacgccatgcttcatcgct

SEQ ID NO: 29522 - DNA, 25 bp, Mus musculus
aacagtaacgccttgcttcatcgct

SEQ ID NO: 29523 - DNA, 25 bp, Mus musculus
aacagtaagggcaacgtggtaacat

SEQ ID NO: 29524 - DNA, 25 bp, Mus musculus
aacagtaagggctacgtggtaacat

SEQ ID NO: 29525 - DNA, 25 bp, Mus musculus
aacagtaaggttcggcgctgctcct

SEQ ID NO: 29526 - DNA, 25 bp, Mus musculus
aacagtaaggttgggcgctgctcct

SEQ ID NO: 29527 - DNA, 25 bp, Mus musculus
aacagtaataatcctacattcaaat

SEQ ID NO: 29528 - DNA, 25 bp, Mus musculus
aacagtaataatgctacattcaaat

SEQ ID NO: 29529 - DNA, 25 bp, Mus musculus
aacagtaatagcaggtggctcctga

SEQ ID NO: 29530 - DNA, 25 bp, Mus musculus
aacagtaatagctggtggctcctga

SEQ ID NO: 29531 - DNA, 25 bp, Mus musculus
aacagtacagcgatgggttcctaga

SEQ ID NO: 29532 - DNA, 25 bp, Mus musculus
aacagtacagcgttgggttcctaga

SEQ ID NO: 29533 - DNA, 25 bp, Mus musculus
aacagtacagtactcatttcttcct

SEQ ID NO: 29534 - DNA, 25 bp, Mus musculus
aacagtacagtagtcatttcttcct

SEQ ID NO: 29535 - DNA, 25 bp, Mus musculus
aacagtacatgcatttagtctcaat

SEQ ID NO: 29536 - DNA, 25 bp, Mus musculus
aacagtacatgcttttagtctcaat

SEQ ID NO: 29537 - DNA, 25 bp, Mus musculus
aacagtaccattcaccaggctggtt

SEQ ID NO: 29538 - DNA, 25 bp, Mus musculus
aacagtaccattgaccaggctggtt

SEQ ID NO: 29539 - DNA, 25 bp, Mus musculus
aacagtaccctgacatccctgtgtg

SEQ ID NO: 29540 - DNA, 25 bp, Mus musculus
aacagtaccctgtcatccctgtgtg

SEQ ID NO: 29541 - DNA, 25 bp, Mus musculus
aacagtacgaggacatggtcgtgga

SEQ ID NO: 29542 - DNA, 25 bp, Mus musculus
aacagtacgaggtcatggtcgtgga

SEQ ID NO: 29543 - DNA, 25 bp, Mus musculus
aacagtactcttactttgcctctgc

SEQ ID NO: 29544 - DNA, 25 bp, Mus musculus
aacagtactctttctttgcctctgc

SEQ ID NO: 29545 - DNA, 25 bp, Mus musculus
aacagtactgacatgtgcgaccact

SEQ ID NO: 29546 - DNA, 25 bp, Mus musculus
aacagtactgacttgtgcgaccact

SEQ ID NO: 29547 - DNA, 25 bp, Mus musculus
aacagtactggtcttccagctttat

SEQ ID NO: 29548 - DNA, 25 bp, Mus musculus
aacagtactggtgttccagctttat

SEQ ID NO: 29549 - DNA, 25 bp, Mus musculus
aacagtactgtgaagccacgtgcct

SEQ ID NO: 29550 - DNA, 25 bp, Mus musculus
aacagtactgtgtagccacgtgcct

SEQ ID NO: 29551 - DNA, 25 bp, Mus musculus
aacagtagacaaaggctcagcattt

SEQ ID NO: 29552 - DNA, 25 bp, Mus musculus
aacagtagacaatggctcagcattt

SEQ ID NO: 29553 - DNA, 25 bp, Mus musculus
aacagtagactgagcctgaccccag

SEQ ID NO: 29554 - DNA, 25 bp, Mus musculus
aacagtagactgtgcctgaccccag

SEQ ID NO: 29555 - DNA, 25 bp, Mus musculus
aacagtagcaaccttacagtcatca

SEQ ID NO: 29556 - DNA, 25 bp, Mus musculus
aacagtagcaacgttacagtcatca

SEQ ID NO: 29557 - DNA, 25 bp, Mus musculus
aacagtagcatgacatacgagaagc

SEQ ID NO: 29558 - DNA, 25 bp, Mus musculus
aacagtagcatgtcatacgagaagc

SEQ ID NO: 29559 - DNA, 25 bp, Mus musculus
aacagtagcgtgagggtggaaccct

SEQ ID NO: 29560 - DNA, 25 bp, Mus musculus
aacagtagcgtgtgggtggaaccct

SEQ ID NO: 29561 - DNA, 25 bp, Mus musculus
aacagtagctacagcgtgagagcct

SEQ ID NO: 29562 - DNA, 25 bp, Mus musculus
aacagtagctactgcgtgagagcct

SEQ ID NO: 29563 - DNA, 25 bp, Mus musculus
aacagtagggtcagggaggctgcaa

SEQ ID NO: 29564 - DNA, 25 bp, Mus musculus
aacagtagggtctgggaggctgcaa

SEQ ID NO: 29565 - DNA, 25 bp, Mus musculus
aacagtaggtacactttctgagcca

SEQ ID NO: 29566 - DNA, 25 bp, Mus musculus
aacagtaggtactctttctgagcca

SEQ ID NO: 29567 - DNA, 25 bp, Mus musculus
aacagtaggtctcccttaattccct

SEQ ID NO: 29568 - DNA, 25 bp, Mus musculus
aacagtaggtctgccttaattccct

SEQ ID NO: 29569 - DNA, 25 bp, Mus musculus
aacagtagtgcacttcaaccctcac

SEQ ID NO: 29570 - DNA, 25 bp, Mus musculus
aacagtagtgcagttcaaccctcac

SEQ ID NO: 29571 - DNA, 25 bp, Mus musculus
aacagtatacttcttaagctcttat

SEQ ID NO: 29572 - DNA, 25 bp, Mus musculus
aacagtatacttgttaagctcttat

SEQ ID NO: 29573 - DNA, 25 bp, Mus musculus
aacagtatcaacaaatctggacctg

SEQ ID NO: 29574 - DNA, 25 bp, Mus musculus
aacagtatcaactaatctggacctg

SEQ ID NO: 29575 - DNA, 25 bp, Mus musculus
aacagtatccagctttcctaggaaa

SEQ ID NO: 29576 - DNA, 25 bp, Mus musculus
aacagtatccaggtttcctaggaaa

SEQ ID NO: 29577 - DNA, 25 bp, Mus musculus
aacagtatcgacatgcattgtgcat

SEQ ID NO: 29578 - DNA, 25 bp, Mus musculus
aacagtatcgacttgcattgtgcat

SEQ ID NO: 29579 - DNA, 25 bp, Mus musculus
aacagtatcgtcagatcacacggca

SEQ ID NO: 29580 - DNA, 25 bp, Mus musculus
aacagtatcgtctgatcacacggca

SEQ ID NO: 29581 - DNA, 25 bp, Mus musculus
aacagtatctgcagtccatcgagga

SEQ ID NO: 29582 - DNA, 25 bp, Mus musculus
aacagtatctgctgtccatcgagga

SEQ ID NO: 29583 - DNA, 25 bp, Mus musculus
aacagtatcttgctcctcatgacgc

SEQ ID NO: 29584 - DNA, 25 bp, Mus musculus
aacagtatcttggtcctcatgacgc

SEQ ID NO: 29585 - DNA, 25 bp, Mus musculus
aacagtatgccaagagagcttttgc

SEQ ID NO: 29586 - DNA, 25 bp, Mus musculus
aacagtatgccatgagagcttttgc

SEQ ID NO: 29587 - DNA, 25 bp, Mus musculus
aacagtatggagattgacctttaat

SEQ ID NO: 29588 - DNA, 25 bp, Mus musculus
aacagtatggagtttgacctttaat

SEQ ID NO: 29589 - DNA, 25 bp, Mus musculus
aacagtatggtaaccccatccgtgg

SEQ ID NO: 29590 - DNA, 25 bp, Mus musculus
aacagtatggtaatgtggataaccc

SEQ ID NO: 29591 - DNA, 25 bp, Mus musculus
aacagtatggtatccccatccgtgg

SEQ ID NO: 29592 - DNA, 25 bp, Mus musculus
aacagtatggtattgtggataaccc

SEQ ID NO: 29593 - DNA, 25 bp, Mus musculus
aacagtatgttgctagctgaggcta

SEQ ID NO: 29594 - DNA, 25 bp, Mus musculus
aacagtatgttggtagctgaggcta

SEQ ID NO: 29595 - DNA, 25 bp, Mus musculus
aacagtattacaagcactctgatag

SEQ ID NO: 29596 - DNA, 25 bp, Mus musculus
aacagtattacatgcactctgatag

SEQ ID NO: 29597 - DNA, 25 bp, Mus musculus
aacagtattaccctttcactcttct

SEQ ID NO: 29598 - DNA, 25 bp, Mus musculus
aacagtattaccgtttcactcttct

SEQ ID NO: 29599 - DNA, 25 bp, Mus musculus
aacagtattcatactttgtgctccc

SEQ ID NO: 29600 - DNA, 25 bp, Mus musculus
aacagtattcattctttgtgctccc

SEQ ID NO: 29601 - DNA, 25 bp, Mus musculus
aacagtattgacaccgatgggttct

SEQ ID NO: 29602 - DNA, 25 bp, Mus musculus
aacagtattgactccgatgggttct

SEQ ID NO: 29603 - DNA, 25 bp, Mus musculus
aacagtatttcacaacactataggc

SEQ ID NO: 29604 - DNA, 25 bp, Mus musculus
aacagtatttcagaacactataggc

SEQ ID NO: 29605 - DNA, 25 bp, Mus musculus
aacagtatttccatcactaagacta

SEQ ID NO: 29606 - DNA, 25 bp, Mus musculus
aacagtatttccttcactaagacta

SEQ ID NO: 29607 - DNA, 25 bp, Mus musculus
aacagtattttcagtggaacccaag

SEQ ID NO: 29608 - DNA, 25 bp, Mus musculus
aacagtattttctgtggaacccaag

SEQ ID NO: 29609 - DNA, 25 bp, Mus musculus
aacagtattttgctttccacctata

SEQ ID NO: 29610 - DNA, 25 bp, Mus musculus
aacagtattttggtttccacctata

SEQ ID NO: 29611 - DNA, 25 bp, Mus musculus
aacagtcaaactccacccagtaaat

SEQ ID NO: 29612 - DNA, 25 bp, Mus musculus
aacagtcaaactgcacccagtaaat

SEQ ID NO: 29613 - DNA, 25 bp, Mus musculus
aacagtcaactcctcactttggatg

SEQ ID NO: 29614 - DNA, 25 bp, Mus musculus
aacagtcaactcgtcactttggatg

SEQ ID NO: 29615 - DNA, 25 bp, Mus musculus
aacagtcaagtaagagattctctgc

SEQ ID NO: 29616 - DNA, 25 bp, Mus musculus
aacagtcaagtatgagattctctgc

SEQ ID NO: 29617 - DNA, 25 bp, Mus musculus
aacagtcacaaaatctcatacccat

SEQ ID NO: 29618 - DNA, 25 bp, Mus musculus
aacagtcacaaattctcatacccat

SEQ ID NO: 29619 - DNA, 25 bp, Mus musculus
aacagtcacaggcattacctgggta

SEQ ID NO: 29620 - DNA, 25 bp, Mus musculus
aacagtcacagggattacctgggta

SEQ ID NO: 29621 - DNA, 25 bp, Mus musculus
aacagtcaccagcatggccgtggaa

SEQ ID NO: 29622 - DNA, 25 bp, Mus musculus
aacagtcaccaggatggccgtggaa

SEQ ID NO: 29623 - DNA, 25 bp, Mus musculus
aacagtcacctcaggaaccttctga

SEQ ID NO: 29624 - DNA, 25 bp, Mus musculus
aacagtcacctctggaaccttctga

SEQ ID NO: 29625 - DNA, 25 bp, Mus musculus
aacagtcacctgattcctagtacct

SEQ ID NO: 29626 - DNA, 25 bp, Mus musculus
aacagtcacctgtttcctagtacct

SEQ ID NO: 29627 - DNA, 25 bp, Mus musculus
aacagtcaccttaaactcagggctt

SEQ ID NO: 29628 - DNA, 25 bp, Mus musculus
aacagtcacctttaactcagggctt

SEQ ID NO: 29629 - DNA, 25 bp, Mus musculus
aacagtcacgatctatcaggttcta

SEQ ID NO: 29630 - DNA, 25 bp, Mus musculus
aacagtcacgatgtatcaggttcta

SEQ ID NO: 29631 - DNA, 25 bp, Mus musculus
aacagtcacgtcagccagccgaact

SEQ ID NO: 29632 - DNA, 25 bp, Mus musculus
aacagtcacgtctgccagccgaact

SEQ ID NO: 29633 - DNA, 25 bp, Mus musculus
aacagtcacgttccaactagttaat

SEQ ID NO: 29634 - DNA, 25 bp, Mus musculus
aacagtcacgttgcaactagttaat

SEQ ID NO: 29635 - DNA, 25 bp, Mus musculus
aacagtcactatagctatctctttt

SEQ ID NO: 29636 - DNA, 25 bp, Mus musculus
aacagtcactattgctatctctttt

SEQ ID NO: 29637 - DNA, 25 bp, Mus musculus
aacagtcactgtaatgtactaggaa

SEQ ID NO: 29638 - DNA, 25 bp, Mus musculus
aacagtcactgttatgtactaggaa

SEQ ID NO: 29639 - DNA, 25 bp, Mus musculus
aacagtcatcatccctgaacaagtg

SEQ ID NO: 29640 - DNA, 25 bp, Mus musculus
aacagtcatcatgcctgaacaagtg

SEQ ID NO: 29641 - DNA, 25 bp, Mus musculus
aacagtccaactatgcggatatcga

SEQ ID NO: 29642 - DNA, 25 bp, Mus musculus
aacagtccaactttgcggatatcga

SEQ ID NO: 29643 - DNA, 25 bp, Mus musculus
aacagtccaagtctccacttatcag

SEQ ID NO: 29644 - DNA, 25 bp, Mus musculus
aacagtccaagtgtccacttatcag

SEQ ID NO: 29645 - DNA, 25 bp, Mus musculus
aacagtccactgaacggctagaatg

SEQ ID NO: 29646 - DNA, 25 bp, Mus musculus
aacagtccactgctgttatcatcag

SEQ ID NO: 29647 - DNA, 25 bp, Mus musculus
aacagtccactggtgttatcatcag

SEQ ID NO: 29648 - DNA, 25 bp, Mus musculus
aacagtccactgtacggctagaatg

SEQ ID NO: 29649 - DNA, 25 bp, Mus musculus
aacagtccacttaaattccaactgg

SEQ ID NO: 29650 - DNA, 25 bp, Mus musculus
aacagtccacttcaagaaccgagat

SEQ ID NO: 29651 - DNA, 25 bp, Mus musculus
aacagtccacttgaagaaccgagat

SEQ ID NO: 29652 - DNA, 25 bp, Mus musculus
aacagtccactttaattccaactgg

SEQ ID NO: 29653 - DNA, 25 bp, Mus musculus
aacagtccagtaacatgcatgagct

SEQ ID NO: 29654 - DNA, 25 bp, Mus musculus
aacagtccagtatcatgcatgagct

SEQ ID NO: 29655 - DNA, 25 bp, Mus musculus
aacagtccatagctggctcgctgac

SEQ ID NO: 29656 - DNA, 25 bp, Mus musculus
aacagtccataggtggctcgctgac

SEQ ID NO: 29657 - DNA, 25 bp, Mus musculus
aacagtccatcacaagtcaaaccaa

SEQ ID NO: 29658 - DNA, 25 bp, Mus musculus
aacagtccatcagaagtcaaaccaa

SEQ ID NO: 29659 - DNA, 25 bp, Mus musculus
aacagtccctgtcatccttaagtga

SEQ ID NO: 29660 - DNA, 25 bp, Mus musculus
aacagtccctgtgatccttaagtga

SEQ ID NO: 29661 - DNA, 25 bp, Mus musculus
aacagtcccttaccgtgtgattgag

SEQ ID NO: 29662 - DNA, 25 bp, Mus musculus
aacagtcccttagcgtgtgattgag

SEQ ID NO: 29663 - DNA, 25 bp, Mus musculus
aacagtcctacgaatgcagtggtgg

SEQ ID NO: 29664 - DNA, 25 bp, Mus musculus
aacagtcctacgtatgcagtggtgg

SEQ ID NO: 29665 - DNA, 25 bp, Mus musculus
aacagtcctatgactccgtcgtgca

SEQ ID NO: 29666 - DNA, 25 bp, Mus musculus
aacagtcctatgtctccgtcgtgca

SEQ ID NO: 29667 - DNA, 25 bp, Mus musculus
aacagtcctgttcattgcatcgttt

SEQ ID NO: 29668 - DNA, 25 bp, Mus musculus
aacagtcctgttgattgcatcgttt

SEQ ID NO: 29669 - DNA, 25 bp, Mus musculus
aacagtccttccatctaggactcaa

SEQ ID NO: 29670 - DNA, 25 bp, Mus musculus
aacagtccttccttctaggactcaa

SEQ ID NO: 29671 - DNA, 25 bp, Mus musculus
aacagtcgacacactttcagcttag

SEQ ID NO: 29672 - DNA, 25 bp, Mus musculus
aacagtcgacactctttcagcttag

SEQ ID NO: 29673 - DNA, 25 bp, Mus musculus
aacagtcgctgaacggcgtgcatta

SEQ ID NO: 29674 - DNA, 25 bp, Mus musculus
aacagtcgctgatcggcgtgcatta

SEQ ID NO: 29675 - DNA, 25 bp, Mus musculus
aacagtcgggcgagtatcccgttgg

SEQ ID NO: 29676 - DNA, 25 bp, Mus musculus
aacagtcgggcgtgtatcccgttgg

SEQ ID NO: 29677 - DNA, 25 bp, Mus musculus
aacagtcgtgttctaatgggcagta

SEQ ID NO: 29678 - DNA, 25 bp, Mus musculus
aacagtcgtgttgtaatgggcagta

SEQ ID NO: 29679 - DNA, 25 bp, Mus musculus
aacagtctcaagacttccttagtaa

SEQ ID NO: 29680 - DNA, 25 bp, Mus musculus
aacagtctcaagtcttccttagtaa

SEQ ID NO: 29681 - DNA, 25 bp, Mus musculus
aacagtctcactaccttatgagaag

SEQ ID NO: 29682 - DNA, 25 bp, Mus musculus
aacagtctcacttccttatgagaag

SEQ ID NO: 29683 - DNA, 25 bp, Mus musculus
aacagtctcatgacctgccaaatag

SEQ ID NO: 29684 - DNA, 25 bp, Mus musculus
aacagtctcatgtcctgccaaatag

SEQ ID NO: 29685 - DNA, 25 bp, Mus musculus
aacagtctccagcatgtctttctgc

SEQ ID NO: 29686 - DNA, 25 bp, Mus musculus
aacagtctccaggatgtctttctgc

SEQ ID NO: 29687 - DNA, 25 bp, Mus musculus
aacagtctcttcatttcttgaggtt

SEQ ID NO: 29688 - DNA, 25 bp, Mus musculus
aacagtctcttcttttcttgaggtt

SEQ ID NO: 29689 - DNA, 25 bp, Mus musculus
aacagtctctttaccccgtgaggag

SEQ ID NO: 29690 - DNA, 25 bp, Mus musculus
aacagtctcttttccccgtgaggag

SEQ ID NO: 29691 - DNA, 25 bp, Mus musculus
aacagtctgaaaaatctgcagcagt

SEQ ID NO: 29692 - DNA, 25 bp, Mus musculus
aacagtctgaaatatctgcagcagt

SEQ ID NO: 29693 - DNA, 25 bp, Mus musculus
aacagtctgaccagatgacagccaa

SEQ ID NO: 29694 - DNA, 25 bp, Mus musculus
aacagtctgacctgatgacagccaa

SEQ ID NO: 29695 - DNA, 25 bp, Mus musculus
aacagtctgcacaatctcttaagct

SEQ ID NO: 29696 - DNA, 25 bp, Mus musculus
aacagtctgcactatctcttaagct

SEQ ID NO: 29697 - DNA, 25 bp, Mus musculus
aacagtctgcctatgctgaaggaaa

SEQ ID NO: 29698 - DNA, 25 bp, Mus musculus
aacagtctgcctttgctgaaggaaa

SEQ ID NO: 29699 - DNA, 25 bp, Mus musculus
aacagtctgggcacgttcatgccgg

SEQ ID NO: 29700 - DNA, 25 bp, Mus musculus
aacagtctgggccttacatctgggt

SEQ ID NO: 29701 - DNA, 25 bp, Mus musculus
aacagtctgggcgttacatctgggt

SEQ ID NO: 29702 - DNA, 25 bp, Mus musculus
aacagtctgggctcgttcatgccgg

SEQ ID NO: 29703 - DNA, 25 bp, Mus musculus
aacagtctgtaaactatggcgatgc

SEQ ID NO: 29704 - DNA, 25 bp, Mus musculus
aacagtctgtaatctatggcgatgc

SEQ ID NO: 29705 - DNA, 25 bp, Mus musculus
aacagtctgttcctcgaatatgcaa

SEQ ID NO: 29706 - DNA, 25 bp, Mus musculus
aacagtctgttcgtcgaatatgcaa

SEQ ID NO: 29707 - DNA, 25 bp, Mus musculus
aacagtcttcataggtgcatgtcta

SEQ ID NO: 29708 - DNA, 25 bp, Mus musculus
aacagtcttcattggtgcatgtcta

SEQ ID NO: 29709 - DNA, 25 bp, Mus musculus
aacagtcttctgcatctgaggacag

SEQ ID NO: 29710 - DNA, 25 bp, Mus musculus
aacagtcttctgctgagtttttcac

SEQ ID NO: 29711 - DNA, 25 bp, Mus musculus
aacagtcttctggatctgaggacag

SEQ ID NO: 29712 - DNA, 25 bp, Mus musculus
aacagtcttctggtgagtttttcac

SEQ ID NO: 29713 - DNA, 25 bp, Mus musculus
aacagtcttgatacctcaatagaaa

SEQ ID NO: 29714 - DNA, 25 bp, Mus musculus
aacagtcttgattcctcaatagaaa

SEQ ID NO: 29715 - DNA, 25 bp, Mus musculus
aacagtcttgtgctttatggtctca

SEQ ID NO: 29716 - DNA, 25 bp, Mus musculus
aacagtcttgtggtttatggtctca

SEQ ID NO: 29717 - DNA, 25 bp, Mus musculus
aacagtcttttgctgctagagccgc

SEQ ID NO: 29718 - DNA, 25 bp, Mus musculus
aacagtcttttggtgctagagccgc

SEQ ID NO: 29719 - DNA, 25 bp, Mus musculus
aacagtgaagcacaggataccccag

SEQ ID NO: 29720 - DNA, 25 bp, Mus musculus
aacagtgaagcagaggataccccag

SEQ ID NO: 29721 - DNA, 25 bp, Mus musculus
aacagtgaaggtcagcagggtccaa

SEQ ID NO: 29722 - DNA, 25 bp, Mus musculus
aacagtgaaggtgagcagggtccaa

SEQ ID NO: 29723 - DNA, 25 bp, Mus musculus
aacagtgaattcattagttccgtct

SEQ ID NO: 29724 - DNA, 25 bp, Mus musculus
aacagtgaattctttagttccgtct

SEQ ID NO: 29725 - DNA, 25 bp, Mus musculus
aacagtgaattgacctcctccaaaa

SEQ ID NO: 29726 - DNA, 25 bp, Mus musculus
aacagtgaattgtcctcctccaaaa

SEQ ID NO: 29727 - DNA, 25 bp, Mus musculus
aacagtgacaaacctaccgtgacgt

SEQ ID NO: 29728 - DNA, 25 bp, Mus musculus
aacagtgacaaagctaccgtgacgt

SEQ ID NO: 29729 - DNA, 25 bp, Mus musculus
aacagtgacccaagtgctacagctt

SEQ ID NO: 29730 - DNA, 25 bp, Mus musculus
aacagtgacccacaaaattccacag

SEQ ID NO: 29731 - DNA, 25 bp, Mus musculus
aacagtgacccagaaaattccacag

SEQ ID NO: 29732 - DNA, 25 bp, Mus musculus
aacagtgacccatgtgctacagctt

SEQ ID NO: 29733 - DNA, 25 bp, Mus musculus
aacagtgacgccaagtccagtgaaa

SEQ ID NO: 29734 - DNA, 25 bp, Mus musculus
aacagtgacgcctagtccagtgaaa

SEQ ID NO: 29735 - DNA, 25 bp, Mus musculus
aacagtgacgtgactacaccagcgt

SEQ ID NO: 29736 - DNA, 25 bp, Mus musculus
aacagtgacgtgtctacaccagcgt

SEQ ID NO: 29737 - DNA, 25 bp, Mus musculus
aacagtgactaaccgttcctgccaa

SEQ ID NO: 29738 - DNA, 25 bp, Mus musculus
aacagtgactaagcgttcctgccaa

SEQ ID NO: 29739 - DNA, 25 bp, Mus musculus
aacagtgactacaaggtgagcagct

SEQ ID NO: 29740 - DNA, 25 bp, Mus musculus
aacagtgactactaggtgagcagct

SEQ ID NO: 29741 - DNA, 25 bp, Mus musculus
aacagtgactttaccagagcagatg

SEQ ID NO: 29742 - DNA, 25 bp, Mus musculus
aacagtgacttttccagagcagatg

SEQ ID NO: 29743 - DNA, 25 bp, Mus musculus
aacagtgagttcattagcagcctta

SEQ ID NO: 29744 - DNA, 25 bp, Mus musculus
aacagtgagttctttagcagcctta

SEQ ID NO: 29745 - DNA, 25 bp, Mus musculus
aacagtgatagccttgcctgcagag

SEQ ID NO: 29746 - DNA, 25 bp, Mus musculus
aacagtgatagcgttgcctgcagag

SEQ ID NO: 29747 - DNA, 25 bp, Mus musculus
aacagtgatcttaaacctcaggagt

SEQ ID NO: 29748 - DNA, 25 bp, Mus musculus
aacagtgatctttaacctcaggagt

SEQ ID NO: 29749 - DNA, 25 bp, Mus musculus
aacagtgatgttatccagccggatc

SEQ ID NO: 29750 - DNA, 25 bp, Mus musculus
aacagtgatgttcggttgcccttaa

SEQ ID NO: 29751 - DNA, 25 bp, Mus musculus
aacagtgatgttgggttgcccttaa

SEQ ID NO: 29752 - DNA, 25 bp, Mus musculus
aacagtgatgttttccagccggatc

SEQ ID NO: 29753 - DNA, 25 bp, Mus musculus
aacagtgattgccacggttctcatg

SEQ ID NO: 29754 - DNA, 25 bp, Mus musculus
aacagtgattgcgacggttctcatg

SEQ ID NO: 29755 - DNA, 25 bp, Mus musculus
aacagtgcagcaacccttttaattc

SEQ ID NO: 29756 - DNA, 25 bp, Mus musculus
aacagtgcagcatcccttttaattc

SEQ ID NO: 29757 - DNA, 25 bp, Mus musculus
aacagtgcagttaatacctcattct

SEQ ID NO: 29758 - DNA, 25 bp, Mus musculus
aacagtgcagttagtgttgtcacaa

SEQ ID NO: 29759 - DNA, 25 bp, Mus musculus
aacagtgcagtttatacctcattct

SEQ ID NO: 29760 - DNA, 25 bp, Mus musculus
aacagtgcagtttgtgttgtcacaa

SEQ ID NO: 29761 - DNA, 25 bp, Mus musculus
aacagtgcattgaagtacacccatt

SEQ ID NO: 29762 - DNA, 25 bp, Mus musculus
aacagtgcattgtagtacacccatt

SEQ ID NO: 29763 - DNA, 25 bp, Mus musculus
aacagtgccccaagatgtgatccta

SEQ ID NO: 29764 - DNA, 25 bp, Mus musculus
aacagtgccccatgatgtgatccta

SEQ ID NO: 29765 - DNA, 25 bp, Mus musculus
aacagtgcccttcacaaagctccag

SEQ ID NO: 29766 - DNA, 25 bp, Mus musculus
aacagtgcccttgacaaagctccag

SEQ ID NO: 29767 - DNA, 25 bp, Mus musculus
aacagtgcctaccaagcctttaaca

SEQ ID NO: 29768 - DNA, 25 bp, Mus musculus
aacagtgcctacgaagcctttaaca

SEQ ID NO: 29769 - DNA, 25 bp, Mus musculus
aacagtgcctttaagaataccttct

SEQ ID NO: 29770 - DNA, 25 bp, Mus musculus
aacagtgccttttagaataccttct

SEQ ID NO: 29771 - DNA, 25 bp, Mus musculus
aacagtgcggagagacccggtgact

SEQ ID NO: 29772 - DNA, 25 bp, Mus musculus
aacagtgcggagtgacccggtgact

SEQ ID NO: 29773 - DNA, 25 bp, Mus musculus
aacagtgctaccagctaagctgcta

SEQ ID NO: 29774 - DNA, 25 bp, Mus musculus
aacagtgctacctgctaagctgcta

SEQ ID NO: 29775 - DNA, 25 bp, Mus musculus
aacagtgctagactcgagatccaac

SEQ ID NO: 29776 - DNA, 25 bp, Mus musculus
aacagtgctagagtcgagatccaac

SEQ ID NO: 29777 - DNA, 25 bp, Mus musculus
aacagtgctgctctggagagagacc

SEQ ID NO: 29778 - DNA, 25 bp, Mus musculus
aacagtgctgctgtggagagagacc

SEQ ID NO: 29779 - DNA, 25 bp, Mus musculus
aacagtgctggaagctgtaacctca

SEQ ID NO: 29780 - DNA, 25 bp, Mus musculus
aacagtgctggatgctgtaacctca

SEQ ID NO: 29781 - DNA, 25 bp, Mus musculus
aacagtgctgtcacatgggcatcag

SEQ ID NO: 29782 - DNA, 25 bp, Mus musculus
aacagtgctgtctcatgggcatcag

SEQ ID NO: 29783 - DNA, 25 bp, Mus musculus
aacagtgcttggatgttaactccca

SEQ ID NO: 29784 - DNA, 25 bp, Mus musculus
aacagtgcttggttgttaactccca

SEQ ID NO: 29785 - DNA, 25 bp, Mus musculus
aacagtgcttttcagactagtgtgt

SEQ ID NO: 29786 - DNA, 25 bp, Mus musculus
aacagtgcttttgagactagtgtgt

SEQ ID NO: 29787 - DNA, 25 bp, Mus musculus
aacagtggaactaacacgggcatgt

SEQ ID NO: 29788 - DNA, 25 bp, Mus musculus
aacagtggaacttacacgggcatgt

SEQ ID NO: 29789 - DNA, 25 bp, Mus musculus
aacagtggaatgctggaggctttta

SEQ ID NO: 29790 - DNA, 25 bp, Mus musculus
aacagtggaatggtggaggctttta

SEQ ID NO: 29791 - DNA, 25 bp, Mus musculus
aacagtggaattcgatctccccaaa

SEQ ID NO: 29792 - DNA, 25 bp, Mus musculus
aacagtggaattggatctccccaaa

SEQ ID NO: 29793 - DNA, 25 bp, Mus musculus
aacagtggacaccagggagctctgc

SEQ ID NO: 29794 - DNA, 25 bp, Mus musculus
aacagtggacacgagggagctctgc

SEQ ID NO: 29795 - DNA, 25 bp, Mus musculus
aacagtggacagctttactcccaag

SEQ ID NO: 29796 - DNA, 25 bp, Mus musculus
aacagtggacaggtttactcccaag

SEQ ID NO: 29797 - DNA, 25 bp, Mus musculus
aacagtggaccgagacgcagggtca

SEQ ID NO: 29798 - DNA, 25 bp, Mus musculus
aacagtggaccgtgacgcagggtca

SEQ ID NO: 29799 - DNA, 25 bp, Mus musculus
aacagtggatcccagtgcatcatcc

SEQ ID NO: 29800 - DNA, 25 bp, Mus musculus
aacagtggatccgagtgcatcatcc

SEQ ID NO: 29801 - DNA, 25 bp, Mus musculus
aacagtggccatacgtggagtgcac

SEQ ID NO: 29802 - DNA, 25 bp, Mus musculus
aacagtggccattcgtggagtgcac

SEQ ID NO: 29803 - DNA, 25 bp, Mus musculus
aacagtggccttagtgaaggcggtc

SEQ ID NO: 29804 - DNA, 25 bp, Mus musculus
aacagtggcctttgtgaaggcggtc

SEQ ID NO: 29805 - DNA, 25 bp, Mus musculus
aacagtggctgacctttccagtgtt

SEQ ID NO: 29806 - DNA, 25 bp, Mus musculus
aacagtggctgagctttccagtgtt

SEQ ID NO: 29807 - DNA, 25 bp, Mus musculus
aacagtggctgcaattatttttcct

SEQ ID NO: 29808 - DNA, 25 bp, Mus musculus
aacagtggctgcatccaaatgttgt

SEQ ID NO: 29809 - DNA, 25 bp, Mus musculus
aacagtggctgctattatttttcct

SEQ ID NO: 29810 - DNA, 25 bp, Mus musculus
aacagtggctgcttccaaatgttgt

SEQ ID NO: 29811 - DNA, 25 bp, Mus musculus
aacagtggctggatggatccttgga

SEQ ID NO: 29812 - DNA, 25 bp, Mus musculus
aacagtggctggttggatccttgga

SEQ ID NO: 29813 - DNA, 25 bp, Mus musculus
aacagtgggactccctgcctttggt

SEQ ID NO: 29814 - DNA, 25 bp, Mus musculus
aacagtgggactgcctgcctttggt

SEQ ID NO: 29815 - DNA, 25 bp, Mus musculus
aacagtgggagtacctcagcactca

SEQ ID NO: 29816 - DNA, 25 bp, Mus musculus
aacagtgggagttcctcagcactca

SEQ ID NO: 29817 - DNA, 25 bp, Mus musculus
aacagtgggattatgtgcacaggaa

SEQ ID NO: 29818 - DNA, 25 bp, Mus musculus
aacagtgggattttgtgcacaggaa

SEQ ID NO: 29819 - DNA, 25 bp, Mus musculus
aacagtgggcggagtctgcagaagt

SEQ ID NO: 29820 - DNA, 25 bp, Mus musculus
aacagtgggcggtgtctgcagaagt

SEQ ID NO: 29821 - DNA, 25 bp, Mus musculus
aacagtgggtgtctctctccaggtt

SEQ ID NO: 29822 - DNA, 25 bp, Mus musculus
aacagtgggtgtgtctctccaggtt

SEQ ID NO: 29823 - DNA, 25 bp, Mus musculus
aacagtggtactctgatttgaacag

SEQ ID NO: 29824 - DNA, 25 bp, Mus musculus
aacagtggtactgtgatttgaacag

SEQ ID NO: 29825 - DNA, 25 bp, Mus musculus
aacagtggtagcacagtctgcttgc

SEQ ID NO: 29826 - DNA, 25 bp, Mus musculus
aacagtggtagctcagtctgcttgc

SEQ ID NO: 29827 - DNA, 25 bp, Mus musculus
aacagtggtctgattgggtccaatt

SEQ ID NO: 29828 - DNA, 25 bp, Mus musculus
aacagtggtctgtttgggtccaatt

SEQ ID NO: 29829 - DNA, 25 bp, Mus musculus
aacagtggtgaacacacttgtgcac

SEQ ID NO: 29830 - DNA, 25 bp, Mus musculus
aacagtggtgaagacacttgtgcac

SEQ ID NO: 29831 - DNA, 25 bp, Mus musculus
aacagtggtgtcctcaacctaactt

SEQ ID NO: 29832 - DNA, 25 bp, Mus musculus
aacagtggtgtcgtcaacctaactt

SEQ ID NO: 29833 - DNA, 25 bp, Mus musculus
aacagtggttctcaatcaaggctca

SEQ ID NO: 29834 - DNA, 25 bp, Mus musculus
aacagtggttctgaatcaaggctca

SEQ ID NO: 29835 - DNA, 25 bp, Mus musculus
aacagtggttgtcgccacagtcgcc

SEQ ID NO: 29836 - DNA, 25 bp, Mus musculus
aacagtggttgtggccacagtcgcc

SEQ ID NO: 29837 - DNA, 25 bp, Mus musculus
aacagtggtttcactctgtatcctt

SEQ ID NO: 29838 - DNA, 25 bp, Mus musculus
aacagtggtttctctctgtatcctt

SEQ ID NO: 29839 - DNA, 25 bp, Mus musculus
aacagtgtacaaacgcctagcagtc

SEQ ID NO: 29840 - DNA, 25 bp, Mus musculus
aacagtgtacaatcgcctagcagtc

SEQ ID NO: 29841 - DNA, 25 bp, Mus musculus
aacagtgtactcattttgaagggtg

SEQ ID NO: 29842 - DNA, 25 bp, Mus musculus
aacagtgtactctttttgaagggtg

SEQ ID NO: 29843 - DNA, 25 bp, Mus musculus
aacagtgtagatcttctggtataac

SEQ ID NO: 29844 - DNA, 25 bp, Mus musculus
aacagtgtagatgttctggtataac

SEQ ID NO: 29845 - DNA, 25 bp, Mus musculus
aacagtgtatggatgctatgaaatg

SEQ ID NO: 29846 - DNA, 25 bp, Mus musculus
aacagtgtatggttgctatgaaatg

SEQ ID NO: 29847 - DNA, 25 bp, Mus musculus
aacagtgtatttatccctagcagga

SEQ ID NO: 29848 - DNA, 25 bp, Mus musculus
aacagtgtatttttccctagcagga

SEQ ID NO: 29849 - DNA, 25 bp, Mus musculus
aacagtgtcactctcttcagtcctt

SEQ ID NO: 29850 - DNA, 25 bp, Mus musculus
aacagtgtcactgtcttcagtcctt

SEQ ID NO: 29851 - DNA, 25 bp, Mus musculus
aacagtgtcagccaaatctcggtgc

SEQ ID NO: 29852 - DNA, 25 bp, Mus musculus
aacagtgtcagcgaaatctcggtgc

SEQ ID NO: 29853 - DNA, 25 bp, Mus musculus
aacagtgtcaggagcaatgccgtag

SEQ ID NO: 29854 - DNA, 25 bp, Mus musculus
aacagtgtcaggtgcaatgccgtag

SEQ ID NO: 29855 - DNA, 25 bp, Mus musculus
aacagtgtcagtcctatccttttag

SEQ ID NO: 29856 - DNA, 25 bp, Mus musculus
aacagtgtcagtgctatccttttag

SEQ ID NO: 29857 - DNA, 25 bp, Mus musculus
aacagtgtccatcaagttgctgact

SEQ ID NO: 29858 - DNA, 25 bp, Mus musculus
aacagtgtccatgaagttgctgact

SEQ ID NO: 29859 - DNA, 25 bp, Mus musculus
aacagtgtcctgagtatagagcaga

SEQ ID NO: 29860 - DNA, 25 bp, Mus musculus
aacagtgtcctgtgtatagagcaga

SEQ ID NO: 29861 - DNA, 25 bp, Mus musculus
aacagtgtcgtcaacttatctaaga

SEQ ID NO: 29862 - DNA, 25 bp, Mus musculus
aacagtgtcgtctacttatctaaga

SEQ ID NO: 29863 - DNA, 25 bp, Mus musculus
aacagtgtgagcatcaaacgcatat

SEQ ID NO: 29864 - DNA, 25 bp, Mus musculus
aacagtgtgagcttcaaacgcatat

SEQ ID NO: 29865 - DNA, 25 bp, Mus musculus
aacagtgtgagtccctgtctcaaaa

SEQ ID NO: 29866 - DNA, 25 bp, Mus musculus
aacagtgtgagtgcctgtctcaaaa

SEQ ID NO: 29867 - DNA, 25 bp, Mus musculus
aacagtgtgatgaagctgtccctgg

SEQ ID NO: 29868 - DNA, 25 bp, Mus musculus
aacagtgtgatgtagctgtccctgg

SEQ ID NO: 29869 - DNA, 25 bp, Mus musculus
aacagtgtgcctatgagtgcccaga

SEQ ID NO: 29870 - DNA, 25 bp, Mus musculus
aacagtgtgcctttgagtgcccaga

SEQ ID NO: 29871 - DNA, 25 bp, Mus musculus
aacagtgtgctacgagagcctcagt

SEQ ID NO: 29872 - DNA, 25 bp, Mus musculus
aacagtgtgctaggagagcctcagt

SEQ ID NO: 29873 - DNA, 25 bp, Mus musculus
aacagtgtgctgaatcgcctattta

SEQ ID NO: 29874 - DNA, 25 bp, Mus musculus
aacagtgtgctgatgtaaacatatt

SEQ ID NO: 29875 - DNA, 25 bp, Mus musculus
aacagtgtgctgtatcgcctattta

SEQ ID NO: 29876 - DNA, 25 bp, Mus musculus
aacagtgtgctgttgtaaacatatt

SEQ ID NO: 29877 - DNA, 25 bp, Mus musculus
aacagtgtggacaagttgccccagc

SEQ ID NO: 29878 - DNA, 25 bp, Mus musculus
aacagtgtggactagttgccccagc

SEQ ID NO: 29879 - DNA, 25 bp, Mus musculus
aacagtgtggcgagcagatcaccaa

SEQ ID NO: 29880 - DNA, 25 bp, Mus musculus
aacagtgtggcgtgcagatcaccaa

SEQ ID NO: 29881 - DNA, 25 bp, Mus musculus
aacagtgtggctagcagcctggcag

SEQ ID NO: 29882 - DNA, 25 bp, Mus musculus
aacagtgtggctcccttgagctcag

SEQ ID NO: 29883 - DNA, 25 bp, Mus musculus
aacagtgtggctgccttgagctcag

SEQ ID NO: 29884 - DNA, 25 bp, Mus musculus
aacagtgtggcttgcagcctggcag

SEQ ID NO: 29885 - DNA, 25 bp, Mus musculus
aacagtgtgtagactatggctaaat

SEQ ID NO: 29886 - DNA, 25 bp, Mus musculus
aacagtgtgtagtctatggctaaat

SEQ ID NO: 29887 - DNA, 25 bp, Mus musculus
aacagtgtgtgacttactggcccag

SEQ ID NO: 29888 - DNA, 25 bp, Mus musculus
aacagtgtgtgagttactggcccag

SEQ ID NO: 29889 - DNA, 25 bp, Mus musculus
aacagtgtgtgtacctagacttgcc

SEQ ID NO: 29890 - DNA, 25 bp, Mus musculus
aacagtgtgtgttcctagacttgcc

SEQ ID NO: 29891 - DNA, 25 bp, Mus musculus
aacagtgtgtttctggcccaactat

SEQ ID NO: 29892 - DNA, 25 bp, Mus musculus
aacagtgtgtttgtggcccaactat

SEQ ID NO: 29893 - DNA, 25 bp, Mus musculus
aacagtgttagccaactgtggtagc

SEQ ID NO: 29894 - DNA, 25 bp, Mus musculus
aacagtgttagcgaactgtggtagc

SEQ ID NO: 29895 - DNA, 25 bp, Mus musculus
aacagtgttcagcttatcagtgtca

SEQ ID NO: 29896 - DNA, 25 bp, Mus musculus
aacagtgttcaggttatcagtgtca

SEQ ID NO: 29897 - DNA, 25 bp, Mus musculus
aacagtgttcttactgcagccttga

SEQ ID NO: 29898 - DNA, 25 bp, Mus musculus
aacagtgttctttctgcagccttga

SEQ ID NO: 29899 - DNA, 25 bp, Mus musculus
aacagtgttggaagtccttgccctc

SEQ ID NO: 29900 - DNA, 25 bp, Mus musculus
aacagtgttggatgtccttgccctc

SEQ ID NO: 29901 - DNA, 25 bp, Mus musculus
aacagtgttggtacattagttagcc

SEQ ID NO: 29902 - DNA, 25 bp, Mus musculus
aacagtgttggttcattagttagcc

SEQ ID NO: 29903 - DNA, 25 bp, Mus musculus
aacagtgttgtgacaccgtggtcat

SEQ ID NO: 29904 - DNA, 25 bp, Mus musculus
aacagtgttgtgtcaccgtggtcat

SEQ ID NO: 29905 - DNA, 25 bp, Mus musculus
aacagtgtttcaaatgacccatttt

SEQ ID NO: 29906 - DNA, 25 bp, Mus musculus
aacagtgtttcatatgacccatttt

SEQ ID NO: 29907 - DNA, 25 bp, Mus musculus
aacagtgtttggagtgggatcccgc

SEQ ID NO: 29908 - DNA, 25 bp, Mus musculus
aacagtgtttggtgtgggatcccgc

SEQ ID NO: 29909 - DNA, 25 bp, Mus musculus
aacagttaactgcactgagtgctgt

SEQ ID NO: 29910 - DNA, 25 bp, Mus musculus
aacagttaactgcttacctacatcc

SEQ ID NO: 29911 - DNA, 25 bp, Mus musculus
aacagttaactggactgagtgctgt

SEQ ID NO: 29912 - DNA, 25 bp, Mus musculus
aacagttaactggttacctacatcc

SEQ ID NO: 29913 - DNA, 25 bp, Mus musculus
aacagttaagagctttctctccaaa

SEQ ID NO: 29914 - DNA, 25 bp, Mus musculus
aacagttaagaggtttctctccaaa

SEQ ID NO: 29915 - DNA, 25 bp, Mus musculus
aacagttacaaaaagtccatttcat

SEQ ID NO: 29916 - DNA, 25 bp, Mus musculus
aacagttacaaatagtccatttcat

SEQ ID NO: 29917 - DNA, 25 bp, Mus musculus
aacagttacaccatgttttcaatgt

SEQ ID NO: 29918 - DNA, 25 bp, Mus musculus
aacagttacaccttgttttcaatgt

SEQ ID NO: 29919 - DNA, 25 bp, Mus musculus
aacagttaccatcatccattgaaat

SEQ ID NO: 29920 - DNA, 25 bp, Mus musculus
aacagttaccatgatccattgaaat

SEQ ID NO: 29921 - DNA, 25 bp, Mus musculus
aacagttactgacgcaatcttacat

SEQ ID NO: 29922 - DNA, 25 bp, Mus musculus
aacagttactgaggcaatcttacat

SEQ ID NO: 29923 - DNA, 25 bp, Mus musculus
aacagttagatcatgactaggcatt

SEQ ID NO: 29924 - DNA, 25 bp, Mus musculus
aacagttagatcttgactaggcatt

SEQ ID NO: 29925 - DNA, 25 bp, Mus musculus
aacagttagcttatcctaggagaag

SEQ ID NO: 29926 - DNA, 25 bp, Mus musculus
aacagttagcttttcctaggagaag

SEQ ID NO: 29927 - DNA, 25 bp, Mus musculus
aacagttcaacaatccgtggctgct

SEQ ID NO: 29928 - DNA, 25 bp, Mus musculus
aacagttcaacattccgtggctgct

SEQ ID NO: 29929 - DNA, 25 bp, Mus musculus
aacagttcacaaacggctcagttcc

SEQ ID NO: 29930 - DNA, 25 bp, Mus musculus
aacagttcacaatcggctcagttcc

SEQ ID NO: 29931 - DNA, 25 bp, Mus musculus
aacagttcactgaggactcctcgta

SEQ ID NO: 29932 - DNA, 25 bp, Mus musculus
aacagttcactgtggactcctcgta

SEQ ID NO: 29933 - DNA, 25 bp, Mus musculus
aacagttcagatctactcagcccac

SEQ ID NO: 29934 - DNA, 25 bp, Mus musculus
aacagttcagatgtactcagcccac

SEQ ID NO: 29935 - DNA, 25 bp, Mus musculus
aacagttcatagaccgagccagcct

SEQ ID NO: 29936 - DNA, 25 bp, Mus musculus
aacagttcatagtccgagccagcct

SEQ ID NO: 29937 - DNA, 25 bp, Mus musculus
aacagttcatcaacagtttttctaa

SEQ ID NO: 29938 - DNA, 25 bp, Mus musculus
aacagttcatcatcagtttttctaa

SEQ ID NO: 29939 - DNA, 25 bp, Mus musculus
aacagttcatgaatttgttatcagt

SEQ ID NO: 29940 - DNA, 25 bp, Mus musculus
aacagttcatgattttgttatcagt

SEQ ID NO: 29941 - DNA, 25 bp, Mus musculus
aacagttcattgactcctcttagta

SEQ ID NO: 29942 - DNA, 25 bp, Mus musculus
aacagttcattgctttggaatggcc

SEQ ID NO: 29943 - DNA, 25 bp, Mus musculus
aacagttcattggtttggaatggcc

SEQ ID NO: 29944 - DNA, 25 bp, Mus musculus
aacagttcattgtctcctcttagta

SEQ ID NO: 29945 - DNA, 25 bp, Mus musculus
aacagttccaaacctaggtgactaa

SEQ ID NO: 29946 - DNA, 25 bp, Mus musculus
aacagttccaaagctaggtgactaa

SEQ ID NO: 29947 - DNA, 25 bp, Mus musculus
aacagttccatcatagtttgctact

SEQ ID NO: 29948 - DNA, 25 bp, Mus musculus
aacagttccatcttagtttgctact

SEQ ID NO: 29949 - DNA, 25 bp, Mus musculus
aacagttccccacatatctgaaaaa

SEQ ID NO: 29950 - DNA, 25 bp, Mus musculus
aacagttccccagatatctgaaaaa

SEQ ID NO: 29951 - DNA, 25 bp, Mus musculus
aacagttccggccattgagagcctg

SEQ ID NO: 29952 - DNA, 25 bp, Mus musculus
aacagttccggcgattgagagcctg

SEQ ID NO: 29953 - DNA, 25 bp, Mus musculus
aacagttcctcaatcaatttcttaa

SEQ ID NO: 29954 - DNA, 25 bp, Mus musculus
aacagttcctcattcaatttcttaa

SEQ ID NO: 29955 - DNA, 25 bp, Mus musculus
aacagttcctccagctgtagtgact

SEQ ID NO: 29956 - DNA, 25 bp, Mus musculus
aacagttcctcctgctgtagtgact

SEQ ID NO: 29957 - DNA, 25 bp, Mus musculus
aacagttccttgcttacacactcaa

SEQ ID NO: 29958 - DNA, 25 bp, Mus musculus
aacagttccttggttacacactcaa

SEQ ID NO: 29959 - DNA, 25 bp, Mus musculus
aacagttcgcttcccagcttgccaa

SEQ ID NO: 29960 - DNA, 25 bp, Mus musculus
aacagttcgcttgccagcttgccaa

SEQ ID NO: 29961 - DNA, 25 bp, Mus musculus
aacagttcgtgcaattgattttcag

SEQ ID NO: 29962 - DNA, 25 bp, Mus musculus
aacagttcgtgctattgattttcag

SEQ ID NO: 29963 - DNA, 25 bp, Mus musculus
aacagttctaacagggcttggtgag

SEQ ID NO: 29964 - DNA, 25 bp, Mus musculus
aacagttctaactgggcttggtgag

SEQ ID NO: 29965 - DNA, 25 bp, Mus musculus
aacagttctacaaccttctgacggc

SEQ ID NO: 29966 - DNA, 25 bp, Mus musculus
aacagttctacatccttctgacggc

SEQ ID NO: 29967 - DNA, 25 bp, Mus musculus
aacagttctcaactcacatttgagt

SEQ ID NO: 29968 - DNA, 25 bp, Mus musculus
aacagttctcaagtcacatttgagt

SEQ ID NO: 29969 - DNA, 25 bp, Mus musculus
aacagttctgcgcttgttttctgta

SEQ ID NO: 29970 - DNA, 25 bp, Mus musculus
aacagttctgcggttgttttctgta

SEQ ID NO: 29971 - DNA, 25 bp, Mus musculus
aacagttctggcatgcctggctaca

SEQ ID NO: 29972 - DNA, 25 bp, Mus musculus
aacagttctggcttgcctggctaca

SEQ ID NO: 29973 - DNA, 25 bp, Mus musculus
aacagttcttccaatgagctagtca

SEQ ID NO: 29974 - DNA, 25 bp, Mus musculus
aacagttcttcctatgagctagtca

SEQ ID NO: 29975 - DNA, 25 bp, Mus musculus
aacagttcttctatcataatagcaa

SEQ ID NO: 29976 - DNA, 25 bp, Mus musculus
aacagttcttctttcataatagcaa

SEQ ID NO: 29977 - DNA, 25 bp, Mus musculus
aacagttctttgacagcttcaagga

SEQ ID NO: 29978 - DNA, 25 bp, Mus musculus
aacagttctttgtcagcttcaagga

SEQ ID NO: 29979 - DNA, 25 bp, Mus musculus
aacagttgaatcagatactttctat

SEQ ID NO: 29980 - DNA, 25 bp, Mus musculus
aacagttgaatctgatactttctat

SEQ ID NO: 29981 - DNA, 25 bp, Mus musculus
aacagttgaccgaataccagcgccg

SEQ ID NO: 29982 - DNA, 25 bp, Mus musculus
aacagttgaccgtataccagcgccg

SEQ ID NO: 29983 - DNA, 25 bp, Mus musculus
aacagttgaggtatgtgttcctctt

SEQ ID NO: 29984 - DNA, 25 bp, Mus musculus
aacagttgaggtttgtgttcctctt

SEQ ID NO: 29985 - DNA, 25 bp, Mus musculus
aacagttgatgcattctaacatttg

SEQ ID NO: 29986 - DNA, 25 bp, Mus musculus
aacagttgatgctttctaacatttg

SEQ ID NO: 29987 - DNA, 25 bp, Mus musculus
aacagttgattgactcctctagaaa

SEQ ID NO: 29988 - DNA, 25 bp, Mus musculus
aacagttgattgtctcctctagaaa

SEQ ID NO: 29989 - DNA, 25 bp, Mus musculus
aacagttgccaaaaccatgcagctt

SEQ ID NO: 29990 - DNA, 25 bp, Mus musculus
aacagttgccaataccatgcagctt

SEQ ID NO: 29991 - DNA, 25 bp, Mus musculus
aacagttgcctacagatatagtcct

SEQ ID NO: 29992 - DNA, 25 bp, Mus musculus
aacagttgcctagagatatagtcct

SEQ ID NO: 29993 - DNA, 25 bp, Mus musculus
aacagttgcctgcaaatgttttatt

SEQ ID NO: 29994 - DNA, 25 bp, Mus musculus
aacagttgcctggaaatgttttatt

SEQ ID NO: 29995 - DNA, 25 bp, Mus musculus
aacagttggaggacgcgtacgccca

SEQ ID NO: 29996 - DNA, 25 bp, Mus musculus
aacagttggaggtcgcgtacgccca

SEQ ID NO: 29997 - DNA, 25 bp, Mus musculus
aacagttggcacattgcagatggct

SEQ ID NO: 29998 - DNA, 25 bp, Mus musculus
aacagttggcactttgcagatggct

SEQ ID NO: 29999 - DNA, 25 bp, Mus musculus
aacagttggtcacccgagtaaccat

SEQ ID NO: 30000 - DNA, 25 bp, Mus musculus
aacagttggtcagccgagtaaccat

SEQ ID NO: 30001 - DNA, 25 bp, Mus musculus
aacagttggttcacatgtaacagct

SEQ ID NO: 30002 - DNA, 25 bp, Mus musculus
aacagttggttctcatgtaacagct

SEQ ID NO: 30003 - DNA, 25 bp, Mus musculus
aacagttgtaggaccagtggctggc

SEQ ID NO: 30004 - DNA, 25 bp, Mus musculus
aacagttgtaggtccagtggctggc

SEQ ID NO: 30005 - DNA, 25 bp, Mus musculus
aacagttgtcatattctgactaagg

SEQ ID NO: 30006 - DNA, 25 bp, Mus musculus
aacagttgtcattttctgactaagg

SEQ ID NO: 30007 - DNA, 25 bp, Mus musculus
aacagttgtttgcagcagaatcttg

SEQ ID NO: 30008 - DNA, 25 bp, Mus musculus
aacagttgtttggagcagaatcttg

SEQ ID NO: 30009 - DNA, 25 bp, Mus musculus
aacagtttaacacacatgcttgtag

SEQ ID NO: 30010 - DNA, 25 bp, Mus musculus
aacagtttaacagacatgcttgtag

SEQ ID NO: 30011 - DNA, 25 bp, Mus musculus
aacagtttaaccagatgcatgatcc

SEQ ID NO: 30012 - DNA, 25 bp, Mus musculus
aacagtttaacctgatgcatgatcc

SEQ ID NO: 30013 - DNA, 25 bp, Mus musculus
aacagtttacagcgcgcaattttat

SEQ ID NO: 30014 - DNA, 25 bp, Mus musculus
aacagtttacagggcgcaattttat

SEQ ID NO: 30015 - DNA, 25 bp, Mus musculus
aacagtttagttctgcggcttctga

SEQ ID NO: 30016 - DNA, 25 bp, Mus musculus
aacagtttagttgtgcggcttctga

SEQ ID NO: 30017 - DNA, 25 bp, Mus musculus
aacagtttatgaccattttccttaa

SEQ ID NO: 30018 - DNA, 25 bp, Mus musculus
aacagtttatgagcattttccttaa

SEQ ID NO: 30019 - DNA, 25 bp, Mus musculus
aacagtttatgcaattccacagtaa

SEQ ID NO: 30020 - DNA, 25 bp, Mus musculus
aacagtttatgctattccacagtaa

SEQ ID NO: 30021 - DNA, 25 bp, Mus musculus
aacagtttatttcctacccttcctg

SEQ ID NO: 30022 - DNA, 25 bp, Mus musculus
aacagtttatttgctacccttcctg

SEQ ID NO: 30023 - DNA, 25 bp, Mus musculus
aacagtttcaaactcaagccaggtg

SEQ ID NO: 30024 - DNA, 25 bp, Mus musculus
aacagtttcaaagtcaagccaggtg

SEQ ID NO: 30025 - DNA, 25 bp, Mus musculus
aacagtttcaggacacttgcaaagt

SEQ ID NO: 30026 - DNA, 25 bp, Mus musculus
aacagtttcaggtcacttgcaaagt

SEQ ID NO: 30027 - DNA, 25 bp, Mus musculus
aacagtttcatcatctgccaagacc

SEQ ID NO: 30028 - DNA, 25 bp, Mus musculus
aacagtttcatcttctgccaagacc

SEQ ID NO: 30029 - DNA, 25 bp, Mus musculus
aacagtttccagatgtctgtggccc

SEQ ID NO: 30030 - DNA, 25 bp, Mus musculus
aacagtttccagttgtctgtggccc

SEQ ID NO: 30031 - DNA, 25 bp, Mus musculus
aacagtttccatcgtacaggcggcc

SEQ ID NO: 30032 - DNA, 25 bp, Mus musculus
aacagtttccatggtacaggcggcc

SEQ ID NO: 30033 - DNA, 25 bp, Mus musculus
aacagtttccctaaggagaagtgag

SEQ ID NO: 30034 - DNA, 25 bp, Mus musculus
aacagtttccctatgtttcatggct

SEQ ID NO: 30035 - DNA, 25 bp, Mus musculus
aacagtttcccttaggagaagtgag

SEQ ID NO: 30036 - DNA, 25 bp, Mus musculus
aacagtttccctttgtttcatggct

SEQ ID NO: 30037 - DNA, 25 bp, Mus musculus
aacagtttcctcctcagactaagat

SEQ ID NO: 30038 - DNA, 25 bp, Mus musculus
aacagtttcctcgtcagactaagat

SEQ ID NO: 30039 - DNA, 25 bp, Mus musculus
aacagtttcgggagcggctgttgct

SEQ ID NO: 30040 - DNA, 25 bp, Mus musculus
aacagtttcgggtgcggctgttgct

SEQ ID NO: 30041 - DNA, 25 bp, Mus musculus
aacagtttctgcagtctttgaactc

SEQ ID NO: 30042 - DNA, 25 bp, Mus musculus
aacagtttctgctgtctttgaactc

SEQ ID NO: 30043 - DNA, 25 bp, Mus musculus
aacagtttctgtctggacacagcct

SEQ ID NO: 30044 - DNA, 25 bp, Mus musculus
aacagtttctgtgtggacacagcct

SEQ ID NO: 30045 - DNA, 25 bp, Mus musculus
aacagtttgggcattcagcctaccg

SEQ ID NO: 30046 - DNA, 25 bp, Mus musculus
aacagtttgggctttcagcctaccg

SEQ ID NO: 30047 - DNA, 25 bp, Mus musculus
aacagtttgggtcgactgtctacat

SEQ ID NO: 30048 - DNA, 25 bp, Mus musculus
aacagtttgggtggactgtctacat

SEQ ID NO: 30049 - DNA, 25 bp, Mus musculus
aacagtttggtgaccatctcatcaa

SEQ ID NO: 30050 - DNA, 25 bp, Mus musculus
aacagtttggtgtccatctcatcaa

SEQ ID NO: 30051 - DNA, 25 bp, Mus musculus
aacagtttgtcactctcgcagcatt

SEQ ID NO: 30052 - DNA, 25 bp, Mus musculus
aacagtttgtcagtctcgcagcatt

SEQ ID NO: 30053 - DNA, 25 bp, Mus musculus
aacagttttcatacattcatctcaa

SEQ ID NO: 30054 - DNA, 25 bp, Mus musculus
aacagttttcattcattcatctcaa

SEQ ID NO: 30055 - DNA, 25 bp, Mus musculus
aacagttttctgattccttgtgctt

SEQ ID NO: 30056 - DNA, 25 bp, Mus musculus
aacagttttctgtttccttgtgctt

SEQ ID NO: 30057 - DNA, 25 bp, Mus musculus
aacagttttttacacatggctttag

SEQ ID NO: 30058 - DNA, 25 bp, Mus musculus
aacagttttttagacatggctttag

SEQ ID NO: 30059 - DNA, 25 bp, Mus musculus
aacataaaaagcattaccacggcaa

SEQ ID NO: 30060 - DNA, 25 bp, Mus musculus
aacataaaaagctttaccacggcaa

SEQ ID NO: 30061 - DNA, 25 bp, Mus musculus
aacataaaaggtctctatctgcaga

SEQ ID NO: 30062 - DNA, 25 bp, Mus musculus
aacataaaaggtgtctatctgcaga

SEQ ID NO: 30063 - DNA, 25 bp, Mus musculus
aacataaacatcatctggcctacac

SEQ ID NO: 30064 - DNA, 25 bp, Mus musculus
aacataaacatcttctggcctacac

SEQ ID NO: 30065 - DNA, 25 bp, Mus musculus
aacataaactagaactctgccccaa

SEQ ID NO: 30066 - DNA, 25 bp, Mus musculus
aacataaactagtactctgccccaa

SEQ ID NO: 30067 - DNA, 25 bp, Mus musculus
aacataaagcttaccgggttgtgag

SEQ ID NO: 30068 - DNA, 25 bp, Mus musculus
aacataaagctttccgggttgtgag

SEQ ID NO: 30069 - DNA, 25 bp, Mus musculus
aacataaaggtaaagtgcttaattg

SEQ ID NO: 30070 - DNA, 25 bp, Mus musculus
aacataaaggtatagtgcttaattg

SEQ ID NO: 30071 - DNA, 25 bp, Mus musculus
aacataaatgagatttcctgccttc

SEQ ID NO: 30072 - DNA, 25 bp, Mus musculus
aacataaatgagttttcctgccttc

SEQ ID NO: 30073 - DNA, 25 bp, Mus musculus
aacataacaaccctccatggatctg

SEQ ID NO: 30074 - DNA, 25 bp, Mus musculus
aacataacaaccgtccatggatctg

SEQ ID NO: 30075 - DNA, 25 bp, Mus musculus
aacataacaactcacaacaaaacaa

SEQ ID NO: 30076 - DNA, 25 bp, Mus musculus
aacataacaactgacaacaaaacaa

SEQ ID NO: 30077 - DNA, 25 bp, Mus musculus
aacataacaggcatcatttcccctt

SEQ ID NO: 30078 - DNA, 25 bp, Mus musculus
aacataacaggcttcatttcccctt

SEQ ID NO: 30079 - DNA, 25 bp, Mus musculus
aacataacccacctgtaacatttgt

SEQ ID NO: 30080 - DNA, 25 bp, Mus musculus
aacataacccacgtgtaacatttgt

SEQ ID NO: 30081 - DNA, 25 bp, Mus musculus
aacataacgggactctatcttcaac

SEQ ID NO: 30082 - DNA, 25 bp, Mus musculus
aacataacgggagtctatcttcaac

SEQ ID NO: 30083 - DNA, 25 bp, Mus musculus
aacataactatgatgctcgcctctg

SEQ ID NO: 30084 - DNA, 25 bp, Mus musculus
aacataactatgttgctcgcctctg

SEQ ID NO: 30085 - DNA, 25 bp, Mus musculus
aacataactctcatgccacgacctg

SEQ ID NO: 30086 - DNA, 25 bp, Mus musculus
aacataactctcttgccacgacctg

SEQ ID NO: 30087 - DNA, 25 bp, Mus musculus
aacataagatctccctgttcgaagg

SEQ ID NO: 30088 - DNA, 25 bp, Mus musculus
aacataagatctgcctgttcgaagg

SEQ ID NO: 30089 - DNA, 25 bp, Mus musculus
aacataagcttgacagtgcacacat

SEQ ID NO: 30090 - DNA, 25 bp, Mus musculus
aacataagcttgtcagtgcacacat

SEQ ID NO: 30091 - DNA, 25 bp, Mus musculus
aacataaggctcatatactcctccg

SEQ ID NO: 30092 - DNA, 25 bp, Mus musculus
aacataaggctcttatactcctccg

SEQ ID NO: 30093 - DNA, 25 bp, Mus musculus
aacataagtctgaacctactcccca

SEQ ID NO: 30094 - DNA, 25 bp, Mus musculus
aacataagtctgtacctactcccca

SEQ ID NO: 30095 - DNA, 25 bp, Mus musculus
aacataagtcttacctgacagccga

SEQ ID NO: 30096 - DNA, 25 bp, Mus musculus
aacataagtctttcctgacagccga

SEQ ID NO: 30097 - DNA, 25 bp, Mus musculus
aacataatagagacttggcaccatt

SEQ ID NO: 30098 - DNA, 25 bp, Mus musculus
aacataatagagtcttggcaccatt

SEQ ID NO: 30099 - DNA, 25 bp, Mus musculus
aacataatcaggatgcttaacaatc

SEQ ID NO: 30100 - DNA, 25 bp, Mus musculus
aacataatcaggttgcttaacaatc

SEQ ID NO: 30101 - DNA, 25 bp, Mus musculus
aacataatccctctcctttataaat

SEQ ID NO: 30102 - DNA, 25 bp, Mus musculus
aacataatccctgtcctttataaat

SEQ ID NO: 30103 - DNA, 25 bp, Mus musculus
aacataatcttcactgtcttgacaa

SEQ ID NO: 30104 - DNA, 25 bp, Mus musculus
aacataatcttctctgtcttgacaa

SEQ ID NO: 30105 - DNA, 25 bp, Mus musculus
aacataatgttaattctacaggcga

SEQ ID NO: 30106 - DNA, 25 bp, Mus musculus
aacataatgttatttctacaggcga

SEQ ID NO: 30107 - DNA, 25 bp, Mus musculus
aacataattcctatgctcagtctaa

SEQ ID NO: 30108 - DNA, 25 bp, Mus musculus
aacataattcctttgctcagtctaa

SEQ ID NO: 30109 - DNA, 25 bp, Mus musculus
aacatacaagctatctccattcacc

SEQ ID NO: 30110 - DNA, 25 bp, Mus musculus
aacatacaagctttctccattcacc

SEQ ID NO: 30111 - DNA, 25 bp, Mus musculus
aacatacacttcacagatggcaagg

SEQ ID NO: 30112 - DNA, 25 bp, Mus musculus
aacatacacttctcagatggcaagg

SEQ ID NO: 30113 - DNA, 25 bp, Mus musculus
aacatacagagaagctacccctgaa

SEQ ID NO: 30114 - DNA, 25 bp, Mus musculus
aacatacagagatgctacccctgaa

SEQ ID NO: 30115 - DNA, 25 bp, Mus musculus
aacatacagctgcttaccgacaggc

SEQ ID NO: 30116 - DNA, 25 bp, Mus musculus
aacatacagctggttaccgacaggc

SEQ ID NO: 30117 - DNA, 25 bp, Mus musculus
aacatacaggaacacctgggctgga

SEQ ID NO: 30118 - DNA, 25 bp, Mus musculus
aacatacaggaagacctgggctgga

SEQ ID NO: 30119 - DNA, 25 bp, Mus musculus
aacatacagtgaaattcagctctga

SEQ ID NO: 30120 - DNA, 25 bp, Mus musculus
aacatacagtgatattcagctctga

SEQ ID NO: 30121 - DNA, 25 bp, Mus musculus
aacatacagtttcgccaaggctctc

SEQ ID NO: 30122 - DNA, 25 bp, Mus musculus
aacatacagtttggccaaggctctc

SEQ ID NO: 30123 - DNA, 25 bp, Mus musculus
aacatacatggcacaaggaaactat

SEQ ID NO: 30124 - DNA, 25 bp, Mus musculus
aacatacatggctcaaggaaactat

SEQ ID NO: 30125 - DNA, 25 bp, Mus musculus
aacataccacttacacaagctaagg

SEQ ID NO: 30126 - DNA, 25 bp, Mus musculus
aacataccactttcacaagctaagg

SEQ ID NO: 30127 - DNA, 25 bp, Mus musculus
aacatacccacgagcccagtcagat

SEQ ID NO: 30128 - DNA, 25 bp, Mus musculus
aacatacccacgtgcccagtcagat

SEQ ID NO: 30129 - DNA, 25 bp, Mus musculus
aacataccgtagagtttatagacaa

SEQ ID NO: 30130 - DNA, 25 bp, Mus musculus
aacataccgtagtgtttatagacaa

SEQ ID NO: 30131 - DNA, 25 bp, Mus musculus
aacatacctgaaaaagcatcctaac

SEQ ID NO: 30132 - DNA, 25 bp, Mus musculus
aacatacctgaataagcatcctaac

SEQ ID NO: 30133 - DNA, 25 bp, Mus musculus
aacataccttttactccatccttct

SEQ ID NO: 30134 - DNA, 25 bp, Mus musculus
aacatacctttttctccatccttct

SEQ ID NO: 30135 - DNA, 25 bp, Mus musculus
aacatacgagcaagctggcagcaat

SEQ ID NO: 30136 - DNA, 25 bp, Mus musculus
aacatacgagcatgctggcagcaat

SEQ ID NO: 30137 - DNA, 25 bp, Mus musculus
aacatacgatgtcagggctgcccag

SEQ ID NO: 30138 - DNA, 25 bp, Mus musculus
aacatacgatgtgagggctgcccag

SEQ ID NO: 30139 - DNA, 25 bp, Mus musculus
aacatacgcagacgactacagtcat

SEQ ID NO: 30140 - DNA, 25 bp, Mus musculus
aacatacgcagaggactacagtcat

SEQ ID NO: 30141 - DNA, 25 bp, Mus musculus
aacatacgggtccatgtgttggccg

SEQ ID NO: 30142 - DNA, 25 bp, Mus musculus
aacatacgggtcgatgtgttggccg

SEQ ID NO: 30143 - DNA, 25 bp, Mus musculus
aacatacgtggacccggccatgcaa

SEQ ID NO: 30144 - DNA, 25 bp, Mus musculus
aacatacgtggagccggccatgcaa

SEQ ID NO: 30145 - DNA, 25 bp, Mus musculus
aacatactcctgctgaagtctgata

SEQ ID NO: 30146 - DNA, 25 bp, Mus musculus
aacatactcctggtgaagtctgata

SEQ ID NO: 30147 - DNA, 25 bp, Mus musculus
aacatactgccaacaaaggtgccaa

SEQ ID NO: 30148 - DNA, 25 bp, Mus musculus
aacatactgccatcaaaggtgccaa

SEQ ID NO: 30149 - DNA, 25 bp, Mus musculus
aacatactgtatcctttctacctgt

SEQ ID NO: 30150 - DNA, 25 bp, Mus musculus
aacatactgtatgctttctacctgt

SEQ ID NO: 30151 - DNA, 25 bp, Mus musculus
aacatacttagcacctactgctttc

SEQ ID NO: 30152 - DNA, 25 bp, Mus musculus
aacatacttagctcctactgctttc

SEQ ID NO: 30153 - DNA, 25 bp, Mus musculus
aacatacttgtcagagtctgcctta

SEQ ID NO: 30154 - DNA, 25 bp, Mus musculus
aacatacttgtctgagtctgcctta

SEQ ID NO: 30155 - DNA, 25 bp, Mus musculus
aacatactttgactgacattctaaa

SEQ ID NO: 30156 - DNA, 25 bp, Mus musculus
aacatactttgagtgacattctaaa

SEQ ID NO: 30157 - DNA, 25 bp, Mus musculus
aacatactttggacagtttagagag

SEQ ID NO: 30158 - DNA, 25 bp, Mus musculus
aacatactttggtcagtttagagag

SEQ ID NO: 30159 - DNA, 25 bp, Mus musculus
aacatacttttcagttcccgagaga

SEQ ID NO: 30160 - DNA, 25 bp, Mus musculus
aacatacttttctgttcccgagaga

SEQ ID NO: 30161 - DNA, 25 bp, Mus musculus
aacatagaatttcaggtaggaacaa

SEQ ID NO: 30162 - DNA, 25 bp, Mus musculus
aacatagaatttgaggtaggaacaa

SEQ ID NO: 30163 - DNA, 25 bp, Mus musculus
aacatagacactcctgatggtccac

SEQ ID NO: 30164 - DNA, 25 bp, Mus musculus
aacatagacactgctgatggtccac

SEQ ID NO: 30165 - DNA, 25 bp, Mus musculus
aacatagactagcatagactgacca

SEQ ID NO: 30166 - DNA, 25 bp, Mus musculus
aacatagactaggatagactgacca

SEQ ID NO: 30167 - DNA, 25 bp, Mus musculus
aacatagactctagagccaggttgt

SEQ ID NO: 30168 - DNA, 25 bp, Mus musculus
aacatagactcttgagccaggttgt

SEQ ID NO: 30169 - DNA, 25 bp, Mus musculus
aacatagagaccatccgagtggctc

SEQ ID NO: 30170 - DNA, 25 bp, Mus musculus
aacatagagaccttccgagtggctc

SEQ ID NO: 30171 - DNA, 25 bp, Mus musculus
aacatagagactcgttgggccttgg

SEQ ID NO: 30172 - DNA, 25 bp, Mus musculus
aacatagagactggttgggccttgg

SEQ ID NO: 30173 - DNA, 25 bp, Mus musculus
aacatagatgtaaccctctacctct

SEQ ID NO: 30174 - DNA, 25 bp, Mus musculus
aacatagatgtatccctctacctct

SEQ ID NO: 30175 - DNA, 25 bp, Mus musculus
aacatagcaataaatcctggaaggg

SEQ ID NO: 30176 - DNA, 25 bp, Mus musculus
aacatagcaatatatcctggaaggg

SEQ ID NO: 30177 - DNA, 25 bp, Mus musculus
aacatagcacctaatcttttggata

SEQ ID NO: 30178 - DNA, 25 bp, Mus musculus
aacatagcaccttatcttttggata

SEQ ID NO: 30179 - DNA, 25 bp, Mus musculus
aacatagcccaactgcagattctaa

SEQ ID NO: 30180 - DNA, 25 bp, Mus musculus
aacatagcccaagtgcagattctaa

SEQ ID NO: 30181 - DNA, 25 bp, Mus musculus
aacatagcccctcgctgtagcggta

SEQ ID NO: 30182 - DNA, 25 bp, Mus musculus
aacatagcccctggctgtagcggta

SEQ ID NO: 30183 - DNA, 25 bp, Mus musculus
aacatagcgcgtaccaggttcagtg

SEQ ID NO: 30184 - DNA, 25 bp, Mus musculus
aacatagcgcgttccaggttcagtg

SEQ ID NO: 30185 - DNA, 25 bp, Mus musculus
aacatagctaacacagtctggtaca

SEQ ID NO: 30186 - DNA, 25 bp, Mus musculus
aacatagctaactcagtctggtaca

SEQ ID NO: 30187 - DNA, 25 bp, Mus musculus
aacatagctagaccctgtgttctgt

SEQ ID NO: 30188 - DNA, 25 bp, Mus musculus
aacatagctagagcctgtgttctgt

SEQ ID NO: 30189 - DNA, 25 bp, Mus musculus
aacatagctcatattggaaattctg

SEQ ID NO: 30190 - DNA, 25 bp, Mus musculus
aacatagctcattttggaaattctg

SEQ ID NO: 30191 - DNA, 25 bp, Mus musculus
aacatagcttttaggagatcagcca

SEQ ID NO: 30192 - DNA, 25 bp, Mus musculus
aacatagctttttggagatcagcca

SEQ ID NO: 30193 - DNA, 25 bp, Mus musculus
aacataggaattcacttatcaatag

SEQ ID NO: 30194 - DNA, 25 bp, Mus musculus
aacataggaattgacttatcaatag

SEQ ID NO: 30195 - DNA, 25 bp, Mus musculus
aacataggaccactgagttggaaaa

SEQ ID NO: 30196 - DNA, 25 bp, Mus musculus
aacataggaccagtgagttggaaaa

SEQ ID NO: 30197 - DNA, 25 bp, Mus musculus
aacataggcacaatgctcctgggct

SEQ ID NO: 30198 - DNA, 25 bp, Mus musculus
aacataggcacattgctcctgggct

SEQ ID NO: 30199 - DNA, 25 bp, Mus musculus
aacataggcaggacaatgaagatga

SEQ ID NO: 30200 - DNA, 25 bp, Mus musculus
aacataggcaggtcaatgaagatga

SEQ ID NO: 30201 - DNA, 25 bp, Mus musculus
aacataggccaccagatgggcccct

SEQ ID NO: 30202 - DNA, 25 bp, Mus musculus
aacataggccacgagatgggcccct

SEQ ID NO: 30203 - DNA, 25 bp, Mus musculus
aacatagggcccagcttagcaacag

SEQ ID NO: 30204 - DNA, 25 bp, Mus musculus
aacatagggccctgcttagcaacag

SEQ ID NO: 30205 - DNA, 25 bp, Mus musculus
aacatagggtttcgaagcagcatta

SEQ ID NO: 30206 - DNA, 25 bp, Mus musculus
aacatagggtttggaagcagcatta

SEQ ID NO: 30207 - DNA, 25 bp, Mus musculus
aacatagtggccactgctcatttgc

SEQ ID NO: 30208 - DNA, 25 bp, Mus musculus
aacatagtggcctctgctcatttgc

SEQ ID NO: 30209 - DNA, 25 bp, Mus musculus
aacatagtggctaccagaagggtac

SEQ ID NO: 30210 - DNA, 25 bp, Mus musculus
aacatagtggcttccagaagggtac

SEQ ID NO: 30211 - DNA, 25 bp, Mus musculus
aacatagttggtaacatggaaacaa

SEQ ID NO: 30212 - DNA, 25 bp, Mus musculus
aacatagttggttacatggaaacaa

SEQ ID NO: 30213 - DNA, 25 bp, Mus musculus
aacatatacatcacatctgccgaag

SEQ ID NO: 30214 - DNA, 25 bp, Mus musculus
aacatatacatctcatctgccgaag

SEQ ID NO: 30215 - DNA, 25 bp, Mus musculus
aacatatacgtcatcgccgaggagc

SEQ ID NO: 30216 - DNA, 25 bp, Mus musculus
aacatatacgtcttcgccgaggagc

SEQ ID NO: 30217 - DNA, 25 bp, Mus musculus
aacatatattgtactacttcaggtg

SEQ ID NO: 30218 - DNA, 25 bp, Mus musculus
aacatatattgttctacttcaggtg

SEQ ID NO: 30219 - DNA, 25 bp, Mus musculus
aacatatcaagtcctcatcttattt

SEQ ID NO: 30220 - DNA, 25 bp, Mus musculus
aacatatcaagtgctcatcttattt

SEQ ID NO: 30221 - DNA, 25 bp, Mus musculus
aacatatcacctctgtaagccatat

SEQ ID NO: 30222 - DNA, 25 bp, Mus musculus
aacatatcacctgtgtaagccatat

SEQ ID NO: 30223 - DNA, 25 bp, Mus musculus
aacatatcacttctagagacctatt

SEQ ID NO: 30224 - DNA, 25 bp, Mus musculus
aacatatcacttgtagagacctatt

SEQ ID NO: 30225 - DNA, 25 bp, Mus musculus
aacatatgatctactagagcagtgg

SEQ ID NO: 30226 - DNA, 25 bp, Mus musculus
aacatatgatcttctagagcagtgg

SEQ ID NO: 30227 - DNA, 25 bp, Mus musculus
aacatatgcacactacttcgatctc

SEQ ID NO: 30228 - DNA, 25 bp, Mus musculus
aacatatgcacagtacttcgatctc

SEQ ID NO: 30229 - DNA, 25 bp, Mus musculus
aacatatgcactcagcttctggata

SEQ ID NO: 30230 - DNA, 25 bp, Mus musculus
aacatatgcactgagcttctggata

SEQ ID NO: 30231 - DNA, 25 bp, Mus musculus
aacatatgcagtatgtagtctcagt

SEQ ID NO: 30232 - DNA, 25 bp, Mus musculus
aacatatgcagtttgtagtctcagt

SEQ ID NO: 30233 - DNA, 25 bp, Mus musculus
aacatatggcagctgtttgtgaagc

SEQ ID NO: 30234 - DNA, 25 bp, Mus musculus
aacatatggcaggtgtttgtgaagc

SEQ ID NO: 30235 - DNA, 25 bp, Mus musculus
aacatatgggctaatctggatctaa

SEQ ID NO: 30236 - DNA, 25 bp, Mus musculus
aacatatgggcttatctggatctaa

SEQ ID NO: 30237 - DNA, 25 bp, Mus musculus
aacatatgggtgaattttcctcctt

SEQ ID NO: 30238 - DNA, 25 bp, Mus musculus
aacatatgggtgtattttcctcctt

SEQ ID NO: 30239 - DNA, 25 bp, Mus musculus
aacatatgtcagctgcatcattccc

SEQ ID NO: 30240 - DNA, 25 bp, Mus musculus
aacatatgtcaggtgcatcattccc

SEQ ID NO: 30241 - DNA, 25 bp, Mus musculus
aacatatgttagagtctccttccca

SEQ ID NO: 30242 - DNA, 25 bp, Mus musculus
aacatatgttagtgtctccttccca

SEQ ID NO: 30243 - DNA, 25 bp, Mus musculus
aacatattaaatcgcctggttcagt

SEQ ID NO: 30244 - DNA, 25 bp, Mus musculus
aacatattaaatggcctggttcagt

SEQ ID NO: 30245 - DNA, 25 bp, Mus musculus
aacatattactacctctccagatta

SEQ ID NO: 30246 - DNA, 25 bp, Mus musculus
aacatattactagctctccagatta

SEQ ID NO: 30247 - DNA, 25 bp, Mus musculus
aacatattcaggaccaacatgaagt

SEQ ID NO: 30248 - DNA, 25 bp, Mus musculus
aacatattcaggtccaacatgaagt

SEQ ID NO: 30249 - DNA, 25 bp, Mus musculus
aacatattcatacttcactgacaga

SEQ ID NO: 30250 - DNA, 25 bp, Mus musculus
aacatattcatagttcactgacaga

SEQ ID NO: 30251 - DNA, 25 bp, Mus musculus
aacatattctctaatcagggctgat

SEQ ID NO: 30252 - DNA, 25 bp, Mus musculus
aacatattctcttatcagggctgat

SEQ ID NO: 30253 - DNA, 25 bp, Mus musculus
aacatattgtcacctcctaggttat

SEQ ID NO: 30254 - DNA, 25 bp, Mus musculus
aacatattgtcagctcctaggttat

SEQ ID NO: 30255 - DNA, 25 bp, Mus musculus
aacatatttcccatgaatttgcaaa

SEQ ID NO: 30256 - DNA, 25 bp, Mus musculus
aacatatttcccttgaatttgcaaa

SEQ ID NO: 30257 - DNA, 25 bp, Mus musculus
aacatatttctaatgcaccctgctc

SEQ ID NO: 30258 - DNA, 25 bp, Mus musculus
aacatatttctattgcaccctgctc

SEQ ID NO: 30259 - DNA, 25 bp, Mus musculus
aacatatttgccaatgcttccagct

SEQ ID NO: 30260 - DNA, 25 bp, Mus musculus
aacatatttgcctatgcttccagct

SEQ ID NO: 30261 - DNA, 25 bp, Mus musculus
aacatcaaatgtcctgtgacctcac

SEQ ID NO: 30262 - DNA, 25 bp, Mus musculus
aacatcaaatgtgctgtgacctcac

SEQ ID NO: 30263 - DNA, 25 bp, Mus musculus
aacatcaagggaacctgtggctgcg

SEQ ID NO: 30264 - DNA, 25 bp, Mus musculus
aacatcaagggatcctgtggctgcg

SEQ ID NO: 30265 - DNA, 25 bp, Mus musculus
aacatcaataccctggatccagttg

SEQ ID NO: 30266 - DNA, 25 bp, Mus musculus
aacatcaataccgtggatccagttg

SEQ ID NO: 30267 - DNA, 25 bp, Mus musculus
aacatcaccaatcggacggccaagg

SEQ ID NO: 30268 - DNA, 25 bp, Mus musculus
aacatcaccaatgggacggccaagg

SEQ ID NO: 30269 - DNA, 25 bp, Mus musculus
aacatcaccagtcggaggagaatac

SEQ ID NO: 30270 - DNA, 25 bp, Mus musculus
aacatcaccagtcgggcaacaaatt

SEQ ID NO: 30271 - DNA, 25 bp, Mus musculus
aacatcaccagtgggaggagaatac

SEQ ID NO: 30272 - DNA, 25 bp, Mus musculus
aacatcaccagtggggcaacaaatt

SEQ ID NO: 30273 - DNA, 25 bp, Mus musculus
aacatcacccctatctgatatggga

SEQ ID NO: 30274 - DNA, 25 bp, Mus musculus
aacatcacccctttctgatatggga

SEQ ID NO: 30275 - DNA, 25 bp, Mus musculus
aacatcaccttaaccaagaccacag

SEQ ID NO: 30276 - DNA, 25 bp, Mus musculus
aacatcaccttatccaagaccacag

SEQ ID NO: 30277 - DNA, 25 bp, Mus musculus
aacatcactattaccaacgattgga

SEQ ID NO: 30278 - DNA, 25 bp, Mus musculus
aacatcactatttccaacgattgga

SEQ ID NO: 30279 - DNA, 25 bp, Mus musculus
aacatcacttgtaagattggcaatg

SEQ ID NO: 30280 - DNA, 25 bp, Mus musculus
aacatcacttgttagattggcaatg

SEQ ID NO: 30281 - DNA, 25 bp, Mus musculus
aacatcagaccacattcctagaacc

SEQ ID NO: 30282 - DNA, 25 bp, Mus musculus
aacatcagaccagattcctagaacc

SEQ ID NO: 30283 - DNA, 25 bp, Mus musculus
aacatcagactcagggtttctccag

SEQ ID NO: 30284 - DNA, 25 bp, Mus musculus
aacatcagactctgggtttctccag

SEQ ID NO: 30285 - DNA, 25 bp, Mus musculus
aacatcagagagattaactgtgtct

SEQ ID NO: 30286 - DNA, 25 bp, Mus musculus
aacatcagagagtttaactgtgtct

SEQ ID NO: 30287 - DNA, 25 bp, Mus musculus
aacatcagatacctgtcttcgtctt

SEQ ID NO: 30288 - DNA, 25 bp, Mus musculus
aacatcagatacgtgtcttcgtctt

SEQ ID NO: 30289 - DNA, 25 bp, Mus musculus
aacatcagcaccagtttgaggcaaa

SEQ ID NO: 30290 - DNA, 25 bp, Mus musculus
aacatcagcacctgtttgaggcaaa

SEQ ID NO: 30291 - DNA, 25 bp, Mus musculus
aacatcagcaggcattcccttaatg

SEQ ID NO: 30292 - DNA, 25 bp, Mus musculus
aacatcagcagggattcccttaatg

SEQ ID NO: 30293 - DNA, 25 bp, Mus musculus
aacatcagccatccaaggagcctac

SEQ ID NO: 30294 - DNA, 25 bp, Mus musculus
aacatcagccatgcaaggagcctac

SEQ ID NO: 30295 - DNA, 25 bp, Mus musculus
aacatcagctggacccttaagtgta

SEQ ID NO: 30296 - DNA, 25 bp, Mus musculus
aacatcagctggtcccttaagtgta

SEQ ID NO: 30297 - DNA, 25 bp, Mus musculus
aacatcaggctgagcagccactgca

SEQ ID NO: 30298 - DNA, 25 bp, Mus musculus
aacatcaggctgtgcagccactgca

SEQ ID NO: 30299 - DNA, 25 bp, Mus musculus
aacatcagtaccatcctgggctgag

SEQ ID NO: 30300 - DNA, 25 bp, Mus musculus
aacatcagtaccttcctgggctgag

SEQ ID NO: 30301 - DNA, 25 bp, Mus musculus
aacatcagtagcattgcaagatcaa

SEQ ID NO: 30302 - DNA, 25 bp, Mus musculus
aacatcagtagctttgcaagatcaa

SEQ ID NO: 30303 - DNA, 25 bp, Mus musculus
aacatcataagtatcttcgtggcta

SEQ ID NO: 30304 - DNA, 25 bp, Mus musculus
aacatcataagtttcttcgtggcta

SEQ ID NO: 30305 - DNA, 25 bp, Mus musculus
aacatcatagatccttctgagggaa

SEQ ID NO: 30306 - DNA, 25 bp, Mus musculus
aacatcatagatgcttctgagggaa

SEQ ID NO: 30307 - DNA, 25 bp, Mus musculus
aacatcatatctactgcatctctca

SEQ ID NO: 30308 - DNA, 25 bp, Mus musculus
aacatcatatcttctgcatctctca

SEQ ID NO: 30309 - DNA, 25 bp, Mus musculus
aacatcatcaacctcatacatcaac

SEQ ID NO: 30310 - DNA, 25 bp, Mus musculus
aacatcatcaacgtcatacatcaac

SEQ ID NO: 30311 - DNA, 25 bp, Mus musculus
aacatcatcaatatgcctccattac

SEQ ID NO: 30312 - DNA, 25 bp, Mus musculus
aacatcatcaatccctgcaccaagg

SEQ ID NO: 30313 - DNA, 25 bp, Mus musculus
aacatcatcaatgcctgcaccaagg

SEQ ID NO: 30314 - DNA, 25 bp, Mus musculus
aacatcatcaatttgcctccattac

SEQ ID NO: 30315 - DNA, 25 bp, Mus musculus
aacatcatcagcagtacaggccggc

SEQ ID NO: 30316 - DNA, 25 bp, Mus musculus
aacatcatcagctgtacaggccggc

SEQ ID NO: 30317 - DNA, 25 bp, Mus musculus
aacatcatcataagtccttgacatt

SEQ ID NO: 30318 - DNA, 25 bp, Mus musculus
aacatcatcatatgtccttgacatt

SEQ ID NO: 30319 - DNA, 25 bp, Mus musculus
aacatcatcccgagggtggacaaca

SEQ ID NO: 30320 - DNA, 25 bp, Mus musculus
aacatcatcccgtgggtggacaaca

SEQ ID NO: 30321 - DNA, 25 bp, Mus musculus
aacatcatccctctccgggttttca

SEQ ID NO: 30322 - DNA, 25 bp, Mus musculus
aacatcatccctgtccgggttttca

SEQ ID NO: 30323 - DNA, 25 bp, Mus musculus
aacatcatccgacctgtagaacaac

SEQ ID NO: 30324 - DNA, 25 bp, Mus musculus
aacatcatccgagctgtagaacaac

SEQ ID NO: 30325 - DNA, 25 bp, Mus musculus
aacatcatcgcaacagcagcactag

SEQ ID NO: 30326 - DNA, 25 bp, Mus musculus
aacatcatcgcatcagcagcactag

SEQ ID NO: 30327 - DNA, 25 bp, Mus musculus
aacatcatcgtcaaccagcttgtct

SEQ ID NO: 30328 - DNA, 25 bp, Mus musculus
aacatcatcgtctaccagcttgtct

SEQ ID NO: 30329 - DNA, 25 bp, Mus musculus
aacatcatctataatggcatctgat

SEQ ID NO: 30330 - DNA, 25 bp, Mus musculus
aacatcatctattatggcatctgat

SEQ ID NO: 30331 - DNA, 25 bp, Mus musculus
aacatcatctgtagacaatttgcca

SEQ ID NO: 30332 - DNA, 25 bp, Mus musculus
aacatcatctgttgacaatttgcca

SEQ ID NO: 30333 - DNA, 25 bp, Mus musculus
aacatcatgatcaactggacgacag

SEQ ID NO: 30334 - DNA, 25 bp, Mus musculus
aacatcatgatctactggacgacag

SEQ ID NO: 30335 - DNA, 25 bp, Mus musculus
aacatcatgatgattcccttggcca

SEQ ID NO: 30336 - DNA, 25 bp, Mus musculus
aacatcatgatgtttcccttggcca

SEQ ID NO: 30337 - DNA, 25 bp, Mus musculus
aacatcatgattatcctggagactc

SEQ ID NO: 30338 - DNA, 25 bp, Mus musculus
aacatcatgattttcctggagactc

SEQ ID NO: 30339 - DNA, 25 bp, Mus musculus
aacatcatgggtacttggcctcagt

SEQ ID NO: 30340 - DNA, 25 bp, Mus musculus
aacatcatgggttcttggcctcagt

SEQ ID NO: 30341 - DNA, 25 bp, Mus musculus
aacatcatgtaaccctcatccgaag

SEQ ID NO: 30342 - DNA, 25 bp, Mus musculus
aacatcatgtaagcctcatccgaag

SEQ ID NO: 30343 - DNA, 25 bp, Mus musculus
aacatcatttagatcggtgctcacg

SEQ ID NO: 30344 - DNA, 25 bp, Mus musculus
aacatcatttagttcggtgctcacg

SEQ ID NO: 30345 - DNA, 25 bp, Mus musculus
aacatccaacttatacatctgtggg

SEQ ID NO: 30346 - DNA, 25 bp, Mus musculus
aacatccaacttttacatctgtggg

SEQ ID NO: 30347 - DNA, 25 bp, Mus musculus
aacatccaccctatgtcaggttata

SEQ ID NO: 30348 - DNA, 25 bp, Mus musculus
aacatccaccctttgtcaggttata

SEQ ID NO: 30349 - DNA, 25 bp, Mus musculus
aacatccaggttcgtgaaaggacaa

SEQ ID NO: 30350 - DNA, 25 bp, Mus musculus
aacatccaggttggtgaaaggacaa

SEQ ID NO: 30351 - DNA, 25 bp, Mus musculus
aacatccagtacaacaacatcccat

SEQ ID NO: 30352 - DNA, 25 bp, Mus musculus
aacatccagtactacaacatcccat

SEQ ID NO: 30353 - DNA, 25 bp, Mus musculus
aacatccataatagcccattgctac

SEQ ID NO: 30354 - DNA, 25 bp, Mus musculus
aacatccataattgcccattgctac

SEQ ID NO: 30355 - DNA, 25 bp, Mus musculus
aacatccatctgaatgtctcaggtt

SEQ ID NO: 30356 - DNA, 25 bp, Mus musculus
aacatccatctgtatgtctcaggtt

SEQ ID NO: 30357 - DNA, 25 bp, Mus musculus
aacatcccaatgaggtaaacagcaa

SEQ ID NO: 30358 - DNA, 25 bp, Mus musculus
aacatcccaatgtggtaaacagcaa

SEQ ID NO: 30359 - DNA, 25 bp, Mus musculus
aacatcccagcgagcaggactccgt

SEQ ID NO: 30360 - DNA, 25 bp, Mus musculus
aacatcccagcgtgcaggactccgt

SEQ ID NO: 30361 - DNA, 25 bp, Mus musculus
aacatcccatacatcgagagtgagg

SEQ ID NO: 30362 - DNA, 25 bp, Mus musculus
aacatcccatacttcgagagtgagg

SEQ ID NO: 30363 - DNA, 25 bp, Mus musculus
aacatccccactaaacttgttctag

SEQ ID NO: 30364 - DNA, 25 bp, Mus musculus
aacatccccacttaacttgttctag

SEQ ID NO: 30365 - DNA, 25 bp, Mus musculus
aacatccccagtcagtctttaagtg

SEQ ID NO: 30366 - DNA, 25 bp, Mus musculus
aacatccccagtgagtctttaagtg

SEQ ID NO: 30367 - DNA, 25 bp, Mus musculus
aacatccccatgagaagttaactgt

SEQ ID NO: 30368 - DNA, 25 bp, Mus musculus
aacatccccatgtgaagttaactgt

SEQ ID NO: 30369 - DNA, 25 bp, Mus musculus
aacatcccgatgaacatgaagtgca

SEQ ID NO: 30370 - DNA, 25 bp, Mus musculus
aacatcccgatgtacatgaagtgca

SEQ ID NO: 30371 - DNA, 25 bp, Mus musculus
aacatcccgtgaactcattttgaca

SEQ ID NO: 30372 - DNA, 25 bp, Mus musculus
aacatcccgtgatctcattttgaca

SEQ ID NO: 30373 - DNA, 25 bp, Mus musculus
aacatccctatcaacgacattgtcc

SEQ ID NO: 30374 - DNA, 25 bp, Mus musculus
aacatccctatctacgacattgtcc

SEQ ID NO: 30375 - DNA, 25 bp, Mus musculus
aacatccctctgctgttttaggatc

SEQ ID NO: 30376 - DNA, 25 bp, Mus musculus
aacatccctctggtgttttaggatc

SEQ ID NO: 30377 - DNA, 25 bp, Mus musculus
aacatccctgaacatggttgcctta

SEQ ID NO: 30378 - DNA, 25 bp, Mus musculus
aacatccctgaagatggttgcctta

SEQ ID NO: 30379 - DNA, 25 bp, Mus musculus
aacatccgaagtaatcttctcccaa

SEQ ID NO: 30380 - DNA, 25 bp, Mus musculus
aacatccgaagttatcttctcccaa

SEQ ID NO: 30381 - DNA, 25 bp, Mus musculus
aacatccgccttaacaggtcgttat

SEQ ID NO: 30382 - DNA, 25 bp, Mus musculus
aacatccgcctttacaggtcgttat

SEQ ID NO: 30383 - DNA, 25 bp, Mus musculus
aacatccgctttctgttcgcagctg

SEQ ID NO: 30384 - DNA, 25 bp, Mus musculus
aacatccgctttgtgttcgcagctg

SEQ ID NO: 30385 - DNA, 25 bp, Mus musculus
aacatccgtggaattcccattggaa

SEQ ID NO: 30386 - DNA, 25 bp, Mus musculus
aacatccgtggatttcccattggaa

SEQ ID NO: 30387 - DNA, 25 bp, Mus musculus
aacatcctaacccagactgtttcaa

SEQ ID NO: 30388 - DNA, 25 bp, Mus musculus
aacatcctaaccgagactgtttcaa

SEQ ID NO: 30389 - DNA, 25 bp, Mus musculus
aacatcctagaaccagcacacatat

SEQ ID NO: 30390 - DNA, 25 bp, Mus musculus
aacatcctagaagcagcacacatat

SEQ ID NO: 30391 - DNA, 25 bp, Mus musculus
aacatcctagcgcaggttagcccag

SEQ ID NO: 30392 - DNA, 25 bp, Mus musculus
aacatcctagcggaggttagcccag

SEQ ID NO: 30393 - DNA, 25 bp, Mus musculus
aacatcctcactaagctggctgtga

SEQ ID NO: 30394 - DNA, 25 bp, Mus musculus
aacatcctcacttagctggctgtga

SEQ ID NO: 30395 - DNA, 25 bp, Mus musculus
aacatcctccataaattgtatgtac

SEQ ID NO: 30396 - DNA, 25 bp, Mus musculus
aacatcctccattaattgtatgtac

SEQ ID NO: 30397 - DNA, 25 bp, Mus musculus
aacatcctcccactggcagatggaa

SEQ ID NO: 30398 - DNA, 25 bp, Mus musculus
aacatcctcccagtggcagatggaa

SEQ ID NO: 30399 - DNA, 25 bp, Mus musculus
aacatcctctataggcttctgtgga

SEQ ID NO: 30400 - DNA, 25 bp, Mus musculus
aacatcctctattggcttctgtgga

SEQ ID NO: 30401 - DNA, 25 bp, Mus musculus
aacatcctctcaatccaatacattg

SEQ ID NO: 30402 - DNA, 25 bp, Mus musculus
aacatcctctcacgttgtcgccaga

SEQ ID NO: 30403 - DNA, 25 bp, Mus musculus
aacatcctctcaggttgtcgccaga

SEQ ID NO: 30404 - DNA, 25 bp, Mus musculus
aacatcctctcattccaatacattg

SEQ ID NO: 30405 - DNA, 25 bp, Mus musculus
aacatcctgaaaacacctctggcct

SEQ ID NO: 30406 - DNA, 25 bp, Mus musculus
aacatcctgaaatcacctctggcct

SEQ ID NO: 30407 - DNA, 25 bp, Mus musculus
aacatcctgagaactttgtcttcat

SEQ ID NO: 30408 - DNA, 25 bp, Mus musculus
aacatcctgagatctttgtcttcat

SEQ ID NO: 30409 - DNA, 25 bp, Mus musculus
aacatcctgctgagaacactaggta

SEQ ID NO: 30410 - DNA, 25 bp, Mus musculus
aacatcctgctgtgaacactaggta

SEQ ID NO: 30411 - DNA, 25 bp, Mus musculus
aacatcctgcttctgggtttcggca

SEQ ID NO: 30412 - DNA, 25 bp, Mus musculus
aacatcctgcttgtgggtttcggca

SEQ ID NO: 30413 - DNA, 25 bp, Mus musculus
aacatcctgggaaataccacgattt

SEQ ID NO: 30414 - DNA, 25 bp, Mus musculus
aacatcctgggatataccacgattt

SEQ ID NO: 30415 - DNA, 25 bp, Mus musculus
aacatcctgtaaaggattccaacta

SEQ ID NO: 30416 - DNA, 25 bp, Mus musculus
aacatcctgtaatggattccaacta

SEQ ID NO: 30417 - DNA, 25 bp, Mus musculus
aacatcctgtgactcctaggtaaag

SEQ ID NO: 30418 - DNA, 25 bp, Mus musculus
aacatcctgtgagtcctaggtaaag

SEQ ID NO: 30419 - DNA, 25 bp, Mus musculus
aacatcctgtgtatcaagcccctta

SEQ ID NO: 30420 - DNA, 25 bp, Mus musculus
aacatcctgtgtttcaagcccctta

SEQ ID NO: 30421 - DNA, 25 bp, Mus musculus
aacatccttatacttgctgtctgct

SEQ ID NO: 30422 - DNA, 25 bp, Mus musculus
aacatccttatagttgctgtctgct

SEQ ID NO: 30423 - DNA, 25 bp, Mus musculus
aacatccttctcagtttctccggaa

SEQ ID NO: 30424 - DNA, 25 bp, Mus musculus
aacatccttctctgtttctccggaa

SEQ ID NO: 30425 - DNA, 25 bp, Mus musculus
aacatccttgccattatactttaat

SEQ ID NO: 30426 - DNA, 25 bp, Mus musculus
aacatccttgcctttatactttaat

SEQ ID NO: 30427 - DNA, 25 bp, Mus musculus
aacatccttgggaggagacttgggt

SEQ ID NO: 30428 - DNA, 25 bp, Mus musculus
aacatccttgggtggagacttgggt

SEQ ID NO: 30429 - DNA, 25 bp, Mus musculus
aacatcctttgtacccgctttgtgc

SEQ ID NO: 30430 - DNA, 25 bp, Mus musculus
aacatcctttgttcccgctttgtgc

SEQ ID NO: 30431 - DNA, 25 bp, Mus musculus
aacatccttttgctgctggagggtg

SEQ ID NO: 30432 - DNA, 25 bp, Mus musculus
aacatccttttggtgctggagggtg

SEQ ID NO: 30433 - DNA, 25 bp, Mus musculus
aacatcgaaattcagtatgtgcccc

SEQ ID NO: 30434 - DNA, 25 bp, Mus musculus
aacatcgaaattgagtatgtgcccc

SEQ ID NO: 30435 - DNA, 25 bp, Mus musculus
aacatcgacaagaagggctaaaggt

SEQ ID NO: 30436 - DNA, 25 bp, Mus musculus
aacatcgacaagtagggctaaaggt

SEQ ID NO: 30437 - DNA, 25 bp, Mus musculus
aacatcgacgagctggacccagagg

SEQ ID NO: 30438 - DNA, 25 bp, Mus musculus
aacatcgacgaggtggacccagagg

SEQ ID NO: 30439 - DNA, 25 bp, Mus musculus
aacatcgagatcacgcgccaggagc

SEQ ID NO: 30440 - DNA, 25 bp, Mus musculus
aacatcgagatctcgcgccaggagc

SEQ ID NO: 30441 - DNA, 25 bp, Mus musculus
aacatcgaggaacttggctgcctct

SEQ ID NO: 30442 - DNA, 25 bp, Mus musculus
aacatcgaggaagttggctgcctct

SEQ ID NO: 30443 - DNA, 25 bp, Mus musculus
aacatcgataatcctgggccttggt

SEQ ID NO: 30444 - DNA, 25 bp, Mus musculus
aacatcgataatgctgggccttggt

SEQ ID NO: 30445 - DNA, 25 bp, Mus musculus
aacatcgatcttccaaactaccttg

SEQ ID NO: 30446 - DNA, 25 bp, Mus musculus
aacatcgatcttgcaaactaccttg

SEQ ID NO: 30447 - DNA, 25 bp, Mus musculus
aacatcgatgaccagggcagcgcct

SEQ ID NO: 30448 - DNA, 25 bp, Mus musculus
aacatcgatgacgagggcagcgcct

SEQ ID NO: 30449 - DNA, 25 bp, Mus musculus
aacatcgcacagacagactcacctt

SEQ ID NO: 30450 - DNA, 25 bp, Mus musculus
aacatcgcacagtcagactcacctt

SEQ ID NO: 30451 - DNA, 25 bp, Mus musculus
aacatcgcaccgattcagaggtagc

SEQ ID NO: 30452 - DNA, 25 bp, Mus musculus
aacatcgcaccgtttcagaggtagc

SEQ ID NO: 30453 - DNA, 25 bp, Mus musculus
aacatcgccgcactggtgtttgcct

SEQ ID NO: 30454 - DNA, 25 bp, Mus musculus
aacatcgccgcagtggtgtttgcct

SEQ ID NO: 30455 - DNA, 25 bp, Mus musculus
aacatcggccgtagataagcgctga

SEQ ID NO: 30456 - DNA, 25 bp, Mus musculus
aacatcggccgttgataagcgctga

SEQ ID NO: 30457 - DNA, 25 bp, Mus musculus
aacatcgggcttcctgtcagcacca

SEQ ID NO: 30458 - DNA, 25 bp, Mus musculus
aacatcgggcttgctgtcagcacca

SEQ ID NO: 30459 - DNA, 25 bp, Mus musculus
aacatcggtcggcttttatgagcct

SEQ ID NO: 30460 - DNA, 25 bp, Mus musculus
aacatcggtcgggttttatgagcct

SEQ ID NO: 30461 - DNA, 25 bp, Mus musculus
aacatcggtgttcagttgtccactg

SEQ ID NO: 30462 - DNA, 25 bp, Mus musculus
aacatcggtgttgagttgtccactg

SEQ ID NO: 30463 - DNA, 25 bp, Mus musculus
aacatcgtcatacactcttctgcat

SEQ ID NO: 30464 - DNA, 25 bp, Mus musculus
aacatcgtcatagactcttctgcat

SEQ ID NO: 30465 - DNA, 25 bp, Mus musculus
aacatcgtcatgaacatgtgtcagt

SEQ ID NO: 30466 - DNA, 25 bp, Mus musculus
aacatcgtcatgtacatgtgtcagt

SEQ ID NO: 30467 - DNA, 25 bp, Mus musculus
aacatcgtccccaaacagaagtatt

SEQ ID NO: 30468 - DNA, 25 bp, Mus musculus
aacatcgtcccctaacagaagtatt

SEQ ID NO: 30469 - DNA, 25 bp, Mus musculus
aacatcgtcgctatgaagatcccac

SEQ ID NO: 30470 - DNA, 25 bp, Mus musculus
aacatcgtcgctttgaagatcccac

SEQ ID NO: 30471 - DNA, 25 bp, Mus musculus
aacatcgtctgtcaagtaaacccta

SEQ ID NO: 30472 - DNA, 25 bp, Mus musculus
aacatcgtctgtgaagtaaacccta

SEQ ID NO: 30473 - DNA, 25 bp, Mus musculus
aacatcgtgcgcagcatagtgcact

SEQ ID NO: 30474 - DNA, 25 bp, Mus musculus
aacatcgtgcgctgcatagtgcact

SEQ ID NO: 30475 - DNA, 25 bp, Mus musculus
aacatcgttgggactgttctggttt

SEQ ID NO: 30476 - DNA, 25 bp, Mus musculus
aacatcgttgggtctgttctggttt

SEQ ID NO: 30477 - DNA, 25 bp, Mus musculus
aacatctaactacactgagcaccta

SEQ ID NO: 30478 - DNA, 25 bp, Mus musculus
aacatctaactagactgagcaccta

SEQ ID NO: 30479 - DNA, 25 bp, Mus musculus
aacatctacacaagaaccagaggaa

SEQ ID NO: 30480 - DNA, 25 bp, Mus musculus
aacatctacacatgaaccagaggaa

SEQ ID NO: 30481 - DNA, 25 bp, Mus musculus
aacatctacaccaacgacgacatgg

SEQ ID NO: 30482 - DNA, 25 bp, Mus musculus
aacatctacacctacgacgacatgg

SEQ ID NO: 30483 - DNA, 25 bp, Mus musculus
aacatctacttgcagtcaaagggct

SEQ ID NO: 30484 - DNA, 25 bp, Mus musculus
aacatctacttggagtcaaagggct

SEQ ID NO: 30485 - DNA, 25 bp, Mus musculus
aacatctagactaaagggtttcaga

SEQ ID NO: 30486 - DNA, 25 bp, Mus musculus
aacatctagactatggagtttccaa

SEQ ID NO: 30487 - DNA, 25 bp, Mus musculus
aacatctagacttaagggtttcaga

SEQ ID NO: 30488 - DNA, 25 bp, Mus musculus
aacatctagactttggagtttccaa

SEQ ID NO: 30489 - DNA, 25 bp, Mus musculus
aacatctagatcactttactaaaga

SEQ ID NO: 30490 - DNA, 25 bp, Mus musculus
aacatctagatctctttactaaaga

SEQ ID NO: 30491 - DNA, 25 bp, Mus musculus
aacatctataggcaaccgctggcat

SEQ ID NO: 30492 - DNA, 25 bp, Mus musculus
aacatctatagggaaccgctggcat

SEQ ID NO: 30493 - DNA, 25 bp, Mus musculus
aacatctatatgcttgggtgataag

SEQ ID NO: 30494 - DNA, 25 bp, Mus musculus
aacatctatatggttgggtgataag

SEQ ID NO: 30495 - DNA, 25 bp, Mus musculus
aacatctattctatctttctagagg

SEQ ID NO: 30496 - DNA, 25 bp, Mus musculus
aacatctattctttctttctagagg

SEQ ID NO: 30497 - DNA, 25 bp, Mus musculus
aacatctattgccttcctgtggaaa

SEQ ID NO: 30498 - DNA, 25 bp, Mus musculus
aacatctattgcgttcctgtggaaa

SEQ ID NO: 30499 - DNA, 25 bp, Mus musculus
aacatctattttctgtactgcaaac

SEQ ID NO: 30500 - DNA, 25 bp, Mus musculus
aacatctattttgtgtactgcaaac

SEQ ID NO: 30501 - DNA, 25 bp, Mus musculus
aacatctcaagaataccgtgcctag

SEQ ID NO: 30502 - DNA, 25 bp, Mus musculus
aacatctcaagattaccgtgcctag

SEQ ID NO: 30503 - DNA, 25 bp, Mus musculus
aacatctcagctctgtttatcataa

SEQ ID NO: 30504 - DNA, 25 bp, Mus musculus
aacatctcagctgtgtttatcataa

SEQ ID NO: 30505 - DNA, 25 bp, Mus musculus
aacatctcatcacgtcgatctgctg

SEQ ID NO: 30506 - DNA, 25 bp, Mus musculus
aacatctcatcaggtcgatctgctg

SEQ ID NO: 30507 - DNA, 25 bp, Mus musculus
aacatctccacaaacttggtgtgtg

SEQ ID NO: 30508 - DNA, 25 bp, Mus musculus
aacatctccacatacttggtgtgtg

SEQ ID NO: 30509 - DNA, 25 bp, Mus musculus
aacatctccgcaaaccggaaatcca

SEQ ID NO: 30510 - DNA, 25 bp, Mus musculus
aacatctccgcataccggaaatcca

SEQ ID NO: 30511 - DNA, 25 bp, Mus musculus
aacatctccggtcgacttgccagga

SEQ ID NO: 30512 - DNA, 25 bp, Mus musculus
aacatctccggtggacttgccagga

SEQ ID NO: 30513 - DNA, 25 bp, Mus musculus
aacatctcctgcctagagttctaaa

SEQ ID NO: 30514 - DNA, 25 bp, Mus musculus
aacatctcctgcgtagagttctaaa

SEQ ID NO: 30515 - DNA, 25 bp, Mus musculus
aacatctcgaggcaccctaaattac

SEQ ID NO: 30516 - DNA, 25 bp, Mus musculus
aacatctcgagggaccctaaattac

SEQ ID NO: 30517 - DNA, 25 bp, Mus musculus
aacatctcgctgatcctgaagataa

SEQ ID NO: 30518 - DNA, 25 bp, Mus musculus
aacatctcgctgttcctgaagataa

SEQ ID NO: 30519 - DNA, 25 bp, Mus musculus
aacatctcggtgctacattttctct

SEQ ID NO: 30520 - DNA, 25 bp, Mus musculus
aacatctcggtggtacattttctct

SEQ ID NO: 30521 - DNA, 25 bp, Mus musculus
aacatctctagactggaagcttact

SEQ ID NO: 30522 - DNA, 25 bp, Mus musculus
aacatctctagagtggaagcttact

SEQ ID NO: 30523 - DNA, 25 bp, Mus musculus
aacatctctcctatatagtccaata

SEQ ID NO: 30524 - DNA, 25 bp, Mus musculus
aacatctctcctttatagtccaata

SEQ ID NO: 30525 - DNA, 25 bp, Mus musculus
aacatctctgataggtccgagggca

SEQ ID NO: 30526 - DNA, 25 bp, Mus musculus
aacatctctgattggtccgagggca

SEQ ID NO: 30527 - DNA, 25 bp, Mus musculus
aacatctctggcacaggaccatgaa

SEQ ID NO: 30528 - DNA, 25 bp, Mus musculus
aacatctctggcctatgggccagcc

SEQ ID NO: 30529 - DNA, 25 bp, Mus musculus
aacatctctggcgtatgggccagcc

SEQ ID NO: 30530 - DNA, 25 bp, Mus musculus
aacatctctggctcaggaccatgaa

SEQ ID NO: 30531 - DNA, 25 bp, Mus musculus
aacatctcttctacaatctgtcaag

SEQ ID NO: 30532 - DNA, 25 bp, Mus musculus
aacatctcttcttcaatctgtcaag

SEQ ID NO: 30533 - DNA, 25 bp, Mus musculus
aacatctgaaccatcttgacatctc

SEQ ID NO: 30534 - DNA, 25 bp, Mus musculus
aacatctgaaccttcttgacatctc

SEQ ID NO: 30535 - DNA, 25 bp, Mus musculus
aacatctgacatatccaggcttctg

SEQ ID NO: 30536 - DNA, 25 bp, Mus musculus
aacatctgacatttccaggcttctg

SEQ ID NO: 30537 - DNA, 25 bp, Mus musculus
aacatctgagttccctgtcactaga

SEQ ID NO: 30538 - DNA, 25 bp, Mus musculus
aacatctgagttgcctgtcactaga

SEQ ID NO: 30539 - DNA, 25 bp, Mus musculus
aacatctgcaacaggaactgacgaa

SEQ ID NO: 30540 - DNA, 25 bp, Mus musculus
aacatctgcaactggaactgacgaa

SEQ ID NO: 30541 - DNA, 25 bp, Mus musculus
aacatctgcactaggagcactgaag

SEQ ID NO: 30542 - DNA, 25 bp, Mus musculus
aacatctgcacttggagcactgaag

SEQ ID NO: 30543 - DNA, 25 bp, Mus musculus
aacatctgcagaagacagtgatgca

SEQ ID NO: 30544 - DNA, 25 bp, Mus musculus
aacatctgcagatgacagtgatgca

SEQ ID NO: 30545 - DNA, 25 bp, Mus musculus
aacatctgcagtcctattgctttca

SEQ ID NO: 30546 - DNA, 25 bp, Mus musculus
aacatctgcagtgctattgctttca

SEQ ID NO: 30547 - DNA, 25 bp, Mus musculus
aacatctgcatccactgcttggata

SEQ ID NO: 30548 - DNA, 25 bp, Mus musculus
aacatctgcatcgactgcttggata

SEQ ID NO: 30549 - DNA, 25 bp, Mus musculus
aacatctgcctgctaactaggccca

SEQ ID NO: 30550 - DNA, 25 bp, Mus musculus
aacatctgcctggtaactaggccca

SEQ ID NO: 30551 - DNA, 25 bp, Mus musculus
aacatctgcgtcactggtttcaggt

SEQ ID NO: 30552 - DNA, 25 bp, Mus musculus
aacatctgcgtctctggtttcaggt

SEQ ID NO: 30553 - DNA, 25 bp, Mus musculus
aacatctgcgtgatggtgctactcc

SEQ ID NO: 30554 - DNA, 25 bp, Mus musculus
aacatctgcgtgttggtgctactcc

SEQ ID NO: 30555 - DNA, 25 bp, Mus musculus
aacatctgctccaggttgcaaacat

SEQ ID NO: 30556 - DNA, 25 bp, Mus musculus
aacatctgctcctggttgcaaacat

SEQ ID NO: 30557 - DNA, 25 bp, Mus musculus
aacatctgctcgcaatggcacacag

SEQ ID NO: 30558 - DNA, 25 bp, Mus musculus
aacatctgctcggaatggcacacag

SEQ ID NO: 30559 - DNA, 25 bp, Mus musculus
aacatctgctgccttagacctgggt

SEQ ID NO: 30560 - DNA, 25 bp, Mus musculus
aacatctgctgcgttagacctgggt

SEQ ID NO: 30561 - DNA, 25 bp, Mus musculus
aacatctgctggatcagttcctcag

SEQ ID NO: 30562 - DNA, 25 bp, Mus musculus
aacatctgctggttcagttcctcag

SEQ ID NO: 30563 - DNA, 25 bp, Mus musculus
aacatctggacgaagcgcagcctgt

SEQ ID NO: 30564 - DNA, 25 bp, Mus musculus
aacatctggacgtagcgcagcctgt

SEQ ID NO: 30565 - DNA, 25 bp, Mus musculus
aacatctggagcctaacccctaata

SEQ ID NO: 30566 - DNA, 25 bp, Mus musculus
aacatctggagcgtaacccctaata

SEQ ID NO: 30567 - DNA, 25 bp, Mus musculus
aacatctggatgctccccttaggag

SEQ ID NO: 30568 - DNA, 25 bp, Mus musculus
aacatctggatggtccccttaggag

SEQ ID NO: 30569 - DNA, 25 bp, Mus musculus
aacatctgggaacttaaattactgc

SEQ ID NO: 30570 - DNA, 25 bp, Mus musculus
aacatctgggaagttaaattactgc

SEQ ID NO: 30571 - DNA, 25 bp, Mus musculus
aacatctgggacactgaagatcccc

SEQ ID NO: 30572 - DNA, 25 bp, Mus musculus
aacatctgggactctgaagatcccc

SEQ ID NO: 30573 - DNA, 25 bp, Mus musculus
aacatctgggagattctgcggcagc

SEQ ID NO: 30574 - DNA, 25 bp, Mus musculus
aacatctgggagtttctgcggcagc

SEQ ID NO: 30575 - DNA, 25 bp, Mus musculus
aacatctgggatcagcaccttgtga

SEQ ID NO: 30576 - DNA, 25 bp, Mus musculus
aacatctgggatgagcaccttgtga

SEQ ID NO: 30577 - DNA, 25 bp, Mus musculus
aacatctgggtcaagaaaacgcaaa

SEQ ID NO: 30578 - DNA, 25 bp, Mus musculus
aacatctgggtctagaaaacgcaaa

SEQ ID NO: 30579 - DNA, 25 bp, Mus musculus
aacatctggtgtacctctggaggtc

SEQ ID NO: 30580 - DNA, 25 bp, Mus musculus
aacatctggtgttcctctggaggtc

SEQ ID NO: 30581 - DNA, 25 bp, Mus musculus
aacatctggtttacagtgtcctgag

SEQ ID NO: 30582 - DNA, 25 bp, Mus musculus
aacatctggttttcagtgtcctgag

SEQ ID NO: 30583 - DNA, 25 bp, Mus musculus
aacatctgtcgccactgttgtcttt

SEQ ID NO: 30584 - DNA, 25 bp, Mus musculus
aacatctgtcgcgactgttgtcttt

SEQ ID NO: 30585 - DNA, 25 bp, Mus musculus
aacatctgtctcaggtggagggcca

SEQ ID NO: 30586 - DNA, 25 bp, Mus musculus
aacatctgtctctggtggagggcca

SEQ ID NO: 30587 - DNA, 25 bp, Mus musculus
aacatctgtgaaactgccccgaata

SEQ ID NO: 30588 - DNA, 25 bp, Mus musculus
aacatctgtgaatctgccccgaata

SEQ ID NO: 30589 - DNA, 25 bp, Mus musculus
aacatctgtgagagttcttcaggca

SEQ ID NO: 30590 - DNA, 25 bp, Mus musculus
aacatctgtgagtgttcttcaggca

SEQ ID NO: 30591 - DNA, 25 bp, Mus musculus
aacatctgtggtctctgttcctagc

SEQ ID NO: 30592 - DNA, 25 bp, Mus musculus
aacatctgtggtgtctgttcctagc

SEQ ID NO: 30593 - DNA, 25 bp, Mus musculus
aacatctgtgtccaagttcacactt

SEQ ID NO: 30594 - DNA, 25 bp, Mus musculus
aacatctgtgtcgaagttcacactt

SEQ ID NO: 30595 - DNA, 25 bp, Mus musculus
aacatctgtttcaaggtcttagcta

SEQ ID NO: 30596 - DNA, 25 bp, Mus musculus
aacatctgtttctaggtcttagcta

SEQ ID NO: 30597 - DNA, 25 bp, Mus musculus
aacatcttcaacaaaatcataagag

SEQ ID NO: 30598 - DNA, 25 bp, Mus musculus
aacatcttcaactaaatcataagag

SEQ ID NO: 30599 - DNA, 25 bp, Mus musculus
aacatcttcaccaaggtctcctact

SEQ ID NO: 30600 - DNA, 25 bp, Mus musculus
aacatcttcacctaggtctcctact

SEQ ID NO: 30601 - DNA, 25 bp, Mus musculus
aacatcttcatgaaagctttccact

SEQ ID NO: 30602 - DNA, 25 bp, Mus musculus
aacatcttcatgaccaacacatacc

SEQ ID NO: 30603 - DNA, 25 bp, Mus musculus
aacatcttcatgtaagctttccact

SEQ ID NO: 30604 - DNA, 25 bp, Mus musculus
aacatcttcatgtccaacacatacc

SEQ ID NO: 30605 - DNA, 25 bp, Mus musculus
aacatcttccacacggttgcacgag

SEQ ID NO: 30606 - DNA, 25 bp, Mus musculus
aacatcttccactcggttgcacgag

SEQ ID NO: 30607 - DNA, 25 bp, Mus musculus
aacatcttcttcatggattgactcc

SEQ ID NO: 30608 - DNA, 25 bp, Mus musculus
aacatcttcttcttggattgactcc

SEQ ID NO: 30609 - DNA, 25 bp, Mus musculus
aacatctttatcactagtactaaag

SEQ ID NO: 30610 - DNA, 25 bp, Mus musculus
aacatctttatctctagtactaaag

SEQ ID NO: 30611 - DNA, 25 bp, Mus musculus
aacatctttcatcctccttggaaaa

SEQ ID NO: 30612 - DNA, 25 bp, Mus musculus
aacatctttcatgctccttggaaaa

SEQ ID NO: 30613 - DNA, 25 bp, Mus musculus
aacatctttcgaaaactgctcaagt

SEQ ID NO: 30614 - DNA, 25 bp, Mus musculus
aacatctttcgataactgctcaagt

SEQ ID NO: 30615 - DNA, 25 bp, Mus musculus
aacatctttcttcctcacacttaaa

SEQ ID NO: 30616 - DNA, 25 bp, Mus musculus
aacatctttcttgctcacacttaaa

SEQ ID NO: 30617 - DNA, 25 bp, Mus musculus
aacatctttgcgagttataccctcc

SEQ ID NO: 30618 - DNA, 25 bp, Mus musculus
aacatctttgcgtgttataccctcc

SEQ ID NO: 30619 - DNA, 25 bp, Mus musculus
aacatctttgttacagcagtcttca

SEQ ID NO: 30620 - DNA, 25 bp, Mus musculus
aacatctttgttagacacaccacac

SEQ ID NO: 30621 - DNA, 25 bp, Mus musculus
aacatctttgttcgcttgaacacca

SEQ ID NO: 30622 - DNA, 25 bp, Mus musculus
aacatctttgttggcttgaacacca

SEQ ID NO: 30623 - DNA, 25 bp, Mus musculus
aacatctttgtttcagcagtcttca

SEQ ID NO: 30624 - DNA, 25 bp, Mus musculus
aacatctttgtttgacacaccacac

SEQ ID NO: 30625 - DNA, 25 bp, Mus musculus
aacatcttttgtactacctgctagt

SEQ ID NO: 30626 - DNA, 25 bp, Mus musculus
aacatcttttgttctacctgctagt

SEQ ID NO: 30627 - DNA, 25 bp, Mus musculus
aacatcttttttcctaacccagcat

SEQ ID NO: 30628 - DNA, 25 bp, Mus musculus
aacatcttttttgctaacccagcat

SEQ ID NO: 30629 - DNA, 25 bp, Mus musculus
aacatgaaatccattcactttggca

SEQ ID NO: 30630 - DNA, 25 bp, Mus musculus
aacatgaaatcctttcactttggca

SEQ ID NO: 30631 - DNA, 25 bp, Mus musculus
aacatgaacaatctgcagcacactg

SEQ ID NO: 30632 - DNA, 25 bp, Mus musculus
aacatgaacaatgtgcagcacactg

SEQ ID NO: 30633 - DNA, 25 bp, Mus musculus
aacatgaaccatcagcgcatccctt

SEQ ID NO: 30634 - DNA, 25 bp, Mus musculus
aacatgaaccatgagcgcatccctt

SEQ ID NO: 30635 - DNA, 25 bp, Mus musculus
aacatgaacctgcaaactattcctt

SEQ ID NO: 30636 - DNA, 25 bp, Mus musculus
aacatgaacctggaaactattcctt

SEQ ID NO: 30637 - DNA, 25 bp, Mus musculus
aacatgaacgacctcgtctctgagt

SEQ ID NO: 30638 - DNA, 25 bp, Mus musculus
aacatgaacgacgtcgtctctgagt

SEQ ID NO: 30639 - DNA, 25 bp, Mus musculus
aacatgaagcacagtgtacttgttt

SEQ ID NO: 30640 - DNA, 25 bp, Mus musculus
aacatgaagcactgtgtacttgttt

SEQ ID NO: 30641 - DNA, 25 bp, Mus musculus
aacatgaagccacaccttagggttt

SEQ ID NO: 30642 - DNA, 25 bp, Mus musculus
aacatgaagccagaccttagggttt

SEQ ID NO: 30643 - DNA, 25 bp, Mus musculus
aacatgaagccgctcccacaggagg

SEQ ID NO: 30644 - DNA, 25 bp, Mus musculus
aacatgaagccggtcccacaggagg

SEQ ID NO: 30645 - DNA, 25 bp, Mus musculus
aacatgaagctccatctcagagagg

SEQ ID NO: 30646 - DNA, 25 bp, Mus musculus
aacatgaagctcgatctcagagagg

SEQ ID NO: 30647 - DNA, 25 bp, Mus musculus
aacatgaagctgattctctagcccc

SEQ ID NO: 30648 - DNA, 25 bp, Mus musculus
aacatgaagctgtttctctagcccc

SEQ ID NO: 30649 - DNA, 25 bp, Mus musculus
aacatgaagggacccttcggatgaa

SEQ ID NO: 30650 - DNA, 25 bp, Mus musculus
aacatgaagggagccttcggatgaa

SEQ ID NO: 30651 - DNA, 25 bp, Mus musculus
aacatgaagtatccccatggtttac

SEQ ID NO: 30652 - DNA, 25 bp, Mus musculus
aacatgaagtatgcccatggtttac

SEQ ID NO: 30653 - DNA, 25 bp, Mus musculus
aacatgaagtgacaggtgtgagcct

SEQ ID NO: 30654 - DNA, 25 bp, Mus musculus
aacatgaagtgagaggtgtgagcct

SEQ ID NO: 30655 - DNA, 25 bp, Mus musculus
aacatgaatcccatcctaggagtgg

SEQ ID NO: 30656 - DNA, 25 bp, Mus musculus
aacatgaatcccttcctaggagtgg

SEQ ID NO: 30657 - DNA, 25 bp, Mus musculus
aacatgaatctcactgaggcccaag

SEQ ID NO: 30658 - DNA, 25 bp, Mus musculus
aacatgaatctctctgaggcccaag

SEQ ID NO: 30659 - DNA, 25 bp, Mus musculus
aacatgaattatccaagagtcccca

SEQ ID NO: 30660 - DNA, 25 bp, Mus musculus
aacatgaattatgcaagagtcccca

SEQ ID NO: 30661 - DNA, 25 bp, Mus musculus
aacatgaatttgcaccttacagaaa

SEQ ID NO: 30662 - DNA, 25 bp, Mus musculus
aacatgaatttggaccttacagaaa

SEQ ID NO: 30663 - DNA, 25 bp, Mus musculus
aacatgaccctcagctgactggagt

SEQ ID NO: 30664 - DNA, 25 bp, Mus musculus
aacatgaccctctgctgactggagt

SEQ ID NO: 30665 - DNA, 25 bp, Mus musculus
aacatgaccctgaatgcaagttaaa

SEQ ID NO: 30666 - DNA, 25 bp, Mus musculus
aacatgaccctgtatgcaagttaaa

SEQ ID NO: 30667 - DNA, 25 bp, Mus musculus
aacatgacgctgcaggctggcgcaa

SEQ ID NO: 30668 - DNA, 25 bp, Mus musculus
aacatgacgctggaggctggcgcaa

SEQ ID NO: 30669 - DNA, 25 bp, Mus musculus
aacatgacgtctctttgcctcaggg

SEQ ID NO: 30670 - DNA, 25 bp, Mus musculus
aacatgacgtctgtttgcctcaggg

SEQ ID NO: 30671 - DNA, 25 bp, Mus musculus
aacatgactaccaaaattgcccctg

SEQ ID NO: 30672 - DNA, 25 bp, Mus musculus
aacatgactacctaaattgcccctg

SEQ ID NO: 30673 - DNA, 25 bp, Mus musculus
aacatgactactaccaacctttcta

SEQ ID NO: 30674 - DNA, 25 bp, Mus musculus
aacatgactacttccaacctttcta

SEQ ID NO: 30675 - DNA, 25 bp, Mus musculus
aacatgactattaagcttgtggctt

SEQ ID NO: 30676 - DNA, 25 bp, Mus musculus
aacatgactatttagcttgtggctt

SEQ ID NO: 30677 - DNA, 25 bp, Mus musculus
aacatgagaggcagtaaggtgtaat

SEQ ID NO: 30678 - DNA, 25 bp, Mus musculus
aacatgagaggctgtaaggtgtaat

SEQ ID NO: 30679 - DNA, 25 bp, Mus musculus
aacatgagattgcatttagctgaag

SEQ ID NO: 30680 - DNA, 25 bp, Mus musculus
aacatgagattggatttagctgaag

SEQ ID NO: 30681 - DNA, 25 bp, Mus musculus
aacatgagcatgctgttcagagagg

SEQ ID NO: 30682 - DNA, 25 bp, Mus musculus
aacatgagcatggtgttcagagagg

SEQ ID NO: 30683 - DNA, 25 bp, Mus musculus
aacatgagcctcctcataatccaca

SEQ ID NO: 30684 - DNA, 25 bp, Mus musculus
aacatgagcctcgtcataatccaca

SEQ ID NO: 30685 - DNA, 25 bp, Mus musculus
aacatgagccttcagctgtctgact

SEQ ID NO: 30686 - DNA, 25 bp, Mus musculus
aacatgagccttgagctgtctgact

SEQ ID NO: 30687 - DNA, 25 bp, Mus musculus
aacatgatacggagccgctgcaagt

SEQ ID NO: 30688 - DNA, 25 bp, Mus musculus
aacatgatacggtgccgctgcaagt

SEQ ID NO: 30689 - DNA, 25 bp, Mus musculus
aacatgatatgacccttgcttctgc

SEQ ID NO: 30690 - DNA, 25 bp, Mus musculus
aacatgatatgagccttgcttctgc

SEQ ID NO: 30691 - DNA, 25 bp, Mus musculus
aacatgatcccacctgaacagccgt

SEQ ID NO: 30692 - DNA, 25 bp, Mus musculus
aacatgatcccagctgaacagccgt

SEQ ID NO: 30693 - DNA, 25 bp, Mus musculus
aacatgatccgtagtatctgggaaa

SEQ ID NO: 30694 - DNA, 25 bp, Mus musculus
aacatgatccgttgtatctgggaaa

SEQ ID NO: 30695 - DNA, 25 bp, Mus musculus
aacatgatctgtcctctttacaaaa

SEQ ID NO: 30696 - DNA, 25 bp, Mus musculus
aacatgatctgtgctctttacaaaa

SEQ ID NO: 30697 - DNA, 25 bp, Mus musculus
aacatgatcttgagccaggtggact

SEQ ID NO: 30698 - DNA, 25 bp, Mus musculus
aacatgatcttgtgccaggtggact

SEQ ID NO: 30699 - DNA, 25 bp, Mus musculus
aacatgatgagtacctctccacttg

SEQ ID NO: 30700 - DNA, 25 bp, Mus musculus
aacatgatgagttcctctccacttg

SEQ ID NO: 30701 - DNA, 25 bp, Mus musculus
aacatgatgcacattggagggtaca

SEQ ID NO: 30702 - DNA, 25 bp, Mus musculus
aacatgatgcactttggagggtaca

SEQ ID NO: 30703 - DNA, 25 bp, Mus musculus
aacatgatgcgaccggttgcaagac

SEQ ID NO: 30704 - DNA, 25 bp, Mus musculus
aacatgatgcgagcggttgcaagac

SEQ ID NO: 30705 - DNA, 25 bp, Mus musculus
aacatgatggcgatgggtcccttaa

SEQ ID NO: 30706 - DNA, 25 bp, Mus musculus
aacatgatggcgttgggtcccttaa

SEQ ID NO: 30707 - DNA, 25 bp, Mus musculus
aacatgattccaaaacacatagctg

SEQ ID NO: 30708 - DNA, 25 bp, Mus musculus
aacatgattccataacacatagctg

SEQ ID NO: 30709 - DNA, 25 bp, Mus musculus
aacatgattcccatgcataattaaa

SEQ ID NO: 30710 - DNA, 25 bp, Mus musculus
aacatgattcccttgcataattaaa

SEQ ID NO: 30711 - DNA, 25 bp, Mus musculus
aacatgattctgctagccttaggat

SEQ ID NO: 30712 - DNA, 25 bp, Mus musculus
aacatgattctggtagccttaggat

SEQ ID NO: 30713 - DNA, 25 bp, Mus musculus
aacatgattcttacctcaaaaccaa

SEQ ID NO: 30714 - DNA, 25 bp, Mus musculus
aacatgattctttcctcaaaaccaa

SEQ ID NO: 30715 - DNA, 25 bp, Mus musculus
aacatgattggtaactgagggagcc

SEQ ID NO: 30716 - DNA, 25 bp, Mus musculus
aacatgattggttactgagggagcc

SEQ ID NO: 30717 - DNA, 25 bp, Mus musculus
aacatgatttctaatctataaacga

SEQ ID NO: 30718 - DNA, 25 bp, Mus musculus
aacatgatttcttatctataaacga

SEQ ID NO: 30719 - DNA, 25 bp, Mus musculus
aacatgatttggagccaccatggga

SEQ ID NO: 30720 - DNA, 25 bp, Mus musculus
aacatgatttggtgccaccatggga

SEQ ID NO: 30721 - DNA, 25 bp, Mus musculus
aacatgcaaacacacatacggacag

SEQ ID NO: 30722 - DNA, 25 bp, Mus musculus
aacatgcaaacagacatacggacag

SEQ ID NO: 30723 - DNA, 25 bp, Mus musculus
aacatgcaaactactgtatctggaa

SEQ ID NO: 30724 - DNA, 25 bp, Mus musculus
aacatgcaaacttctgtatctggaa

SEQ ID NO: 30725 - DNA, 25 bp, Mus musculus
aacatgcaaataacccactgtgagc

SEQ ID NO: 30726 - DNA, 25 bp, Mus musculus
aacatgcaaatatcccactgtgagc

SEQ ID NO: 30727 - DNA, 25 bp, Mus musculus
aacatgcaagatccccttgggagcc

SEQ ID NO: 30728 - DNA, 25 bp, Mus musculus
aacatgcaagatgcccttgggagcc

SEQ ID NO: 30729 - DNA, 25 bp, Mus musculus
aacatgcaagtcagcatcgtgtgca

SEQ ID NO: 30730 - DNA, 25 bp, Mus musculus
aacatgcaagtctgcatcgtgtgca

SEQ ID NO: 30731 - DNA, 25 bp, Mus musculus
aacatgcagatcaacagcgccagag

SEQ ID NO: 30732 - DNA, 25 bp, Mus musculus
aacatgcagatctacagcgccagag

SEQ ID NO: 30733 - DNA, 25 bp, Mus musculus
aacatgcagcagagtggccagcgct

SEQ ID NO: 30734 - DNA, 25 bp, Mus musculus
aacatgcagcagtgtggccagcgct

SEQ ID NO: 30735 - DNA, 25 bp, Mus musculus
aacatgcagctgaaaaccctgggaa

SEQ ID NO: 30736 - DNA, 25 bp, Mus musculus
aacatgcagctgtaaaccctgggaa

SEQ ID NO: 30737 - DNA, 25 bp, Mus musculus
aacatgcaggaaccacgcgctgtgc

SEQ ID NO: 30738 - DNA, 25 bp, Mus musculus
aacatgcaggaagcacgcgctgtgc

SEQ ID NO: 30739 - DNA, 25 bp, Mus musculus
aacatgcaggcaatttcctcattaa

SEQ ID NO: 30740 - DNA, 25 bp, Mus musculus
aacatgcaggcattttcctcattaa

SEQ ID NO: 30741 - DNA, 25 bp, Mus musculus
aacatgcaggtgaaggcttcctcgg

SEQ ID NO: 30742 - DNA, 25 bp, Mus musculus
aacatgcaggtgtaggcttcctcgg

SEQ ID NO: 30743 - DNA, 25 bp, Mus musculus
aacatgcagtttctccagggttcca

SEQ ID NO: 30744 - DNA, 25 bp, Mus musculus
aacatgcagtttgtccagggttcca

SEQ ID NO: 30745 - DNA, 25 bp, Mus musculus
aacatgcatgaccaatggagccata

SEQ ID NO: 30746 - DNA, 25 bp, Mus musculus
aacatgcatgacgaatggagccata

SEQ ID NO: 30747 - DNA, 25 bp, Mus musculus
aacatgcatgcacaacacctgtata

SEQ ID NO: 30748 - DNA, 25 bp, Mus musculus
aacatgcatgcactgtaccaggtaa

SEQ ID NO: 30749 - DNA, 25 bp, Mus musculus
aacatgcatgcagaacacctgtata

SEQ ID NO: 30750 - DNA, 25 bp, Mus musculus
aacatgcatgcagtgtaccaggtaa

SEQ ID NO: 30751 - DNA, 25 bp, Mus musculus
aacatgcatgttagactgtaacggt

SEQ ID NO: 30752 - DNA, 25 bp, Mus musculus
aacatgcatgtttgactgtaacggt

SEQ ID NO: 30753 - DNA, 25 bp, Mus musculus
aacatgcattatcttcccatctggc

SEQ ID NO: 30754 - DNA, 25 bp, Mus musculus
aacatgcattatgttcccatctggc

SEQ ID NO: 30755 - DNA, 25 bp, Mus musculus
aacatgcattccacgttggctgttg

SEQ ID NO: 30756 - DNA, 25 bp, Mus musculus
aacatgcattcctcgttggctgttg

SEQ ID NO: 30757 - DNA, 25 bp, Mus musculus
aacatgcattggctaggttttctct

SEQ ID NO: 30758 - DNA, 25 bp, Mus musculus
aacatgcattgggtaggttttctct

SEQ ID NO: 30759 - DNA, 25 bp, Mus musculus
aacatgccaatgagactgcctgcca

SEQ ID NO: 30760 - DNA, 25 bp, Mus musculus
aacatgccaatgtgactgcctgcca

SEQ ID NO: 30761 - DNA, 25 bp, Mus musculus
aacatgccaattaggctggcacact

SEQ ID NO: 30762 - DNA, 25 bp, Mus musculus
aacatgccaatttggctggcacact

SEQ ID NO: 30763 - DNA, 25 bp, Mus musculus
aacatgccacagctgtctacacaca

SEQ ID NO: 30764 - DNA, 25 bp, Mus musculus
aacatgccacaggtgtctacacaca

SEQ ID NO: 30765 - DNA, 25 bp, Mus musculus
aacatgccacggagcttgctcaggg

SEQ ID NO: 30766 - DNA, 25 bp, Mus musculus
aacatgccacggtgcttgctcaggg

SEQ ID NO: 30767 - DNA, 25 bp, Mus musculus
aacatgccagcaagttttcttcatt

SEQ ID NO: 30768 - DNA, 25 bp, Mus musculus
aacatgccagcatgttttcttcatt

SEQ ID NO: 30769 - DNA, 25 bp, Mus musculus
aacatgccatgcacctgacttggct

SEQ ID NO: 30770 - DNA, 25 bp, Mus musculus
aacatgccatgctcctgacttggct

SEQ ID NO: 30771 - DNA, 25 bp, Mus musculus
aacatgcccagtctgcagcaggaca

SEQ ID NO: 30772 - DNA, 25 bp, Mus musculus
aacatgcccagtgtgcagcaggaca

SEQ ID NO: 30773 - DNA, 25 bp, Mus musculus
aacatgcccatactcaaaagatctg

SEQ ID NO: 30774 - DNA, 25 bp, Mus musculus
aacatgcccatagtcaaaagatctg

SEQ ID NO: 30775 - DNA, 25 bp, Mus musculus
aacatgcccattatatgctgctgtg

SEQ ID NO: 30776 - DNA, 25 bp, Mus musculus
aacatgcccattttatgctgctgtg

SEQ ID NO: 30777 - DNA, 25 bp, Mus musculus
aacatgccccgtactgaggctagta

SEQ ID NO: 30778 - DNA, 25 bp, Mus musculus
aacatgccccgttctgaggctagta

SEQ ID NO: 30779 - DNA, 25 bp, Mus musculus
aacatgcccctgagcatgctttagc

SEQ ID NO: 30780 - DNA, 25 bp, Mus musculus
aacatgcccctgtgcatgctttagc

SEQ ID NO: 30781 - DNA, 25 bp, Mus musculus
aacatgcccttcactggttatgtaa

SEQ ID NO: 30782 - DNA, 25 bp, Mus musculus
aacatgcccttctctggttatgtaa

SEQ ID NO: 30783 - DNA, 25 bp, Mus musculus
aacatgccctttaggaggatatcaa

SEQ ID NO: 30784 - DNA, 25 bp, Mus musculus
aacatgcccttttggaggatatcaa

SEQ ID NO: 30785 - DNA, 25 bp, Mus musculus
aacatgcctattacttggttgccac

SEQ ID NO: 30786 - DNA, 25 bp, Mus musculus
aacatgcctattatacttctgtggg

SEQ ID NO: 30787 - DNA, 25 bp, Mus musculus
aacatgcctatttcttggttgccac

SEQ ID NO: 30788 - DNA, 25 bp, Mus musculus
aacatgcctattttacttctgtggg

SEQ ID NO: 30789 - DNA, 25 bp, Mus musculus
aacatgcctgaacgctctggtgtcc

SEQ ID NO: 30790 - DNA, 25 bp, Mus musculus
aacatgcctgaaggctctggtgtcc

SEQ ID NO: 30791 - DNA, 25 bp, Mus musculus
aacatgcggcaaaggaacgtcaact

SEQ ID NO: 30792 - DNA, 25 bp, Mus musculus
aacatgcggcaatggaacgtcaact

SEQ ID NO: 30793 - DNA, 25 bp, Mus musculus
aacatgcggtgtacggatgattctt

SEQ ID NO: 30794 - DNA, 25 bp, Mus musculus
aacatgcggtgttcggatgattctt

SEQ ID NO: 30795 - DNA, 25 bp, Mus musculus
aacatgcgtgtaagagggtggtaat

SEQ ID NO: 30796 - DNA, 25 bp, Mus musculus
aacatgcgtgtactcatcacctagg

SEQ ID NO: 30797 - DNA, 25 bp, Mus musculus
aacatgcgtgtagtcatcacctagg

SEQ ID NO: 30798 - DNA, 25 bp, Mus musculus
aacatgcgtgtatgagggtggtaat

SEQ ID NO: 30799 - DNA, 25 bp, Mus musculus
aacatgctacatccctgaagctatt

SEQ ID NO: 30800 - DNA, 25 bp, Mus musculus
aacatgctacatgcctgaagctatt

SEQ ID NO: 30801 - DNA, 25 bp, Mus musculus
aacatgctagcaagtactctcccat

SEQ ID NO: 30802 - DNA, 25 bp, Mus musculus
aacatgctagcatgtactctcccat

SEQ ID NO: 30803 - DNA, 25 bp, Mus musculus
aacatgctgaagaagccatctgagg

SEQ ID NO: 30804 - DNA, 25 bp, Mus musculus
aacatgctgaagtagccatctgagg

SEQ ID NO: 30805 - DNA, 25 bp, Mus musculus
aacatgctgcgcagttttcgtgggt

SEQ ID NO: 30806 - DNA, 25 bp, Mus musculus
aacatgctgcgctgttttcgtgggt

SEQ ID NO: 30807 - DNA, 25 bp, Mus musculus
aacatgctgcggatgcgaccggtga

SEQ ID NO: 30808 - DNA, 25 bp, Mus musculus
aacatgctgcggttgcgaccggtga

SEQ ID NO: 30809 - DNA, 25 bp, Mus musculus
aacatgctgggcctgtcgcttttct

SEQ ID NO: 30810 - DNA, 25 bp, Mus musculus
aacatgctgggcgtgtcgcttttct

SEQ ID NO: 30811 - DNA, 25 bp, Mus musculus
aacatgctgttaaactcaggccaag

SEQ ID NO: 30812 - DNA, 25 bp, Mus musculus
aacatgctgttatactcaggccaag

SEQ ID NO: 30813 - DNA, 25 bp, Mus musculus
aacatgcttaccactttaactcttg

SEQ ID NO: 30814 - DNA, 25 bp, Mus musculus
aacatgcttacctctttaactcttg

SEQ ID NO: 30815 - DNA, 25 bp, Mus musculus
aacatgcttcacaggctgacagctg

SEQ ID NO: 30816 - DNA, 25 bp, Mus musculus
aacatgcttcactggctgacagctg

SEQ ID NO: 30817 - DNA, 25 bp, Mus musculus
aacatgcttctaccatttgggcctg

SEQ ID NO: 30818 - DNA, 25 bp, Mus musculus
aacatgcttctagcatttgggcctg

SEQ ID NO: 30819 - DNA, 25 bp, Mus musculus
aacatgcttggccagcgtgagcctc

SEQ ID NO: 30820 - DNA, 25 bp, Mus musculus
aacatgcttggcgagcgtgagcctc

SEQ ID NO: 30821 - DNA, 25 bp, Mus musculus
aacatgcttgtcactccaatatggg

SEQ ID NO: 30822 - DNA, 25 bp, Mus musculus
aacatgcttgtctctccaatatggg

SEQ ID NO: 30823 - DNA, 25 bp, Mus musculus
aacatgctttacacagttttcaagt

SEQ ID NO: 30824 - DNA, 25 bp, Mus musculus
aacatgctttactcagttttcaagt

SEQ ID NO: 30825 - DNA, 25 bp, Mus musculus
aacatgctttatctgtgggtgtcat

SEQ ID NO: 30826 - DNA, 25 bp, Mus musculus
aacatgctttatgtgtgggtgtcat

SEQ ID NO: 30827 - DNA, 25 bp, Mus musculus
aacatgctttctaatgggccctgta

SEQ ID NO: 30828 - DNA, 25 bp, Mus musculus
aacatgctttcttatgggccctgta

SEQ ID NO: 30829 - DNA, 25 bp, Mus musculus
aacatggaacccatgtgtgcagctc

SEQ ID NO: 30830 - DNA, 25 bp, Mus musculus
aacatggaacccttgtgtgcagctc

SEQ ID NO: 30831 - DNA, 25 bp, Mus musculus
aacatggacacacatcctggttaat

SEQ ID NO: 30832 - DNA, 25 bp, Mus musculus
aacatggacacagatcctggttaat

SEQ ID NO: 30833 - DNA, 25 bp, Mus musculus
aacatggaccaactgagcctgctca

SEQ ID NO: 30834 - DNA, 25 bp, Mus musculus
aacatggaccaagtgagcctgctca

SEQ ID NO: 30835 - DNA, 25 bp, Mus musculus
aacatggaccttcaattctgcctgc

SEQ ID NO: 30836 - DNA, 25 bp, Mus musculus
aacatggaccttgaattctgcctgc

SEQ ID NO: 30837 - DNA, 25 bp, Mus musculus
aacatggagcagaccatcaaggact

SEQ ID NO: 30838 - DNA, 25 bp, Mus musculus
aacatggagcagtccatcaaggact

SEQ ID NO: 30839 - DNA, 25 bp, Mus musculus
aacatggatggtctctggtatcaga

SEQ ID NO: 30840 - DNA, 25 bp, Mus musculus
aacatggatggtgtctggtatcaga

SEQ ID NO: 30841 - DNA, 25 bp, Mus musculus
aacatggattccacttactcttact

SEQ ID NO: 30842 - DNA, 25 bp, Mus musculus
aacatggattcctcttactcttact

SEQ ID NO: 30843 - DNA, 25 bp, Mus musculus
aacatggcacttaaccaggtattgg

SEQ ID NO: 30844 - DNA, 25 bp, Mus musculus
aacatggcactttaccaggtattgg

SEQ ID NO: 30845 - DNA, 25 bp, Mus musculus
aacatggcagtgagacagcaagtca

SEQ ID NO: 30846 - DNA, 25 bp, Mus musculus
aacatggcagtgtgacagcaagtca

SEQ ID NO: 30847 - DNA, 25 bp, Mus musculus
aacatggccaccattctagtcagca

SEQ ID NO: 30848 - DNA, 25 bp, Mus musculus
aacatggccacctttctagtcagca

SEQ ID NO: 30849 - DNA, 25 bp, Mus musculus
aacatggccagccaagacaccgagc

SEQ ID NO: 30850 - DNA, 25 bp, Mus musculus
aacatggccagcgaagacaccgagc

SEQ ID NO: 30851 - DNA, 25 bp, Mus musculus
aacatggccagtcgtgctgtcatcc

SEQ ID NO: 30852 - DNA, 25 bp, Mus musculus
aacatggccagtggtgctgtcatcc

SEQ ID NO: 30853 - DNA, 25 bp, Mus musculus
aacatggccatgaatgtcatcgact

SEQ ID NO: 30854 - DNA, 25 bp, Mus musculus
aacatggccatgtatgtcatcgact

SEQ ID NO: 30855 - DNA, 25 bp, Mus musculus
aacatggccattactccttacagga

SEQ ID NO: 30856 - DNA, 25 bp, Mus musculus
aacatggccatttctccttacagga

SEQ ID NO: 30857 - DNA, 25 bp, Mus musculus
aacatggccctgatggtgcacttcc

SEQ ID NO: 30858 - DNA, 25 bp, Mus musculus
aacatggccctgttggtgcacttcc

SEQ ID NO: 30859 - DNA, 25 bp, Mus musculus
aacatggccgttcctaactttgaag

SEQ ID NO: 30860 - DNA, 25 bp, Mus musculus
aacatggccgttgctaactttgaag

SEQ ID NO: 30861 - DNA, 25 bp, Mus musculus
aacatggcctggcttagggtcagaa

SEQ ID NO: 30862 - DNA, 25 bp, Mus musculus
aacatggcctgggttagggtcagaa

SEQ ID NO: 30863 - DNA, 25 bp, Mus musculus
aacatggcggaaccctttctgtctt

SEQ ID NO: 30864 - DNA, 25 bp, Mus musculus
aacatggcggaagcctttctgtctt

SEQ ID NO: 30865 - DNA, 25 bp, Mus musculus
aacatggcgggcactgctacgatcg

SEQ ID NO: 30866 - DNA, 25 bp, Mus musculus
aacatggcgggctctgctacgatcg

SEQ ID NO: 30867 - DNA, 25 bp, Mus musculus
aacatggcggtgaggagtgttccct

SEQ ID NO: 30868 - DNA, 25 bp, Mus musculus
aacatggcggtgatcacggttttat

SEQ ID NO: 30869 - DNA, 25 bp, Mus musculus
aacatggcggtgtggagtgttccct

SEQ ID NO: 30870 - DNA, 25 bp, Mus musculus
aacatggcggtgttcacggttttat

SEQ ID NO: 30871 - DNA, 25 bp, Mus musculus
aacatggctaagaaggctgtgcaga

SEQ ID NO: 30872 - DNA, 25 bp, Mus musculus
aacatggctaagtaggctgtgcaga

SEQ ID NO: 30873 - DNA, 25 bp, Mus musculus
aacatggctctgctttcaggtcctc

SEQ ID NO: 30874 - DNA, 25 bp, Mus musculus
aacatggctctggtttcaggtcctc

SEQ ID NO: 30875 - DNA, 25 bp, Mus musculus
aacatggctgcactagacttcttta

SEQ ID NO: 30876 - DNA, 25 bp, Mus musculus
aacatggctgcagtagacttcttta

SEQ ID NO: 30877 - DNA, 25 bp, Mus musculus
aacatggctgccagagggtcgaatc

SEQ ID NO: 30878 - DNA, 25 bp, Mus musculus
aacatggctgccatgctgtctgtca

SEQ ID NO: 30879 - DNA, 25 bp, Mus musculus
aacatggctgcctgagggtcgaatc

SEQ ID NO: 30880 - DNA, 25 bp, Mus musculus
aacatggctgccttgctgtctgtca

SEQ ID NO: 30881 - DNA, 25 bp, Mus musculus
aacatggctgttacttgatggcttt

SEQ ID NO: 30882 - DNA, 25 bp, Mus musculus
aacatggctgtttcttgatggcttt

SEQ ID NO: 30883 - DNA, 25 bp, Mus musculus
aacatggcttctatgaactcctgca

SEQ ID NO: 30884 - DNA, 25 bp, Mus musculus
aacatggcttctttgaactcctgca

SEQ ID NO: 30885 - DNA, 25 bp, Mus musculus
aacatggctttcattttcctcaatc

SEQ ID NO: 30886 - DNA, 25 bp, Mus musculus
aacatggctttctttttcctcaatc

SEQ ID NO: 30887 - DNA, 25 bp, Mus musculus
aacatgggaagacaaatagaccctt

SEQ ID NO: 30888 - DNA, 25 bp, Mus musculus
aacatgggaagagaaatagaccctt

SEQ ID NO: 30889 - DNA, 25 bp, Mus musculus
aacatgggcaggacacggtggctta

SEQ ID NO: 30890 - DNA, 25 bp, Mus musculus
aacatgggcaggagtccttcctgat

SEQ ID NO: 30891 - DNA, 25 bp, Mus musculus
aacatgggcaggtcacggtggctta

SEQ ID NO: 30892 - DNA, 25 bp, Mus musculus
aacatgggcaggtgtccttcctgat

SEQ ID NO: 30893 - DNA, 25 bp, Mus musculus
aacatgggccagatctttgcaagtg

SEQ ID NO: 30894 - DNA, 25 bp, Mus musculus
aacatgggccagttctttgcaagtg

SEQ ID NO: 30895 - DNA, 25 bp, Mus musculus
aacatgggcctgcagtaacgtcagt

SEQ ID NO: 30896 - DNA, 25 bp, Mus musculus
aacatgggcctggagtaacgtcagt

SEQ ID NO: 30897 - DNA, 25 bp, Mus musculus
aacatgggctgtatgcagatgaaca

SEQ ID NO: 30898 - DNA, 25 bp, Mus musculus
aacatgggctgtttgcagatgaaca

SEQ ID NO: 30899 - DNA, 25 bp, Mus musculus
aacatgggtctgaccacaaccttag

SEQ ID NO: 30900 - DNA, 25 bp, Mus musculus
aacatgggtctgtccacaaccttag

SEQ ID NO: 30901 - DNA, 25 bp, Mus musculus
aacatgggtttgctacgtgaagtcc

SEQ ID NO: 30902 - DNA, 25 bp, Mus musculus
aacatgggtttggtacgtgaagtcc

SEQ ID NO: 30903 - DNA, 25 bp, Mus musculus
aacatggtagccaccgagtgcggct

SEQ ID NO: 30904 - DNA, 25 bp, Mus musculus
aacatggtagcctccgagtgcggct

SEQ ID NO: 30905 - DNA, 25 bp, Mus musculus
aacatggtattcctcttatgacaga

SEQ ID NO: 30906 - DNA, 25 bp, Mus musculus
aacatggtattcgtcttatgacaga

SEQ ID NO: 30907 - DNA, 25 bp, Mus musculus
aacatggtcaacaggagagagttcc

SEQ ID NO: 30908 - DNA, 25 bp, Mus musculus
aacatggtcaacattgaatacagaa

SEQ ID NO: 30909 - DNA, 25 bp, Mus musculus
aacatggtcaactggagagagttcc

SEQ ID NO: 30910 - DNA, 25 bp, Mus musculus
aacatggtcaactttgaatacagaa

SEQ ID NO: 30911 - DNA, 25 bp, Mus musculus
aacatggtccatatgtgatgaatac

SEQ ID NO: 30912 - DNA, 25 bp, Mus musculus
aacatggtccatttgtgatgaatac

SEQ ID NO: 30913 - DNA, 25 bp, Mus musculus
aacatggtctggaaacaccacgctt

SEQ ID NO: 30914 - DNA, 25 bp, Mus musculus
aacatggtctggtaacaccacgctt

SEQ ID NO: 30915 - DNA, 25 bp, Mus musculus
aacatggtctgtacataagccagtg

SEQ ID NO: 30916 - DNA, 25 bp, Mus musculus
aacatggtctgttcataagccagtg

SEQ ID NO: 30917 - DNA, 25 bp, Mus musculus
aacatggtgacgattttcccaggat

SEQ ID NO: 30918 - DNA, 25 bp, Mus musculus
aacatggtgacgtttttcccaggat

SEQ ID NO: 30919 - DNA, 25 bp, Mus musculus
aacatggtgccaaactgattccagt

SEQ ID NO: 30920 - DNA, 25 bp, Mus musculus
aacatggtgccatactgattccagt

SEQ ID NO: 30921 - DNA, 25 bp, Mus musculus
aacatggtgcctcgttgcagaggac

SEQ ID NO: 30922 - DNA, 25 bp, Mus musculus
aacatggtgcctggttgcagaggac

SEQ ID NO: 30923 - DNA, 25 bp, Mus musculus
aacatggtggagagccctgaaccct

SEQ ID NO: 30924 - DNA, 25 bp, Mus musculus
aacatggtggagcagaaacttctag

SEQ ID NO: 30925 - DNA, 25 bp, Mus musculus
aacatggtggaggagaaacttctag

SEQ ID NO: 30926 - DNA, 25 bp, Mus musculus
aacatggtggagtgccctgaaccct

SEQ ID NO: 30927 - DNA, 25 bp, Mus musculus
aacatggtgggcagccgtcctacct

SEQ ID NO: 30928 - DNA, 25 bp, Mus musculus
aacatggtgggctgccgtcctacct

SEQ ID NO: 30929 - DNA, 25 bp, Mus musculus
aacatggttatgagatgcccagcct

SEQ ID NO: 30930 - DNA, 25 bp, Mus musculus
aacatggttatgtgatgcccagcct

SEQ ID NO: 30931 - DNA, 25 bp, Mus musculus
aacatggttgacagccagctttgca

SEQ ID NO: 30932 - DNA, 25 bp, Mus musculus
aacatggttgactgccagctttgca

SEQ ID NO: 30933 - DNA, 25 bp, Mus musculus
aacatggttgctctataacagccct

SEQ ID NO: 30934 - DNA, 25 bp, Mus musculus
aacatggttgctgtataacagccct

SEQ ID NO: 30935 - DNA, 25 bp, Mus musculus
aacatggtttaaactgagcagcctg

SEQ ID NO: 30936 - DNA, 25 bp, Mus musculus
aacatggtttaatctgagcagcctg

SEQ ID NO: 30937 - DNA, 25 bp, Mus musculus
aacatgtaagcccgcataccctgac

SEQ ID NO: 30938 - DNA, 25 bp, Mus musculus
aacatgtaagccggcataccctgac

SEQ ID NO: 30939 - DNA, 25 bp, Mus musculus
aacatgtacactctggccgtgctga

SEQ ID NO: 30940 - DNA, 25 bp, Mus musculus
aacatgtacactgtggccgtgctga

SEQ ID NO: 30941 - DNA, 25 bp, Mus musculus
aacatgtacaggagcccatacacac

SEQ ID NO: 30942 - DNA, 25 bp, Mus musculus
aacatgtacaggtgcccatacacac

SEQ ID NO: 30943 - DNA, 25 bp, Mus musculus
aacatgtacattccaaggctgagca

SEQ ID NO: 30944 - DNA, 25 bp, Mus musculus
aacatgtacattgcaaggctgagca

SEQ ID NO: 30945 - DNA, 25 bp, Mus musculus
aacatgtactatagccgactgtgcc

SEQ ID NO: 30946 - DNA, 25 bp, Mus musculus
aacatgtactattgccgactgtgcc

SEQ ID NO: 30947 - DNA, 25 bp, Mus musculus
aacatgtacttaaccagctctcaac

SEQ ID NO: 30948 - DNA, 25 bp, Mus musculus
aacatgtacttatccagctctcaac

SEQ ID NO: 30949 - DNA, 25 bp, Mus musculus
aacatgtacttgaagcagctggcag

SEQ ID NO: 30950 - DNA, 25 bp, Mus musculus
aacatgtacttgtagcagctggcag

SEQ ID NO: 30951 - DNA, 25 bp, Mus musculus
aacatgtagacacctgccattgcct

SEQ ID NO: 30952 - DNA, 25 bp, Mus musculus
aacatgtagacagctgccattgcct

SEQ ID NO: 30953 - DNA, 25 bp, Mus musculus
aacatgtagactacagagttcagct

SEQ ID NO: 30954 - DNA, 25 bp, Mus musculus
aacatgtagacttcagagttcagct

SEQ ID NO: 30955 - DNA, 25 bp, Mus musculus
aacatgtagagtattcccacacgga

SEQ ID NO: 30956 - DNA, 25 bp, Mus musculus
aacatgtagagttttcccacacgga

SEQ ID NO: 30957 - DNA, 25 bp, Mus musculus
aacatgtaggaacccaaaatgcaga

SEQ ID NO: 30958 - DNA, 25 bp, Mus musculus
aacatgtaggaagccaaaatgcaga

SEQ ID NO: 30959 - DNA, 25 bp, Mus musculus
aacatgtagggaacaatgcaggcca

SEQ ID NO: 30960 - DNA, 25 bp, Mus musculus
aacatgtagggatcaatgcaggcca

SEQ ID NO: 30961 - DNA, 25 bp, Mus musculus
aacatgtagtacctttgaccttgaa

SEQ ID NO: 30962 - DNA, 25 bp, Mus musculus
aacatgtagtacgtttgaccttgaa

SEQ ID NO: 30963 - DNA, 25 bp, Mus musculus
aacatgtagtccacatacacttgga

SEQ ID NO: 30964 - DNA, 25 bp, Mus musculus
aacatgtagtcctcatacacttgga

SEQ ID NO: 30965 - DNA, 25 bp, Mus musculus
aacatgtagtgtacccgggtgtccg

SEQ ID NO: 30966 - DNA, 25 bp, Mus musculus
aacatgtagtgttcccgggtgtccg

SEQ ID NO: 30967 - DNA, 25 bp, Mus musculus
aacatgtatcagcagtcattcaata

SEQ ID NO: 30968 - DNA, 25 bp, Mus musculus
aacatgtatcaggagtcattcaata

SEQ ID NO: 30969 - DNA, 25 bp, Mus musculus
aacatgtatgagactgacgttcctg

SEQ ID NO: 30970 - DNA, 25 bp, Mus musculus
aacatgtatgagtctgacgttcctg

SEQ ID NO: 30971 - DNA, 25 bp, Mus musculus
aacatgtatgccaatacctaccctg

SEQ ID NO: 30972 - DNA, 25 bp, Mus musculus
aacatgtatgcctatacctaccctg

SEQ ID NO: 30973 - DNA, 25 bp, Mus musculus
aacatgtcactcaagcaagaccaag

SEQ ID NO: 30974 - DNA, 25 bp, Mus musculus
aacatgtcactctagcaagaccaag

SEQ ID NO: 30975 - DNA, 25 bp, Mus musculus
aacatgtcattaaggttctcacaat

SEQ ID NO: 30976 - DNA, 25 bp, Mus musculus
aacatgtcattatggttctcacaat

SEQ ID NO: 30977 - DNA, 25 bp, Mus musculus
aacatgtccactcatgacctgttag

SEQ ID NO: 30978 - DNA, 25 bp, Mus musculus
aacatgtccactgatgacctgttag

SEQ ID NO: 30979 - DNA, 25 bp, Mus musculus
aacatgtcctcaaatggcgatccca

SEQ ID NO: 30980 - DNA, 25 bp, Mus musculus
aacatgtcctcatatggcgatccca

SEQ ID NO: 30981 - DNA, 25 bp, Mus musculus
aacatgtcctttatctttgcctttg

SEQ ID NO: 30982 - DNA, 25 bp, Mus musculus
aacatgtcctttttctttgcctttg

SEQ ID NO: 30983 - DNA, 25 bp, Mus musculus
aacatgtcggagaccgagctgggca

SEQ ID NO: 30984 - DNA, 25 bp, Mus musculus
aacatgtcggagtccgagctgggca

SEQ ID NO: 30985 - DNA, 25 bp, Mus musculus
aacatgtctctcctatgcgtcaagt

SEQ ID NO: 30986 - DNA, 25 bp, Mus musculus
aacatgtctctcgtatgcgtcaagt

SEQ ID NO: 30987 - DNA, 25 bp, Mus musculus
aacatgtctgtcaaggccatgcgct

SEQ ID NO: 30988 - DNA, 25 bp, Mus musculus
aacatgtctgtctaggccatgcgct

SEQ ID NO: 30989 - DNA, 25 bp, Mus musculus
aacatgtcttctcttgtctttagca

SEQ ID NO: 30990 - DNA, 25 bp, Mus musculus
aacatgtcttctgttgtctttagca

SEQ ID NO: 30991 - DNA, 25 bp, Mus musculus
aacatgtgacatccagtatggctgc

SEQ ID NO: 30992 - DNA, 25 bp, Mus musculus
aacatgtgacatgcagtatggctgc

SEQ ID NO: 30993 - DNA, 25 bp, Mus musculus
aacatgtgactcaggacctacggat

SEQ ID NO: 30994 - DNA, 25 bp, Mus musculus
aacatgtgactctggacctacggat

SEQ ID NO: 30995 - DNA, 25 bp, Mus musculus
aacatgtgatggctttctatcccca

SEQ ID NO: 30996 - DNA, 25 bp, Mus musculus
aacatgtgatgggtttctatcccca

SEQ ID NO: 30997 - DNA, 25 bp, Mus musculus
aacatgtgcacccatgcatatgatg

SEQ ID NO: 30998 - DNA, 25 bp, Mus musculus
aacatgtgcaccgatgcatatgatg

SEQ ID NO: 30999 - DNA, 25 bp, Mus musculus
aacatgtgccgccagtgcttccggc

SEQ ID NO: 31000 - DNA, 25 bp, Mus musculus
aacatgtgccgcgagtgcttccggc

SEQ ID NO: 31001 - DNA, 25 bp, Mus musculus
aacatgtgcgtcacaaccatctgat

SEQ ID NO: 31002 - DNA, 25 bp, Mus musculus
aacatgtgcgtctcaaccatctgat

SEQ ID NO: 31003 - DNA, 25 bp, Mus musculus
aacatgtggcagatagctctcagga

SEQ ID NO: 31004 - DNA, 25 bp, Mus musculus
aacatgtggcagttagctctcagga

SEQ ID NO: 31005 - DNA, 25 bp, Mus musculus
aacatgtggcctcgatttgtgtttc

SEQ ID NO: 31006 - DNA, 25 bp, Mus musculus
aacatgtggcctggatttgtgtttc

SEQ ID NO: 31007 - DNA, 25 bp, Mus musculus
aacatgtggcttcctcagtgtttac

SEQ ID NO: 31008 - DNA, 25 bp, Mus musculus
aacatgtggcttgctcagtgtttac

SEQ ID NO: 31009 - DNA, 25 bp, Mus musculus
aacatgtgtatcatgtcagcccaac

SEQ ID NO: 31010 - DNA, 25 bp, Mus musculus
aacatgtgtatcttgtcagcccaac

SEQ ID NO: 31011 - DNA, 25 bp, Mus musculus
aacatgtgtcccaaagcctttaggc

SEQ ID NO: 31012 - DNA, 25 bp, Mus musculus
aacatgtgtccctaagcctttaggc

SEQ ID NO: 31013 - DNA, 25 bp, Mus musculus
aacatgttactacacgcttacacgc

SEQ ID NO: 31014 - DNA, 25 bp, Mus musculus
aacatgttactagacgcttacacgc

SEQ ID NO: 31015 - DNA, 25 bp, Mus musculus
aacatgttatgtacagtcagatttc

SEQ ID NO: 31016 - DNA, 25 bp, Mus musculus
aacatgttatgttcagtcagatttc

SEQ ID NO: 31017 - DNA, 25 bp, Mus musculus
aacatgttcaacacctgttgccgtg

SEQ ID NO: 31018 - DNA, 25 bp, Mus musculus
aacatgttcaactcctgttgccgtg

SEQ ID NO: 31019 - DNA, 25 bp, Mus musculus
aacatgttccgccaacgggcaagag

SEQ ID NO: 31020 - DNA, 25 bp, Mus musculus
aacatgttccgcgaacgggcaagag

SEQ ID NO: 31021 - DNA, 25 bp, Mus musculus
aacatgttccttctgtgatcagcca

SEQ ID NO: 31022 - DNA, 25 bp, Mus musculus
aacatgttccttgtgtgatcagcca

SEQ ID NO: 31023 - DNA, 25 bp, Mus musculus
aacatgttgatgcaccacctctgag

SEQ ID NO: 31024 - DNA, 25 bp, Mus musculus
aacatgttgatggaccacctctgag

SEQ ID NO: 31025 - DNA, 25 bp, Mus musculus
aacatgttggaacccgtactcagga

SEQ ID NO: 31026 - DNA, 25 bp, Mus musculus
aacatgttggaagccgtactcagga

SEQ ID NO: 31027 - DNA, 25 bp, Mus musculus
aacatgttggccagagtggaatcct

SEQ ID NO: 31028 - DNA, 25 bp, Mus musculus
aacatgttggcctgagtggaatcct

SEQ ID NO: 31029 - DNA, 25 bp, Mus musculus
aacatgtttcatatggaagaccatg

SEQ ID NO: 31030 - DNA, 25 bp, Mus musculus
aacatgtttcatctactcagtgagg

SEQ ID NO: 31031 - DNA, 25 bp, Mus musculus
aacatgtttcatgtactcagtgagg

SEQ ID NO: 31032 - DNA, 25 bp, Mus musculus
aacatgtttcatttggaagaccatg

SEQ ID NO: 31033 - DNA, 25 bp, Mus musculus
aacatgtttccactgttccacaata

SEQ ID NO: 31034 - DNA, 25 bp, Mus musculus
aacatgtttccagtgttccacaata

SEQ ID NO: 31035 - DNA, 25 bp, Mus musculus
aacatgtttcctccgccataatgga

SEQ ID NO: 31036 - DNA, 25 bp, Mus musculus
aacatgtttcctgcgccataatgga

SEQ ID NO: 31037 - DNA, 25 bp, Mus musculus
aacatgtttcttagagtgtttctca

SEQ ID NO: 31038 - DNA, 25 bp, Mus musculus
aacatgtttctttgagtgtttctca

SEQ ID NO: 31039 - DNA, 25 bp, Mus musculus
aacatgtttgcacagttccggaaaa

SEQ ID NO: 31040 - DNA, 25 bp, Mus musculus
aacatgtttgcagagttccggaaaa

SEQ ID NO: 31041 - DNA, 25 bp, Mus musculus
aacatgtttgctacttggtctcctt

SEQ ID NO: 31042 - DNA, 25 bp, Mus musculus
aacatgtttgcttcttggtctcctt

SEQ ID NO: 31043 - DNA, 25 bp, Mus musculus
aacatgtttgtgagctaagttgaca

SEQ ID NO: 31044 - DNA, 25 bp, Mus musculus
aacatgtttgtgtgctaagttgaca

SEQ ID NO: 31045 - DNA, 25 bp, Mus musculus
aacatgttttttcgtagttctgtat

SEQ ID NO: 31046 - DNA, 25 bp, Mus musculus
aacatgttttttggtagttctgtat

SEQ ID NO: 31047 - DNA, 25 bp, Mus musculus
aacattaaatgcagtaagtgctcaa

SEQ ID NO: 31048 - DNA, 25 bp, Mus musculus
aacattaaatgctgtaagtgctcaa

SEQ ID NO: 31049 - DNA, 25 bp, Mus musculus
aacattaacataacctgcaaatggg

SEQ ID NO: 31050 - DNA, 25 bp, Mus musculus
aacattaacatatcctgcaaatggg

SEQ ID NO: 31051 - DNA, 25 bp, Mus musculus
aacattaactctctccacgagcttt

SEQ ID NO: 31052 - DNA, 25 bp, Mus musculus
aacattaactctgtccacgagcttt

SEQ ID NO: 31053 - DNA, 25 bp, Mus musculus
aacattaacttcagaatcacagtgc

SEQ ID NO: 31054 - DNA, 25 bp, Mus musculus
aacattaacttctgaatcacagtgc

SEQ ID NO: 31055 - DNA, 25 bp, Mus musculus
aacattaagctgctcctaattttcc

SEQ ID NO: 31056 - DNA, 25 bp, Mus musculus
aacattaagctggtcctaattttcc

SEQ ID NO: 31057 - DNA, 25 bp, Mus musculus
aacattaagttcacctctgctgtct

SEQ ID NO: 31058 - DNA, 25 bp, Mus musculus
aacattaagttctcctctgctgtct

SEQ ID NO: 31059 - DNA, 25 bp, Mus musculus
aacattaatactcaggaccccaaga

SEQ ID NO: 31060 - DNA, 25 bp, Mus musculus
aacattaatactgaggaccccaaga

SEQ ID NO: 31061 - DNA, 25 bp, Mus musculus
aacattaatatccatgccatatcat

SEQ ID NO: 31062 - DNA, 25 bp, Mus musculus
aacattaatatcgatgccatatcat

SEQ ID NO: 31063 - DNA, 25 bp, Mus musculus
aacattaatgccaagggtccctcat

SEQ ID NO: 31064 - DNA, 25 bp, Mus musculus
aacattaatgcctagggtccctcat

SEQ ID NO: 31065 - DNA, 25 bp, Mus musculus
aacattacaaatcccaacaaccata

SEQ ID NO: 31066 - DNA, 25 bp, Mus musculus
aacattacaaatgccaacaaccata

SEQ ID NO: 31067 - DNA, 25 bp, Mus musculus
aacattacacgtaactctgcacaac

SEQ ID NO: 31068 - DNA, 25 bp, Mus musculus
aacattacacgttactctgcacaac

SEQ ID NO: 31069 - DNA, 25 bp, Mus musculus
aacattacatcccttgacagtctaa

SEQ ID NO: 31070 - DNA, 25 bp, Mus musculus
aacattacatccgttgacagtctaa

SEQ ID NO: 31071 - DNA, 25 bp, Mus musculus
aacattacattcattcttctctatt

SEQ ID NO: 31072 - DNA, 25 bp, Mus musculus
aacattacattctttcttctctatt

SEQ ID NO: 31073 - DNA, 25 bp, Mus musculus
aacattacctccctgctatgtgtac

SEQ ID NO: 31074 - DNA, 25 bp, Mus musculus
aacattacctccgtgctatgtgtac

SEQ ID NO: 31075 - DNA, 25 bp, Mus musculus
aacattactcctactcacgttgaag

SEQ ID NO: 31076 - DNA, 25 bp, Mus musculus
aacattactccttctcacgttgaag

SEQ ID NO: 31077 - DNA, 25 bp, Mus musculus
aacattactgtgcacctggtcatcg

SEQ ID NO: 31078 - DNA, 25 bp, Mus musculus
aacattactgtggacctggtcatcg

SEQ ID NO: 31079 - DNA, 25 bp, Mus musculus
aacattagagttatcctttctgact

SEQ ID NO: 31080 - DNA, 25 bp, Mus musculus
aacattagagttttcctttctgact

SEQ ID NO: 31081 - DNA, 25 bp, Mus musculus
aacattagcatgagcctggagcggt

SEQ ID NO: 31082 - DNA, 25 bp, Mus musculus
aacattagcatgataataccccgta

SEQ ID NO: 31083 - DNA, 25 bp, Mus musculus
aacattagcatgtgcctggagcggt

SEQ ID NO: 31084 - DNA, 25 bp, Mus musculus
aacattagcatgttaataccccgta

SEQ ID NO: 31085 - DNA, 25 bp, Mus musculus
aacattagctaacaggcatgccttt

SEQ ID NO: 31086 - DNA, 25 bp, Mus musculus
aacattagctaagaggcatgccttt

SEQ ID NO: 31087 - DNA, 25 bp, Mus musculus
aacattagctgtctagtttctcaca

SEQ ID NO: 31088 - DNA, 25 bp, Mus musculus
aacattagctgtgtagtttctcaca

SEQ ID NO: 31089 - DNA, 25 bp, Mus musculus
aacattagggcaccaagttcaacat

SEQ ID NO: 31090 - DNA, 25 bp, Mus musculus
aacattagggcagcaagttcaacat

SEQ ID NO: 31091 - DNA, 25 bp, Mus musculus
aacattaggtcaatctctccagcat

SEQ ID NO: 31092 - DNA, 25 bp, Mus musculus
aacattaggtcattctctccagcat

SEQ ID NO: 31093 - DNA, 25 bp, Mus musculus
aacattaggttaaggcgagagccaa

SEQ ID NO: 31094 - DNA, 25 bp, Mus musculus
aacattaggttatggcgagagccaa

SEQ ID NO: 31095 - DNA, 25 bp, Mus musculus
aacattatacctcttctggcagttt

SEQ ID NO: 31096 - DNA, 25 bp, Mus musculus
aacattatacctgttctggcagttt

SEQ ID NO: 31097 - DNA, 25 bp, Mus musculus
aacattatagcactccgctcacgtt

SEQ ID NO: 31098 - DNA, 25 bp, Mus musculus
aacattatagcagtccgctcacgtt

SEQ ID NO: 31099 - DNA, 25 bp, Mus musculus
aacattatcaacaaactggcagagt

SEQ ID NO: 31100 - DNA, 25 bp, Mus musculus
aacattatcaactaactggcagagt

SEQ ID NO: 31101 - DNA, 25 bp, Mus musculus
aacattatcagtagctcctgagaga

SEQ ID NO: 31102 - DNA, 25 bp, Mus musculus
aacattatcagttgctcctgagaga

SEQ ID NO: 31103 - DNA, 25 bp, Mus musculus
aacattatccagagatattccagga

SEQ ID NO: 31104 - DNA, 25 bp, Mus musculus
aacattatccagtgatattccagga

SEQ ID NO: 31105 - DNA, 25 bp, Mus musculus
aacattatgcccacacagtgtatgg

SEQ ID NO: 31106 - DNA, 25 bp, Mus musculus
aacattatgccctcacagtgtatgg

SEQ ID NO: 31107 - DNA, 25 bp, Mus musculus
aacattatgcggctgctgaccatat

SEQ ID NO: 31108 - DNA, 25 bp, Mus musculus
aacattatgcgggtgctgaccatat

SEQ ID NO: 31109 - DNA, 25 bp, Mus musculus
aacattatggcaagtgctcccttcc

SEQ ID NO: 31110 - DNA, 25 bp, Mus musculus
aacattatggcatgtgctcccttcc

SEQ ID NO: 31111 - DNA, 25 bp, Mus musculus
aacattatggctctttcgtctgtaa

SEQ ID NO: 31112 - DNA, 25 bp, Mus musculus
aacattatggctgtttcgtctgtaa

SEQ ID NO: 31113 - DNA, 25 bp, Mus musculus
aacattattagcaggtaattctgat

SEQ ID NO: 31114 - DNA, 25 bp, Mus musculus
aacattattagctggtaattctgat

SEQ ID NO: 31115 - DNA, 25 bp, Mus musculus
aacattattgatacggttccagagg

SEQ ID NO: 31116 - DNA, 25 bp, Mus musculus
aacattattgattcggttccagagg

SEQ ID NO: 31117 - DNA, 25 bp, Mus musculus
aacattcaacggaagctgcctcagt

SEQ ID NO: 31118 - DNA, 25 bp, Mus musculus
aacattcaacggtagctgcctcagt

SEQ ID NO: 31119 - DNA, 25 bp, Mus musculus
aacattcaactcagcttctgaaagg

SEQ ID NO: 31120 - DNA, 25 bp, Mus musculus
aacattcaactctgcttctgaaagg

SEQ ID NO: 31121 - DNA, 25 bp, Mus musculus
aacattcacaacctgttaagtgcag

SEQ ID NO: 31122 - DNA, 25 bp, Mus musculus
aacattcacaacgtgttaagtgcag

SEQ ID NO: 31123 - DNA, 25 bp, Mus musculus
aacattcacatacatgactcttggg

SEQ ID NO: 31124 - DNA, 25 bp, Mus musculus
aacattcacatagatgactcttggg

SEQ ID NO: 31125 - DNA, 25 bp, Mus musculus
aacattcacatgctagctaactaag

SEQ ID NO: 31126 - DNA, 25 bp, Mus musculus
aacattcacatggtagctaactaag

SEQ ID NO: 31127 - DNA, 25 bp, Mus musculus
aacattcacattaagagaggccaat

SEQ ID NO: 31128 - DNA, 25 bp, Mus musculus
aacattcacatttagagaggccaat

SEQ ID NO: 31129 - DNA, 25 bp, Mus musculus
aacattcacccacaacgtgcagcag

SEQ ID NO: 31130 - DNA, 25 bp, Mus musculus
aacattcacccagaacgtgcagcag

SEQ ID NO: 31131 - DNA, 25 bp, Mus musculus
aacattcaggacctgggtgcctttt

SEQ ID NO: 31132 - DNA, 25 bp, Mus musculus
aacattcaggacgtgggtgcctttt

SEQ ID NO: 31133 - DNA, 25 bp, Mus musculus
aacattcagtttcctgcatcaggca

SEQ ID NO: 31134 - DNA, 25 bp, Mus musculus
aacattcagtttgctgcatcaggca

SEQ ID NO: 31135 - DNA, 25 bp, Mus musculus
aacattcatattatcacagtttgat

SEQ ID NO: 31136 - DNA, 25 bp, Mus musculus
aacattcatattttcacagtttgat

SEQ ID NO: 31137 - DNA, 25 bp, Mus musculus
aacattcatcacatgtccatctatg

SEQ ID NO: 31138 - DNA, 25 bp, Mus musculus
aacattcatcacttgtccatctatg

SEQ ID NO: 31139 - DNA, 25 bp, Mus musculus
aacattcatgacactgaggccatta

SEQ ID NO: 31140 - DNA, 25 bp, Mus musculus
aacattcatgactctgaggccatta

SEQ ID NO: 31141 - DNA, 25 bp, Mus musculus
aacattcatgccaaggccagaaatc

SEQ ID NO: 31142 - DNA, 25 bp, Mus musculus
aacattcatgcctaggccagaaatc

SEQ ID NO: 31143 - DNA, 25 bp, Mus musculus
aacattcatgttattccaaggtcaa

SEQ ID NO: 31144 - DNA, 25 bp, Mus musculus
aacattcatgtttttccaaggtcaa

SEQ ID NO: 31145 - DNA, 25 bp, Mus musculus
aacattcattcaagtgttcctacga

SEQ ID NO: 31146 - DNA, 25 bp, Mus musculus
aacattcattcatgtgttcctacga

SEQ ID NO: 31147 - DNA, 25 bp, Mus musculus
aacattcattctatccttcactagc

SEQ ID NO: 31148 - DNA, 25 bp, Mus musculus
aacattcattctttccttcactagc

SEQ ID NO: 31149 - DNA, 25 bp, Mus musculus
aacattccaaccagtttgcctgtat

SEQ ID NO: 31150 - DNA, 25 bp, Mus musculus
aacattccaacctgtttgcctgtat

SEQ ID NO: 31151 - DNA, 25 bp, Mus musculus
aacattccaactcttcacagtcatt

SEQ ID NO: 31152 - DNA, 25 bp, Mus musculus
aacattccaactgttcacagtcatt

SEQ ID NO: 31153 - DNA, 25 bp, Mus musculus
aacattccacttagcttgactagcc

SEQ ID NO: 31154 - DNA, 25 bp, Mus musculus
aacattccactttgcttgactagcc

SEQ ID NO: 31155 - DNA, 25 bp, Mus musculus
aacattccatacatgcctactgtgc

SEQ ID NO: 31156 - DNA, 25 bp, Mus musculus
aacattccatacttgcctactgtgc

SEQ ID NO: 31157 - DNA, 25 bp, Mus musculus
aacattcccgggacactcaaactct

SEQ ID NO: 31158 - DNA, 25 bp, Mus musculus
aacattcccgggtcactcaaactct

SEQ ID NO: 31159 - DNA, 25 bp, Mus musculus
aacattcctatgatgggcactcaca

SEQ ID NO: 31160 - DNA, 25 bp, Mus musculus
aacattcctatgttgggcactcaca

SEQ ID NO: 31161 - DNA, 25 bp, Mus musculus
aacattcctcagcttccaagcgaga

SEQ ID NO: 31162 - DNA, 25 bp, Mus musculus
aacattcctcaggttccaagcgaga

SEQ ID NO: 31163 - DNA, 25 bp, Mus musculus
aacattcctcttattgtgtctggtg

SEQ ID NO: 31164 - DNA, 25 bp, Mus musculus
aacattcctctttttgtgtctggtg

SEQ ID NO: 31165 - DNA, 25 bp, Mus musculus
aacattcctgcacctctgaagcaga

SEQ ID NO: 31166 - DNA, 25 bp, Mus musculus
aacattcctgcagctctgaagcaga

SEQ ID NO: 31167 - DNA, 25 bp, Mus musculus
aacattcctgtccagcaatattatt

SEQ ID NO: 31168 - DNA, 25 bp, Mus musculus
aacattcctgtcgagcaatattatt

SEQ ID NO: 31169 - DNA, 25 bp, Mus musculus
aacattcctgttcagtactggagaa

SEQ ID NO: 31170 - DNA, 25 bp, Mus musculus
aacattcctgttgagtactggagaa

SEQ ID NO: 31171 - DNA, 25 bp, Mus musculus
aacattcgtatacctcagtctttat

SEQ ID NO: 31172 - DNA, 25 bp, Mus musculus
aacattcgtatagctcagtctttat

SEQ ID NO: 31173 - DNA, 25 bp, Mus musculus
aacattcgtcaaccctttcggttca

SEQ ID NO: 31174 - DNA, 25 bp, Mus musculus
aacattcgtcaagcctttcggttca

SEQ ID NO: 31175 - DNA, 25 bp, Mus musculus
aacattcgttgactacttcgtaccg

SEQ ID NO: 31176 - DNA, 25 bp, Mus musculus
aacattcgttgagtacttcgtaccg

SEQ ID NO: 31177 - DNA, 25 bp, Mus musculus
aacattctactcaccttcggctgta

SEQ ID NO: 31178 - DNA, 25 bp, Mus musculus
aacattctactctccttcggctgta

SEQ ID NO: 31179 - DNA, 25 bp, Mus musculus
aacattctagaaaggcattaggagt

SEQ ID NO: 31180 - DNA, 25 bp, Mus musculus
aacattctagaatggcattaggagt

SEQ ID NO: 31181 - DNA, 25 bp, Mus musculus
aacattctagttacaccttacacag

SEQ ID NO: 31182 - DNA, 25 bp, Mus musculus
aacattctagtttcaccttacacag

SEQ ID NO: 31183 - DNA, 25 bp, Mus musculus
aacattctcagcacatggctttgga

SEQ ID NO: 31184 - DNA, 25 bp, Mus musculus
aacattctcagctcatggctttgga

SEQ ID NO: 31185 - DNA, 25 bp, Mus musculus
aacattctcaggacgctctgcagct

SEQ ID NO: 31186 - DNA, 25 bp, Mus musculus
aacattctcaggatttctaactcaa

SEQ ID NO: 31187 - DNA, 25 bp, Mus musculus
aacattctcaggtcgctctgcagct

SEQ ID NO: 31188 - DNA, 25 bp, Mus musculus
aacattctcaggttttctaactcaa

SEQ ID NO: 31189 - DNA, 25 bp, Mus musculus
aacattctcttcatggcatgccaac

SEQ ID NO: 31190 - DNA, 25 bp, Mus musculus
aacattctcttcttggcatgccaac

SEQ ID NO: 31191 - DNA, 25 bp, Mus musculus
aacattctggaaaggatcctggaga

SEQ ID NO: 31192 - DNA, 25 bp, Mus musculus
aacattctggaatggatcctggaga

SEQ ID NO: 31193 - DNA, 25 bp, Mus musculus
aacattctggacatacatagtgacc

SEQ ID NO: 31194 - DNA, 25 bp, Mus musculus
aacattctggacttacatagtgacc

SEQ ID NO: 31195 - DNA, 25 bp, Mus musculus
aacattcttacaattgggcctcttc

SEQ ID NO: 31196 - DNA, 25 bp, Mus musculus
aacattcttacatttgggcctcttc

SEQ ID NO: 31197 - DNA, 25 bp, Mus musculus
aacattcttcaaagacttctcactt

SEQ ID NO: 31198 - DNA, 25 bp, Mus musculus
aacattcttcaatgacttctcactt

SEQ ID NO: 31199 - DNA, 25 bp, Mus musculus
aacattcttccaatgggctttttag

SEQ ID NO: 31200 - DNA, 25 bp, Mus musculus
aacattcttccattgggctttttag

SEQ ID NO: 31201 - DNA, 25 bp, Mus musculus
aacattctttctaggctacaaccta

SEQ ID NO: 31202 - DNA, 25 bp, Mus musculus
aacattctttcttggctacaaccta

SEQ ID NO: 31203 - DNA, 25 bp, Mus musculus
aacattcttttaaaggtcaattctg

SEQ ID NO: 31204 - DNA, 25 bp, Mus musculus
aacattcttttataggtcaattctg

SEQ ID NO: 31205 - DNA, 25 bp, Mus musculus
aacattgaacaaatacctatgaaga

SEQ ID NO: 31206 - DNA, 25 bp, Mus musculus
aacattgaacaattacctatgaaga

SEQ ID NO: 31207 - DNA, 25 bp, Mus musculus
aacattgaacttcaggctcctttcc

SEQ ID NO: 31208 - DNA, 25 bp, Mus musculus
aacattgaacttgaggctcctttcc

SEQ ID NO: 31209 - DNA, 25 bp, Mus musculus
aacattgaattcaaccctcccaaga

SEQ ID NO: 31210 - DNA, 25 bp, Mus musculus
aacattgaattctaccctcccaaga

SEQ ID NO: 31211 - DNA, 25 bp, Mus musculus
aacattgacttgaaccacaaagtga

SEQ ID NO: 31212 - DNA, 25 bp, Mus musculus
aacattgacttgtaccacaaagtga

SEQ ID NO: 31213 - DNA, 25 bp, Mus musculus
aacattgagacccttttccaccaag

SEQ ID NO: 31214 - DNA, 25 bp, Mus musculus
aacattgagaccgttttccaccaag

SEQ ID NO: 31215 - DNA, 25 bp, Mus musculus
aacattgagggcacttccagaagta

SEQ ID NO: 31216 - DNA, 25 bp, Mus musculus
aacattgagggctcttccagaagta

SEQ ID NO: 31217 - DNA, 25 bp, Mus musculus
aacattgaggtgagactgtcatcta

SEQ ID NO: 31218 - DNA, 25 bp, Mus musculus
aacattgaggtgtgactgtcatcta

SEQ ID NO: 31219 - DNA, 25 bp, Mus musculus
aacattgatgttccctgtggtggta

SEQ ID NO: 31220 - DNA, 25 bp, Mus musculus
aacattgatgttgcctgtggtggta

SEQ ID NO: 31221 - DNA, 25 bp, Mus musculus
aacattgcaagcatggtgcggcccg

SEQ ID NO: 31222 - DNA, 25 bp, Mus musculus
aacattgcaagcttggtgcggcccg

SEQ ID NO: 31223 - DNA, 25 bp, Mus musculus
aacattgcatggacttaactgagcg

SEQ ID NO: 31224 - DNA, 25 bp, Mus musculus
aacattgcatggtcttaactgagcg

SEQ ID NO: 31225 - DNA, 25 bp, Mus musculus
aacattgccaaacaaccgctgattt

SEQ ID NO: 31226 - DNA, 25 bp, Mus musculus
aacattgccaaagaaccgctgattt

SEQ ID NO: 31227 - DNA, 25 bp, Mus musculus
aacattgccactctattgacctcta

SEQ ID NO: 31228 - DNA, 25 bp, Mus musculus
aacattgccactgtattgacctcta

SEQ ID NO: 31229 - DNA, 25 bp, Mus musculus
aacattgccaggatgagggtcattt

SEQ ID NO: 31230 - DNA, 25 bp, Mus musculus
aacattgccaggttgagggtcattt

SEQ ID NO: 31231 - DNA, 25 bp, Mus musculus
aacattgccctgaatagtggcggaa

SEQ ID NO: 31232 - DNA, 25 bp, Mus musculus
aacattgccctgtatagtggcggaa

SEQ ID NO: 31233 - DNA, 25 bp, Mus musculus
aacattgcctgaagctgtctacagt

SEQ ID NO: 31234 - DNA, 25 bp, Mus musculus
aacattgcctgatgctgtctacagt

SEQ ID NO: 31235 - DNA, 25 bp, Mus musculus
aacattgcgcctccaacacgtacgt

SEQ ID NO: 31236 - DNA, 25 bp, Mus musculus
aacattgcgcctgcaacacgtacgt

SEQ ID NO: 31237 - DNA, 25 bp, Mus musculus
aacattgcgtggacaaccctcaggg

SEQ ID NO: 31238 - DNA, 25 bp, Mus musculus
aacattgcgtggtcaaccctcaggg

SEQ ID NO: 31239 - DNA, 25 bp, Mus musculus
aacattgctatactgagccttcctt

SEQ ID NO: 31240 - DNA, 25 bp, Mus musculus
aacattgctatagtgagccttcctt

SEQ ID NO: 31241 - DNA, 25 bp, Mus musculus
aacattgctcaacagtgcctcaggg

SEQ ID NO: 31242 - DNA, 25 bp, Mus musculus
aacattgctcaagagtgcctcaggg

SEQ ID NO: 31243 - DNA, 25 bp, Mus musculus
aacattgctcctacatgtgcacatg

SEQ ID NO: 31244 - DNA, 25 bp, Mus musculus
aacattgctccttcatgtgcacatg

SEQ ID NO: 31245 - DNA, 25 bp, Mus musculus
aacattgctgcaatggacaccaggc

SEQ ID NO: 31246 - DNA, 25 bp, Mus musculus
aacattgctgcattggacaccaggc

SEQ ID NO: 31247 - DNA, 25 bp, Mus musculus
aacattgctggtctcgttcaggaac

SEQ ID NO: 31248 - DNA, 25 bp, Mus musculus
aacattgctggtgtcgttcaggaac

SEQ ID NO: 31249 - DNA, 25 bp, Mus musculus
aacattgctgtcctcaactatgaga

SEQ ID NO: 31250 - DNA, 25 bp, Mus musculus
aacattgctgtcgtcaactatgaga

SEQ ID NO: 31251 - DNA, 25 bp, Mus musculus
aacattgctgttctacctcttagag

SEQ ID NO: 31252 - DNA, 25 bp, Mus musculus
aacattgctgttgtacctcttagag

SEQ ID NO: 31253 - DNA, 25 bp, Mus musculus
aacattgcttagagaaaccttcctg

SEQ ID NO: 31254 - DNA, 25 bp, Mus musculus
aacattgcttagtgaaaccttcctg

SEQ ID NO: 31255 - DNA, 25 bp, Mus musculus
aacattggagccaaacagctttgct

SEQ ID NO: 31256 - DNA, 25 bp, Mus musculus
aacattggagcctaacagctttgct

SEQ ID NO: 31257 - DNA, 25 bp, Mus musculus
aacattggcacacattgctaccttg

SEQ ID NO: 31258 - DNA, 25 bp, Mus musculus
aacattggcacagattgctaccttg

SEQ ID NO: 31259 - DNA, 25 bp, Mus musculus
aacattggcagcatatgaagcttgc

SEQ ID NO: 31260 - DNA, 25 bp, Mus musculus
aacattggcagcttatgaagcttgc

SEQ ID NO: 31261 - DNA, 25 bp, Mus musculus
aacattggcatgctggtcatccgag

SEQ ID NO: 31262 - DNA, 25 bp, Mus musculus
aacattggcatggtggtcatccgag

SEQ ID NO: 31263 - DNA, 25 bp, Mus musculus
aacattggccctcatttaaaaagca

SEQ ID NO: 31264 - DNA, 25 bp, Mus musculus
aacattggccctgatttaaaaagca

SEQ ID NO: 31265 - DNA, 25 bp, Mus musculus
aacattggcgatctgggctgctaca

SEQ ID NO: 31266 - DNA, 25 bp, Mus musculus
aacattggcgatgtgggctgctaca

SEQ ID NO: 31267 - DNA, 25 bp, Mus musculus
aacattggcgggaacctggcaagtt

SEQ ID NO: 31268 - DNA, 25 bp, Mus musculus
aacattggcgggtacctggcaagtt

SEQ ID NO: 31269 - DNA, 25 bp, Mus musculus
aacattggctacatcacctttgtgc

SEQ ID NO: 31270 - DNA, 25 bp, Mus musculus
aacattggctacttcacctttgtgc

SEQ ID NO: 31271 - DNA, 25 bp, Mus musculus
aacattgggactctactctcctatc

SEQ ID NO: 31272 - DNA, 25 bp, Mus musculus
aacattgggactgtactctcctatc

SEQ ID NO: 31273 - DNA, 25 bp, Mus musculus
aacattgggctgaattgttcagtgt

SEQ ID NO: 31274 - DNA, 25 bp, Mus musculus
aacattgggctgtattgttcagtgt

SEQ ID NO: 31275 - DNA, 25 bp, Mus musculus
aacattgggtgcagtggctgcacta

SEQ ID NO: 31276 - DNA, 25 bp, Mus musculus
aacattgggtgctgtggctgcacta

SEQ ID NO: 31277 - DNA, 25 bp, Mus musculus
aacattgggttacattgctaggctt

SEQ ID NO: 31278 - DNA, 25 bp, Mus musculus
aacattgggttagattgctaggctt

SEQ ID NO: 31279 - DNA, 25 bp, Mus musculus
aacattgggtttcgtctgggctgac

SEQ ID NO: 31280 - DNA, 25 bp, Mus musculus
aacattgggtttggtctgggctgac

SEQ ID NO: 31281 - DNA, 25 bp, Mus musculus
aacattggtatgaaggtgtcctctt

SEQ ID NO: 31282 - DNA, 25 bp, Mus musculus
aacattggtatgtaggtgtcctctt

SEQ ID NO: 31283 - DNA, 25 bp, Mus musculus
aacattggtctcagagaattgccct

SEQ ID NO: 31284 - DNA, 25 bp, Mus musculus
aacattggtctctgagaattgccct

SEQ ID NO: 31285 - DNA, 25 bp, Mus musculus
aacattggtgaacggttagacaaat

SEQ ID NO: 31286 - DNA, 25 bp, Mus musculus
aacattggtgaagggttagacaaat

SEQ ID NO: 31287 - DNA, 25 bp, Mus musculus
aacattggttctaatttctgaggac

SEQ ID NO: 31288 - DNA, 25 bp, Mus musculus
aacattggttcttatttctgaggac

SEQ ID NO: 31289 - DNA, 25 bp, Mus musculus
aacattggttggctttaagttagtg

SEQ ID NO: 31290 - DNA, 25 bp, Mus musculus
aacattggttgggtttaagttagtg

SEQ ID NO: 31291 - DNA, 25 bp, Mus musculus
aacattgtaaaacttgacctcatag

SEQ ID NO: 31292 - DNA, 25 bp, Mus musculus
aacattgtaaaagttgacctcatag

SEQ ID NO: 31293 - DNA, 25 bp, Mus musculus
aacattgtacccatcttccttttgt

SEQ ID NO: 31294 - DNA, 25 bp, Mus musculus
aacattgtacccttcttccttttgt

SEQ ID NO: 31295 - DNA, 25 bp, Mus musculus
aacattgtatccatttgattaagta

SEQ ID NO: 31296 - DNA, 25 bp, Mus musculus
aacattgtatccttttgattaagta

SEQ ID NO: 31297 - DNA, 25 bp, Mus musculus
aacattgtcagacgctgtcacactg

SEQ ID NO: 31298 - DNA, 25 bp, Mus musculus
aacattgtcagaggctgtcacactg

SEQ ID NO: 31299 - DNA, 25 bp, Mus musculus
aacattgtcatacccactgcacgtt

SEQ ID NO: 31300 - DNA, 25 bp, Mus musculus
aacattgtcatagccactgcacgtt

SEQ ID NO: 31301 - DNA, 25 bp, Mus musculus
aacattgtcctgctgactgcggtag

SEQ ID NO: 31302 - DNA, 25 bp, Mus musculus
aacattgtcctggtgactgcggtag

SEQ ID NO: 31303 - DNA, 25 bp, Mus musculus
aacattgtctttaagccgttctcgt

SEQ ID NO: 31304 - DNA, 25 bp, Mus musculus
aacattgtcttttagccgttctcgt

SEQ ID NO: 31305 - DNA, 25 bp, Mus musculus
aacattgtgtacagccatggagtta

SEQ ID NO: 31306 - DNA, 25 bp, Mus musculus
aacattgtgtactgccatggagtta

SEQ ID NO: 31307 - DNA, 25 bp, Mus musculus
aacattgtgtcgattcttggcacct

SEQ ID NO: 31308 - DNA, 25 bp, Mus musculus
aacattgtgtcgtttcttggcacct

SEQ ID NO: 31309 - DNA, 25 bp, Mus musculus
aacattgtgttcagtgtcctggcac

SEQ ID NO: 31310 - DNA, 25 bp, Mus musculus
aacattgtgttctgtgtcctggcac

SEQ ID NO: 31311 - DNA, 25 bp, Mus musculus
aacattgttaccatgtcagtattat

SEQ ID NO: 31312 - DNA, 25 bp, Mus musculus
aacattgttaccttgtcagtattat

SEQ ID NO: 31313 - DNA, 25 bp, Mus musculus
aacattgttattaagctgctttgaa

SEQ ID NO: 31314 - DNA, 25 bp, Mus musculus
aacattgttatttagctgctttgaa

SEQ ID NO: 31315 - DNA, 25 bp, Mus musculus
aacattgttcatatatgagggctat

SEQ ID NO: 31316 - DNA, 25 bp, Mus musculus
aacattgttcatcacctggtagcta

SEQ ID NO: 31317 - DNA, 25 bp, Mus musculus
aacattgttcatgacctggtagcta

SEQ ID NO: 31318 - DNA, 25 bp, Mus musculus
aacattgttcatttatgagggctat

SEQ ID NO: 31319 - DNA, 25 bp, Mus musculus
aacattgttgaaaggactcttcact

SEQ ID NO: 31320 - DNA, 25 bp, Mus musculus
aacattgttgaatggactcttcact

SEQ ID NO: 31321 - DNA, 25 bp, Mus musculus
aacattgttgtcagccaggcaagat

SEQ ID NO: 31322 - DNA, 25 bp, Mus musculus
aacattgttgtctgccaggcaagat

SEQ ID NO: 31323 - DNA, 25 bp, Mus musculus
aacattgtttaacgtggctctgtct

SEQ ID NO: 31324 - DNA, 25 bp, Mus musculus
aacattgtttaaggtggctctgtct

SEQ ID NO: 31325 - DNA, 25 bp, Mus musculus
aacattgtttacatgatctttcgca

SEQ ID NO: 31326 - DNA, 25 bp, Mus musculus
aacattgtttacttgatctttcgca

SEQ ID NO: 31327 - DNA, 25 bp, Mus musculus
aacatttaccctcataaaatggtgc

SEQ ID NO: 31328 - DNA, 25 bp, Mus musculus
aacatttaccctgataaaatggtgc

SEQ ID NO: 31329 - DNA, 25 bp, Mus musculus
aacatttaccgaccgtgtgcagttc

SEQ ID NO: 31330 - DNA, 25 bp, Mus musculus
aacatttaccgagcgtgtgcagttc

SEQ ID NO: 31331 - DNA, 25 bp, Mus musculus
aacatttacgtactagtccttgaag

SEQ ID NO: 31332 - DNA, 25 bp, Mus musculus
aacatttacgtagtagtccttgaag

SEQ ID NO: 31333 - DNA, 25 bp, Mus musculus
aacatttactatctttaccagcggg

SEQ ID NO: 31334 - DNA, 25 bp, Mus musculus
aacatttactatgtttaccagcggg

SEQ ID NO: 31335 - DNA, 25 bp, Mus musculus
aacatttagcggctcaccatcgaag

SEQ ID NO: 31336 - DNA, 25 bp, Mus musculus
aacatttagcgggtcaccatcgaag

SEQ ID NO: 31337 - DNA, 25 bp, Mus musculus
aacatttagctacatctttggatac

SEQ ID NO: 31338 - DNA, 25 bp, Mus musculus
aacatttagctagatctttggatac

SEQ ID NO: 31339 - DNA, 25 bp, Mus musculus
aacatttattgacctccattaggtg

SEQ ID NO: 31340 - DNA, 25 bp, Mus musculus
aacatttattgagctccattaggtg

SEQ ID NO: 31341 - DNA, 25 bp, Mus musculus
aacatttcaccaagtttccatgtaa

SEQ ID NO: 31342 - DNA, 25 bp, Mus musculus
aacatttcaccatgtttccatgtaa

SEQ ID NO: 31343 - DNA, 25 bp, Mus musculus
aacatttcatataggtgggcatgca

SEQ ID NO: 31344 - DNA, 25 bp, Mus musculus
aacatttcatattggtgggcatgca

SEQ ID NO: 31345 - DNA, 25 bp, Mus musculus
aacatttcatcaatcttgtacattg

SEQ ID NO: 31346 - DNA, 25 bp, Mus musculus
aacatttcatcattcttgtacattg

SEQ ID NO: 31347 - DNA, 25 bp, Mus musculus
aacatttccatcagcttctattctt

SEQ ID NO: 31348 - DNA, 25 bp, Mus musculus
aacatttccatctgcttctattctt

SEQ ID NO: 31349 - DNA, 25 bp, Mus musculus
aacatttcccatatgtccatggaca

SEQ ID NO: 31350 - DNA, 25 bp, Mus musculus
aacatttcccatttgtccatggaca

SEQ ID NO: 31351 - DNA, 25 bp, Mus musculus
aacatttccctcacaatttctatcc

SEQ ID NO: 31352 - DNA, 25 bp, Mus musculus
aacatttccctctcaatttctatcc

SEQ ID NO: 31353 - DNA, 25 bp, Mus musculus
aacatttcgagcatgatcattcccc

SEQ ID NO: 31354 - DNA, 25 bp, Mus musculus
aacatttcgagcttgatcattcccc

SEQ ID NO: 31355 - DNA, 25 bp, Mus musculus
aacatttcgtcccaaagtctgagta

SEQ ID NO: 31356 - DNA, 25 bp, Mus musculus
aacatttcgtccgaaagtctgagta

SEQ ID NO: 31357 - DNA, 25 bp, Mus musculus
aacatttctgccagcatccagagga

SEQ ID NO: 31358 - DNA, 25 bp, Mus musculus
aacatttctgcctgcatccagagga

SEQ ID NO: 31359 - DNA, 25 bp, Mus musculus
aacatttcttctcgaggacctgggt

SEQ ID NO: 31360 - DNA, 25 bp, Mus musculus
aacatttcttctggaggacctgggt

SEQ ID NO: 31361 - DNA, 25 bp, Mus musculus
aacatttctttcctatctattctaa

SEQ ID NO: 31362 - DNA, 25 bp, Mus musculus
aacatttctttcgtatctattctaa

SEQ ID NO: 31363 - DNA, 25 bp, Mus musculus
aacatttctttgacctcttctgtat

SEQ ID NO: 31364 - DNA, 25 bp, Mus musculus
aacatttctttgtcctcttctgtat

SEQ ID NO: 31365 - DNA, 25 bp, Mus musculus
aacatttcttttagtgggtgtctca

SEQ ID NO: 31366 - DNA, 25 bp, Mus musculus
aacatttctttttgtgggtgtctca

SEQ ID NO: 31367 - DNA, 25 bp, Mus musculus
aacatttgaacgcaactctggcgcg

SEQ ID NO: 31368 - DNA, 25 bp, Mus musculus
aacatttgaacggaactctggcgcg

SEQ ID NO: 31369 - DNA, 25 bp, Mus musculus
aacatttgatgtcactggaccctcc

SEQ ID NO: 31370 - DNA, 25 bp, Mus musculus
aacatttgatgtgactggaccctcc

SEQ ID NO: 31371 - DNA, 25 bp, Mus musculus
aacatttgccgtatgcatggccctt

SEQ ID NO: 31372 - DNA, 25 bp, Mus musculus
aacatttgccgtttgcatggccctt

SEQ ID NO: 31373 - DNA, 25 bp, Mus musculus
aacatttgctgtatctggaatccaa

SEQ ID NO: 31374 - DNA, 25 bp, Mus musculus
aacatttgctgtttctggaatccaa

SEQ ID NO: 31375 - DNA, 25 bp, Mus musculus
aacatttggaagcttttgcaaacaa

SEQ ID NO: 31376 - DNA, 25 bp, Mus musculus
aacatttggaaggttttgcaaacaa

SEQ ID NO: 31377 - DNA, 25 bp, Mus musculus
aacatttggcatccctctctaaggc

SEQ ID NO: 31378 - DNA, 25 bp, Mus musculus
aacatttggcatgcctctctaaggc

SEQ ID NO: 31379 - DNA, 25 bp, Mus musculus
aacatttggctacacgaggcatccc

SEQ ID NO: 31380 - DNA, 25 bp, Mus musculus
aacatttggctagacgaggcatccc

SEQ ID NO: 31381 - DNA, 25 bp, Mus musculus
aacatttgggcaaggcacttggctc

SEQ ID NO: 31382 - DNA, 25 bp, Mus musculus
aacatttgggcatggcacttggctc

SEQ ID NO: 31383 - DNA, 25 bp, Mus musculus
aacatttgtaccaagcctgcttttc

SEQ ID NO: 31384 - DNA, 25 bp, Mus musculus
aacatttgtacctagcctgcttttc

SEQ ID NO: 31385 - DNA, 25 bp, Mus musculus
aacatttgtatgaagtcctagcact

SEQ ID NO: 31386 - DNA, 25 bp, Mus musculus
aacatttgtatgtagtcctagcact

SEQ ID NO: 31387 - DNA, 25 bp, Mus musculus
aacatttgtcgactctggcagagtc

SEQ ID NO: 31388 - DNA, 25 bp, Mus musculus
aacatttgtcgagtctggcagagtc

SEQ ID NO: 31389 - DNA, 25 bp, Mus musculus
aacatttgtctcatgtacatctcac

SEQ ID NO: 31390 - DNA, 25 bp, Mus musculus
aacatttgtctcttgtacatctcac

SEQ ID NO: 31391 - DNA, 25 bp, Mus musculus
aacatttgtggaaggtcttttgcaa

SEQ ID NO: 31392 - DNA, 25 bp, Mus musculus
aacatttgtggatggtcttttgcaa

SEQ ID NO: 31393 - DNA, 25 bp, Mus musculus
aacatttgttatcgatgccacctcc

SEQ ID NO: 31394 - DNA, 25 bp, Mus musculus
aacatttgttatggatgccacctcc

SEQ ID NO: 31395 - DNA, 25 bp, Mus musculus
aacatttgtttcatgctcctggata

SEQ ID NO: 31396 - DNA, 25 bp, Mus musculus
aacatttgtttcttgctcctggata

SEQ ID NO: 31397 - DNA, 25 bp, Mus musculus
aacatttgtttgatgcagcctccct

SEQ ID NO: 31398 - DNA, 25 bp, Mus musculus
aacatttgtttgttgcagcctccct

SEQ ID NO: 31399 - DNA, 25 bp, Mus musculus
aacattttaaacatgccattcagca

SEQ ID NO: 31400 - DNA, 25 bp, Mus musculus
aacattttaaacttgccattcagca

SEQ ID NO: 31401 - DNA, 25 bp, Mus musculus
aacattttaaatccttcttagcata

SEQ ID NO: 31402 - DNA, 25 bp, Mus musculus
aacattttaaatgcttcttagcata

SEQ ID NO: 31403 - DNA, 25 bp, Mus musculus
aacattttaatcaacgctgcggtta

SEQ ID NO: 31404 - DNA, 25 bp, Mus musculus
aacattttaatctacgctgcggtta

SEQ ID NO: 31405 - DNA, 25 bp, Mus musculus
aacattttaccccttcagctgttct

SEQ ID NO: 31406 - DNA, 25 bp, Mus musculus
aacattttacccgttcagctgttct

SEQ ID NO: 31407 - DNA, 25 bp, Mus musculus
aacattttagagatgcaagcgtctt

SEQ ID NO: 31408 - DNA, 25 bp, Mus musculus
aacattttagagttgcaagcgtctt

SEQ ID NO: 31409 - DNA, 25 bp, Mus musculus
aacattttataactcacagtagtct

SEQ ID NO: 31410 - DNA, 25 bp, Mus musculus
aacattttataagtcacagtagtct

SEQ ID NO: 31411 - DNA, 25 bp, Mus musculus
aacattttatgcctgtggtagatgc

SEQ ID NO: 31412 - DNA, 25 bp, Mus musculus
aacattttatgcgtgtggtagatgc

SEQ ID NO: 31413 - DNA, 25 bp, Mus musculus
aacattttcagtcagtacttttgga

SEQ ID NO: 31414 - DNA, 25 bp, Mus musculus
aacattttcagtgagtacttttgga

SEQ ID NO: 31415 - DNA, 25 bp, Mus musculus
aacattttccctctgctagaagatc

SEQ ID NO: 31416 - DNA, 25 bp, Mus musculus
aacattttccctgtgctagaagatc

SEQ ID NO: 31417 - DNA, 25 bp, Mus musculus
aacattttcgaactcctcttctggg

SEQ ID NO: 31418 - DNA, 25 bp, Mus musculus
aacattttcgaagtcctcttctggg

SEQ ID NO: 31419 - DNA, 25 bp, Mus musculus
aacattttctcaagtacctgtccac

SEQ ID NO: 31420 - DNA, 25 bp, Mus musculus
aacattttctcatgtacctgtccac

SEQ ID NO: 31421 - DNA, 25 bp, Mus musculus
aacattttcttactggttgatagga

SEQ ID NO: 31422 - DNA, 25 bp, Mus musculus
aacattttcttagtggttgatagga

SEQ ID NO: 31423 - DNA, 25 bp, Mus musculus
aacattttgactaagctcagcggca

SEQ ID NO: 31424 - DNA, 25 bp, Mus musculus
aacattttgacttagctcagcggca

SEQ ID NO: 31425 - DNA, 25 bp, Mus musculus
aacattttgataatcctcactctgg

SEQ ID NO: 31426 - DNA, 25 bp, Mus musculus
aacattttgatattcctcactctgg

SEQ ID NO: 31427 - DNA, 25 bp, Mus musculus
aacattttgatgaccgtcttcccag

SEQ ID NO: 31428 - DNA, 25 bp, Mus musculus
aacattttgatgtccgtcttcccag

SEQ ID NO: 31429 - DNA, 25 bp, Mus musculus
aacattttgctgagtaagacctaac

SEQ ID NO: 31430 - DNA, 25 bp, Mus musculus
aacattttgctgagtgagaggactt

SEQ ID NO: 31431 - DNA, 25 bp, Mus musculus
aacattttgctgtgtaagacctaac

SEQ ID NO: 31432 - DNA, 25 bp, Mus musculus
aacattttgctgtgtgagaggactt

SEQ ID NO: 31433 - DNA, 25 bp, Mus musculus
aacattttggtcacagttgcaagaa

SEQ ID NO: 31434 - DNA, 25 bp, Mus musculus
aacattttggtctcagttgcaagaa

SEQ ID NO: 31435 - DNA, 25 bp, Mus musculus
aacattttggtgactggttctcttg

SEQ ID NO: 31436 - DNA, 25 bp, Mus musculus
aacattttggtgtctggttctcttg

SEQ ID NO: 31437 - DNA, 25 bp, Mus musculus
aacatttttattcaccagtcgtgat

SEQ ID NO: 31438 - DNA, 25 bp, Mus musculus
aacatttttattgaccagtcgtgat

SEQ ID NO: 31439 - DNA, 25 bp, Mus musculus
aacatttttcagaatcccttagata

SEQ ID NO: 31440 - DNA, 25 bp, Mus musculus
aacatttttcagtatcccttagata

SEQ ID NO: 31441 - DNA, 25 bp, Mus musculus
aacatttttcataatctcggcagta

SEQ ID NO: 31442 - DNA, 25 bp, Mus musculus
aacatttttcattatctcggcagta

SEQ ID NO: 31443 - DNA, 25 bp, Mus musculus
aacatttttcttatcgcagagagga

SEQ ID NO: 31444 - DNA, 25 bp, Mus musculus
aacatttttcttttcgcagagagga

SEQ ID NO: 31445 - DNA, 25 bp, Mus musculus
aacatttttgtgctgcttctcgtta

SEQ ID NO: 31446 - DNA, 25 bp, Mus musculus
aacatttttgtggtgcttctcgtta

SEQ ID NO: 31447 - DNA, 25 bp, Mus musculus
aacattttttccaggagtgcttatt

SEQ ID NO: 31448 - DNA, 25 bp, Mus musculus
aacattttttcctggagtgcttatt

SEQ ID NO: 31449 - DNA, 25 bp, Mus musculus
aaccaaaacacaccatcattcccac

SEQ ID NO: 31450 - DNA, 25 bp, Mus musculus
aaccaaaacacagcatcattcccac

SEQ ID NO: 31451 - DNA, 25 bp, Mus musculus
aaccaaaacattcccagtgggccaa

SEQ ID NO: 31452 - DNA, 25 bp, Mus musculus
aaccaaaacattgccagtgggccaa

SEQ ID NO: 31453 - DNA, 25 bp, Mus musculus
aaccaaaaccaaagtgagccctgcc

SEQ ID NO: 31454 - DNA, 25 bp, Mus musculus
aaccaaaaccaatgtgagccctgcc

SEQ ID NO: 31455 - DNA, 25 bp, Mus musculus
aaccaaaacgatctagccctgcttt

SEQ ID NO: 31456 - DNA, 25 bp, Mus musculus
aaccaaaacgatgtagccctgcttt

SEQ ID NO: 31457 - DNA, 25 bp, Mus musculus
aaccaaaacttgagccgtatcagga

SEQ ID NO: 31458 - DNA, 25 bp, Mus musculus
aaccaaaacttgtgccgtatcagga

SEQ ID NO: 31459 - DNA, 25 bp, Mus musculus
aaccaaaagcagatgcctgcctgtt

SEQ ID NO: 31460 - DNA, 25 bp, Mus musculus
aaccaaaagcagttgcctgcctgtt

SEQ ID NO: 31461 - DNA, 25 bp, Mus musculus
aaccaaaagcatctatgagctctgt

SEQ ID NO: 31462 - DNA, 25 bp, Mus musculus
aaccaaaagcatgtatgagctctgt

SEQ ID NO: 31463 - DNA, 25 bp, Mus musculus
aaccaaaaggtgaccagcctctact

SEQ ID NO: 31464 - DNA, 25 bp, Mus musculus
aaccaaaaggtgtccagcctctact

SEQ ID NO: 31465 - DNA, 25 bp, Mus musculus
aaccaaaatcaaaaagtcgtgccaa

SEQ ID NO: 31466 - DNA, 25 bp, Mus musculus
aaccaaaatcaataagtcgtgccaa

SEQ ID NO: 31467 - DNA, 25 bp, Mus musculus
aaccaaacaagcagctcgtagtcgt

SEQ ID NO: 31468 - DNA, 25 bp, Mus musculus
aaccaaacaagctgctcgtagtcgt

SEQ ID NO: 31469 - DNA, 25 bp, Mus musculus
aaccaaacagttcttgccaccatga

SEQ ID NO: 31470 - DNA, 25 bp, Mus musculus
aaccaaacagttgttgccaccatga

SEQ ID NO: 31471 - DNA, 25 bp, Mus musculus
aaccaaaccgcaatcgtgtggattt

SEQ ID NO: 31472 - DNA, 25 bp, Mus musculus
aaccaaaccgcattcgtgtggattt

SEQ ID NO: 31473 - DNA, 25 bp, Mus musculus
aaccaaacctatactctgcaaggac

SEQ ID NO: 31474 - DNA, 25 bp, Mus musculus
aaccaaacctattctctgcaaggac

SEQ ID NO: 31475 - DNA, 25 bp, Mus musculus
aaccaaacgctaatgaagactacag

SEQ ID NO: 31476 - DNA, 25 bp, Mus musculus
aaccaaacgctattgaagactacag

SEQ ID NO: 31477 - DNA, 25 bp, Mus musculus
aaccaaacgttgatgcatgtagcta

SEQ ID NO: 31478 - DNA, 25 bp, Mus musculus
aaccaaacgttgttgcatgtagcta

SEQ ID NO: 31479 - DNA, 25 bp, Mus musculus
aaccaaactatgaatttctgatctt

SEQ ID NO: 31480 - DNA, 25 bp, Mus musculus
aaccaaactatgtatttctgatctt

SEQ ID NO: 31481 - DNA, 25 bp, Mus musculus
aaccaaactcctcaccagatagatg

SEQ ID NO: 31482 - DNA, 25 bp, Mus musculus
aaccaaactcctgaccagatagatg

SEQ ID NO: 31483 - DNA, 25 bp, Mus musculus
aaccaaagatgacgcactttctctt

SEQ ID NO: 31484 - DNA, 25 bp, Mus musculus
aaccaaagatgaggcactttctctt

SEQ ID NO: 31485 - DNA, 25 bp, Mus musculus
aaccaaagatttctctgccatcctc

SEQ ID NO: 31486 - DNA, 25 bp, Mus musculus
aaccaaagatttgtctgccatcctc

SEQ ID NO: 31487 - DNA, 25 bp, Mus musculus
aaccaaagcccgctcgctgtaaggg

SEQ ID NO: 31488 - DNA, 25 bp, Mus musculus
aaccaaagcccggtcgctgtaaggg

SEQ ID NO: 31489 - DNA, 25 bp, Mus musculus
aaccaaaggccgcacaggctggcca

SEQ ID NO: 31490 - DNA, 25 bp, Mus musculus
aaccaaaggccggacaggctggcca

SEQ ID NO: 31491 - DNA, 25 bp, Mus musculus
aaccaaagtatgatctaaggcaagt

SEQ ID NO: 31492 - DNA, 25 bp, Mus musculus
aaccaaagtatgttctaaggcaagt

SEQ ID NO: 31493 - DNA, 25 bp, Mus musculus
aaccaaagtcagctcttcagagtgt

SEQ ID NO: 31494 - DNA, 25 bp, Mus musculus
aaccaaagtcaggtcttcagagtgt

SEQ ID NO: 31495 - DNA, 25 bp, Mus musculus
aaccaaagtccactgagggctgctt

SEQ ID NO: 31496 - DNA, 25 bp, Mus musculus
aaccaaagtccagtgagggctgctt

SEQ ID NO: 31497 - DNA, 25 bp, Mus musculus
aaccaaagtgcacgctgagccaggt

SEQ ID NO: 31498 - DNA, 25 bp, Mus musculus
aaccaaagtgcaggctgagccaggt

SEQ ID NO: 31499 - DNA, 25 bp, Mus musculus
aaccaaagttctcatgctgtttaca

SEQ ID NO: 31500 - DNA, 25 bp, Mus musculus
aaccaaagttctgatgctgtttaca

SEQ ID NO: 31501 - DNA, 25 bp, Mus musculus
aaccaaagtttgagggccttcaatg

SEQ ID NO: 31502 - DNA, 25 bp, Mus musculus
aaccaaagtttgtgggccttcaatg

SEQ ID NO: 31503 - DNA, 25 bp, Mus musculus
aaccaaatactgaaactggagatca

SEQ ID NO: 31504 - DNA, 25 bp, Mus musculus
aaccaaatactgtaactggagatca

SEQ ID NO: 31505 - DNA, 25 bp, Mus musculus
aaccaaatatccactgctagggaaa

SEQ ID NO: 31506 - DNA, 25 bp, Mus musculus
aaccaaatatcctctgctagggaaa

SEQ ID NO: 31507 - DNA, 25 bp, Mus musculus
aaccaaatcctacagccagctgaga

SEQ ID NO: 31508 - DNA, 25 bp, Mus musculus
aaccaaatcctagagccagctgaga

SEQ ID NO: 31509 - DNA, 25 bp, Mus musculus
aaccaaatctccagcagcaacggca

SEQ ID NO: 31510 - DNA, 25 bp, Mus musculus
aaccaaatctcctgcagcaacggca

SEQ ID NO: 31511 - DNA, 25 bp, Mus musculus
aaccaaatggctacctggaataatt

SEQ ID NO: 31512 - DNA, 25 bp, Mus musculus
aaccaaatggcttcctggaataatt

SEQ ID NO: 31513 - DNA, 25 bp, Mus musculus
aaccaaatggtgactttttaagatg

SEQ ID NO: 31514 - DNA, 25 bp, Mus musculus
aaccaaatggtgtctttttaagatg

SEQ ID NO: 31515 - DNA, 25 bp, Mus musculus
aaccaaatgtctcgcttactgcttt

SEQ ID NO: 31516 - DNA, 25 bp, Mus musculus
aaccaaatgtctggcttactgcttt

SEQ ID NO: 31517 - DNA, 25 bp, Mus musculus
aaccaaatgttcatccgtgttccac

SEQ ID NO: 31518 - DNA, 25 bp, Mus musculus
aaccaaatgttcttccgtgttccac

SEQ ID NO: 31519 - DNA, 25 bp, Mus musculus
aaccaaatgttgacttgcctgctgc

SEQ ID NO: 31520 - DNA, 25 bp, Mus musculus
aaccaaatgttgtcttgcctgctgc

SEQ ID NO: 31521 - DNA, 25 bp, Mus musculus
aaccaaattatcaatgcccatatgc

SEQ ID NO: 31522 - DNA, 25 bp, Mus musculus
aaccaaattatctatgcccatatgc

SEQ ID NO: 31523 - DNA, 25 bp, Mus musculus
aaccaaattctgacaacagcccaca

SEQ ID NO: 31524 - DNA, 25 bp, Mus musculus
aaccaaattctgtcaacagcccaca

SEQ ID NO: 31525 - DNA, 25 bp, Mus musculus
aaccaaattgtgacccatgtttaat

SEQ ID NO: 31526 - DNA, 25 bp, Mus musculus
aaccaaattgtgtcccatgtttaat

SEQ ID NO: 31527 - DNA, 25 bp, Mus musculus
aaccaacaacctagaatgacatcag

SEQ ID NO: 31528 - DNA, 25 bp, Mus musculus
aaccaacaaccttgaatgacatcag

SEQ ID NO: 31529 - DNA, 25 bp, Mus musculus
aaccaacaacttacttctctgggtg

SEQ ID NO: 31530 - DNA, 25 bp, Mus musculus
aaccaacaactttcttctctgggtg

SEQ ID NO: 31531 - DNA, 25 bp, Mus musculus
aaccaacaaggacacagctgccttc

SEQ ID NO: 31532 - DNA, 25 bp, Mus musculus
aaccaacaaggagacagctgccttc

SEQ ID NO: 31533 - DNA, 25 bp, Mus musculus
aaccaacacgggaggcttgagcagc

SEQ ID NO: 31534 - DNA, 25 bp, Mus musculus
aaccaacacgggtggcttgagcagc

SEQ ID NO: 31535 - DNA, 25 bp, Mus musculus
aaccaaccacgtaacgatgctgcta

SEQ ID NO: 31536 - DNA, 25 bp, Mus musculus
aaccaaccacgttacgatgctgcta

SEQ ID NO: 31537 - DNA, 25 bp, Mus musculus
aaccaaccagaaagcttgctctgtt

SEQ ID NO: 31538 - DNA, 25 bp, Mus musculus
aaccaaccagaatgcttgctctgtt

SEQ ID NO: 31539 - DNA, 25 bp, Mus musculus
aaccaaccatttatgtccagacaag

SEQ ID NO: 31540 - DNA, 25 bp, Mus musculus
aaccaaccatttttgtccagacaag

SEQ ID NO: 31541 - DNA, 25 bp, Mus musculus
aaccaaccgtgtcatcagcacagtg

SEQ ID NO: 31542 - DNA, 25 bp, Mus musculus
aaccaaccgtgtgatcagcacagtg

SEQ ID NO: 31543 - DNA, 25 bp, Mus musculus
aaccaacctgaacagttaaccgcat

SEQ ID NO: 31544 - DNA, 25 bp, Mus musculus
aaccaacctgaagagttaaccgcat

SEQ ID NO: 31545 - DNA, 25 bp, Mus musculus
aaccaacctggacccttttgtgaga

SEQ ID NO: 31546 - DNA, 25 bp, Mus musculus
aaccaacctggagccttttgtgaga

SEQ ID NO: 31547 - DNA, 25 bp, Mus musculus
aaccaacctgtaacatttgtgtttg

SEQ ID NO: 31548 - DNA, 25 bp, Mus musculus
aaccaacctgtatcatttgtgtttg

SEQ ID NO: 31549 - DNA, 25 bp, Mus musculus
aaccaaccttggctgtgtatgtgga

SEQ ID NO: 31550 - DNA, 25 bp, Mus musculus
aaccaaccttgggtgtgtatgtgga

SEQ ID NO: 31551 - DNA, 25 bp, Mus musculus
aaccaacgtgggatcgaatacatat

SEQ ID NO: 31552 - DNA, 25 bp, Mus musculus
aaccaacgtgggttcgaatacatat

SEQ ID NO: 31553 - DNA, 25 bp, Mus musculus
aaccaacgttggatgaactagatca

SEQ ID NO: 31554 - DNA, 25 bp, Mus musculus
aaccaacgttggttgaactagatca

SEQ ID NO: 31555 - DNA, 25 bp, Mus musculus
aaccaactaaatccaacgcaacatc

SEQ ID NO: 31556 - DNA, 25 bp, Mus musculus
aaccaactaaatgcaacgcaacatc

SEQ ID NO: 31557 - DNA, 25 bp, Mus musculus
aaccaactaaccatccttcatttca

SEQ ID NO: 31558 - DNA, 25 bp, Mus musculus
aaccaactaaccttccttcatttca

SEQ ID NO: 31559 - DNA, 25 bp, Mus musculus
aaccaactatttacctaactgcatg

SEQ ID NO: 31560 - DNA, 25 bp, Mus musculus
aaccaactattttcctaactgcatg

SEQ ID NO: 31561 - DNA, 25 bp, Mus musculus
aaccaactcctccaattatcctttg

SEQ ID NO: 31562 - DNA, 25 bp, Mus musculus
aaccaactcctcgaattatcctttg

SEQ ID NO: 31563 - DNA, 25 bp, Mus musculus
aaccaactctgacaactacaaacca

SEQ ID NO: 31564 - DNA, 25 bp, Mus musculus
aaccaactctgagaactacaaacca

SEQ ID NO: 31565 - DNA, 25 bp, Mus musculus
aaccaactctttcaccagttttatg

SEQ ID NO: 31566 - DNA, 25 bp, Mus musculus
aaccaactctttgaccagttttatg

SEQ ID NO: 31567 - DNA, 25 bp, Mus musculus
aaccaactgtgaaatcagcttattt

SEQ ID NO: 31568 - DNA, 25 bp, Mus musculus
aaccaactgtgatatcagcttattt

SEQ ID NO: 31569 - DNA, 25 bp, Mus musculus
aaccaacttgcaatgctgttcatgg

SEQ ID NO: 31570 - DNA, 25 bp, Mus musculus
aaccaacttgcattgctgttcatgg

SEQ ID NO: 31571 - DNA, 25 bp, Mus musculus
aaccaacttgttcgataactctcca

SEQ ID NO: 31572 - DNA, 25 bp, Mus musculus
aaccaacttgttcggcttcttctgg

SEQ ID NO: 31573 - DNA, 25 bp, Mus musculus
aaccaacttgttggataactctcca

SEQ ID NO: 31574 - DNA, 25 bp, Mus musculus
aaccaacttgttgggcttcttctgg

SEQ ID NO: 31575 - DNA, 25 bp, Mus musculus
aaccaactttagatactgcatgtgt

SEQ ID NO: 31576 - DNA, 25 bp, Mus musculus
aaccaactttagttactgcatgtgt

SEQ ID NO: 31577 - DNA, 25 bp, Mus musculus
aaccaactttgaagattcctgtgat

SEQ ID NO: 31578 - DNA, 25 bp, Mus musculus
aaccaactttgatgattcctgtgat

SEQ ID NO: 31579 - DNA, 25 bp, Mus musculus
aaccaagaaagcctacagatccgtt

SEQ ID NO: 31580 - DNA, 25 bp, Mus musculus
aaccaagaaagcgtacagatccgtt

SEQ ID NO: 31581 - DNA, 25 bp, Mus musculus
aaccaagaagaaccgggctgtgatc

SEQ ID NO: 31582 - DNA, 25 bp, Mus musculus
aaccaagaagaagcgggctgtgatc

SEQ ID NO: 31583 - DNA, 25 bp, Mus musculus
aaccaagaccacagacagcagagga

SEQ ID NO: 31584 - DNA, 25 bp, Mus musculus
aaccaagaccactgacagcagagga

SEQ ID NO: 31585 - DNA, 25 bp, Mus musculus
aaccaagacggtcgcctttcagagc

SEQ ID NO: 31586 - DNA, 25 bp, Mus musculus
aaccaagacggtggcctttcagagc

SEQ ID NO: 31587 - DNA, 25 bp, Mus musculus
aaccaagactctagtgggctcttta

SEQ ID NO: 31588 - DNA, 25 bp, Mus musculus
aaccaagactcttgtgggctcttta

SEQ ID NO: 31589 - DNA, 25 bp, Mus musculus
aaccaagactgtatctttagtcagt

SEQ ID NO: 31590 - DNA, 25 bp, Mus musculus
aaccaagactgtcgtgcctgctggg

SEQ ID NO: 31591 - DNA, 25 bp, Mus musculus
aaccaagactgtggtgcctgctggg

SEQ ID NO: 31592 - DNA, 25 bp, Mus musculus
aaccaagactgtttctttagtcagt

SEQ ID NO: 31593 - DNA, 25 bp, Mus musculus
aaccaagagggcaacaacttcttct

SEQ ID NO: 31594 - DNA, 25 bp, Mus musculus
aaccaagagggctacaacttcttct

SEQ ID NO: 31595 - DNA, 25 bp, Mus musculus
aaccaagaggtccagaggccagcca

SEQ ID NO: 31596 - DNA, 25 bp, Mus musculus
aaccaagaggtcgagaggccagcca

SEQ ID NO: 31597 - DNA, 25 bp, Mus musculus
aaccaagagtcccaagccagctgtc

SEQ ID NO: 31598 - DNA, 25 bp, Mus musculus
aaccaagagtccgaagccagctgtc

SEQ ID NO: 31599 - DNA, 25 bp, Mus musculus
aaccaagagtttcctcagctactgg

SEQ ID NO: 31600 - DNA, 25 bp, Mus musculus
aaccaagagtttgctcagctactgg

SEQ ID NO: 31601 - DNA, 25 bp, Mus musculus
aaccaagatacaattcaacagacta

SEQ ID NO: 31602 - DNA, 25 bp, Mus musculus
aaccaagatacatttcaacagacta

SEQ ID NO: 31603 - DNA, 25 bp, Mus musculus
aaccaagatggcatcatggcagaaa

SEQ ID NO: 31604 - DNA, 25 bp, Mus musculus
aaccaagatggcttcatggcagaaa

SEQ ID NO: 31605 - DNA, 25 bp, Mus musculus
aaccaagatttgatagtttactgtg

SEQ ID NO: 31606 - DNA, 25 bp, Mus musculus
aaccaagatttgttagtttactgtg

SEQ ID NO: 31607 - DNA, 25 bp, Mus musculus
aaccaagattttcctgctttcaaag

SEQ ID NO: 31608 - DNA, 25 bp, Mus musculus
aaccaagattttgctgctttcaaag

SEQ ID NO: 31609 - DNA, 25 bp, Mus musculus
aaccaagcactcagaaaatggaggc

SEQ ID NO: 31610 - DNA, 25 bp, Mus musculus
aaccaagcactctgaaaatggaggc

SEQ ID NO: 31611 - DNA, 25 bp, Mus musculus
aaccaagcaggtcatctccaagatc

SEQ ID NO: 31612 - DNA, 25 bp, Mus musculus
aaccaagcaggtgatctccaagatc

SEQ ID NO: 31613 - DNA, 25 bp, Mus musculus
aaccaagcatgccacgggtctgtgc

SEQ ID NO: 31614 - DNA, 25 bp, Mus musculus
aaccaagcatgcgacgggtctgtgc

SEQ ID NO: 31615 - DNA, 25 bp, Mus musculus
aaccaagccaaaaccacctatgtgt

SEQ ID NO: 31616 - DNA, 25 bp, Mus musculus
aaccaagccaaatccacctatgtgt

SEQ ID NO: 31617 - DNA, 25 bp, Mus musculus
aaccaagcctgacagaacccagtga

SEQ ID NO: 31618 - DNA, 25 bp, Mus musculus
aaccaagcctgagagaacccagtga

SEQ ID NO: 31619 - DNA, 25 bp, Mus musculus
aaccaagcctggatgcagataaacc

SEQ ID NO: 31620 - DNA, 25 bp, Mus musculus
aaccaagcctggttgcagataaacc

SEQ ID NO: 31621 - DNA, 25 bp, Mus musculus
aaccaagcgagcacgggcaatgcct

SEQ ID NO: 31622 - DNA, 25 bp, Mus musculus
aaccaagcgagctcgggcaatgcct

SEQ ID NO: 31623 - DNA, 25 bp, Mus musculus
aaccaagcggttcctgatgttacac

SEQ ID NO: 31624 - DNA, 25 bp, Mus musculus
aaccaagcggttgctgatgttacac

SEQ ID NO: 31625 - DNA, 25 bp, Mus musculus
aaccaagctgaaaggtctgttttgt

SEQ ID NO: 31626 - DNA, 25 bp, Mus musculus
aaccaagctgaatggtctgttttgt

SEQ ID NO: 31627 - DNA, 25 bp, Mus musculus
aaccaagcttgcatgatggcacctt

SEQ ID NO: 31628 - DNA, 25 bp, Mus musculus
aaccaagcttgcttgatggcacctt

SEQ ID NO: 31629 - DNA, 25 bp, Mus musculus
aaccaagctttgcagtaactccatc

SEQ ID NO: 31630 - DNA, 25 bp, Mus musculus
aaccaagctttggagtaactccatc

SEQ ID NO: 31631 - DNA, 25 bp, Mus musculus
aaccaaggacacagtctgtcattca

SEQ ID NO: 31632 - DNA, 25 bp, Mus musculus
aaccaaggacactgtctgtcattca

SEQ ID NO: 31633 - DNA, 25 bp, Mus musculus
aaccaaggaccaatcagtccctagg

SEQ ID NO: 31634 - DNA, 25 bp, Mus musculus
aaccaaggaccattcagtccctagg

SEQ ID NO: 31635 - DNA, 25 bp, Mus musculus
aaccaaggagcccaagtgtcactga

SEQ ID NO: 31636 - DNA, 25 bp, Mus musculus
aaccaaggagccgaagtgtcactga

SEQ ID NO: 31637 - DNA, 25 bp, Mus musculus
aaccaaggcctacattgcaggactt

SEQ ID NO: 31638 - DNA, 25 bp, Mus musculus
aaccaaggcctagattgcaggactt

SEQ ID NO: 31639 - DNA, 25 bp, Mus musculus
aaccaaggccttctacatggtaaat

SEQ ID NO: 31640 - DNA, 25 bp, Mus musculus
aaccaaggccttgtacatggtaaat

SEQ ID NO: 31641 - DNA, 25 bp, Mus musculus
aaccaagggcacatgttgcctctgt

SEQ ID NO: 31642 - DNA, 25 bp, Mus musculus
aaccaagggcacttgttgcctctgt

SEQ ID NO: 31643 - DNA, 25 bp, Mus musculus
aaccaagggcatcactgtggccacc

SEQ ID NO: 31644 - DNA, 25 bp, Mus musculus
aaccaagggcatgactgtggccacc

SEQ ID NO: 31645 - DNA, 25 bp, Mus musculus
aaccaagggtgtcagtccaatgaca

SEQ ID NO: 31646 - DNA, 25 bp, Mus musculus
aaccaagggtgtgagtccaatgaca

SEQ ID NO: 31647 - DNA, 25 bp, Mus musculus
aaccaaggtcaacgtgtccatcact

SEQ ID NO: 31648 - DNA, 25 bp, Mus musculus
aaccaaggtcaaggtgtccatcact

SEQ ID NO: 31649 - DNA, 25 bp, Mus musculus
aaccaaggtgagatgctctgtttta

SEQ ID NO: 31650 - DNA, 25 bp, Mus musculus
aaccaaggtgagttgctctgtttta

SEQ ID NO: 31651 - DNA, 25 bp, Mus musculus
aaccaagtatggcttaatgttgcag

SEQ ID NO: 31652 - DNA, 25 bp, Mus musculus
aaccaagtatgggttaatgttgcag

SEQ ID NO: 31653 - DNA, 25 bp, Mus musculus
aaccaagtcactccagcaaagcgtt

SEQ ID NO: 31654 - DNA, 25 bp, Mus musculus
aaccaagtcactgcagcaaagcgtt

SEQ ID NO: 31655 - DNA, 25 bp, Mus musculus
aaccaagtcccacgcggtcaaggat

SEQ ID NO: 31656 - DNA, 25 bp, Mus musculus
aaccaagtcccaggcggtcaaggat

SEQ ID NO: 31657 - DNA, 25 bp, Mus musculus
aaccaagtctccactagtcttagat

SEQ ID NO: 31658 - DNA, 25 bp, Mus musculus
aaccaagtctcctctagtcttagat

SEQ ID NO: 31659 - DNA, 25 bp, Mus musculus
aaccaagtgagtcaacaagagggat

SEQ ID NO: 31660 - DNA, 25 bp, Mus musculus
aaccaagtgagtgaacaagagggat

SEQ ID NO: 31661 - DNA, 25 bp, Mus musculus
aaccaagtgcctacataccatgtgg

SEQ ID NO: 31662 - DNA, 25 bp, Mus musculus
aaccaagtgcctcatctctggctct

SEQ ID NO: 31663 - DNA, 25 bp, Mus musculus
aaccaagtgcctgatctctggctct

SEQ ID NO: 31664 - DNA, 25 bp, Mus musculus
aaccaagtgccttcataccatgtgg

SEQ ID NO: 31665 - DNA, 25 bp, Mus musculus
aaccaagtggacatctgtgccctgg

SEQ ID NO: 31666 - DNA, 25 bp, Mus musculus
aaccaagtggacttctgtgccctgg

SEQ ID NO: 31667 - DNA, 25 bp, Mus musculus
aaccaagtggctatcctgatagaat

SEQ ID NO: 31668 - DNA, 25 bp, Mus musculus
aaccaagtggctcgattcacgttcc

SEQ ID NO: 31669 - DNA, 25 bp, Mus musculus
aaccaagtggctggattcacgttcc

SEQ ID NO: 31670 - DNA, 25 bp, Mus musculus
aaccaagtggctttcctgatagaat

SEQ ID NO: 31671 - DNA, 25 bp, Mus musculus
aaccaagtgggcagtctgacaatag

SEQ ID NO: 31672 - DNA, 25 bp, Mus musculus
aaccaagtgggctgtctgacaatag

SEQ ID NO: 31673 - DNA, 25 bp, Mus musculus
aaccaagtgtccaagcactgggaga

SEQ ID NO: 31674 - DNA, 25 bp, Mus musculus
aaccaagtgtcctagcactgggaga

SEQ ID NO: 31675 - DNA, 25 bp, Mus musculus
aaccaagttaagctaaccagctttg

SEQ ID NO: 31676 - DNA, 25 bp, Mus musculus
aaccaagttaaggtaaccagctttg

SEQ ID NO: 31677 - DNA, 25 bp, Mus musculus
aaccaagttgcaaatcctttctcct

SEQ ID NO: 31678 - DNA, 25 bp, Mus musculus
aaccaagttgcatatcctttctcct

SEQ ID NO: 31679 - DNA, 25 bp, Mus musculus
aaccaagttttcatgtcaagtctca

SEQ ID NO: 31680 - DNA, 25 bp, Mus musculus
aaccaagttttcttgtcaagtctca

SEQ ID NO: 31681 - DNA, 25 bp, Mus musculus
aaccaatacctcatgaatccagtgt

SEQ ID NO: 31682 - DNA, 25 bp, Mus musculus
aaccaatacctcttgaatccagtgt

SEQ ID NO: 31683 - DNA, 25 bp, Mus musculus
aaccaatactggctgttgtgggcaa

SEQ ID NO: 31684 - DNA, 25 bp, Mus musculus
aaccaatactgggtgttgtgggcaa

SEQ ID NO: 31685 - DNA, 25 bp, Mus musculus
aaccaatcacctatgtctacatgtc

SEQ ID NO: 31686 - DNA, 25 bp, Mus musculus
aaccaatcacctttgtctacatgtc

SEQ ID NO: 31687 - DNA, 25 bp, Mus musculus
aaccaatccttgcagagactccagt

SEQ ID NO: 31688 - DNA, 25 bp, Mus musculus
aaccaatccttggagagactccagt

SEQ ID NO: 31689 - DNA, 25 bp, Mus musculus
aaccaatctggtcgaagcattttct

SEQ ID NO: 31690 - DNA, 25 bp, Mus musculus
aaccaatctggtggaagcattttct

SEQ ID NO: 31691 - DNA, 25 bp, Mus musculus
aaccaatcttctctctttatagccc

SEQ ID NO: 31692 - DNA, 25 bp, Mus musculus
aaccaatcttctgtctttatagccc

SEQ ID NO: 31693 - DNA, 25 bp, Mus musculus
aaccaatcttttcctttgcagtatt

SEQ ID NO: 31694 - DNA, 25 bp, Mus musculus
aaccaatcttttgctttgcagtatt

SEQ ID NO: 31695 - DNA, 25 bp, Mus musculus
aaccaatgatgccagttcctggcca

SEQ ID NO: 31696 - DNA, 25 bp, Mus musculus
aaccaatgatgcgagttcctggcca

SEQ ID NO: 31697 - DNA, 25 bp, Mus musculus
aaccaatgtggactctgtgtttgtg

SEQ ID NO: 31698 - DNA, 25 bp, Mus musculus
aaccaatgtggagtctgtgtttgtg

SEQ ID NO: 31699 - DNA, 25 bp, Mus musculus
aaccaatgtgggacaagcctttgca

SEQ ID NO: 31700 - DNA, 25 bp, Mus musculus
aaccaatgtgggtcaagcctttgca

SEQ ID NO: 31701 - DNA, 25 bp, Mus musculus
aaccaatgtgttagccaataggctg

SEQ ID NO: 31702 - DNA, 25 bp, Mus musculus
aaccaatgtgtttgccaataggctg

SEQ ID NO: 31703 - DNA, 25 bp, Mus musculus
aaccaatgttccctggaaactccag

SEQ ID NO: 31704 - DNA, 25 bp, Mus musculus
aaccaatgttccgtggaaactccag

SEQ ID NO: 31705 - DNA, 25 bp, Mus musculus
aaccaattatttacatggctgcatg

SEQ ID NO: 31706 - DNA, 25 bp, Mus musculus
aaccaattattttcatggctgcatg

SEQ ID NO: 31707 - DNA, 25 bp, Mus musculus
aaccaattcaggctggtctgtcctt

SEQ ID NO: 31708 - DNA, 25 bp, Mus musculus
aaccaattcagggtggtctgtcctt

SEQ ID NO: 31709 - DNA, 25 bp, Mus musculus
aaccaattctggaagcatctaagct

SEQ ID NO: 31710 - DNA, 25 bp, Mus musculus
aaccaattctggagacaatcctgtg

SEQ ID NO: 31711 - DNA, 25 bp, Mus musculus
aaccaattctggtagcatctaagct

SEQ ID NO: 31712 - DNA, 25 bp, Mus musculus
aaccaattctggtgacaatcctgtg

SEQ ID NO: 31713 - DNA, 25 bp, Mus musculus
aaccaattgctgaccttcaggccag

SEQ ID NO: 31714 - DNA, 25 bp, Mus musculus
aaccaattgctgtccttcaggccag

SEQ ID NO: 31715 - DNA, 25 bp, Mus musculus
aaccaattggatccatacatgtcga

SEQ ID NO: 31716 - DNA, 25 bp, Mus musculus
aaccaattggatgcatacatgtcga

SEQ ID NO: 31717 - DNA, 25 bp, Mus musculus
aaccaatttctacagatctagggat

SEQ ID NO: 31718 - DNA, 25 bp, Mus musculus
aaccaatttctagagatctagggat

SEQ ID NO: 31719 - DNA, 25 bp, Mus musculus
aaccaatttggcatcacttcctgaa

SEQ ID NO: 31720 - DNA, 25 bp, Mus musculus
aaccaatttggcttcacttcctgaa

SEQ ID NO: 31721 - DNA, 25 bp, Mus musculus
aaccaattttggctcgagtgcattt

SEQ ID NO: 31722 - DNA, 25 bp, Mus musculus
aaccaattttgggtcgagtgcattt

SEQ ID NO: 31723 - DNA, 25 bp, Mus musculus
aaccacaaactactatcatgcttat

SEQ ID NO: 31724 - DNA, 25 bp, Mus musculus
aaccacaaactagtatcatgcttat

SEQ ID NO: 31725 - DNA, 25 bp, Mus musculus
aaccacaaagtgaatctttatcctg

SEQ ID NO: 31726 - DNA, 25 bp, Mus musculus
aaccacaaagtgtatctttatcctg

SEQ ID NO: 31727 - DNA, 25 bp, Mus musculus
aaccacaacccaccaaagactgatt

SEQ ID NO: 31728 - DNA, 25 bp, Mus musculus
aaccacaacccagcaaagactgatt

SEQ ID NO: 31729 - DNA, 25 bp, Mus musculus
aaccacaacgtgcaagacacctggg

SEQ ID NO: 31730 - DNA, 25 bp, Mus musculus
aaccacaacgtggaagacacctggg

SEQ ID NO: 31731 - DNA, 25 bp, Mus musculus
aaccacaagacacgatgtacattct

SEQ ID NO: 31732 - DNA, 25 bp, Mus musculus
aaccacaagacaggatgtacattct

SEQ ID NO: 31733 - DNA, 25 bp, Mus musculus
aaccacaagccgcagcaacatggat

SEQ ID NO: 31734 - DNA, 25 bp, Mus musculus
aaccacaagccggagcaacatggat

SEQ ID NO: 31735 - DNA, 25 bp, Mus musculus
aaccacaaggagcaggcctgtcagt

SEQ ID NO: 31736 - DNA, 25 bp, Mus musculus
aaccacaaggaggaggcctgtcagt

SEQ ID NO: 31737 - DNA, 25 bp, Mus musculus
aaccacaagtggagtgtgttttcat

SEQ ID NO: 31738 - DNA, 25 bp, Mus musculus
aaccacaagtggtgtgtgttttcat

SEQ ID NO: 31739 - DNA, 25 bp, Mus musculus
aaccacaatagcacgaaccattgaa

SEQ ID NO: 31740 - DNA, 25 bp, Mus musculus
aaccacaatagctcgaaccattgaa

SEQ ID NO: 31741 - DNA, 25 bp, Mus musculus
aaccacaatgggacaccagttacag

SEQ ID NO: 31742 - DNA, 25 bp, Mus musculus
aaccacaatgggtcaccagttacag

SEQ ID NO: 31743 - DNA, 25 bp, Mus musculus
aaccacacacacaatgagtatgtac

SEQ ID NO: 31744 - DNA, 25 bp, Mus musculus
aaccacacacactatgagtatgtac

SEQ ID NO: 31745 - DNA, 25 bp, Mus musculus
aaccacaccaacaacaatgaaccaa

SEQ ID NO: 31746 - DNA, 25 bp, Mus musculus
aaccacaccaactacaatgaaccaa

SEQ ID NO: 31747 - DNA, 25 bp, Mus musculus
aaccacaccattctggctggagttc

SEQ ID NO: 31748 - DNA, 25 bp, Mus musculus
aaccacaccattgtggctggagttc

SEQ ID NO: 31749 - DNA, 25 bp, Mus musculus
aaccacacccggcatccatgagatg

SEQ ID NO: 31750 - DNA, 25 bp, Mus musculus
aaccacacccgggatccatgagatg

SEQ ID NO: 31751 - DNA, 25 bp, Mus musculus
aaccacacggacacggccgagggcg

SEQ ID NO: 31752 - DNA, 25 bp, Mus musculus
aaccacacggactcggccgagggcg

SEQ ID NO: 31753 - DNA, 25 bp, Mus musculus
aaccacacgtggagaagtctgcaga

SEQ ID NO: 31754 - DNA, 25 bp, Mus musculus
aaccacacgtggtgaagtctgcaga

SEQ ID NO: 31755 - DNA, 25 bp, Mus musculus
aaccacactcatagacaccgtaatt

SEQ ID NO: 31756 - DNA, 25 bp, Mus musculus
aaccacactcattgacaccgtaatt

SEQ ID NO: 31757 - DNA, 25 bp, Mus musculus
aaccacactttcattagccaattct

SEQ ID NO: 31758 - DNA, 25 bp, Mus musculus
aaccacactttctttagccaattct

SEQ ID NO: 31759 - DNA, 25 bp, Mus musculus
aaccacagaacaaccttgttgggag

SEQ ID NO: 31760 - DNA, 25 bp, Mus musculus
aaccacagaacacccatcatgattg

SEQ ID NO: 31761 - DNA, 25 bp, Mus musculus
aaccacagaacagccatcatgattg

SEQ ID NO: 31762 - DNA, 25 bp, Mus musculus
aaccacagaacatccttgttgggag

SEQ ID NO: 31763 - DNA, 25 bp, Mus musculus
aaccacagaatgattcaacaggcca

SEQ ID NO: 31764 - DNA, 25 bp, Mus musculus
aaccacagaatgtttcaacaggcca

SEQ ID NO: 31765 - DNA, 25 bp, Mus musculus
aaccacagacttcatagacctaagg

SEQ ID NO: 31766 - DNA, 25 bp, Mus musculus
aaccacagacttgatagacctaagg

SEQ ID NO: 31767 - DNA, 25 bp, Mus musculus
aaccacagagggacagctgagcaaa

SEQ ID NO: 31768 - DNA, 25 bp, Mus musculus
aaccacagagggtcagctgagcaaa

SEQ ID NO: 31769 - DNA, 25 bp, Mus musculus
aaccacagagtcaagaggcccagga

SEQ ID NO: 31770 - DNA, 25 bp, Mus musculus
aaccacagagtctagaggcccagga

SEQ ID NO: 31771 - DNA, 25 bp, Mus musculus
aaccacagatggaattgaattgtat

SEQ ID NO: 31772 - DNA, 25 bp, Mus musculus
aaccacagatggtattgaattgtat

SEQ ID NO: 31773 - DNA, 25 bp, Mus musculus
aaccacagcagtaagtttggaaaga

SEQ ID NO: 31774 - DNA, 25 bp, Mus musculus
aaccacagcagttagtttggaaaga

SEQ ID NO: 31775 - DNA, 25 bp, Mus musculus
aaccacagcattcatgagaaggcat

SEQ ID NO: 31776 - DNA, 25 bp, Mus musculus
aaccacagcattgatgagaaggcat

SEQ ID NO: 31777 - DNA, 25 bp, Mus musculus
aaccacagcgagagactcatatcca

SEQ ID NO: 31778 - DNA, 25 bp, Mus musculus
aaccacagcgagtgactcatatcca

SEQ ID NO: 31779 - DNA, 25 bp, Mus musculus
aaccacagctttattggcaatgagc

SEQ ID NO: 31780 - DNA, 25 bp, Mus musculus
aaccacagcttttttggcaatgagc

SEQ ID NO: 31781 - DNA, 25 bp, Mus musculus
aaccacaggactctcacactttgtt

SEQ ID NO: 31782 - DNA, 25 bp, Mus musculus
aaccacaggactgtcacactttgtt

SEQ ID NO: 31783 - DNA, 25 bp, Mus musculus
aaccacagggtacacacttcaatca

SEQ ID NO: 31784 - DNA, 25 bp, Mus musculus
aaccacagggtagacacttcaatca

SEQ ID NO: 31785 - DNA, 25 bp, Mus musculus
aaccacaggttgagcggcatccaat

SEQ ID NO: 31786 - DNA, 25 bp, Mus musculus
aaccacaggttgtgcggcatccaat

SEQ ID NO: 31787 - DNA, 25 bp, Mus musculus
aaccacagtacaatagagacacaat

SEQ ID NO: 31788 - DNA, 25 bp, Mus musculus
aaccacagtacattagagacacaat

SEQ ID NO: 31789 - DNA, 25 bp, Mus musculus
aaccacagtccacatgagttcaagg

SEQ ID NO: 31790 - DNA, 25 bp, Mus musculus
aaccacagtccagatgagttcaagg

SEQ ID NO: 31791 - DNA, 25 bp, Mus musculus
aaccacagtctgatgtctcttgatg

SEQ ID NO: 31792 - DNA, 25 bp, Mus musculus
aaccacagtctgttgtctcttgatg

SEQ ID NO: 31793 - DNA, 25 bp, Mus musculus
aaccacagttcactgctcacaaata

SEQ ID NO: 31794 - DNA, 25 bp, Mus musculus
aaccacagttcagtgctcacaaata

SEQ ID NO: 31795 - DNA, 25 bp, Mus musculus
aaccacataagccatcaacctgtat

SEQ ID NO: 31796 - DNA, 25 bp, Mus musculus
aaccacataagcgatcaacctgtat

SEQ ID NO: 31797 - DNA, 25 bp, Mus musculus
aaccacataggactcaatcttttat

SEQ ID NO: 31798 - DNA, 25 bp, Mus musculus
aaccacataggagtcaatcttttat

SEQ ID NO: 31799 - DNA, 25 bp, Mus musculus
aaccacatccagagcaattgtcagt

SEQ ID NO: 31800 - DNA, 25 bp, Mus musculus
aaccacatccagtgcaattgtcagt

SEQ ID NO: 31801 - DNA, 25 bp, Mus musculus
aaccacatccccagaatgaactgct

SEQ ID NO: 31802 - DNA, 25 bp, Mus musculus
aaccacatcccctgaatgaactgct

SEQ ID NO: 31803 - DNA, 25 bp, Mus musculus
aaccacatcggtaggattccttcag

SEQ ID NO: 31804 - DNA, 25 bp, Mus musculus
aaccacatcggttggattccttcag

SEQ ID NO: 31805 - DNA, 25 bp, Mus musculus
aaccacatggatactatcaggcctg

SEQ ID NO: 31806 - DNA, 25 bp, Mus musculus
aaccacatggattctatcaggcctg

SEQ ID NO: 31807 - DNA, 25 bp, Mus musculus
aaccacatggccagtagctttgcag

SEQ ID NO: 31808 - DNA, 25 bp, Mus musculus
aaccacatggcctgtagctttgcag

SEQ ID NO: 31809 - DNA, 25 bp, Mus musculus
aaccacatggtgcctcacaaccatc

SEQ ID NO: 31810 - DNA, 25 bp, Mus musculus
aaccacatggtggctcacaaccatc

SEQ ID NO: 31811 - DNA, 25 bp, Mus musculus
aaccacatgtaaatcttgttccagg

SEQ ID NO: 31812 - DNA, 25 bp, Mus musculus
aaccacatgtaattcttgttccagg

SEQ ID NO: 31813 - DNA, 25 bp, Mus musculus
aaccacatgtacaagctccgcacaa

SEQ ID NO: 31814 - DNA, 25 bp, Mus musculus
aaccacatgtactagctccgcacaa

SEQ ID NO: 31815 - DNA, 25 bp, Mus musculus
aaccacatgtcactagtcctagcac

SEQ ID NO: 31816 - DNA, 25 bp, Mus musculus
aaccacatgtcagtagtcctagcac

SEQ ID NO: 31817 - DNA, 25 bp, Mus musculus
aaccacatgttaatgcccttctagg

SEQ ID NO: 31818 - DNA, 25 bp, Mus musculus
aaccacatgttattgcccttctagg

SEQ ID NO: 31819 - DNA, 25 bp, Mus musculus
aaccacatgttcagtatccagatca

SEQ ID NO: 31820 - DNA, 25 bp, Mus musculus
aaccacatgttctgtatccagatca

SEQ ID NO: 31821 - DNA, 25 bp, Mus musculus
aaccacattagcacacctgcaaatg

SEQ ID NO: 31822 - DNA, 25 bp, Mus musculus
aaccacattagctcacctgcaaatg

SEQ ID NO: 31823 - DNA, 25 bp, Mus musculus
aaccacattctacttctaattgctg

SEQ ID NO: 31824 - DNA, 25 bp, Mus musculus
aaccacattctagttctaattgctg

SEQ ID NO: 31825 - DNA, 25 bp, Mus musculus
aaccacattcttaatccctttatgc

SEQ ID NO: 31826 - DNA, 25 bp, Mus musculus
aaccacattctttatccctttatgc

SEQ ID NO: 31827 - DNA, 25 bp, Mus musculus
aaccacattggccaggtcactgcag

SEQ ID NO: 31828 - DNA, 25 bp, Mus musculus
aaccacattggcgaggtcactgcag

SEQ ID NO: 31829 - DNA, 25 bp, Mus musculus
aaccacatttagactcccttggcat

SEQ ID NO: 31830 - DNA, 25 bp, Mus musculus
aaccacatttagtctcccttggcat

SEQ ID NO: 31831 - DNA, 25 bp, Mus musculus
aaccaccaaatcataaggatatttt

SEQ ID NO: 31832 - DNA, 25 bp, Mus musculus
aaccaccaaatcttaaggatatttt

SEQ ID NO: 31833 - DNA, 25 bp, Mus musculus
aaccaccaagagcagaccctgggat

SEQ ID NO: 31834 - DNA, 25 bp, Mus musculus
aaccaccaagaggagaccctgggat

SEQ ID NO: 31835 - DNA, 25 bp, Mus musculus
aaccaccacaaccatatggagggca

SEQ ID NO: 31836 - DNA, 25 bp, Mus musculus
aaccaccacaacgatatggagggca

SEQ ID NO: 31837 - DNA, 25 bp, Mus musculus
aaccaccacacaaaggaggcctgga

SEQ ID NO: 31838 - DNA, 25 bp, Mus musculus
aaccaccacacataggaggcctgga

SEQ ID NO: 31839 - DNA, 25 bp, Mus musculus
aaccaccacagtaatttgttagcat

SEQ ID NO: 31840 - DNA, 25 bp, Mus musculus
aaccaccacagtcatttcctgtagt

SEQ ID NO: 31841 - DNA, 25 bp, Mus musculus
aaccaccacagtgatttcctgtagt

SEQ ID NO: 31842 - DNA, 25 bp, Mus musculus
aaccaccacagttatttgttagcat

SEQ ID NO: 31843 - DNA, 25 bp, Mus musculus
aaccaccaccaactgagttcttaga

SEQ ID NO: 31844 - DNA, 25 bp, Mus musculus
aaccaccaccaagtgagttcttaga

SEQ ID NO: 31845 - DNA, 25 bp, Mus musculus
aaccaccaccacatgaactttgcag

SEQ ID NO: 31846 - DNA, 25 bp, Mus musculus
aaccaccaccacttgaactttgcag

SEQ ID NO: 31847 - DNA, 25 bp, Mus musculus
aaccaccatactaggctacatagtg

SEQ ID NO: 31848 - DNA, 25 bp, Mus musculus
aaccaccatacttggctacatagtg

SEQ ID NO: 31849 - DNA, 25 bp, Mus musculus
aaccaccatagtatcagaactcaag

SEQ ID NO: 31850 - DNA, 25 bp, Mus musculus
aaccaccatagtttcagaactcaag

SEQ ID NO: 31851 - DNA, 25 bp, Mus musculus
aaccaccatgccaggaattctcaat

SEQ ID NO: 31852 - DNA, 25 bp, Mus musculus
aaccaccatgcctggaattctcaat

SEQ ID NO: 31853 - DNA, 25 bp, Mus musculus
aaccaccatggaaccagcctgggaa

SEQ ID NO: 31854 - DNA, 25 bp, Mus musculus
aaccaccatggatccagcctgggaa

SEQ ID NO: 31855 - DNA, 25 bp, Mus musculus
aaccaccatggcaagcttgagcttc

SEQ ID NO: 31856 - DNA, 25 bp, Mus musculus
aaccaccatggctagcttgagcttc

SEQ ID NO: 31857 - DNA, 25 bp, Mus musculus
aaccaccattcaagcccaaagtgtg

SEQ ID NO: 31858 - DNA, 25 bp, Mus musculus
aaccaccattcatgcccaaagtgtg

SEQ ID NO: 31859 - DNA, 25 bp, Mus musculus
aaccaccattgacggcgtttaagat

SEQ ID NO: 31860 - DNA, 25 bp, Mus musculus
aaccaccattgagggcgtttaagat

SEQ ID NO: 31861 - DNA, 25 bp, Mus musculus
aaccacccagccccgccagctaatg

SEQ ID NO: 31862 - DNA, 25 bp, Mus musculus
aaccacccagccgcgccagctaatg

SEQ ID NO: 31863 - DNA, 25 bp, Mus musculus
aaccaccctggtctgcaatttgaga

SEQ ID NO: 31864 - DNA, 25 bp, Mus musculus
aaccaccctggtgtgcaatttgaga

SEQ ID NO: 31865 - DNA, 25 bp, Mus musculus
aaccaccgagatccgtttaattcga

SEQ ID NO: 31866 - DNA, 25 bp, Mus musculus
aaccaccgagatgcgtttaattcga

SEQ ID NO: 31867 - DNA, 25 bp, Mus musculus
aaccaccggagcaagatcagtttct

SEQ ID NO: 31868 - DNA, 25 bp, Mus musculus
aaccaccggagctagatcagtttct

SEQ ID NO: 31869 - DNA, 25 bp, Mus musculus
aaccaccggctgactgaagagctgc

SEQ ID NO: 31870 - DNA, 25 bp, Mus musculus
aaccaccggctgtctgaagagctgc

SEQ ID NO: 31871 - DNA, 25 bp, Mus musculus
aaccacctaaggacattggttgata

SEQ ID NO: 31872 - DNA, 25 bp, Mus musculus
aaccacctaaggtcattggttgata

SEQ ID NO: 31873 - DNA, 25 bp, Mus musculus
aaccacctactgactgttatttgct

SEQ ID NO: 31874 - DNA, 25 bp, Mus musculus
aaccacctactgtctgttatttgct

SEQ ID NO: 31875 - DNA, 25 bp, Mus musculus
aaccacctaggccatgttgactctt

SEQ ID NO: 31876 - DNA, 25 bp, Mus musculus
aaccacctaggcgatgttgactctt

SEQ ID NO: 31877 - DNA, 25 bp, Mus musculus
aaccacctataactcaagctctggg

SEQ ID NO: 31878 - DNA, 25 bp, Mus musculus
aaccacctataagtcaagctctggg

SEQ ID NO: 31879 - DNA, 25 bp, Mus musculus
aaccacctcaacagaactattcact

SEQ ID NO: 31880 - DNA, 25 bp, Mus musculus
aaccacctcaactgaactattcact

SEQ ID NO: 31881 - DNA, 25 bp, Mus musculus
aaccacctgactatcttactgtgaa

SEQ ID NO: 31882 - DNA, 25 bp, Mus musculus
aaccacctgactttcttactgtgaa

SEQ ID NO: 31883 - DNA, 25 bp, Mus musculus
aaccacctgagtccatcctatggaa

SEQ ID NO: 31884 - DNA, 25 bp, Mus musculus
aaccacctgagtgcatcctatggaa

SEQ ID NO: 31885 - DNA, 25 bp, Mus musculus
aaccacctgctgcatgagagcgaca

SEQ ID NO: 31886 - DNA, 25 bp, Mus musculus
aaccacctgctggatgagagcgaca

SEQ ID NO: 31887 - DNA, 25 bp, Mus musculus
aaccacctggtgatgttcttttctg

SEQ ID NO: 31888 - DNA, 25 bp, Mus musculus
aaccacctggtgttgttcttttctg

SEQ ID NO: 31889 - DNA, 25 bp, Mus musculus
aaccacctgtctctgtgtcaaattt

SEQ ID NO: 31890 - DNA, 25 bp, Mus musculus
aaccacctgtctgtgtgtcaaattt

SEQ ID NO: 31891 - DNA, 25 bp, Mus musculus
aaccaccttgagatagcactgggtc

SEQ ID NO: 31892 - DNA, 25 bp, Mus musculus
aaccaccttgagttagcactgggtc

SEQ ID NO: 31893 - DNA, 25 bp, Mus musculus
aaccaccttgcactcttttagttgt

SEQ ID NO: 31894 - DNA, 25 bp, Mus musculus
aaccaccttgcagtcttttagttgt

SEQ ID NO: 31895 - DNA, 25 bp, Mus musculus
aaccaccttggacatgacttacgct

SEQ ID NO: 31896 - DNA, 25 bp, Mus musculus
aaccaccttggagatgacttacgct

SEQ ID NO: 31897 - DNA, 25 bp, Mus musculus
aaccacctttgccatggaagccatg

SEQ ID NO: 31898 - DNA, 25 bp, Mus musculus
aaccacctttgcgatggaagccatg

SEQ ID NO: 31899 - DNA, 25 bp, Mus musculus
aaccacgacgtcacttcaggtgaac

SEQ ID NO: 31900 - DNA, 25 bp, Mus musculus
aaccacgacgtctcttcaggtgaac

SEQ ID NO: 31901 - DNA, 25 bp, Mus musculus
aaccacgcacatctgaggacggctt

SEQ ID NO: 31902 - DNA, 25 bp, Mus musculus
aaccacgcacatgtgaggacggctt

SEQ ID NO: 31903 - DNA, 25 bp, Mus musculus
aaccacgcagttctggagttagcca

SEQ ID NO: 31904 - DNA, 25 bp, Mus musculus
aaccacgcagttgtggagttagcca

SEQ ID NO: 31905 - DNA, 25 bp, Mus musculus
aaccacgcctgactgtgacgagtca

SEQ ID NO: 31906 - DNA, 25 bp, Mus musculus
aaccacgcctgagtgtgacgagtca

SEQ ID NO: 31907 - DNA, 25 bp, Mus musculus
aaccacgcgggcatcgtcactgttg

SEQ ID NO: 31908 - DNA, 25 bp, Mus musculus
aaccacgcgggcttcgtcactgttg

SEQ ID NO: 31909 - DNA, 25 bp, Mus musculus
aaccacggacacatggcccgaggtg

SEQ ID NO: 31910 - DNA, 25 bp, Mus musculus
aaccacggacacttggcccgaggtg

SEQ ID NO: 31911 - DNA, 25 bp, Mus musculus
aaccacggatatagacttcttctgt

SEQ ID NO: 31912 - DNA, 25 bp, Mus musculus
aaccacggatattgacttcttctgt

SEQ ID NO: 31913 - DNA, 25 bp, Mus musculus
aaccacggcaggctgaaattctcct

SEQ ID NO: 31914 - DNA, 25 bp, Mus musculus
aaccacggcagggtgaaattctcct

SEQ ID NO: 31915 - DNA, 25 bp, Mus musculus
aaccacgggaagactgctgggtaca

SEQ ID NO: 31916 - DNA, 25 bp, Mus musculus
aaccacgggaagtctgctgggtaca

SEQ ID NO: 31917 - DNA, 25 bp, Mus musculus
aaccacgggagacttgtatatgtag

SEQ ID NO: 31918 - DNA, 25 bp, Mus musculus
aaccacgggagagttgtatatgtag

SEQ ID NO: 31919 - DNA, 25 bp, Mus musculus
aaccacggttaactagtggtctcag

SEQ ID NO: 31920 - DNA, 25 bp, Mus musculus
aaccacggttaagtagtggtctcag

SEQ ID NO: 31921 - DNA, 25 bp, Mus musculus
aaccacgtctccagttactgactgg

SEQ ID NO: 31922 - DNA, 25 bp, Mus musculus
aaccacgtctcctgttactgactgg

SEQ ID NO: 31923 - DNA, 25 bp, Mus musculus
aaccacgtgccacagaatttttcat

SEQ ID NO: 31924 - DNA, 25 bp, Mus musculus
aaccacgtgccagagaatttttcat

SEQ ID NO: 31925 - DNA, 25 bp, Mus musculus
aaccacgtggccaccatgtctgaag

SEQ ID NO: 31926 - DNA, 25 bp, Mus musculus
aaccacgtggccatcatgtggagaa

SEQ ID NO: 31927 - DNA, 25 bp, Mus musculus
aaccacgtggcctccatgtctgaag

SEQ ID NO: 31928 - DNA, 25 bp, Mus musculus
aaccacgtggccttcatgtggagaa

SEQ ID NO: 31929 - DNA, 25 bp, Mus musculus
aaccacgtgtgacgagcaagctgca

SEQ ID NO: 31930 - DNA, 25 bp, Mus musculus
aaccacgtgtgaggagcaagctgca

SEQ ID NO: 31931 - DNA, 25 bp, Mus musculus
aaccacgttggtcctggccgaggca

SEQ ID NO: 31932 - DNA, 25 bp, Mus musculus
aaccacgttggtgctggccgaggca

SEQ ID NO: 31933 - DNA, 25 bp, Mus musculus
aaccactaatttaatcactgccctt

SEQ ID NO: 31934 - DNA, 25 bp, Mus musculus
aaccactaattttatcactgccctt

SEQ ID NO: 31935 - DNA, 25 bp, Mus musculus
aaccactaccccattgtaagctatg

SEQ ID NO: 31936 - DNA, 25 bp, Mus musculus
aaccactacccctttgtaagctatg

SEQ ID NO: 31937 - DNA, 25 bp, Mus musculus
aaccactaccgacatgatcacagag

SEQ ID NO: 31938 - DNA, 25 bp, Mus musculus
aaccactaccgagatgatcacagag

SEQ ID NO: 31939 - DNA, 25 bp, Mus musculus
aaccactactctactgagatgggaa

SEQ ID NO: 31940 - DNA, 25 bp, Mus musculus
aaccactactcttctgagatgggaa

SEQ ID NO: 31941 - DNA, 25 bp, Mus musculus
aaccactatccccagtatgtaatgg

SEQ ID NO: 31942 - DNA, 25 bp, Mus musculus
aaccactatcccgagtatgtaatgg

SEQ ID NO: 31943 - DNA, 25 bp, Mus musculus
aaccactatgccaacctaagacgtt

SEQ ID NO: 31944 - DNA, 25 bp, Mus musculus
aaccactatgcctacctaagacgtt

SEQ ID NO: 31945 - DNA, 25 bp, Mus musculus
aaccactcagtaccaccattataat

SEQ ID NO: 31946 - DNA, 25 bp, Mus musculus
aaccactcagtagcaccattataat

SEQ ID NO: 31947 - DNA, 25 bp, Mus musculus
aaccactcatacctgtcttgagtca

SEQ ID NO: 31948 - DNA, 25 bp, Mus musculus
aaccactcatacgtgtcttgagtca

SEQ ID NO: 31949 - DNA, 25 bp, Mus musculus
aaccactccgtaaaacttgacagta

SEQ ID NO: 31950 - DNA, 25 bp, Mus musculus
aaccactccgtataacttgacagta

SEQ ID NO: 31951 - DNA, 25 bp, Mus musculus
aaccactcctctctgagtacagtac

SEQ ID NO: 31952 - DNA, 25 bp, Mus musculus
aaccactcctctgtgagtacagtac

SEQ ID NO: 31953 - DNA, 25 bp, Mus musculus
aaccactcgctgcagatgactctgg

SEQ ID NO: 31954 - DNA, 25 bp, Mus musculus
aaccactcgctggagatgactctgg

SEQ ID NO: 31955 - DNA, 25 bp, Mus musculus
aaccactcgggtagtgtccactatg

SEQ ID NO: 31956 - DNA, 25 bp, Mus musculus
aaccactcgggttgtgtccactatg

SEQ ID NO: 31957 - DNA, 25 bp, Mus musculus
aaccactctagaattccgtcttaca

SEQ ID NO: 31958 - DNA, 25 bp, Mus musculus
aaccactctagatttccgtcttaca

SEQ ID NO: 31959 - DNA, 25 bp, Mus musculus
aaccactctcctattatcagttcat

SEQ ID NO: 31960 - DNA, 25 bp, Mus musculus
aaccactctccttttatcagttcat

SEQ ID NO: 31961 - DNA, 25 bp, Mus musculus
aaccactctgctaagatagggcctg

SEQ ID NO: 31962 - DNA, 25 bp, Mus musculus
aaccactctgctcatgtctccaaat

SEQ ID NO: 31963 - DNA, 25 bp, Mus musculus
aaccactctgctgatgtctccaaat

SEQ ID NO: 31964 - DNA, 25 bp, Mus musculus
aaccactctgcttagatagggcctg

SEQ ID NO: 31965 - DNA, 25 bp, Mus musculus
aaccactgaggcaaggctgtagcat

SEQ ID NO: 31966 - DNA, 25 bp, Mus musculus
aaccactgaggctaggctgtagcat

SEQ ID NO: 31967 - DNA, 25 bp, Mus musculus
aaccactgaggtagctctgaacagc

SEQ ID NO: 31968 - DNA, 25 bp, Mus musculus
aaccactgaggttgctctgaacagc

SEQ ID NO: 31969 - DNA, 25 bp, Mus musculus
aaccactgatagaagatcccagcaa

SEQ ID NO: 31970 - DNA, 25 bp, Mus musculus
aaccactgatagtagatcccagcaa

SEQ ID NO: 31971 - DNA, 25 bp, Mus musculus
aaccactgcacaccttactgttgac

SEQ ID NO: 31972 - DNA, 25 bp, Mus musculus
aaccactgcacagcttactgttgac

SEQ ID NO: 31973 - DNA, 25 bp, Mus musculus
aaccactgcaggagagtagtccgca

SEQ ID NO: 31974 - DNA, 25 bp, Mus musculus
aaccactgcaggtgagtagtccgca

SEQ ID NO: 31975 - DNA, 25 bp, Mus musculus
aaccactgccatagtttctaatctc

SEQ ID NO: 31976 - DNA, 25 bp, Mus musculus
aaccactgccattgtttctaatctc

SEQ ID NO: 31977 - DNA, 25 bp, Mus musculus
aaccactgcgtgaccgggcattaat

SEQ ID NO: 31978 - DNA, 25 bp, Mus musculus
aaccactgcgtgtccgggcattaat

SEQ ID NO: 31979 - DNA, 25 bp, Mus musculus
aaccactggccaagttttattcctt

SEQ ID NO: 31980 - DNA, 25 bp, Mus musculus
aaccactggccatgttttattcctt

SEQ ID NO: 31981 - DNA, 25 bp, Mus musculus
aaccactggctcagtttttgaccat

SEQ ID NO: 31982 - DNA, 25 bp, Mus musculus
aaccactggctctgtttttgaccat

SEQ ID NO: 31983 - DNA, 25 bp, Mus musculus
aaccactggcttagtaattctgtga

SEQ ID NO: 31984 - DNA, 25 bp, Mus musculus
aaccactggctttgtaattctgtga

SEQ ID NO: 31985 - DNA, 25 bp, Mus musculus
aaccactggtaaaccttagtaactg

SEQ ID NO: 31986 - DNA, 25 bp, Mus musculus
aaccactggtaatccttagtaactg

SEQ ID NO: 31987 - DNA, 25 bp, Mus musculus
aaccactggtgccaaagctgcctgt

SEQ ID NO: 31988 - DNA, 25 bp, Mus musculus
aaccactggtgcgaaagctgcctgt

SEQ ID NO: 31989 - DNA, 25 bp, Mus musculus
aaccactgtagtctcattagtttag

SEQ ID NO: 31990 - DNA, 25 bp, Mus musculus
aaccactgtagtgtcattagtttag

SEQ ID NO: 31991 - DNA, 25 bp, Mus musculus
aaccactgtctaactttgctgctga

SEQ ID NO: 31992 - DNA, 25 bp, Mus musculus
aaccactgtctatctttgctgctga

SEQ ID NO: 31993 - DNA, 25 bp, Mus musculus
aaccactgtttgcttcctacactct

SEQ ID NO: 31994 - DNA, 25 bp, Mus musculus
aaccactgtttggttcctacactct

SEQ ID NO: 31995 - DNA, 25 bp, Mus musculus
aaccactgttttaaggctggtgaga

SEQ ID NO: 31996 - DNA, 25 bp, Mus musculus
aaccactgtttttaggctggtgaga

SEQ ID NO: 31997 - DNA, 25 bp, Mus musculus
aaccacttaacaaccgtactgtttg

SEQ ID NO: 31998 - DNA, 25 bp, Mus musculus
aaccacttaacatccgtactgtttg

SEQ ID NO: 31999 - DNA, 25 bp, Mus musculus
aaccacttacacattttccctaatg

SEQ ID NO: 32000 - DNA, 25 bp, Mus musculus
aaccacttacactttttccctaatg

SEQ ID NO: 32001 - DNA, 25 bp, Mus musculus
aaccacttactgagagctcttggcg

SEQ ID NO: 32002 - DNA, 25 bp, Mus musculus
aaccacttactgtgagctcttggcg

SEQ ID NO: 32003 - DNA, 25 bp, Mus musculus
aaccacttagtcatgttactcgcgc

SEQ ID NO: 32004 - DNA, 25 bp, Mus musculus
aaccacttagtcttgttactcgcgc

SEQ ID NO: 32005 - DNA, 25 bp, Mus musculus
aaccacttctgtacgggtcatggaa

SEQ ID NO: 32006 - DNA, 25 bp, Mus musculus
aaccacttctgttcgggtcatggaa

SEQ ID NO: 32007 - DNA, 25 bp, Mus musculus
aaccacttctttaacagcttcaagg

SEQ ID NO: 32008 - DNA, 25 bp, Mus musculus
aaccacttcttttacagcttcaagg

SEQ ID NO: 32009 - DNA, 25 bp, Mus musculus
aaccacttgactcagtgtccttaat

SEQ ID NO: 32010 - DNA, 25 bp, Mus musculus
aaccacttgactgagtgtccttaat

SEQ ID NO: 32011 - DNA, 25 bp, Mus musculus
aaccacttgcctcggagcctgaaag

SEQ ID NO: 32012 - DNA, 25 bp, Mus musculus
aaccacttgcctgggagcctgaaag

SEQ ID NO: 32013 - DNA, 25 bp, Mus musculus
aaccacttgtctatttgccttcttt

SEQ ID NO: 32014 - DNA, 25 bp, Mus musculus
aaccacttgtctttttgccttcttt

SEQ ID NO: 32015 - DNA, 25 bp, Mus musculus
aaccactttcctcctaagcagaaga

SEQ ID NO: 32016 - DNA, 25 bp, Mus musculus
aaccactttcctgctaagcagaaga

SEQ ID NO: 32017 - DNA, 25 bp, Mus musculus
aaccactttctccagtaatttcact

SEQ ID NO: 32018 - DNA, 25 bp, Mus musculus
aaccactttctcgagtaatttcact

SEQ ID NO: 32019 - DNA, 25 bp, Mus musculus
aaccactttgctcctaagattttgc

SEQ ID NO: 32020 - DNA, 25 bp, Mus musculus
aaccactttgctgctaagattttgc

SEQ ID NO: 32021 - DNA, 25 bp, Mus musculus
aaccacttttgcacatgttcccatt

SEQ ID NO: 32022 - DNA, 25 bp, Mus musculus
aaccacttttgctcatgttcccatt

SEQ ID NO: 32023 - DNA, 25 bp, Mus musculus
aaccagaacgtgactcgggaggcca

SEQ ID NO: 32024 - DNA, 25 bp, Mus musculus
aaccagaacgtgtctcgggaggcca

SEQ ID NO: 32025 - DNA, 25 bp, Mus musculus
aaccagaagaggcagcaagccccac

SEQ ID NO: 32026 - DNA, 25 bp, Mus musculus
aaccagaagagggagcaagccccac

SEQ ID NO: 32027 - DNA, 25 bp, Mus musculus
aaccagaagatgacacaccttgttt

SEQ ID NO: 32028 - DNA, 25 bp, Mus musculus
aaccagaagatgtcacaccttgttt

SEQ ID NO: 32029 - DNA, 25 bp, Mus musculus
aaccagaagcgcatgtcttgaacag

SEQ ID NO: 32030 - DNA, 25 bp, Mus musculus
aaccagaagcgcttgtcttgaacag

SEQ ID NO: 32031 - DNA, 25 bp, Mus musculus
aaccagaagcttagcccgtgtagga

SEQ ID NO: 32032 - DNA, 25 bp, Mus musculus
aaccagaagctttgcccgtgtagga

SEQ ID NO: 32033 - DNA, 25 bp, Mus musculus
aaccagaatgagatgtcacctttga

SEQ ID NO: 32034 - DNA, 25 bp, Mus musculus
aaccagaatgagttgtcacctttga

SEQ ID NO: 32035 - DNA, 25 bp, Mus musculus
aaccagaatggaagccggtgttctt

SEQ ID NO: 32036 - DNA, 25 bp, Mus musculus
aaccagaatggatgccggtgttctt

SEQ ID NO: 32037 - DNA, 25 bp, Mus musculus
aaccagaattttatgttcccagcat

SEQ ID NO: 32038 - DNA, 25 bp, Mus musculus
aaccagaattttttgttcccagcat

SEQ ID NO: 32039 - DNA, 25 bp, Mus musculus
aaccagacaataaccccattttcat

SEQ ID NO: 32040 - DNA, 25 bp, Mus musculus
aaccagacaatatccccattttcat

SEQ ID NO: 32041 - DNA, 25 bp, Mus musculus
aaccagacactacacttagactgtg

SEQ ID NO: 32042 - DNA, 25 bp, Mus musculus
aaccagacactagacttagactgtg

SEQ ID NO: 32043 - DNA, 25 bp, Mus musculus
aaccagacatacacaaagacagcat

SEQ ID NO: 32044 - DNA, 25 bp, Mus musculus
aaccagacatactcaaagacagcat

SEQ ID NO: 32045 - DNA, 25 bp, Mus musculus
aaccagaccatgaaccgggcggaga

SEQ ID NO: 32046 - DNA, 25 bp, Mus musculus
aaccagaccatgtaccgggcggaga

SEQ ID NO: 32047 - DNA, 25 bp, Mus musculus
aaccagacctagattattcaggaga

SEQ ID NO: 32048 - DNA, 25 bp, Mus musculus
aaccagacctagtttattcaggaga

SEQ ID NO: 32049 - DNA, 25 bp, Mus musculus
aaccagacgattcaaagaaaccaat

SEQ ID NO: 32050 - DNA, 25 bp, Mus musculus
aaccagacgattgaaagaaaccaat

SEQ ID NO: 32051 - DNA, 25 bp, Mus musculus
aaccagactgagatacttgccctaa

SEQ ID NO: 32052 - DNA, 25 bp, Mus musculus
aaccagactgagttacttgccctaa

SEQ ID NO: 32053 - DNA, 25 bp, Mus musculus
aaccagacttgtaatgctttcccct

SEQ ID NO: 32054 - DNA, 25 bp, Mus musculus
aaccagacttgttatgctttcccct

SEQ ID NO: 32055 - DNA, 25 bp, Mus musculus
aaccagactttcacctactcagagc

SEQ ID NO: 32056 - DNA, 25 bp, Mus musculus
aaccagactttctcctactcagagc

SEQ ID NO: 32057 - DNA, 25 bp, Mus musculus
aaccagagaactcctacagatgatg

SEQ ID NO: 32058 - DNA, 25 bp, Mus musculus
aaccagagaactgctacagatgatg

SEQ ID NO: 32059 - DNA, 25 bp, Mus musculus
aaccagagaagccaaattagacttg

SEQ ID NO: 32060 - DNA, 25 bp, Mus musculus
aaccagagaagcgaaattagacttg

SEQ ID NO: 32061 - DNA, 25 bp, Mus musculus
aaccagagagagcaattttaccaca

SEQ ID NO: 32062 - DNA, 25 bp, Mus musculus
aaccagagagaggaattttaccaca

SEQ ID NO: 32063 - DNA, 25 bp, Mus musculus
aaccagagaggaaccatactgttct

SEQ ID NO: 32064 - DNA, 25 bp, Mus musculus
aaccagagaggatccatactgttct

SEQ ID NO: 32065 - DNA, 25 bp, Mus musculus
aaccagagatgtacggaagccccaa

SEQ ID NO: 32066 - DNA, 25 bp, Mus musculus
aaccagagatgttcggaagccccaa

SEQ ID NO: 32067 - DNA, 25 bp, Mus musculus
aaccagagcagcacgggctcagaga

SEQ ID NO: 32068 - DNA, 25 bp, Mus musculus
aaccagagcagctcgggctcagaga

SEQ ID NO: 32069 - DNA, 25 bp, Mus musculus
aaccagagcctgctcaacgagctga

SEQ ID NO: 32070 - DNA, 25 bp, Mus musculus
aaccagagcctggtcaacgagctga

SEQ ID NO: 32071 - DNA, 25 bp, Mus musculus
aaccagagctagcagcatgtccgca

SEQ ID NO: 32072 - DNA, 25 bp, Mus musculus
aaccagagctaggagcatgtccgca

SEQ ID NO: 32073 - DNA, 25 bp, Mus musculus
aaccagagctggcacgatcacgact

SEQ ID NO: 32074 - DNA, 25 bp, Mus musculus
aaccagagctgggacgatcacgact

SEQ ID NO: 32075 - DNA, 25 bp, Mus musculus
aaccagagcttactgtgtggaccat

SEQ ID NO: 32076 - DNA, 25 bp, Mus musculus
aaccagagcttagtgtgtggaccat

SEQ ID NO: 32077 - DNA, 25 bp, Mus musculus
aaccagaggaagaacgtacatctta

SEQ ID NO: 32078 - DNA, 25 bp, Mus musculus
aaccagaggaagtacgtacatctta

SEQ ID NO: 32079 - DNA, 25 bp, Mus musculus
aaccagaggaccatctttgcttctt

SEQ ID NO: 32080 - DNA, 25 bp, Mus musculus
aaccagaggaccttctttgcttctt

SEQ ID NO: 32081 - DNA, 25 bp, Mus musculus
aaccagaggccaatcttctttgttg

SEQ ID NO: 32082 - DNA, 25 bp, Mus musculus
aaccagaggccattcttctttgttg

SEQ ID NO: 32083 - DNA, 25 bp, Mus musculus
aaccagaggcgaccccgcatgtgtg

SEQ ID NO: 32084 - DNA, 25 bp, Mus musculus
aaccagaggcgagcccgcatgtgtg

SEQ ID NO: 32085 - DNA, 25 bp, Mus musculus
aaccagaggctacatccagtattac

SEQ ID NO: 32086 - DNA, 25 bp, Mus musculus
aaccagaggctagatccagtattac

SEQ ID NO: 32087 - DNA, 25 bp, Mus musculus
aaccagagggtgactaaccattggt

SEQ ID NO: 32088 - DNA, 25 bp, Mus musculus
aaccagagggtgtctaaccattggt

SEQ ID NO: 32089 - DNA, 25 bp, Mus musculus
aaccagagtcttacggaggtgagga

SEQ ID NO: 32090 - DNA, 25 bp, Mus musculus
aaccagagtctttcggaggtgagga

SEQ ID NO: 32091 - DNA, 25 bp, Mus musculus
aaccagagtgtcaggctctgattat

SEQ ID NO: 32092 - DNA, 25 bp, Mus musculus
aaccagagtgtctggctctgattat

SEQ ID NO: 32093 - DNA, 25 bp, Mus musculus
aaccagataaccctgtggacacttt

SEQ ID NO: 32094 - DNA, 25 bp, Mus musculus
aaccagataaccgtgtggacacttt

SEQ ID NO: 32095 - DNA, 25 bp, Mus musculus
aaccagatacccacttgtctaaagt

SEQ ID NO: 32096 - DNA, 25 bp, Mus musculus
aaccagataccctcttgtctaaagt

SEQ ID NO: 32097 - DNA, 25 bp, Mus musculus
aaccagatatctctgcgggctgcct

SEQ ID NO: 32098 - DNA, 25 bp, Mus musculus
aaccagatatctgtgcgggctgcct

SEQ ID NO: 32099 - DNA, 25 bp, Mus musculus
aaccagatccacatcagggcccaag

SEQ ID NO: 32100 - DNA, 25 bp, Mus musculus
aaccagatccacttcagggcccaag

SEQ ID NO: 32101 - DNA, 25 bp, Mus musculus
aaccagatccttctgttactttgta

SEQ ID NO: 32102 - DNA, 25 bp, Mus musculus
aaccagatccttgtgttactttgta

SEQ ID NO: 32103 - DNA, 25 bp, Mus musculus
aaccagatcttgacctgcgtgggcg

SEQ ID NO: 32104 - DNA, 25 bp, Mus musculus
aaccagatcttgtcctgcgtgggcg

SEQ ID NO: 32105 - DNA, 25 bp, Mus musculus
aaccagatgagaaggcacatgcctg

SEQ ID NO: 32106 - DNA, 25 bp, Mus musculus
aaccagatgagatggcacatgcctg

SEQ ID NO: 32107 - DNA, 25 bp, Mus musculus
aaccagatgatcctttttccctaga

SEQ ID NO: 32108 - DNA, 25 bp, Mus musculus
aaccagatgatcgtttttccctaga

SEQ ID NO: 32109 - DNA, 25 bp, Mus musculus
aaccagatgcctaccaggacgaact

SEQ ID NO: 32110 - DNA, 25 bp, Mus musculus
aaccagatgccttccaggacgaact

SEQ ID NO: 32111 - DNA, 25 bp, Mus musculus
aaccagatgctgaccccatttggat

SEQ ID NO: 32112 - DNA, 25 bp, Mus musculus
aaccagatgctgtccccatttggat

SEQ ID NO: 32113 - DNA, 25 bp, Mus musculus
aaccagatggacacaccttgtgcag

SEQ ID NO: 32114 - DNA, 25 bp, Mus musculus
aaccagatggactcaccttgtgcag

SEQ ID NO: 32115 - DNA, 25 bp, Mus musculus
aaccagatgggcagtgcctcctgtg

SEQ ID NO: 32116 - DNA, 25 bp, Mus musculus
aaccagatgggctgtgcctcctgtg

SEQ ID NO: 32117 - DNA, 25 bp, Mus musculus
aaccagatggttctgtgttccattt

SEQ ID NO: 32118 - DNA, 25 bp, Mus musculus
aaccagatggttgtgtgttccattt

SEQ ID NO: 32119 - DNA, 25 bp, Mus musculus
aaccagatgtagagcgagtgtggct

SEQ ID NO: 32120 - DNA, 25 bp, Mus musculus
aaccagatgtagtgcgagtgtggct

SEQ ID NO: 32121 - DNA, 25 bp, Mus musculus
aaccagatttccatgggccaaatgg

SEQ ID NO: 32122 - DNA, 25 bp, Mus musculus
aaccagatttccttgggccaaatgg

SEQ ID NO: 32123 - DNA, 25 bp, Mus musculus
aaccagattttgagagtcaagggca

SEQ ID NO: 32124 - DNA, 25 bp, Mus musculus
aaccagattttgtgagtcaagggca

SEQ ID NO: 32125 - DNA, 25 bp, Mus musculus
aaccagcaatggaagcccgttgagg

SEQ ID NO: 32126 - DNA, 25 bp, Mus musculus
aaccagcaatggctgggcagtcaat

SEQ ID NO: 32127 - DNA, 25 bp, Mus musculus
aaccagcaatgggtgggcagtcaat

SEQ ID NO: 32128 - DNA, 25 bp, Mus musculus
aaccagcaatggtagcccgttgagg

SEQ ID NO: 32129 - DNA, 25 bp, Mus musculus
aaccagcagcggcagcacttgtgtt

SEQ ID NO: 32130 - DNA, 25 bp, Mus musculus
aaccagcagcgggagcacttgtgtt

SEQ ID NO: 32131 - DNA, 25 bp, Mus musculus
aaccagcaggacagtcccagagttt

SEQ ID NO: 32132 - DNA, 25 bp, Mus musculus
aaccagcaggactgtcccagagttt

SEQ ID NO: 32133 - DNA, 25 bp, Mus musculus
aaccagcaggtgattgccccgtatt

SEQ ID NO: 32134 - DNA, 25 bp, Mus musculus
aaccagcaggtgtttgccccgtatt

SEQ ID NO: 32135 - DNA, 25 bp, Mus musculus
aaccagcagtaccttttttatgcag

SEQ ID NO: 32136 - DNA, 25 bp, Mus musculus
aaccagcagtacgttttttatgcag

SEQ ID NO: 32137 - DNA, 25 bp, Mus musculus
aaccagcatcatacaggagaccctt

SEQ ID NO: 32138 - DNA, 25 bp, Mus musculus
aaccagcatcattcaggagaccctt

SEQ ID NO: 32139 - DNA, 25 bp, Mus musculus
aaccagcatgatactcctagcgtat

SEQ ID NO: 32140 - DNA, 25 bp, Mus musculus
aaccagcatgatcaccagtgcaaag

SEQ ID NO: 32141 - DNA, 25 bp, Mus musculus
aaccagcatgatgaccagtgcaaag

SEQ ID NO: 32142 - DNA, 25 bp, Mus musculus
aaccagcatgattctcctagcgtat

SEQ ID NO: 32143 - DNA, 25 bp, Mus musculus
aaccagcatggccaggagaccttca

SEQ ID NO: 32144 - DNA, 25 bp, Mus musculus
aaccagcatggcgaggagaccttca

SEQ ID NO: 32145 - DNA, 25 bp, Mus musculus
aaccagccaagcatagtgggaggac

SEQ ID NO: 32146 - DNA, 25 bp, Mus musculus
aaccagccaagccttgtttggcgta

SEQ ID NO: 32147 - DNA, 25 bp, Mus musculus
aaccagccaagcgttgtttggcgta

SEQ ID NO: 32148 - DNA, 25 bp, Mus musculus
aaccagccaagcttagtgggaggac

SEQ ID NO: 32149 - DNA, 25 bp, Mus musculus
aaccagccactcattaaactcaggg

SEQ ID NO: 32150 - DNA, 25 bp, Mus musculus
aaccagccactctttaaactcaggg

SEQ ID NO: 32151 - DNA, 25 bp, Mus musculus
aaccagccagatcagtgtctcagtg

SEQ ID NO: 32152 - DNA, 25 bp, Mus musculus
aaccagccagatgagtgtctcagtg

SEQ ID NO: 32153 - DNA, 25 bp, Mus musculus
aaccagccagcacttcaatgagatg

SEQ ID NO: 32154 - DNA, 25 bp, Mus musculus
aaccagccagcagttcaatgagatg

SEQ ID NO: 32155 - DNA, 25 bp, Mus musculus
aaccagccagccctgtacaaaagta

SEQ ID NO: 32156 - DNA, 25 bp, Mus musculus
aaccagccagccgtgtacaaaagta

SEQ ID NO: 32157 - DNA, 25 bp, Mus musculus
aaccagccagtacaagtcctaattt

SEQ ID NO: 32158 - DNA, 25 bp, Mus musculus
aaccagccagtacactgggccatct

SEQ ID NO: 32159 - DNA, 25 bp, Mus musculus
aaccagccagtagaagtcctaattt

SEQ ID NO: 32160 - DNA, 25 bp, Mus musculus
aaccagccagtagactgggccatct

SEQ ID NO: 32161 - DNA, 25 bp, Mus musculus
aaccagccagttcataatcaaagat

SEQ ID NO: 32162 - DNA, 25 bp, Mus musculus
aaccagccagttgataatcaaagat

SEQ ID NO: 32163 - DNA, 25 bp, Mus musculus
aaccagcccatacctctttatgtaa

SEQ ID NO: 32164 - DNA, 25 bp, Mus musculus
aaccagcccatagctctttatgtaa

SEQ ID NO: 32165 - DNA, 25 bp, Mus musculus
aaccagcccctgcaaagagagcgga

SEQ ID NO: 32166 - DNA, 25 bp, Mus musculus
aaccagcccctggaaagagagcgga

SEQ ID NO: 32167 - DNA, 25 bp, Mus musculus
aaccagcccgtgcattcctgaagat

SEQ ID NO: 32168 - DNA, 25 bp, Mus musculus
aaccagcccgtggattcctgaagat

SEQ ID NO: 32169 - DNA, 25 bp, Mus musculus
aaccagccctgtcgagatgctcact

SEQ ID NO: 32170 - DNA, 25 bp, Mus musculus
aaccagccctgtggagatgctcact

SEQ ID NO: 32171 - DNA, 25 bp, Mus musculus
aaccagccgaagaaggacccagaca

SEQ ID NO: 32172 - DNA, 25 bp, Mus musculus
aaccagccgaagtaggacccagaca

SEQ ID NO: 32173 - DNA, 25 bp, Mus musculus
aaccagccgtacattgtctttgaca

SEQ ID NO: 32174 - DNA, 25 bp, Mus musculus
aaccagccgtactttgtctttgaca

SEQ ID NO: 32175 - DNA, 25 bp, Mus musculus
aaccagcctggtagtggaactagca

SEQ ID NO: 32176 - DNA, 25 bp, Mus musculus
aaccagcctggttgtggaactagca

SEQ ID NO: 32177 - DNA, 25 bp, Mus musculus
aaccagcctttgaactcactcattg

SEQ ID NO: 32178 - DNA, 25 bp, Mus musculus
aaccagcctttgtactcactcattg

SEQ ID NO: 32179 - DNA, 25 bp, Mus musculus
aaccagcgcttccaagctgtcagag

SEQ ID NO: 32180 - DNA, 25 bp, Mus musculus
aaccagcgcttcgaagctgtcagag

SEQ ID NO: 32181 - DNA, 25 bp, Mus musculus
aaccagcgtctgatacgagtgccaa

SEQ ID NO: 32182 - DNA, 25 bp, Mus musculus
aaccagcgtctgttacgagtgccaa

SEQ ID NO: 32183 - DNA, 25 bp, Mus musculus
aaccagcgtgttcatgacgcactca

SEQ ID NO: 32184 - DNA, 25 bp, Mus musculus
aaccagcgtgttgatgacgcactca

SEQ ID NO: 32185 - DNA, 25 bp, Mus musculus
aaccagctaacgatgatgaagcgac

SEQ ID NO: 32186 - DNA, 25 bp, Mus musculus
aaccagctaacgttgatgaagcgac

SEQ ID NO: 32187 - DNA, 25 bp, Mus musculus
aaccagctagctctaaaacattgct

SEQ ID NO: 32188 - DNA, 25 bp, Mus musculus
aaccagctagctgtaaaacattgct

SEQ ID NO: 32189 - DNA, 25 bp, Mus musculus
aaccagctcactctgttttacagaa

SEQ ID NO: 32190 - DNA, 25 bp, Mus musculus
aaccagctcactgtgttttacagaa

SEQ ID NO: 32191 - DNA, 25 bp, Mus musculus
aaccagctcatgcagtacgaccagt

SEQ ID NO: 32192 - DNA, 25 bp, Mus musculus
aaccagctcatggagtacgaccagt

SEQ ID NO: 32193 - DNA, 25 bp, Mus musculus
aaccagctccagacaaagacccata

SEQ ID NO: 32194 - DNA, 25 bp, Mus musculus
aaccagctccagtcaaagacccata

SEQ ID NO: 32195 - DNA, 25 bp, Mus musculus
aaccagctcctaaatgttcttcttt

SEQ ID NO: 32196 - DNA, 25 bp, Mus musculus
aaccagctcctatatgttcttcttt

SEQ ID NO: 32197 - DNA, 25 bp, Mus musculus
aaccagctctgtctgccgggcagca

SEQ ID NO: 32198 - DNA, 25 bp, Mus musculus
aaccagctctgtgtgccgggcagca

SEQ ID NO: 32199 - DNA, 25 bp, Mus musculus
aaccagctgaagacatactcacgta

SEQ ID NO: 32200 - DNA, 25 bp, Mus musculus
aaccagctgaagctgactcctgggt

SEQ ID NO: 32201 - DNA, 25 bp, Mus musculus
aaccagctgaaggtgactcctgggt

SEQ ID NO: 32202 - DNA, 25 bp, Mus musculus
aaccagctgaagtcatactcacgta

SEQ ID NO: 32203 - DNA, 25 bp, Mus musculus
aaccagctgcccattttgtgagatt

SEQ ID NO: 32204 - DNA, 25 bp, Mus musculus
aaccagctgccctttttgtgagatt

SEQ ID NO: 32205 - DNA, 25 bp, Mus musculus
aaccagctgctgaatgggtctcatc

SEQ ID NO: 32206 - DNA, 25 bp, Mus musculus
aaccagctgctgtatgggtctcatc

SEQ ID NO: 32207 - DNA, 25 bp, Mus musculus
aaccagctggtacgatttctcccgt

SEQ ID NO: 32208 - DNA, 25 bp, Mus musculus
aaccagctggtaggatttctcccgt

SEQ ID NO: 32209 - DNA, 25 bp, Mus musculus
aaccagctgtggaaatgtcactatt

SEQ ID NO: 32210 - DNA, 25 bp, Mus musculus
aaccagctgtggtaatgtcactatt

SEQ ID NO: 32211 - DNA, 25 bp, Mus musculus
aaccagcttactctagtggtgacag

SEQ ID NO: 32212 - DNA, 25 bp, Mus musculus
aaccagcttactgtagtggtgacag

SEQ ID NO: 32213 - DNA, 25 bp, Mus musculus
aaccagctttgtcatcacaatgaga

SEQ ID NO: 32214 - DNA, 25 bp, Mus musculus
aaccagctttgtgatcacaatgaga

SEQ ID NO: 32215 - DNA, 25 bp, Mus musculus
aaccagcttttgagacttactgcaa

SEQ ID NO: 32216 - DNA, 25 bp, Mus musculus
aaccagcttttgtgacttactgcaa

SEQ ID NO: 32217 - DNA, 25 bp, Mus musculus
aaccaggaaggtcgagacccaggat

SEQ ID NO: 32218 - DNA, 25 bp, Mus musculus
aaccaggaaggtggagacccaggat

SEQ ID NO: 32219 - DNA, 25 bp, Mus musculus
aaccaggacaatcagctgagctttg

SEQ ID NO: 32220 - DNA, 25 bp, Mus musculus
aaccaggacaatgagctgagctttg

SEQ ID NO: 32221 - DNA, 25 bp, Mus musculus
aaccaggacccacagcttgggcagg

SEQ ID NO: 32222 - DNA, 25 bp, Mus musculus
aaccaggacccagagcttgggcagg

SEQ ID NO: 32223 - DNA, 25 bp, Mus musculus
aaccaggactatccctacagaaatg

SEQ ID NO: 32224 - DNA, 25 bp, Mus musculus
aaccaggactatgcctacagaaatg

SEQ ID NO: 32225 - DNA, 25 bp, Mus musculus
aaccaggactggatttcttgtaaga

SEQ ID NO: 32226 - DNA, 25 bp, Mus musculus
aaccaggactggctgtagaggccca

SEQ ID NO: 32227 - DNA, 25 bp, Mus musculus
aaccaggactgggtgtagaggccca

SEQ ID NO: 32228 - DNA, 25 bp, Mus musculus
aaccaggactggttttcttgtaaga

SEQ ID NO: 32229 - DNA, 25 bp, Mus musculus
aaccaggaggttccagatcgagagt

SEQ ID NO: 32230 - DNA, 25 bp, Mus musculus
aaccaggaggttgcagatcgagagt

SEQ ID NO: 32231 - DNA, 25 bp, Mus musculus
aaccaggagttacgcttcagagagc

SEQ ID NO: 32232 - DNA, 25 bp, Mus musculus
aaccaggagttaggcttcagagagc

SEQ ID NO: 32233 - DNA, 25 bp, Mus musculus
aaccaggatagcagcatgatctact

SEQ ID NO: 32234 - DNA, 25 bp, Mus musculus
aaccaggatagctgcatgatctact

SEQ ID NO: 32235 - DNA, 25 bp, Mus musculus
aaccaggatcctcaacaaccttcta

SEQ ID NO: 32236 - DNA, 25 bp, Mus musculus
aaccaggatcctgaacaaccttcta

SEQ ID NO: 32237 - DNA, 25 bp, Mus musculus
aaccaggatcggctacttcaagtaa

SEQ ID NO: 32238 - DNA, 25 bp, Mus musculus
aaccaggatcgggtacttcaagtaa

SEQ ID NO: 32239 - DNA, 25 bp, Mus musculus
aaccaggatgtgatcctgcatccct

SEQ ID NO: 32240 - DNA, 25 bp, Mus musculus
aaccaggatgtgttcctgcatccct

SEQ ID NO: 32241 - DNA, 25 bp, Mus musculus
aaccaggcaatgactgtatagcttt

SEQ ID NO: 32242 - DNA, 25 bp, Mus musculus
aaccaggcaatgtctgtatagcttt

SEQ ID NO: 32243 - DNA, 25 bp, Mus musculus
aaccaggcacagaagtgacatacag

SEQ ID NO: 32244 - DNA, 25 bp, Mus musculus
aaccaggcacagtagtgacatacag

SEQ ID NO: 32245 - DNA, 25 bp, Mus musculus
aaccaggcaccaagcgagagatcgt

SEQ ID NO: 32246 - DNA, 25 bp, Mus musculus
aaccaggcaccatgcgagagatcgt

SEQ ID NO: 32247 - DNA, 25 bp, Mus musculus
aaccaggcagaaagtccagcagagt

SEQ ID NO: 32248 - DNA, 25 bp, Mus musculus
aaccaggcagaatgtccagcagagt

SEQ ID NO: 32249 - DNA, 25 bp, Mus musculus
aaccaggcaggcatccggttccagt

SEQ ID NO: 32250 - DNA, 25 bp, Mus musculus
aaccaggcaggcttccggttccagt

SEQ ID NO: 32251 - DNA, 25 bp, Mus musculus
aaccaggcatgaagaagaacactga

SEQ ID NO: 32252 - DNA, 25 bp, Mus musculus
aaccaggcatgatgaagaacactga

SEQ ID NO: 32253 - DNA, 25 bp, Mus musculus
aaccaggccaggaggcgaaacagaa

SEQ ID NO: 32254 - DNA, 25 bp, Mus musculus
aaccaggccaggtggcgaaacagaa

SEQ ID NO: 32255 - DNA, 25 bp, Mus musculus
aaccaggcctgcaaagtcatcgctg

SEQ ID NO: 32256 - DNA, 25 bp, Mus musculus
aaccaggcctgctaagtcatcgctg

SEQ ID NO: 32257 - DNA, 25 bp, Mus musculus
aaccaggcgggtacaggaatcagtc

SEQ ID NO: 32258 - DNA, 25 bp, Mus musculus
aaccaggcgggtcattacaatccaa

SEQ ID NO: 32259 - DNA, 25 bp, Mus musculus
aaccaggcgggtgattacaatccaa

SEQ ID NO: 32260 - DNA, 25 bp, Mus musculus
aaccaggcgggttcaggaatcagtc

SEQ ID NO: 32261 - DNA, 25 bp, Mus musculus
aaccaggctctgacattttctcagt

SEQ ID NO: 32262 - DNA, 25 bp, Mus musculus
aaccaggctctgtcattttctcagt

SEQ ID NO: 32263 - DNA, 25 bp, Mus musculus
aaccaggctgataagaccatagttt

SEQ ID NO: 32264 - DNA, 25 bp, Mus musculus
aaccaggctgattagaccatagttt

SEQ ID NO: 32265 - DNA, 25 bp, Mus musculus
aaccaggctgcgatggattcagtga

SEQ ID NO: 32266 - DNA, 25 bp, Mus musculus
aaccaggctgcgttggattcagtga

SEQ ID NO: 32267 - DNA, 25 bp, Mus musculus
aaccagggaccacgctacttttcat

SEQ ID NO: 32268 - DNA, 25 bp, Mus musculus
aaccagggaccaggctacttttcat

SEQ ID NO: 32269 - DNA, 25 bp, Mus musculus
aaccagggactaatcatgccatgac

SEQ ID NO: 32270 - DNA, 25 bp, Mus musculus
aaccagggactattcatgccatgac

SEQ ID NO: 32271 - DNA, 25 bp, Mus musculus
aaccagggagtcagtggtcgactac

SEQ ID NO: 32272 - DNA, 25 bp, Mus musculus
aaccagggagtctgtggtcgactac

SEQ ID NO: 32273 - DNA, 25 bp, Mus musculus
aaccagggcaacagtcactgtgttc

SEQ ID NO: 32274 - DNA, 25 bp, Mus musculus
aaccagggcaactgtcactgtgttc

SEQ ID NO: 32275 - DNA, 25 bp, Mus musculus
aaccagggcaatctcctaaagcact

SEQ ID NO: 32276 - DNA, 25 bp, Mus musculus
aaccagggcaatgtcctaaagcact

SEQ ID NO: 32277 - DNA, 25 bp, Mus musculus
aaccagggcagtcgacctgtcttca

SEQ ID NO: 32278 - DNA, 25 bp, Mus musculus
aaccagggcagtggacctgtcttca

SEQ ID NO: 32279 - DNA, 25 bp, Mus musculus
aaccagggcatcagcctgaactaat

SEQ ID NO: 32280 - DNA, 25 bp, Mus musculus
aaccagggcatctgcctgaactaat

SEQ ID NO: 32281 - DNA, 25 bp, Mus musculus
aaccagggcccgacatggagtttga

SEQ ID NO: 32282 - DNA, 25 bp, Mus musculus
aaccagggcccgtcatggagtttga

SEQ ID NO: 32283 - DNA, 25 bp, Mus musculus
aaccagggctaaagtatcctaccat

SEQ ID NO: 32284 - DNA, 25 bp, Mus musculus
aaccagggctaatgtatcctaccat

SEQ ID NO: 32285 - DNA, 25 bp, Mus musculus
aaccagggctatacatgaaccttgg

SEQ ID NO: 32286 - DNA, 25 bp, Mus musculus
aaccagggctattcatgaaccttgg

SEQ ID NO: 32287 - DNA, 25 bp, Mus musculus
aaccagggctttctatgcttgaagt

SEQ ID NO: 32288 - DNA, 25 bp, Mus musculus
aaccagggctttgtatgcttgaagt

SEQ ID NO: 32289 - DNA, 25 bp, Mus musculus
aaccagggtccccatcctgtgtgtt

SEQ ID NO: 32290 - DNA, 25 bp, Mus musculus
aaccagggtcccgatcctgtgtgtt

SEQ ID NO: 32291 - DNA, 25 bp, Mus musculus
aaccaggtatgacagcatatgccta

SEQ ID NO: 32292 - DNA, 25 bp, Mus musculus
aaccaggtatgagagcatatgccta

SEQ ID NO: 32293 - DNA, 25 bp, Mus musculus
aaccaggtattgaaagtctccattt

SEQ ID NO: 32294 - DNA, 25 bp, Mus musculus
aaccaggtattgtaagtctccattt

SEQ ID NO: 32295 - DNA, 25 bp, Mus musculus
aaccaggtctagctggagtcacaca

SEQ ID NO: 32296 - DNA, 25 bp, Mus musculus
aaccaggtctaggtggagtcacaca

SEQ ID NO: 32297 - DNA, 25 bp, Mus musculus
aaccaggtctgccatgctgtggact

SEQ ID NO: 32298 - DNA, 25 bp, Mus musculus
aaccaggtctgcgatgctgtggact

SEQ ID NO: 32299 - DNA, 25 bp, Mus musculus
aaccaggtgtagaccttgtaagtat

SEQ ID NO: 32300 - DNA, 25 bp, Mus musculus
aaccaggtgtagtccttgtaagtat

SEQ ID NO: 32301 - DNA, 25 bp, Mus musculus
aaccaggttcagacgcttcctgcag

SEQ ID NO: 32302 - DNA, 25 bp, Mus musculus
aaccaggttcagtcgcttcctgcag

SEQ ID NO: 32303 - DNA, 25 bp, Mus musculus
aaccaggttctacttggctggcaat

SEQ ID NO: 32304 - DNA, 25 bp, Mus musculus
aaccaggttctagttggctggcaat

SEQ ID NO: 32305 - DNA, 25 bp, Mus musculus
aaccaggtttctatgccttagcttg

SEQ ID NO: 32306 - DNA, 25 bp, Mus musculus
aaccaggtttctttgccttagcttg

SEQ ID NO: 32307 - DNA, 25 bp, Mus musculus
aaccagtaagcaacatcactccatg

SEQ ID NO: 32308 - DNA, 25 bp, Mus musculus
aaccagtaagcatcatcactccatg

SEQ ID NO: 32309 - DNA, 25 bp, Mus musculus
aaccagtaagttcctactgcctgtg

SEQ ID NO: 32310 - DNA, 25 bp, Mus musculus
aaccagtaagttgctactgcctgtg

SEQ ID NO: 32311 - DNA, 25 bp, Mus musculus
aaccagtacctcacaaccttaattg

SEQ ID NO: 32312 - DNA, 25 bp, Mus musculus
aaccagtacctctcaaccttaattg

SEQ ID NO: 32313 - DNA, 25 bp, Mus musculus
aaccagtacttcagatcggacatca

SEQ ID NO: 32314 - DNA, 25 bp, Mus musculus
aaccagtacttctgatcggacatca

SEQ ID NO: 32315 - DNA, 25 bp, Mus musculus
aaccagtagaggatcacagttcctt

SEQ ID NO: 32316 - DNA, 25 bp, Mus musculus
aaccagtagaggttcacagttcctt

SEQ ID NO: 32317 - DNA, 25 bp, Mus musculus
aaccagtagcctctgtgtgtgcgta

SEQ ID NO: 32318 - DNA, 25 bp, Mus musculus
aaccagtagcctgtgtgtgtgcgta

SEQ ID NO: 32319 - DNA, 25 bp, Mus musculus
aaccagtagctaagacttgtgtttt

SEQ ID NO: 32320 - DNA, 25 bp, Mus musculus
aaccagtagctatgacttgtgtttt

SEQ ID NO: 32321 - DNA, 25 bp, Mus musculus
aaccagtagctcattttcttctttt

SEQ ID NO: 32322 - DNA, 25 bp, Mus musculus
aaccagtagctctttttcttctttt

SEQ ID NO: 32323 - DNA, 25 bp, Mus musculus
aaccagtagctgacagccacgtgtg

SEQ ID NO: 32324 - DNA, 25 bp, Mus musculus
aaccagtagctgtcagccacgtgtg

SEQ ID NO: 32325 - DNA, 25 bp, Mus musculus
aaccagtattaccagcagtaccaga

SEQ ID NO: 32326 - DNA, 25 bp, Mus musculus
aaccagtattacgagcagtaccaga

SEQ ID NO: 32327 - DNA, 25 bp, Mus musculus
aaccagtcacaactgtcctgtgatt

SEQ ID NO: 32328 - DNA, 25 bp, Mus musculus
aaccagtcacaagtgtcctgtgatt

SEQ ID NO: 32329 - DNA, 25 bp, Mus musculus
aaccagtcacagaggtgttggcgat

SEQ ID NO: 32330 - DNA, 25 bp, Mus musculus
aaccagtcacagtggtgttggcgat

SEQ ID NO: 32331 - DNA, 25 bp, Mus musculus
aaccagtcactgcttcatgcttgga

SEQ ID NO: 32332 - DNA, 25 bp, Mus musculus
aaccagtcactggttcatgcttgga

SEQ ID NO: 32333 - DNA, 25 bp, Mus musculus
aaccagtcagctccagcaaggaacc

SEQ ID NO: 32334 - DNA, 25 bp, Mus musculus
aaccagtcagctgcagcaaggaacc

SEQ ID NO: 32335 - DNA, 25 bp, Mus musculus
aaccagtcaggtatctgggaactgt

SEQ ID NO: 32336 - DNA, 25 bp, Mus musculus
aaccagtcaggtttctgggaactgt

SEQ ID NO: 32337 - DNA, 25 bp, Mus musculus
aaccagtcagtcataatgggtgctt

SEQ ID NO: 32338 - DNA, 25 bp, Mus musculus
aaccagtcagtcttaatgggtgctt

SEQ ID NO: 32339 - DNA, 25 bp, Mus musculus
aaccagtctcagcaatgaaacggga

SEQ ID NO: 32340 - DNA, 25 bp, Mus musculus
aaccagtctcaggaatgaaacggga

SEQ ID NO: 32341 - DNA, 25 bp, Mus musculus
aaccagtctggtcggagagatgtct

SEQ ID NO: 32342 - DNA, 25 bp, Mus musculus
aaccagtctggtgggagagatgtct

SEQ ID NO: 32343 - DNA, 25 bp, Mus musculus
aaccagtgacaaatcctatcataga

SEQ ID NO: 32344 - DNA, 25 bp, Mus musculus
aaccagtgacaattcctatcataga

SEQ ID NO: 32345 - DNA, 25 bp, Mus musculus
aaccagtgagcccacaatttccagt

SEQ ID NO: 32346 - DNA, 25 bp, Mus musculus
aaccagtgagccgacaatttccagt

SEQ ID NO: 32347 - DNA, 25 bp, Mus musculus
aaccagtgcacaagaaggtcagact

SEQ ID NO: 32348 - DNA, 25 bp, Mus musculus
aaccagtgcacatgaaggtcagact

SEQ ID NO: 32349 - DNA, 25 bp, Mus musculus
aaccagtgccccatgggccatttct

SEQ ID NO: 32350 - DNA, 25 bp, Mus musculus
aaccagtgccccttgggccatttct

SEQ ID NO: 32351 - DNA, 25 bp, Mus musculus
aaccagtgctggcagatgcttcaat

SEQ ID NO: 32352 - DNA, 25 bp, Mus musculus
aaccagtgctgggagatgcttcaat

SEQ ID NO: 32353 - DNA, 25 bp, Mus musculus
aaccagtgggtcagtatcagtttca

SEQ ID NO: 32354 - DNA, 25 bp, Mus musculus
aaccagtgggtctgtatcagtttca

SEQ ID NO: 32355 - DNA, 25 bp, Mus musculus
aaccagtggttcagtggtcaggaaa

SEQ ID NO: 32356 - DNA, 25 bp, Mus musculus
aaccagtggttctgtggtcaggaaa

SEQ ID NO: 32357 - DNA, 25 bp, Mus musculus
aaccagtgtagtcgccctttgattt

SEQ ID NO: 32358 - DNA, 25 bp, Mus musculus
aaccagtgtagtggccctttgattt

SEQ ID NO: 32359 - DNA, 25 bp, Mus musculus
aaccagttaaaaacagcttctatct

SEQ ID NO: 32360 - DNA, 25 bp, Mus musculus
aaccagttaaaatcagcttctatct

SEQ ID NO: 32361 - DNA, 25 bp, Mus musculus
aaccagttaagccttcctcagatga

SEQ ID NO: 32362 - DNA, 25 bp, Mus musculus
aaccagttaagcgttcctcagatga

SEQ ID NO: 32363 - DNA, 25 bp, Mus musculus
aaccagttacctcgcttctgttttg

SEQ ID NO: 32364 - DNA, 25 bp, Mus musculus
aaccagttacctggcttctgttttg

SEQ ID NO: 32365 - DNA, 25 bp, Mus musculus
aaccagttacgactcctttcaaatg

SEQ ID NO: 32366 - DNA, 25 bp, Mus musculus
aaccagttacgagtcctttcaaatg

SEQ ID NO: 32367 - DNA, 25 bp, Mus musculus
aaccagttagaaagcaggagccact

SEQ ID NO: 32368 - DNA, 25 bp, Mus musculus
aaccagttagaatgcaggagccact

SEQ ID NO: 32369 - DNA, 25 bp, Mus musculus
aaccagttagacactgggagggact

SEQ ID NO: 32370 - DNA, 25 bp, Mus musculus
aaccagttagactctgggagggact

SEQ ID NO: 32371 - DNA, 25 bp, Mus musculus
aaccagttagatacttgctcccaga

SEQ ID NO: 32372 - DNA, 25 bp, Mus musculus
aaccagttagattcttgctcccaga

SEQ ID NO: 32373 - DNA, 25 bp, Mus musculus
aaccagttccagaagtctcttacct

SEQ ID NO: 32374 - DNA, 25 bp, Mus musculus
aaccagttccagtagtctcttacct

SEQ ID NO: 32375 - DNA, 25 bp, Mus musculus
aaccagttcccaaagtataatgcat

SEQ ID NO: 32376 - DNA, 25 bp, Mus musculus
aaccagttcccatagtataatgcat

SEQ ID NO: 32377 - DNA, 25 bp, Mus musculus
aaccagttcctgacgcaagtggact

SEQ ID NO: 32378 - DNA, 25 bp, Mus musculus
aaccagttcctgtcgcaagtggact

SEQ ID NO: 32379 - DNA, 25 bp, Mus musculus
aaccagttcgttccttgaggcaggg

SEQ ID NO: 32380 - DNA, 25 bp, Mus musculus
aaccagttcgttgcttgaggcaggg

SEQ ID NO: 32381 - DNA, 25 bp, Mus musculus
aaccagttctacctgcagttgagtt

SEQ ID NO: 32382 - DNA, 25 bp, Mus musculus
aaccagttctacgtgcagttgagtt

SEQ ID NO: 32383 - DNA, 25 bp, Mus musculus
aaccagttgacccttcacacagagt

SEQ ID NO: 32384 - DNA, 25 bp, Mus musculus
aaccagttgaccgttcacacagagt

SEQ ID NO: 32385 - DNA, 25 bp, Mus musculus
aaccagttgcaaatgtttccatctt

SEQ ID NO: 32386 - DNA, 25 bp, Mus musculus
aaccagttgcaattgtttccatctt

SEQ ID NO: 32387 - DNA, 25 bp, Mus musculus
aaccagttggatcgatttgattcga

SEQ ID NO: 32388 - DNA, 25 bp, Mus musculus
aaccagttggatggatttgattcga

SEQ ID NO: 32389 - DNA, 25 bp, Mus musculus
aaccagttgttcatcataggtccaa

SEQ ID NO: 32390 - DNA, 25 bp, Mus musculus
aaccagttgttcttcataggtccaa

SEQ ID NO: 32391 - DNA, 25 bp, Mus musculus
aaccagttgttgcttggattccact

SEQ ID NO: 32392 - DNA, 25 bp, Mus musculus
aaccagttgttggttggattccact

SEQ ID NO: 32393 - DNA, 25 bp, Mus musculus
aaccagtttatccatcttgctttca

SEQ ID NO: 32394 - DNA, 25 bp, Mus musculus
aaccagtttatcgatcttgctttca

SEQ ID NO: 32395 - DNA, 25 bp, Mus musculus
aaccagtttgaaactcactctttgg

SEQ ID NO: 32396 - DNA, 25 bp, Mus musculus
aaccagtttgaatctcactctttgg

SEQ ID NO: 32397 - DNA, 25 bp, Mus musculus
aaccagtttgtaacatgatagcccc

SEQ ID NO: 32398 - DNA, 25 bp, Mus musculus
aaccagtttgtatcatgatagcccc

SEQ ID NO: 32399 - DNA, 25 bp, Mus musculus
aaccagttttaaatatgcgggaatg

SEQ ID NO: 32400 - DNA, 25 bp, Mus musculus
aaccagttttaattatgcgggaatg

SEQ ID NO: 32401 - DNA, 25 bp, Mus musculus
aaccataacatgacccagcaagaag

SEQ ID NO: 32402 - DNA, 25 bp, Mus musculus
aaccataacatgtcccagcaagaag

SEQ ID NO: 32403 - DNA, 25 bp, Mus musculus
aaccataagccaagacgatctctcc

SEQ ID NO: 32404 - DNA, 25 bp, Mus musculus
aaccataagccatgacgatctctcc

SEQ ID NO: 32405 - DNA, 25 bp, Mus musculus
aaccataatattcagacatgtaccc

SEQ ID NO: 32406 - DNA, 25 bp, Mus musculus
aaccataatattgagacatgtaccc

SEQ ID NO: 32407 - DNA, 25 bp, Mus musculus
aaccataattaacaccccgagctgc

SEQ ID NO: 32408 - DNA, 25 bp, Mus musculus
aaccataattaaccacatgctcaga

SEQ ID NO: 32409 - DNA, 25 bp, Mus musculus
aaccataattaagaccccgagctgc

SEQ ID NO: 32410 - DNA, 25 bp, Mus musculus
aaccataattaagcacatgctcaga

SEQ ID NO: 32411 - DNA, 25 bp, Mus musculus
aaccataattcaatcccttagcaac

SEQ ID NO: 32412 - DNA, 25 bp, Mus musculus
aaccataattcattcccttagcaac

SEQ ID NO: 32413 - DNA, 25 bp, Mus musculus
aaccatacaatgattctctgtacct

SEQ ID NO: 32414 - DNA, 25 bp, Mus musculus
aaccatacaatgtttctctgtacct

SEQ ID NO: 32415 - DNA, 25 bp, Mus musculus
aaccatacaccaatgttagctcgaa

SEQ ID NO: 32416 - DNA, 25 bp, Mus musculus
aaccatacaccattgttagctcgaa

SEQ ID NO: 32417 - DNA, 25 bp, Mus musculus
aaccatacagggacaggtggaggct

SEQ ID NO: 32418 - DNA, 25 bp, Mus musculus
aaccatacagggtcaggtggaggct

SEQ ID NO: 32419 - DNA, 25 bp, Mus musculus
aaccatactaacctggacacccaca

SEQ ID NO: 32420 - DNA, 25 bp, Mus musculus
aaccatactaacgtggacacccaca

SEQ ID NO: 32421 - DNA, 25 bp, Mus musculus
aaccatactcctcctgcctgggtat

SEQ ID NO: 32422 - DNA, 25 bp, Mus musculus
aaccatactcctgctgcctgggtat

SEQ ID NO: 32423 - DNA, 25 bp, Mus musculus
aaccatactctcacatagctttcag

SEQ ID NO: 32424 - DNA, 25 bp, Mus musculus
aaccatactctctcatagctttcag

SEQ ID NO: 32425 - DNA, 25 bp, Mus musculus
aaccatactgggacttgagtttgtt

SEQ ID NO: 32426 - DNA, 25 bp, Mus musculus
aaccatactgggtcttgagtttgtt

SEQ ID NO: 32427 - DNA, 25 bp, Mus musculus
aaccatagagcaccaaggtcccgct

SEQ ID NO: 32428 - DNA, 25 bp, Mus musculus
aaccatagagcagcaaggtcccgct

SEQ ID NO: 32429 - DNA, 25 bp, Mus musculus
aaccatagagggatccagggaggaa

SEQ ID NO: 32430 - DNA, 25 bp, Mus musculus
aaccatagagggttccagggaggaa

SEQ ID NO: 32431 - DNA, 25 bp, Mus musculus
aaccatagcaaaccaaatattgggt

SEQ ID NO: 32432 - DNA, 25 bp, Mus musculus
aaccatagcaaagcaaatattgggt

SEQ ID NO: 32433 - DNA, 25 bp, Mus musculus
aaccatagcacgaggctttgtccct

SEQ ID NO: 32434 - DNA, 25 bp, Mus musculus
aaccatagcacgtggctttgtccct

SEQ ID NO: 32435 - DNA, 25 bp, Mus musculus
aaccatagcaggacatctaagcctc

SEQ ID NO: 32436 - DNA, 25 bp, Mus musculus
aaccatagcaggtcatctaagcctc

SEQ ID NO: 32437 - DNA, 25 bp, Mus musculus
aaccatagcggtactcaggcaactg

SEQ ID NO: 32438 - DNA, 25 bp, Mus musculus
aaccatagcggttctcaggcaactg

SEQ ID NO: 32439 - DNA, 25 bp, Mus musculus
aaccatagctctcctgtaaattcag

SEQ ID NO: 32440 - DNA, 25 bp, Mus musculus
aaccatagctctgctgtaaattcag

SEQ ID NO: 32441 - DNA, 25 bp, Mus musculus
aaccataggcttctgttcatatccg

SEQ ID NO: 32442 - DNA, 25 bp, Mus musculus
aaccataggcttgtgttcatatccg

SEQ ID NO: 32443 - DNA, 25 bp, Mus musculus
aaccatagtgacatacttgcgcata

SEQ ID NO: 32444 - DNA, 25 bp, Mus musculus
aaccatagtgacttacttgcgcata

SEQ ID NO: 32445 - DNA, 25 bp, Mus musculus
aaccatagttggacattttttctca

SEQ ID NO: 32446 - DNA, 25 bp, Mus musculus
aaccatagttggtcattttttctca

SEQ ID NO: 32447 - DNA, 25 bp, Mus musculus
aaccatatattcatgcatgcttaca

SEQ ID NO: 32448 - DNA, 25 bp, Mus musculus
aaccatatattcttgcatgcttaca

SEQ ID NO: 32449 - DNA, 25 bp, Mus musculus
aaccatcaacttcttccttacattc

SEQ ID NO: 32450 - DNA, 25 bp, Mus musculus
aaccatcaacttgttccttacattc

SEQ ID NO: 32451 - DNA, 25 bp, Mus musculus
aaccatcaagacaaagcgcaccatc

SEQ ID NO: 32452 - DNA, 25 bp, Mus musculus
aaccatcaagactaagcgcaccatc

SEQ ID NO: 32453 - DNA, 25 bp, Mus musculus
aaccatcaaggtctgtttcctacta

SEQ ID NO: 32454 - DNA, 25 bp, Mus musculus
aaccatcaaggtgtgtttcctacta

SEQ ID NO: 32455 - DNA, 25 bp, Mus musculus
aaccatcaatgtaatcttccaaaga

SEQ ID NO: 32456 - DNA, 25 bp, Mus musculus
aaccatcaatgttatcttccaaaga

SEQ ID NO: 32457 - DNA, 25 bp, Mus musculus
aaccatcacacaacgagctgctatg

SEQ ID NO: 32458 - DNA, 25 bp, Mus musculus
aaccatcacacatcgagctgctatg

SEQ ID NO: 32459 - DNA, 25 bp, Mus musculus
aaccatcaccaaataaatgtcctca

SEQ ID NO: 32460 - DNA, 25 bp, Mus musculus
aaccatcaccaattaaatgtcctca

SEQ ID NO: 32461 - DNA, 25 bp, Mus musculus
aaccatcacgaccacattaattaaa

SEQ ID NO: 32462 - DNA, 25 bp, Mus musculus
aaccatcacgacgacattaattaaa

SEQ ID NO: 32463 - DNA, 25 bp, Mus musculus
aaccatcagaataactaaataagcc

SEQ ID NO: 32464 - DNA, 25 bp, Mus musculus
aaccatcagaattactaaataagcc

SEQ ID NO: 32465 - DNA, 25 bp, Mus musculus
aaccatcaggagagtttctttcctt

SEQ ID NO: 32466 - DNA, 25 bp, Mus musculus
aaccatcaggagtgtttctttcctt

SEQ ID NO: 32467 - DNA, 25 bp, Mus musculus
aaccatcaggatacctcgattagaa

SEQ ID NO: 32468 - DNA, 25 bp, Mus musculus
aaccatcaggattcctcgattagaa

SEQ ID NO: 32469 - DNA, 25 bp, Mus musculus
aaccatcagggacttggctgtggcc

SEQ ID NO: 32470 - DNA, 25 bp, Mus musculus
aaccatcagggagttggctgtggcc

SEQ ID NO: 32471 - DNA, 25 bp, Mus musculus
aaccatcagtagagggctggcttgt

SEQ ID NO: 32472 - DNA, 25 bp, Mus musculus
aaccatcagtagtgggctggcttgt

SEQ ID NO: 32473 - DNA, 25 bp, Mus musculus
aaccatcagtgaacttgacttgact

SEQ ID NO: 32474 - DNA, 25 bp, Mus musculus
aaccatcagtgatcttgacttgact

SEQ ID NO: 32475 - DNA, 25 bp, Mus musculus
aaccatcatggtagtcatggaaact

SEQ ID NO: 32476 - DNA, 25 bp, Mus musculus
aaccatcatggttgtcatggaaact

SEQ ID NO: 32477 - DNA, 25 bp, Mus musculus
aaccatcatgtcaacagtgttctgt

SEQ ID NO: 32478 - DNA, 25 bp, Mus musculus
aaccatcatgtctacagtgttctgt

SEQ ID NO: 32479 - DNA, 25 bp, Mus musculus
aaccatccaccaatattgagccagc

SEQ ID NO: 32480 - DNA, 25 bp, Mus musculus
aaccatccaccattattgagccagc

SEQ ID NO: 32481 - DNA, 25 bp, Mus musculus
aaccatccatacatctccagggagt

SEQ ID NO: 32482 - DNA, 25 bp, Mus musculus
aaccatccatacttctccagggagt

SEQ ID NO: 32483 - DNA, 25 bp, Mus musculus
aaccatcccgtccacagttgtcagt

SEQ ID NO: 32484 - DNA, 25 bp, Mus musculus
aaccatcccgtcgacagttgtcagt

SEQ ID NO: 32485 - DNA, 25 bp, Mus musculus
aaccatccgctgattgtactgggct

SEQ ID NO: 32486 - DNA, 25 bp, Mus musculus
aaccatccgctgtttgtactgggct

SEQ ID NO: 32487 - DNA, 25 bp, Mus musculus
aaccatccggaccaggaagttcatg

SEQ ID NO: 32488 - DNA, 25 bp, Mus musculus
aaccatccggacgaggaagttcatg

SEQ ID NO: 32489 - DNA, 25 bp, Mus musculus
aaccatccgtatataaagggatccg

SEQ ID NO: 32490 - DNA, 25 bp, Mus musculus
aaccatccgtatttaaagggatccg

SEQ ID NO: 32491 - DNA, 25 bp, Mus musculus
aaccatcctaataaatgttcaagtg

SEQ ID NO: 32492 - DNA, 25 bp, Mus musculus
aaccatcctaattaatgttcaagtg

SEQ ID NO: 32493 - DNA, 25 bp, Mus musculus
aaccatcctatcagcagcacaaggg

SEQ ID NO: 32494 - DNA, 25 bp, Mus musculus
aaccatcctatcagtatttgcaaga

SEQ ID NO: 32495 - DNA, 25 bp, Mus musculus
aaccatcctatctgcagcacaaggg

SEQ ID NO: 32496 - DNA, 25 bp, Mus musculus
aaccatcctatctgtatttgcaaga

SEQ ID NO: 32497 - DNA, 25 bp, Mus musculus
aaccatcgaactcaaggcccttagg

SEQ ID NO: 32498 - DNA, 25 bp, Mus musculus
aaccatcgaactgaaggcccttagg

SEQ ID NO: 32499 - DNA, 25 bp, Mus musculus
aaccatcggagtagcacgtgtccta

SEQ ID NO: 32500 - DNA, 25 bp, Mus musculus
aaccatcggagttgcacgtgtccta

SEQ ID NO: 32501 - DNA, 25 bp, Mus musculus
aaccatctataactcgagttttggg

SEQ ID NO: 32502 - DNA, 25 bp, Mus musculus
aaccatctataagtcgagttttggg

SEQ ID NO: 32503 - DNA, 25 bp, Mus musculus
aaccatctatgtctatcagcctttt

SEQ ID NO: 32504 - DNA, 25 bp, Mus musculus
aaccatctatgtgtatcagcctttt

SEQ ID NO: 32505 - DNA, 25 bp, Mus musculus
aaccatctcaaacaaacactgtatt

SEQ ID NO: 32506 - DNA, 25 bp, Mus musculus
aaccatctcaaagaaacactgtatt

SEQ ID NO: 32507 - DNA, 25 bp, Mus musculus
aaccatctcctccacaatgtgatta

SEQ ID NO: 32508 - DNA, 25 bp, Mus musculus
aaccatctcctcgacaatgtgatta

SEQ ID NO: 32509 - DNA, 25 bp, Mus musculus
aaccatctccttatgggcaatcagg

SEQ ID NO: 32510 - DNA, 25 bp, Mus musculus
aaccatctccttttgggcaatcagg

SEQ ID NO: 32511 - DNA, 25 bp, Mus musculus
aaccatctgactcgactttgttttt

SEQ ID NO: 32512 - DNA, 25 bp, Mus musculus
aaccatctgactggactttgttttt

SEQ ID NO: 32513 - DNA, 25 bp, Mus musculus
aaccatctgcctcgagacctttaag

SEQ ID NO: 32514 - DNA, 25 bp, Mus musculus
aaccatctgcctggagacctttaag

SEQ ID NO: 32515 - DNA, 25 bp, Mus musculus
aaccatctgctaatgtgattatgca

SEQ ID NO: 32516 - DNA, 25 bp, Mus musculus
aaccatctgctattgtgattatgca

SEQ ID NO: 32517 - DNA, 25 bp, Mus musculus
aaccatctggaaaagctgaacatca

SEQ ID NO: 32518 - DNA, 25 bp, Mus musculus
aaccatctggaatagctgaacatca

SEQ ID NO: 32519 - DNA, 25 bp, Mus musculus
aaccatctggagaatgtgaggtgga

SEQ ID NO: 32520 - DNA, 25 bp, Mus musculus
aaccatctggagtatgtgaggtgga

SEQ ID NO: 32521 - DNA, 25 bp, Mus musculus
aaccatctgtaaacgctttgccaac

SEQ ID NO: 32522 - DNA, 25 bp, Mus musculus
aaccatctgtaatcgctttgccaac

SEQ ID NO: 32523 - DNA, 25 bp, Mus musculus
aaccatcttcctattatgtacttgt

SEQ ID NO: 32524 - DNA, 25 bp, Mus musculus
aaccatcttccttttatgtacttgt

SEQ ID NO: 32525 - DNA, 25 bp, Mus musculus
aaccatcttggtcagggaccctcta

SEQ ID NO: 32526 - DNA, 25 bp, Mus musculus
aaccatcttggtgagggaccctcta

SEQ ID NO: 32527 - DNA, 25 bp, Mus musculus
aaccatctttggacttttgtggaat

SEQ ID NO: 32528 - DNA, 25 bp, Mus musculus
aaccatctttggtcttttgtggaat

SEQ ID NO: 32529 - DNA, 25 bp, Mus musculus
aaccatgaacctaactcagaagcga

SEQ ID NO: 32530 - DNA, 25 bp, Mus musculus
aaccatgaaccttactcagaagcga

SEQ ID NO: 32531 - DNA, 25 bp, Mus musculus
aaccatgaagatatctcgttttgaa

SEQ ID NO: 32532 - DNA, 25 bp, Mus musculus
aaccatgaagatttctcgttttgaa

SEQ ID NO: 32533 - DNA, 25 bp, Mus musculus
aaccatgaagctccccgggcaggac

SEQ ID NO: 32534 - DNA, 25 bp, Mus musculus
aaccatgaagctgcccgggcaggac

SEQ ID NO: 32535 - DNA, 25 bp, Mus musculus
aaccatgaataaactgtcagtctta

SEQ ID NO: 32536 - DNA, 25 bp, Mus musculus
aaccatgaataatctgtcagtctta

SEQ ID NO: 32537 - DNA, 25 bp, Mus musculus
aaccatgaattgaccatcctcatac

SEQ ID NO: 32538 - DNA, 25 bp, Mus musculus
aaccatgaattgtccatcctcatac

SEQ ID NO: 32539 - DNA, 25 bp, Mus musculus
aaccatgaccatcctgttgatgacc

SEQ ID NO: 32540 - DNA, 25 bp, Mus musculus
aaccatgaccatgctgttgatgacc

SEQ ID NO: 32541 - DNA, 25 bp, Mus musculus
aaccatgactaaagcgcaggcggac

SEQ ID NO: 32542 - DNA, 25 bp, Mus musculus
aaccatgactaatgcgcaggcggac

SEQ ID NO: 32543 - DNA, 25 bp, Mus musculus
aaccatgacttgacttccagcttgt

SEQ ID NO: 32544 - DNA, 25 bp, Mus musculus
aaccatgacttgtcttccagcttgt

SEQ ID NO: 32545 - DNA, 25 bp, Mus musculus
aaccatgagatccagccgtatgtga

SEQ ID NO: 32546 - DNA, 25 bp, Mus musculus
aaccatgagatcctgcgggaggcct

SEQ ID NO: 32547 - DNA, 25 bp, Mus musculus
aaccatgagatcgagccgtatgtga

SEQ ID NO: 32548 - DNA, 25 bp, Mus musculus
aaccatgagatcgtgcgggaggcct

SEQ ID NO: 32549 - DNA, 25 bp, Mus musculus
aaccatgagtgaattataaccagat

SEQ ID NO: 32550 - DNA, 25 bp, Mus musculus
aaccatgagtgatttataaccagat

SEQ ID NO: 32551 - DNA, 25 bp, Mus musculus
aaccatgatgctaacgtttcacagg

SEQ ID NO: 32552 - DNA, 25 bp, Mus musculus
aaccatgatgcttacgtttcacagg

SEQ ID NO: 32553 - DNA, 25 bp, Mus musculus
aaccatgatgtaattcatcctgcag

SEQ ID NO: 32554 - DNA, 25 bp, Mus musculus
aaccatgatgtatttcatcctgcag

SEQ ID NO: 32555 - DNA, 25 bp, Mus musculus
aaccatgatgttacgcgaccaggtc

SEQ ID NO: 32556 - DNA, 25 bp, Mus musculus
aaccatgatgtttcgcgaccaggtc

SEQ ID NO: 32557 - DNA, 25 bp, Mus musculus
aaccatgattccctaaagttgggca

SEQ ID NO: 32558 - DNA, 25 bp, Mus musculus
aaccatgattccgtaaagttgggca

SEQ ID NO: 32559 - DNA, 25 bp, Mus musculus
aaccatgcagtcatctactctgata

SEQ ID NO: 32560 - DNA, 25 bp, Mus musculus
aaccatgcagtcttctactctgata

SEQ ID NO: 32561 - DNA, 25 bp, Mus musculus
aaccatgcataaagatctggaccag

SEQ ID NO: 32562 - DNA, 25 bp, Mus musculus
aaccatgcataatgatctggaccag

SEQ ID NO: 32563 - DNA, 25 bp, Mus musculus
aaccatgcatcaatcagagggactt

SEQ ID NO: 32564 - DNA, 25 bp, Mus musculus
aaccatgcatcattcagagggactt

SEQ ID NO: 32565 - DNA, 25 bp, Mus musculus
aaccatgccaggagcaggcaggata

SEQ ID NO: 32566 - DNA, 25 bp, Mus musculus
aaccatgccaggtgcaggcaggata

SEQ ID NO: 32567 - DNA, 25 bp, Mus musculus
aaccatgccatactttctattctcc

SEQ ID NO: 32568 - DNA, 25 bp, Mus musculus
aaccatgccatagtttctattctcc

SEQ ID NO: 32569 - DNA, 25 bp, Mus musculus
aaccatgccttcatttgccctgatt

SEQ ID NO: 32570 - DNA, 25 bp, Mus musculus
aaccatgccttcttttgccctgatt

SEQ ID NO: 32571 - DNA, 25 bp, Mus musculus
aaccatgcctttccgaaacatcttc

SEQ ID NO: 32572 - DNA, 25 bp, Mus musculus
aaccatgcctttgcgaaacatcttc

SEQ ID NO: 32573 - DNA, 25 bp, Mus musculus
aaccatgcggtgcttttgactccta

SEQ ID NO: 32574 - DNA, 25 bp, Mus musculus
aaccatgcggtggttttgactccta

SEQ ID NO: 32575 - DNA, 25 bp, Mus musculus
aaccatgcgtgcatttcctctaaga

SEQ ID NO: 32576 - DNA, 25 bp, Mus musculus
aaccatgcgtgcttttcctctaaga

SEQ ID NO: 32577 - DNA, 25 bp, Mus musculus
aaccatgctctaacaatgttcgtga

SEQ ID NO: 32578 - DNA, 25 bp, Mus musculus
aaccatgctctatcaatgttcgtga

SEQ ID NO: 32579 - DNA, 25 bp, Mus musculus
aaccatgctgctaagagagcctcag

SEQ ID NO: 32580 - DNA, 25 bp, Mus musculus
aaccatgctgctattcctgatttag

SEQ ID NO: 32581 - DNA, 25 bp, Mus musculus
aaccatgctgcttagagagcctcag

SEQ ID NO: 32582 - DNA, 25 bp, Mus musculus
aaccatgctgcttttcctgatttag

SEQ ID NO: 32583 - DNA, 25 bp, Mus musculus
aaccatggaagccaggctcaggaaa

SEQ ID NO: 32584 - DNA, 25 bp, Mus musculus
aaccatggaagcgaggctcaggaaa

SEQ ID NO: 32585 - DNA, 25 bp, Mus musculus
aaccatggacttactcgaagagtcg

SEQ ID NO: 32586 - DNA, 25 bp, Mus musculus
aaccatggactttctcgaagagtcg

SEQ ID NO: 32587 - DNA, 25 bp, Mus musculus
aaccatggagaacgtaaccaagatc

SEQ ID NO: 32588 - DNA, 25 bp, Mus musculus
aaccatggagaaggtaaccaagatc

SEQ ID NO: 32589 - DNA, 25 bp, Mus musculus
aaccatggagccagctttccagcct

SEQ ID NO: 32590 - DNA, 25 bp, Mus musculus
aaccatggagcctgctttccagcct

SEQ ID NO: 32591 - DNA, 25 bp, Mus musculus
aaccatggaggaatacggcttgctg

SEQ ID NO: 32592 - DNA, 25 bp, Mus musculus
aaccatggaggattacggcttgctg

SEQ ID NO: 32593 - DNA, 25 bp, Mus musculus
aaccatgggataaatgccatcaata

SEQ ID NO: 32594 - DNA, 25 bp, Mus musculus
aaccatgggatatatgccatcaata

SEQ ID NO: 32595 - DNA, 25 bp, Mus musculus
aaccatgggcgaacagtaagcattc

SEQ ID NO: 32596 - DNA, 25 bp, Mus musculus
aaccatgggcgatcagtaagcattc

SEQ ID NO: 32597 - DNA, 25 bp, Mus musculus
aaccatgggcttctcgtgagtggcc

SEQ ID NO: 32598 - DNA, 25 bp, Mus musculus
aaccatgggcttgtcgtgagtggcc

SEQ ID NO: 32599 - DNA, 25 bp, Mus musculus
aaccatgggtgtaccttacaatccg

SEQ ID NO: 32600 - DNA, 25 bp, Mus musculus
aaccatgggtgttccttacaatccg

SEQ ID NO: 32601 - DNA, 25 bp, Mus musculus
aaccatggtatgcaatagtgtttcc

SEQ ID NO: 32602 - DNA, 25 bp, Mus musculus
aaccatggtatggaatagtgtttcc

SEQ ID NO: 32603 - DNA, 25 bp, Mus musculus
aaccatggtcacacaactcggtagt

SEQ ID NO: 32604 - DNA, 25 bp, Mus musculus
aaccatggtcactcaactcggtagt

SEQ ID NO: 32605 - DNA, 25 bp, Mus musculus
aaccatggtcatccgagcactgtct

SEQ ID NO: 32606 - DNA, 25 bp, Mus musculus
aaccatggtcatgcgagcactgtct

SEQ ID NO: 32607 - DNA, 25 bp, Mus musculus
aaccatgtaaacaacttctcttgtt

SEQ ID NO: 32608 - DNA, 25 bp, Mus musculus
aaccatgtaaactacttctcttgtt

SEQ ID NO: 32609 - DNA, 25 bp, Mus musculus
aaccatgtaactatgtttgagactg

SEQ ID NO: 32610 - DNA, 25 bp, Mus musculus
aaccatgtaactttgtttgagactg

SEQ ID NO: 32611 - DNA, 25 bp, Mus musculus
aaccatgtagtccaaccaaattctc

SEQ ID NO: 32612 - DNA, 25 bp, Mus musculus
aaccatgtagtcgaaccaaattctc

SEQ ID NO: 32613 - DNA, 25 bp, Mus musculus
aaccatgtcatcaacctgtaccgtt

SEQ ID NO: 32614 - DNA, 25 bp, Mus musculus
aaccatgtcatctacctgtaccgtt

SEQ ID NO: 32615 - DNA, 25 bp, Mus musculus
aaccatgtgagcaatcacgcaccag

SEQ ID NO: 32616 - DNA, 25 bp, Mus musculus
aaccatgtgagctatcacgcaccag

SEQ ID NO: 32617 - DNA, 25 bp, Mus musculus
aaccatgtgattaattttcctgaga

SEQ ID NO: 32618 - DNA, 25 bp, Mus musculus
aaccatgtgatttattttcctgaga

SEQ ID NO: 32619 - DNA, 25 bp, Mus musculus
aaccatgtgccccattgaaggagaa

SEQ ID NO: 32620 - DNA, 25 bp, Mus musculus
aaccatgtgcccgattgaaggagaa

SEQ ID NO: 32621 - DNA, 25 bp, Mus musculus
aaccatgtgcctccattattgcaca

SEQ ID NO: 32622 - DNA, 25 bp, Mus musculus
aaccatgtgcctgcattattgcaca

SEQ ID NO: 32623 - DNA, 25 bp, Mus musculus
aaccatgtgcgaccgaacgactcct

SEQ ID NO: 32624 - DNA, 25 bp, Mus musculus
aaccatgtgcgagcgaacgactcct

SEQ ID NO: 32625 - DNA, 25 bp, Mus musculus
aaccatgtgcttaacccaactctat

SEQ ID NO: 32626 - DNA, 25 bp, Mus musculus
aaccatgtgctttacccaactctat

SEQ ID NO: 32627 - DNA, 25 bp, Mus musculus
aaccatgtggacatctgagcacggc

SEQ ID NO: 32628 - DNA, 25 bp, Mus musculus
aaccatgtggacttctgagcacggc

SEQ ID NO: 32629 - DNA, 25 bp, Mus musculus
aaccatgtggccaatatccagccag

SEQ ID NO: 32630 - DNA, 25 bp, Mus musculus
aaccatgtggcctatatccagccag

SEQ ID NO: 32631 - DNA, 25 bp, Mus musculus
aaccatgtgggccacttttggctgt

SEQ ID NO: 32632 - DNA, 25 bp, Mus musculus
aaccatgtgggcgacttttggctgt

SEQ ID NO: 32633 - DNA, 25 bp, Mus musculus
aaccatgtggtgcacatctaacaat

SEQ ID NO: 32634 - DNA, 25 bp, Mus musculus
aaccatgtggtggacatctaacaat

SEQ ID NO: 32635 - DNA, 25 bp, Mus musculus
aaccatgtgtcccttgccatgggaa

SEQ ID NO: 32636 - DNA, 25 bp, Mus musculus
aaccatgtgtccgttgccatgggaa

SEQ ID NO: 32637 - DNA, 25 bp, Mus musculus
aaccatgttagtacagctacagttt

SEQ ID NO: 32638 - DNA, 25 bp, Mus musculus
aaccatgttagttcagctacagttt

SEQ ID NO: 32639 - DNA, 25 bp, Mus musculus
aaccatgttctgctggcgggtacca

SEQ ID NO: 32640 - DNA, 25 bp, Mus musculus
aaccatgttctggtggcgggtacca

SEQ ID NO: 32641 - DNA, 25 bp, Mus musculus
aaccatgttcttcatagcagtcctc

SEQ ID NO: 32642 - DNA, 25 bp, Mus musculus
aaccatgttcttgatagcagtcctc

SEQ ID NO: 32643 - DNA, 25 bp, Mus musculus
aaccatgtttctataagtcttgaaa

SEQ ID NO: 32644 - DNA, 25 bp, Mus musculus
aaccatgtttctttaagtcttgaaa

SEQ ID NO: 32645 - DNA, 25 bp, Mus musculus
aaccattaaatgctgtgctattctg

SEQ ID NO: 32646 - DNA, 25 bp, Mus musculus
aaccattaaatggtgtgctattctg

SEQ ID NO: 32647 - DNA, 25 bp, Mus musculus
aaccattacattcactatgaaccac

SEQ ID NO: 32648 - DNA, 25 bp, Mus musculus
aaccattacattgactatgaaccac

SEQ ID NO: 32649 - DNA, 25 bp, Mus musculus
aaccattagcagactttgtattcag

SEQ ID NO: 32650 - DNA, 25 bp, Mus musculus
aaccattagcagtctttgtattcag

SEQ ID NO: 32651 - DNA, 25 bp, Mus musculus
aaccattagtaaagagatcctaaac

SEQ ID NO: 32652 - DNA, 25 bp, Mus musculus
aaccattagtaatgagatcctaaac

SEQ ID NO: 32653 - DNA, 25 bp, Mus musculus
aaccattataaacaaccttatcaca

SEQ ID NO: 32654 - DNA, 25 bp, Mus musculus
aaccattataaagaaccttatcaca

SEQ ID NO: 32655 - DNA, 25 bp, Mus musculus
aaccattatactaccttctctgtac

SEQ ID NO: 32656 - DNA, 25 bp, Mus musculus
aaccattatacttccttctctgtac

SEQ ID NO: 32657 - DNA, 25 bp, Mus musculus
aaccattatattctccacaactcat

SEQ ID NO: 32658 - DNA, 25 bp, Mus musculus
aaccattatattgtccacaactcat

SEQ ID NO: 32659 - DNA, 25 bp, Mus musculus
aaccattcacagaacttctataggc

SEQ ID NO: 32660 - DNA, 25 bp, Mus musculus
aaccattcacagtacttctataggc

SEQ ID NO: 32661 - DNA, 25 bp, Mus musculus
aaccattcaggcagtacacctgcac

SEQ ID NO: 32662 - DNA, 25 bp, Mus musculus
aaccattcaggctgtacacctgcac

SEQ ID NO: 32663 - DNA, 25 bp, Mus musculus
aaccattcagttagcaggagacata

SEQ ID NO: 32664 - DNA, 25 bp, Mus musculus
aaccattcagtttgcaggagacata

SEQ ID NO: 32665 - DNA, 25 bp, Mus musculus
aaccattcatatccagtgagtgcgg

SEQ ID NO: 32666 - DNA, 25 bp, Mus musculus
aaccattcatatgcagtgagtgcgg

SEQ ID NO: 32667 - DNA, 25 bp, Mus musculus
aaccattcatggaagacctaagggt

SEQ ID NO: 32668 - DNA, 25 bp, Mus musculus
aaccattcatggtagacctaagggt

SEQ ID NO: 32669 - DNA, 25 bp, Mus musculus
aaccattcattgctaccttgcttat

SEQ ID NO: 32670 - DNA, 25 bp, Mus musculus
aaccattcattggtaccttgcttat

SEQ ID NO: 32671 - DNA, 25 bp, Mus musculus
aaccattcctcccatagtcaatgat

SEQ ID NO: 32672 - DNA, 25 bp, Mus musculus
aaccattcctccgatagtcaatgat

SEQ ID NO: 32673 - DNA, 25 bp, Mus musculus
aaccattctgtgaagggtccctaga

SEQ ID NO: 32674 - DNA, 25 bp, Mus musculus
aaccattctgtgtagggtccctaga

SEQ ID NO: 32675 - DNA, 25 bp, Mus musculus
aaccattgagtaaatcggcctgcct

SEQ ID NO: 32676 - DNA, 25 bp, Mus musculus
aaccattgagtaccaacagtgccaa

SEQ ID NO: 32677 - DNA, 25 bp, Mus musculus
aaccattgagtagcaacagtgccaa

SEQ ID NO: 32678 - DNA, 25 bp, Mus musculus
aaccattgagtatatcggcctgcct

SEQ ID NO: 32679 - DNA, 25 bp, Mus musculus
aaccattgagtcagccaatctctct

SEQ ID NO: 32680 - DNA, 25 bp, Mus musculus
aaccattgagtctgccaatctctct

SEQ ID NO: 32681 - DNA, 25 bp, Mus musculus
aaccattgctctagggtatgctcca

SEQ ID NO: 32682 - DNA, 25 bp, Mus musculus
aaccattgctcttgggtatgctcca

SEQ ID NO: 32683 - DNA, 25 bp, Mus musculus
aaccattgctttaacttctgttgtc

SEQ ID NO: 32684 - DNA, 25 bp, Mus musculus
aaccattgcttttacttctgttgtc

SEQ ID NO: 32685 - DNA, 25 bp, Mus musculus
aaccattggccgcttgagttcagag

SEQ ID NO: 32686 - DNA, 25 bp, Mus musculus
aaccattggccggttgagttcagag

SEQ ID NO: 32687 - DNA, 25 bp, Mus musculus
aaccattggctgagactgcacaaca

SEQ ID NO: 32688 - DNA, 25 bp, Mus musculus
aaccattggctgtgactgcacaaca

SEQ ID NO: 32689 - DNA, 25 bp, Mus musculus
aaccattggtacctcacgtaaacat

SEQ ID NO: 32690 - DNA, 25 bp, Mus musculus
aaccattggtacgtcacgtaaacat

SEQ ID NO: 32691 - DNA, 25 bp, Mus musculus
aaccattgtaggcttgagcatttat

SEQ ID NO: 32692 - DNA, 25 bp, Mus musculus
aaccattgtagggttgagcatttat

SEQ ID NO: 32693 - DNA, 25 bp, Mus musculus
aaccattgtatgaccgttaaccaag

SEQ ID NO: 32694 - DNA, 25 bp, Mus musculus
aaccattgtatgtccgttaaccaag

SEQ ID NO: 32695 - DNA, 25 bp, Mus musculus
aaccattgtgaactgcgcagctcaa

SEQ ID NO: 32696 - DNA, 25 bp, Mus musculus
aaccattgtgaagtgcgcagctcaa

SEQ ID NO: 32697 - DNA, 25 bp, Mus musculus
aaccattgttagcatgcacatctgt

SEQ ID NO: 32698 - DNA, 25 bp, Mus musculus
aaccattgttaggatgcacatctgt

SEQ ID NO: 32699 - DNA, 25 bp, Mus musculus
aaccatttagcgctttctgagcata

SEQ ID NO: 32700 - DNA, 25 bp, Mus musculus
aaccatttagcggtttctgagcata

SEQ ID NO: 32701 - DNA, 25 bp, Mus musculus
aaccatttctggattctcacagaga

SEQ ID NO: 32702 - DNA, 25 bp, Mus musculus
aaccatttctggtttctcacagaga

SEQ ID NO: 32703 - DNA, 25 bp, Mus musculus
aaccatttcttaatctcctcagaca

SEQ ID NO: 32704 - DNA, 25 bp, Mus musculus
aaccatttcttacattcatcgagca

SEQ ID NO: 32705 - DNA, 25 bp, Mus musculus
aaccatttcttagattcatcgagca

SEQ ID NO: 32706 - DNA, 25 bp, Mus musculus
aaccatttcttattctcctcagaca

SEQ ID NO: 32707 - DNA, 25 bp, Mus musculus
aaccatttcttcatactgtcagtac

SEQ ID NO: 32708 - DNA, 25 bp, Mus musculus
aaccatttcttcttactgtcagtac

SEQ ID NO: 32709 - DNA, 25 bp, Mus musculus
aaccatttgaatctttctgctgttt

SEQ ID NO: 32710 - DNA, 25 bp, Mus musculus
aaccatttgaatgtttctgctgttt

SEQ ID NO: 32711 - DNA, 25 bp, Mus musculus
aaccatttgctaacgtttagacttt

SEQ ID NO: 32712 - DNA, 25 bp, Mus musculus
aaccatttgctatcgtttagacttt

SEQ ID NO: 32713 - DNA, 25 bp, Mus musculus
aaccatttgctcatgatcctgctca

SEQ ID NO: 32714 - DNA, 25 bp, Mus musculus
aaccatttgctcttgatcctgctca

SEQ ID NO: 32715 - DNA, 25 bp, Mus musculus
aaccatttggacagtagtgctcaca

SEQ ID NO: 32716 - DNA, 25 bp, Mus musculus
aaccatttggactgtagtgctcaca

SEQ ID NO: 32717 - DNA, 25 bp, Mus musculus
aaccatttgtatccggcatcactta

SEQ ID NO: 32718 - DNA, 25 bp, Mus musculus
aaccatttgtatccgtgccaggtgc

SEQ ID NO: 32719 - DNA, 25 bp, Mus musculus
aaccatttgtatgcggcatcactta

SEQ ID NO: 32720 - DNA, 25 bp, Mus musculus
aaccatttgtatgcgtgccaggtgc

SEQ ID NO: 32721 - DNA, 25 bp, Mus musculus
aaccatttgtccatacagggcttag

SEQ ID NO: 32722 - DNA, 25 bp, Mus musculus
aaccatttgtccttacagggcttag

SEQ ID NO: 32723 - DNA, 25 bp, Mus musculus
aaccattttattccctttgtcactg

SEQ ID NO: 32724 - DNA, 25 bp, Mus musculus
aaccattttattgcctttgtcactg

SEQ ID NO: 32725 - DNA, 25 bp, Mus musculus
aaccattttcttaagtggatgagcc

SEQ ID NO: 32726 - DNA, 25 bp, Mus musculus
aaccattttcttcagatcagggcag

SEQ ID NO: 32727 - DNA, 25 bp, Mus musculus
aaccattttcttgagatcagggcag

SEQ ID NO: 32728 - DNA, 25 bp, Mus musculus
aaccattttctttagtggatgagcc

SEQ ID NO: 32729 - DNA, 25 bp, Mus musculus
aaccattttgagagttggccctggc

SEQ ID NO: 32730 - DNA, 25 bp, Mus musculus
aaccattttgagtgttggccctggc

SEQ ID NO: 32731 - DNA, 25 bp, Mus musculus
aacccaaacagtataagcccatctt

SEQ ID NO: 32732 - DNA, 25 bp, Mus musculus
aacccaaacagtttaagcccatctt

SEQ ID NO: 32733 - DNA, 25 bp, Mus musculus
aacccaaactgcagctgagttcaga

SEQ ID NO: 32734 - DNA, 25 bp, Mus musculus
aacccaaactgctgctgagttcaga

SEQ ID NO: 32735 - DNA, 25 bp, Mus musculus
aacccaaagctgcacttcaggcact

SEQ ID NO: 32736 - DNA, 25 bp, Mus musculus
aacccaaagctggacttcaggcact

SEQ ID NO: 32737 - DNA, 25 bp, Mus musculus
aacccaaagtccacatactgcactt

SEQ ID NO: 32738 - DNA, 25 bp, Mus musculus
aacccaaagtcctcatactgcactt

SEQ ID NO: 32739 - DNA, 25 bp, Mus musculus
aacccaaagttgatcgtgcccagca

SEQ ID NO: 32740 - DNA, 25 bp, Mus musculus
aacccaaagttgttcgtgcccagca

SEQ ID NO: 32741 - DNA, 25 bp, Mus musculus
aacccaaatatcctgaactgtgcgt

SEQ ID NO: 32742 - DNA, 25 bp, Mus musculus
aacccaaatatcgtgaactgtgcgt

SEQ ID NO: 32743 - DNA, 25 bp, Mus musculus
aacccaaatgatcctggtgcgtgca

SEQ ID NO: 32744 - DNA, 25 bp, Mus musculus
aacccaaatgatgctggtgcgtgca

SEQ ID NO: 32745 - DNA, 25 bp, Mus musculus
aacccaaatgtgaggcatcagtgac

SEQ ID NO: 32746 - DNA, 25 bp, Mus musculus
aacccaaatgtgattgatggcactt

SEQ ID NO: 32747 - DNA, 25 bp, Mus musculus
aacccaaatgtgtggcatcagtgac

SEQ ID NO: 32748 - DNA, 25 bp, Mus musculus
aacccaaatgtgtttgatggcactt

SEQ ID NO: 32749 - DNA, 25 bp, Mus musculus
aacccaaattctaatgcagtaaatg

SEQ ID NO: 32750 - DNA, 25 bp, Mus musculus
aacccaaattcttatgcagtaaatg

SEQ ID NO: 32751 - DNA, 25 bp, Mus musculus
aacccaaattggagtcactgatgac

SEQ ID NO: 32752 - DNA, 25 bp, Mus musculus
aacccaaattggtgtcactgatgac

SEQ ID NO: 32753 - DNA, 25 bp, Mus musculus
aacccaacactcacattaatctcag

SEQ ID NO: 32754 - DNA, 25 bp, Mus musculus
aacccaacactctcattaatctcag

SEQ ID NO: 32755 - DNA, 25 bp, Mus musculus
aacccaaccagaatgagtttcctga

SEQ ID NO: 32756 - DNA, 25 bp, Mus musculus
aacccaaccagattgagtttcctga

SEQ ID NO: 32757 - DNA, 25 bp, Mus musculus
aacccaacctgtcgcctggactggg

SEQ ID NO: 32758 - DNA, 25 bp, Mus musculus
aacccaacctgtggcctggactggg

SEQ ID NO: 32759 - DNA, 25 bp, Mus musculus
aacccaagaacgcaatctagcaaga

SEQ ID NO: 32760 - DNA, 25 bp, Mus musculus
aacccaagaacggaatctagcaaga

SEQ ID NO: 32761 - DNA, 25 bp, Mus musculus
aacccaagagagagatgaactgcct

SEQ ID NO: 32762 - DNA, 25 bp, Mus musculus
aacccaagagagatgctgcgatgca

SEQ ID NO: 32763 - DNA, 25 bp, Mus musculus
aacccaagagagtgatgaactgcct

SEQ ID NO: 32764 - DNA, 25 bp, Mus musculus
aacccaagagagttgctgcgatgca

SEQ ID NO: 32765 - DNA, 25 bp, Mus musculus
aacccaagagttcgtgctgtgttcc

SEQ ID NO: 32766 - DNA, 25 bp, Mus musculus
aacccaagagttggtgctgtgttcc

SEQ ID NO: 32767 - DNA, 25 bp, Mus musculus
aacccaagcctgagtggattttgaa

SEQ ID NO: 32768 - DNA, 25 bp, Mus musculus
aacccaagcctgtgtggattttgaa

SEQ ID NO: 32769 - DNA, 25 bp, Mus musculus
aacccaagctaccattttcaccaat

SEQ ID NO: 32770 - DNA, 25 bp, Mus musculus
aacccaagctacgattttcaccaat

SEQ ID NO: 32771 - DNA, 25 bp, Mus musculus
aacccaagggatactctgggatttg

SEQ ID NO: 32772 - DNA, 25 bp, Mus musculus
aacccaagggattctctgggatttg

SEQ ID NO: 32773 - DNA, 25 bp, Mus musculus
aacccaagggttatgtcatcctact

SEQ ID NO: 32774 - DNA, 25 bp, Mus musculus
aacccaagggttttgtcatcctact

SEQ ID NO: 32775 - DNA, 25 bp, Mus musculus
aacccaatccgaaatgtcaatctga

SEQ ID NO: 32776 - DNA, 25 bp, Mus musculus
aacccaatccgatatgtcaatctga

SEQ ID NO: 32777 - DNA, 25 bp, Mus musculus
aacccaatggtgacacaattgacta

SEQ ID NO: 32778 - DNA, 25 bp, Mus musculus
aacccaatggtgtcacaattgacta

SEQ ID NO: 32779 - DNA, 25 bp, Mus musculus
aacccaattcatatgttgtacagat

SEQ ID NO: 32780 - DNA, 25 bp, Mus musculus
aacccaattcatttgttgtacagat

SEQ ID NO: 32781 - DNA, 25 bp, Mus musculus
aacccacaaactattatacatacgt

SEQ ID NO: 32782 - DNA, 25 bp, Mus musculus
aacccacaaacttttatacatacgt

SEQ ID NO: 32783 - DNA, 25 bp, Mus musculus
aacccacaagctatgtctcgggaag

SEQ ID NO: 32784 - DNA, 25 bp, Mus musculus
aacccacaagctttgtctcgggaag

SEQ ID NO: 32785 - DNA, 25 bp, Mus musculus
aacccacaatatactgcttgcctag

SEQ ID NO: 32786 - DNA, 25 bp, Mus musculus
aacccacaatattctgcttgcctag

SEQ ID NO: 32787 - DNA, 25 bp, Mus musculus
aacccacacaatagaattgcctttg

SEQ ID NO: 32788 - DNA, 25 bp, Mus musculus
aacccacacaattgaattgcctttg

SEQ ID NO: 32789 - DNA, 25 bp, Mus musculus
aacccacacactatattcagctatg

SEQ ID NO: 32790 - DNA, 25 bp, Mus musculus
aacccacacactttattcagctatg

SEQ ID NO: 32791 - DNA, 25 bp, Mus musculus
aacccacacgatatctctgaattag

SEQ ID NO: 32792 - DNA, 25 bp, Mus musculus
aacccacacgatttctctgaattag

SEQ ID NO: 32793 - DNA, 25 bp, Mus musculus
aacccacagcataatgggagcagct

SEQ ID NO: 32794 - DNA, 25 bp, Mus musculus
aacccacagcattatgggagcagct

SEQ ID NO: 32795 - DNA, 25 bp, Mus musculus
aacccacagtagcatcttggacaaa

SEQ ID NO: 32796 - DNA, 25 bp, Mus musculus
aacccacagtaggatcttggacaaa

SEQ ID NO: 32797 - DNA, 25 bp, Mus musculus
aacccacataaacactgctccttaa

SEQ ID NO: 32798 - DNA, 25 bp, Mus musculus
aacccacataaagactgctccttaa

SEQ ID NO: 32799 - DNA, 25 bp, Mus musculus
aacccacataggagcttcacaacca

SEQ ID NO: 32800 - DNA, 25 bp, Mus musculus
aacccacataggtgcttcacaacca

SEQ ID NO: 32801 - DNA, 25 bp, Mus musculus
aacccacattggctctatgtaagaa

SEQ ID NO: 32802 - DNA, 25 bp, Mus musculus
aacccacattgggtctatgtaagaa

SEQ ID NO: 32803 - DNA, 25 bp, Mus musculus
aacccacattgtattggctatttct

SEQ ID NO: 32804 - DNA, 25 bp, Mus musculus
aacccacattgttttggctatttct

SEQ ID NO: 32805 - DNA, 25 bp, Mus musculus
aacccacatttccttatttcagttg

SEQ ID NO: 32806 - DNA, 25 bp, Mus musculus
aacccacatttcgttatttcagttg

SEQ ID NO: 32807 - DNA, 25 bp, Mus musculus
aacccaccaacactagatttgcaga

SEQ ID NO: 32808 - DNA, 25 bp, Mus musculus
aacccaccaacagtagatttgcaga

SEQ ID NO: 32809 - DNA, 25 bp, Mus musculus
aacccaccatatcctttaaacagat

SEQ ID NO: 32810 - DNA, 25 bp, Mus musculus
aacccaccatatgctttaaacagat

SEQ ID NO: 32811 - DNA, 25 bp, Mus musculus
aacccaccatggatgctgattttat

SEQ ID NO: 32812 - DNA, 25 bp, Mus musculus
aacccaccatggttgctgattttat

SEQ ID NO: 32813 - DNA, 25 bp, Mus musculus
aacccaccctaaaattttgatctgt

SEQ ID NO: 32814 - DNA, 25 bp, Mus musculus
aacccaccctaatattttgatctgt

SEQ ID NO: 32815 - DNA, 25 bp, Mus musculus
aacccacccttacctggaggagctg

SEQ ID NO: 32816 - DNA, 25 bp, Mus musculus
aacccacccttagctggaggagctg

SEQ ID NO: 32817 - DNA, 25 bp, Mus musculus
aacccacctaatctatacctctata

SEQ ID NO: 32818 - DNA, 25 bp, Mus musculus
aacccacctaatgtatacctctata

SEQ ID NO: 32819 - DNA, 25 bp, Mus musculus
aacccaccttgtatctctgtcaaat

SEQ ID NO: 32820 - DNA, 25 bp, Mus musculus
aacccaccttgtttctctgtcaaat

SEQ ID NO: 32821 - DNA, 25 bp, Mus musculus
aacccacgataaactgcttgcaggg

SEQ ID NO: 32822 - DNA, 25 bp, Mus musculus
aacccacgataatctgcttgcaggg

SEQ ID NO: 32823 - DNA, 25 bp, Mus musculus
aacccacggatgatatatcttcctt

SEQ ID NO: 32824 - DNA, 25 bp, Mus musculus
aacccacggatgttatatcttcctt

SEQ ID NO: 32825 - DNA, 25 bp, Mus musculus
aacccacgggcaaagcagtgttcag

SEQ ID NO: 32826 - DNA, 25 bp, Mus musculus
aacccacgggcatagcagtgttcag

SEQ ID NO: 32827 - DNA, 25 bp, Mus musculus
aacccactcagaatggtgttaacag

SEQ ID NO: 32828 - DNA, 25 bp, Mus musculus
aacccactcagattggtgttaacag

SEQ ID NO: 32829 - DNA, 25 bp, Mus musculus
aacccactcctgaattccatgagaa

SEQ ID NO: 32830 - DNA, 25 bp, Mus musculus
aacccactcctgcaagttttgaatc

SEQ ID NO: 32831 - DNA, 25 bp, Mus musculus
aacccactcctggaagttttgaatc

SEQ ID NO: 32832 - DNA, 25 bp, Mus musculus
aacccactcctgtattccatgagaa

SEQ ID NO: 32833 - DNA, 25 bp, Mus musculus
aacccactctacagatcacttttga

SEQ ID NO: 32834 - DNA, 25 bp, Mus musculus
aacccactctactgatcacttttga

SEQ ID NO: 32835 - DNA, 25 bp, Mus musculus
aacccactctctaggagctgatgtt

SEQ ID NO: 32836 - DNA, 25 bp, Mus musculus
aacccactctcttggagctgatgtt

SEQ ID NO: 32837 - DNA, 25 bp, Mus musculus
aacccactcttcagtgcatgtatgt

SEQ ID NO: 32838 - DNA, 25 bp, Mus musculus
aacccactcttctgtgcatgtatgt

SEQ ID NO: 32839 - DNA, 25 bp, Mus musculus
aacccactctttcctatgttagagt

SEQ ID NO: 32840 - DNA, 25 bp, Mus musculus
aacccactctttgctatgttagagt

SEQ ID NO: 32841 - DNA, 25 bp, Mus musculus
aacccactgatacttgctgtacttg

SEQ ID NO: 32842 - DNA, 25 bp, Mus musculus
aacccactgatagttgctgtacttg

SEQ ID NO: 32843 - DNA, 25 bp, Mus musculus
aacccactgctcaaaaggattacat

SEQ ID NO: 32844 - DNA, 25 bp, Mus musculus
aacccactgctcaatgtgttcacat

SEQ ID NO: 32845 - DNA, 25 bp, Mus musculus
aacccactgctctaaaggattacat

SEQ ID NO: 32846 - DNA, 25 bp, Mus musculus
aacccactgctctatgtgttcacat

SEQ ID NO: 32847 - DNA, 25 bp, Mus musculus
aacccactggtacaatgcctgatag

SEQ ID NO: 32848 - DNA, 25 bp, Mus musculus
aacccactggtagaatgcctgatag

SEQ ID NO: 32849 - DNA, 25 bp, Mus musculus
aacccactgtagattctgacttatg

SEQ ID NO: 32850 - DNA, 25 bp, Mus musculus
aacccactgtagtttctgacttatg

SEQ ID NO: 32851 - DNA, 25 bp, Mus musculus
aacccactttgtactcataagaata

SEQ ID NO: 32852 - DNA, 25 bp, Mus musculus
aacccactttgttctcataagaata

SEQ ID NO: 32853 - DNA, 25 bp, Mus musculus
aacccagaaatacacttccacagac

SEQ ID NO: 32854 - DNA, 25 bp, Mus musculus
aacccagaaatagacttccacagac

SEQ ID NO: 32855 - DNA, 25 bp, Mus musculus
aacccagaacagaacccattcttca

SEQ ID NO: 32856 - DNA, 25 bp, Mus musculus
aacccagaacagtacccattcttca

SEQ ID NO: 32857 - DNA, 25 bp, Mus musculus
aacccagaaccacgaaatggatgag

SEQ ID NO: 32858 - DNA, 25 bp, Mus musculus
aacccagaaccaggaaatggatgag

SEQ ID NO: 32859 - DNA, 25 bp, Mus musculus
aacccagaatcccaagcggcaggag

SEQ ID NO: 32860 - DNA, 25 bp, Mus musculus
aacccagaatccgaagcggcaggag

SEQ ID NO: 32861 - DNA, 25 bp, Mus musculus
aacccagaatctaaggcagcagcta

SEQ ID NO: 32862 - DNA, 25 bp, Mus musculus
aacccagaatctactgacatgactg

SEQ ID NO: 32863 - DNA, 25 bp, Mus musculus
aacccagaatcttaggcagcagcta

SEQ ID NO: 32864 - DNA, 25 bp, Mus musculus
aacccagaatcttctgacatgactg

SEQ ID NO: 32865 - DNA, 25 bp, Mus musculus
aacccagaattgctaccacaagctg

SEQ ID NO: 32866 - DNA, 25 bp, Mus musculus
aacccagaattggtaccacaagctg

SEQ ID NO: 32867 - DNA, 25 bp, Mus musculus
aacccagacagcatttgtgatgttt

SEQ ID NO: 32868 - DNA, 25 bp, Mus musculus
aacccagacagcttttgtgatgttt

SEQ ID NO: 32869 - DNA, 25 bp, Mus musculus
aacccagacagtcattttcctttag

SEQ ID NO: 32870 - DNA, 25 bp, Mus musculus
aacccagacagtgattttcctttag

SEQ ID NO: 32871 - DNA, 25 bp, Mus musculus
aacccagacctgctccagcaggaaa

SEQ ID NO: 32872 - DNA, 25 bp, Mus musculus
aacccagacctggtccagcaggaaa

SEQ ID NO: 32873 - DNA, 25 bp, Mus musculus
aacccagactgtcaactgcatcctt

SEQ ID NO: 32874 - DNA, 25 bp, Mus musculus
aacccagactgtgaactgcatcctt

SEQ ID NO: 32875 - DNA, 25 bp, Mus musculus
aacccagacttacttcttagcactc

SEQ ID NO: 32876 - DNA, 25 bp, Mus musculus
aacccagacttagttcttagcactc

SEQ ID NO: 32877 - DNA, 25 bp, Mus musculus
aacccagagaacagctgccagcggt

SEQ ID NO: 32878 - DNA, 25 bp, Mus musculus
aacccagagaactgctgccagcggt

SEQ ID NO: 32879 - DNA, 25 bp, Mus musculus
aacccagagcatcctgtgacctgaa

SEQ ID NO: 32880 - DNA, 25 bp, Mus musculus
aacccagagcatgctgtgacctgaa

SEQ ID NO: 32881 - DNA, 25 bp, Mus musculus
aacccagagcttcagtagttccaaa

SEQ ID NO: 32882 - DNA, 25 bp, Mus musculus
aacccagagcttgagtagttccaaa

SEQ ID NO: 32883 - DNA, 25 bp, Mus musculus
aacccagaggtacctcaaatggagt

SEQ ID NO: 32884 - DNA, 25 bp, Mus musculus
aacccagaggtagctcaaatggagt

SEQ ID NO: 32885 - DNA, 25 bp, Mus musculus
aacccagaggtgagagcttggaagc

SEQ ID NO: 32886 - DNA, 25 bp, Mus musculus
aacccagaggtgtgagcttggaagc

SEQ ID NO: 32887 - DNA, 25 bp, Mus musculus
aacccagatactaaccttgttatca

SEQ ID NO: 32888 - DNA, 25 bp, Mus musculus
aacccagatacttaccttgttatca

SEQ ID NO: 32889 - DNA, 25 bp, Mus musculus
aacccagatataactcttgtgcagt

SEQ ID NO: 32890 - DNA, 25 bp, Mus musculus
aacccagatatatctcttgtgcagt

SEQ ID NO: 32891 - DNA, 25 bp, Mus musculus
aacccagatcacatctattgcctga

SEQ ID NO: 32892 - DNA, 25 bp, Mus musculus
aacccagatcacttctattgcctga

SEQ ID NO: 32893 - DNA, 25 bp, Mus musculus
aacccagatcagactaagtccagca

SEQ ID NO: 32894 - DNA, 25 bp, Mus musculus
aacccagatcagtctaagtccagca

SEQ ID NO: 32895 - DNA, 25 bp, Mus musculus
aacccagatccaacatttcccttag

SEQ ID NO: 32896 - DNA, 25 bp, Mus musculus
aacccagatccaccagtatctagag

SEQ ID NO: 32897 - DNA, 25 bp, Mus musculus
aacccagatccagcagtatctagag

SEQ ID NO: 32898 - DNA, 25 bp, Mus musculus
aacccagatccatcatttcccttag

SEQ ID NO: 32899 - DNA, 25 bp, Mus musculus
aacccagatgagattgctgtcgctc

SEQ ID NO: 32900 - DNA, 25 bp, Mus musculus
aacccagatgagtttgctgtcgctc

SEQ ID NO: 32901 - DNA, 25 bp, Mus musculus
aacccagatgccaccttctgaaaga

SEQ ID NO: 32902 - DNA, 25 bp, Mus musculus
aacccagatgcctccttctgaaaga

SEQ ID NO: 32903 - DNA, 25 bp, Mus musculus
aacccagcaagcatgttggaggtgg

SEQ ID NO: 32904 - DNA, 25 bp, Mus musculus
aacccagcaagcttgttggaggtgg

SEQ ID NO: 32905 - DNA, 25 bp, Mus musculus
aacccagcaagtagattggcggccg

SEQ ID NO: 32906 - DNA, 25 bp, Mus musculus
aacccagcaagttgattggcggccg

SEQ ID NO: 32907 - DNA, 25 bp, Mus musculus
aacccagcacacattttgatgacac

SEQ ID NO: 32908 - DNA, 25 bp, Mus musculus
aacccagcacactttttgatgacac

SEQ ID NO: 32909 - DNA, 25 bp, Mus musculus
aacccagcagcacatcttacaggag

SEQ ID NO: 32910 - DNA, 25 bp, Mus musculus
aacccagcagcacgttcctacccag

SEQ ID NO: 32911 - DNA, 25 bp, Mus musculus
aacccagcagcagatcttacaggag

SEQ ID NO: 32912 - DNA, 25 bp, Mus musculus
aacccagcagcaggttcctacccag

SEQ ID NO: 32913 - DNA, 25 bp, Mus musculus
aacccagcagggatcagtagctcaa

SEQ ID NO: 32914 - DNA, 25 bp, Mus musculus
aacccagcagggttcagtagctcaa

SEQ ID NO: 32915 - DNA, 25 bp, Mus musculus
aacccagcatgaacctgataccacg

SEQ ID NO: 32916 - DNA, 25 bp, Mus musculus
aacccagcatgatcctgataccacg

SEQ ID NO: 32917 - DNA, 25 bp, Mus musculus
aacccagcatgcacaaaagtactat

SEQ ID NO: 32918 - DNA, 25 bp, Mus musculus
aacccagcatgctcaaaagtactat

SEQ ID NO: 32919 - DNA, 25 bp, Mus musculus
aacccagcatgtacctgttaccaag

SEQ ID NO: 32920 - DNA, 25 bp, Mus musculus
aacccagcatgttcctgttaccaag

SEQ ID NO: 32921 - DNA, 25 bp, Mus musculus
aacccagcattcatttggaaggtgg

SEQ ID NO: 32922 - DNA, 25 bp, Mus musculus
aacccagcattcttttggaaggtgg

SEQ ID NO: 32923 - DNA, 25 bp, Mus musculus
aacccagcatttataagctcctaat

SEQ ID NO: 32924 - DNA, 25 bp, Mus musculus
aacccagcatttctcctgtgggaca

SEQ ID NO: 32925 - DNA, 25 bp, Mus musculus
aacccagcatttgtcctgtgggaca

SEQ ID NO: 32926 - DNA, 25 bp, Mus musculus
aacccagcatttttaagctcctaat

SEQ ID NO: 32927 - DNA, 25 bp, Mus musculus
aacccagccctcagagacaaaagaa

SEQ ID NO: 32928 - DNA, 25 bp, Mus musculus
aacccagccctctgagacaaaagaa

SEQ ID NO: 32929 - DNA, 25 bp, Mus musculus
aacccagccgccagaggagcctgta

SEQ ID NO: 32930 - DNA, 25 bp, Mus musculus
aacccagccgcctgaggagcctgta

SEQ ID NO: 32931 - DNA, 25 bp, Mus musculus
aacccagccgttaatatgaaattgt

SEQ ID NO: 32932 - DNA, 25 bp, Mus musculus
aacccagccgtttatatgaaattgt

SEQ ID NO: 32933 - DNA, 25 bp, Mus musculus
aacccagccttcagcttatatgttc

SEQ ID NO: 32934 - DNA, 25 bp, Mus musculus
aacccagccttctgcttatatgttc

SEQ ID NO: 32935 - DNA, 25 bp, Mus musculus
aacccagccttgaatcttcttcaga

SEQ ID NO: 32936 - DNA, 25 bp, Mus musculus
aacccagccttgtatcttcttcaga

SEQ ID NO: 32937 - DNA, 25 bp, Mus musculus
aacccagcgagcctttgacaagtat

SEQ ID NO: 32938 - DNA, 25 bp, Mus musculus
aacccagcgagcgtttgacaagtat

SEQ ID NO: 32939 - DNA, 25 bp, Mus musculus
aacccagcggctcccagttcaaaaa

SEQ ID NO: 32940 - DNA, 25 bp, Mus musculus
aacccagcggctgccagttcaaaaa

SEQ ID NO: 32941 - DNA, 25 bp, Mus musculus
aacccagcgtctacctatacagttc

SEQ ID NO: 32942 - DNA, 25 bp, Mus musculus
aacccagcgtcttcctatacagttc

SEQ ID NO: 32943 - DNA, 25 bp, Mus musculus
aacccagctcagaacttctgtattt

SEQ ID NO: 32944 - DNA, 25 bp, Mus musculus
aacccagctcagtacttctgtattt

SEQ ID NO: 32945 - DNA, 25 bp, Mus musculus
aacccagctccaacacgatgaaaag

SEQ ID NO: 32946 - DNA, 25 bp, Mus musculus
aacccagctccatcacgatgaaaag

SEQ ID NO: 32947 - DNA, 25 bp, Mus musculus
aacccagctgtaccgtgcgccaggg

SEQ ID NO: 32948 - DNA, 25 bp, Mus musculus
aacccagctgtagcgtgcgccaggg

SEQ ID NO: 32949 - DNA, 25 bp, Mus musculus
aacccagcttgaaggcatgtgccgt

SEQ ID NO: 32950 - DNA, 25 bp, Mus musculus
aacccagcttgatggcatgtgccgt

SEQ ID NO: 32951 - DNA, 25 bp, Mus musculus
aacccagctttcagaagtggctgct

SEQ ID NO: 32952 - DNA, 25 bp, Mus musculus
aacccagctttctgaagtggctgct

SEQ ID NO: 32953 - DNA, 25 bp, Mus musculus
aacccaggagtgctgggtctatgct

SEQ ID NO: 32954 - DNA, 25 bp, Mus musculus
aacccaggagtggtgggtctatgct

SEQ ID NO: 32955 - DNA, 25 bp, Mus musculus
aacccaggcaaacagatcatccagt

SEQ ID NO: 32956 - DNA, 25 bp, Mus musculus
aacccaggcaaagagatcatccagt

SEQ ID NO: 32957 - DNA, 25 bp, Mus musculus
aacccaggcaggcaactaattctgt

SEQ ID NO: 32958 - DNA, 25 bp, Mus musculus
aacccaggcagggaactaattctgt

SEQ ID NO: 32959 - DNA, 25 bp, Mus musculus
aacccaggcctgaggcggaatgtgc

SEQ ID NO: 32960 - DNA, 25 bp, Mus musculus
aacccaggcctgtggcggaatgtgc

SEQ ID NO: 32961 - DNA, 25 bp, Mus musculus
aacccaggctgtcatggaactccag

SEQ ID NO: 32962 - DNA, 25 bp, Mus musculus
aacccaggctgtgatggaactccag

SEQ ID NO: 32963 - DNA, 25 bp, Mus musculus
aacccagggcaactcccacagtaag

SEQ ID NO: 32964 - DNA, 25 bp, Mus musculus
aacccagggcaagtcccacagtaag

SEQ ID NO: 32965 - DNA, 25 bp, Mus musculus
aacccagggcctctttcatgttagg

SEQ ID NO: 32966 - DNA, 25 bp, Mus musculus
aacccagggcctgtttcatgttagg

SEQ ID NO: 32967 - DNA, 25 bp, Mus musculus
aacccagggcgtccagatccagaag

SEQ ID NO: 32968 - DNA, 25 bp, Mus musculus
aacccagggcgtgcagatccagaag

SEQ ID NO: 32969 - DNA, 25 bp, Mus musculus
aacccagggcttagcgcttaccatt

SEQ ID NO: 32970 - DNA, 25 bp, Mus musculus
aacccagggcttcctacgtgtgact

SEQ ID NO: 32971 - DNA, 25 bp, Mus musculus
aacccagggcttgctacgtgtgact

SEQ ID NO: 32972 - DNA, 25 bp, Mus musculus
aacccagggctttgcgcttaccatt

SEQ ID NO: 32973 - DNA, 25 bp, Mus musculus
aacccagggtagacagactgctgtg

SEQ ID NO: 32974 - DNA, 25 bp, Mus musculus
aacccagggtagtcagactgctgtg

SEQ ID NO: 32975 - DNA, 25 bp, Mus musculus
aacccagggtctcggcccaggctga

SEQ ID NO: 32976 - DNA, 25 bp, Mus musculus
aacccagggtctgggcccaggctga

SEQ ID NO: 32977 - DNA, 25 bp, Mus musculus
aacccagggttgatgtacaaagctg

SEQ ID NO: 32978 - DNA, 25 bp, Mus musculus
aacccagggttgttgtacaaagctg

SEQ ID NO: 32979 - DNA, 25 bp, Mus musculus
aacccaggttgtaagtcttcacacg

SEQ ID NO: 32980 - DNA, 25 bp, Mus musculus
aacccaggttgttagtcttcacacg

SEQ ID NO: 32981 - DNA, 25 bp, Mus musculus
aacccaggttttacatacatggtag

SEQ ID NO: 32982 - DNA, 25 bp, Mus musculus
aacccaggtttttcatacatggtag

SEQ ID NO: 32983 - DNA, 25 bp, Mus musculus
aacccagtacctcactacgagctta

SEQ ID NO: 32984 - DNA, 25 bp, Mus musculus
aacccagtacctgactacgagctta

SEQ ID NO: 32985 - DNA, 25 bp, Mus musculus
aacccagtatagagggctgcaggag

SEQ ID NO: 32986 - DNA, 25 bp, Mus musculus
aacccagtatagtgggctgcaggag

SEQ ID NO: 32987 - DNA, 25 bp, Mus musculus
aacccagtatggaccatgagaccct

SEQ ID NO: 32988 - DNA, 25 bp, Mus musculus
aacccagtatggtccatgagaccct

SEQ ID NO: 32989 - DNA, 25 bp, Mus musculus
aacccagtattaaacctatgactat

SEQ ID NO: 32990 - DNA, 25 bp, Mus musculus
aacccagtattatacctatgactat

SEQ ID NO: 32991 - DNA, 25 bp, Mus musculus
aacccagtcacaatattttctctag

SEQ ID NO: 32992 - DNA, 25 bp, Mus musculus
aacccagtcacattattttctctag

SEQ ID NO: 32993 - DNA, 25 bp, Mus musculus
aacccagtcctcagcgagagcttgt

SEQ ID NO: 32994 - DNA, 25 bp, Mus musculus
aacccagtcctctgcgagagcttgt

SEQ ID NO: 32995 - DNA, 25 bp, Mus musculus
aacccagtccttcagtggactgaga

SEQ ID NO: 32996 - DNA, 25 bp, Mus musculus
aacccagtccttgagtggactgaga

SEQ ID NO: 32997 - DNA, 25 bp, Mus musculus
aacccagtcgggagctagtgggctc

SEQ ID NO: 32998 - DNA, 25 bp, Mus musculus
aacccagtcgggtgctagtgggctc

SEQ ID NO: 32999 - DNA, 25 bp, Mus musculus
aacccagtcggtacacagaccagtc

SEQ ID NO: 33000 - DNA, 25 bp, Mus musculus
aacccagtcggttcacagaccagtc

SEQ ID NO: 33001 - DNA, 25 bp, Mus musculus
aacccagtctgtctctaaatacttg

SEQ ID NO: 33002 - DNA, 25 bp, Mus musculus
aacccagtctgtgtctaaatacttg

SEQ ID NO: 33003 - DNA, 25 bp, Mus musculus
aacccagtgatcaagcaacttccac

SEQ ID NO: 33004 - DNA, 25 bp, Mus musculus
aacccagtgatctagcaacttccac

SEQ ID NO: 33005 - DNA, 25 bp, Mus musculus
aacccagtgctcaatgtcttcactg

SEQ ID NO: 33006 - DNA, 25 bp, Mus musculus
aacccagtgctctatgtcttcactg

SEQ ID NO: 33007 - DNA, 25 bp, Mus musculus
aacccagtgcttcttctgtaacatg

SEQ ID NO: 33008 - DNA, 25 bp, Mus musculus
aacccagtgcttgttctgtaacatg

SEQ ID NO: 33009 - DNA, 25 bp, Mus musculus
aacccagtggaacatctcagacaaa

SEQ ID NO: 33010 - DNA, 25 bp, Mus musculus
aacccagtggaagatctcagacaaa

SEQ ID NO: 33011 - DNA, 25 bp, Mus musculus
aacccagtgggtaatccattggcct

SEQ ID NO: 33012 - DNA, 25 bp, Mus musculus
aacccagtgggttatccattggcct

SEQ ID NO: 33013 - DNA, 25 bp, Mus musculus
aacccagtgttcaccagtgaccagg

SEQ ID NO: 33014 - DNA, 25 bp, Mus musculus
aacccagtgttctccagtgaccagg

SEQ ID NO: 33015 - DNA, 25 bp, Mus musculus
aacccagttctgagacccaggtcca

SEQ ID NO: 33016 - DNA, 25 bp, Mus musculus
aacccagttctgtgacccaggtcca

SEQ ID NO: 33017 - DNA, 25 bp, Mus musculus
aacccagttcttctcgggtgataat

SEQ ID NO: 33018 - DNA, 25 bp, Mus musculus
aacccagttcttgtcgggtgataat

SEQ ID NO: 33019 - DNA, 25 bp, Mus musculus
aacccagttgaaaaacttggcacag

SEQ ID NO: 33020 - DNA, 25 bp, Mus musculus
aacccagttgaataacttggcacag

SEQ ID NO: 33021 - DNA, 25 bp, Mus musculus
aacccagttgctaacggtggatcca

SEQ ID NO: 33022 - DNA, 25 bp, Mus musculus
aacccagttgcttacggtggatcca

SEQ ID NO: 33023 - DNA, 25 bp, Mus musculus
aacccagtttaactcggaggagcag

SEQ ID NO: 33024 - DNA, 25 bp, Mus musculus
aacccagtttaagtcggaggagcag

SEQ ID NO: 33025 - DNA, 25 bp, Mus musculus
aacccagtttatccggagggcgcct

SEQ ID NO: 33026 - DNA, 25 bp, Mus musculus
aacccagtttatgcggagggcgcct

SEQ ID NO: 33027 - DNA, 25 bp, Mus musculus
aacccagttttcatatctgctatag

SEQ ID NO: 33028 - DNA, 25 bp, Mus musculus
aacccagttttcttatctgctatag

SEQ ID NO: 33029 - DNA, 25 bp, Mus musculus
aacccataactgctgtcaaacaaag

SEQ ID NO: 33030 - DNA, 25 bp, Mus musculus
aacccataactggtgtcaaacaaag

SEQ ID NO: 33031 - DNA, 25 bp, Mus musculus
aacccataccacactcaatgttcat

SEQ ID NO: 33032 - DNA, 25 bp, Mus musculus
aacccataccactctcaatgttcat

SEQ ID NO: 33033 - DNA, 25 bp, Mus musculus
aacccataccttcaacatgcatgtt

SEQ ID NO: 33034 - DNA, 25 bp, Mus musculus
aacccataccttgaacatgcatgtt

SEQ ID NO: 33035 - DNA, 25 bp, Mus musculus
aacccatacttcatccaggaggctg

SEQ ID NO: 33036 - DNA, 25 bp, Mus musculus
aacccatacttcttccaggaggctg

SEQ ID NO: 33037 - DNA, 25 bp, Mus musculus
aacccatagccgaagggtctattca

SEQ ID NO: 33038 - DNA, 25 bp, Mus musculus
aacccatagccgtagggtctattca

SEQ ID NO: 33039 - DNA, 25 bp, Mus musculus
aacccatagctaagaagtgattgct

SEQ ID NO: 33040 - DNA, 25 bp, Mus musculus
aacccatagctatgaagtgattgct

SEQ ID NO: 33041 - DNA, 25 bp, Mus musculus
aacccatagttcatcttagtgcctt

SEQ ID NO: 33042 - DNA, 25 bp, Mus musculus
aacccatagttcttcttagtgcctt

SEQ ID NO: 33043 - DNA, 25 bp, Mus musculus
aacccatatgagcaggatgtgtcct

SEQ ID NO: 33044 - DNA, 25 bp, Mus musculus
aacccatatgaggaggatgtgtcct

SEQ ID NO: 33045 - DNA, 25 bp, Mus musculus
aacccatcagatccagctatacagt

SEQ ID NO: 33046 - DNA, 25 bp, Mus musculus
aacccatcagatgcagctatacagt

SEQ ID NO: 33047 - DNA, 25 bp, Mus musculus
aacccatcagctctaatgtcggaga

SEQ ID NO: 33048 - DNA, 25 bp, Mus musculus
aacccatcagctgtaatgtcggaga

SEQ ID NO: 33049 - DNA, 25 bp, Mus musculus
aacccatcagtgctagatccttcag

SEQ ID NO: 33050 - DNA, 25 bp, Mus musculus
aacccatcagtggtagatccttcag

SEQ ID NO: 33051 - DNA, 25 bp, Mus musculus
aacccatcagttaagctttctctta

SEQ ID NO: 33052 - DNA, 25 bp, Mus musculus
aacccatcagtttagctttctctta

SEQ ID NO: 33053 - DNA, 25 bp, Mus musculus
aacccatccaatccttatgtgcatg

SEQ ID NO: 33054 - DNA, 25 bp, Mus musculus
aacccatccaatgcttatgtgcatg

SEQ ID NO: 33055 - DNA, 25 bp, Mus musculus
aacccatctagcagggtctgcatga

SEQ ID NO: 33056 - DNA, 25 bp, Mus musculus
aacccatctagctgggtctgcatga

SEQ ID NO: 33057 - DNA, 25 bp, Mus musculus
aacccatctaggaagctgctgttgc

SEQ ID NO: 33058 - DNA, 25 bp, Mus musculus
aacccatctaggtagctgctgttgc

SEQ ID NO: 33059 - DNA, 25 bp, Mus musculus
aacccatctttacagagttgtaatg

SEQ ID NO: 33060 - DNA, 25 bp, Mus musculus
aacccatctttagagagttgtaatg

SEQ ID NO: 33061 - DNA, 25 bp, Mus musculus
aacccatgattgctcatagtgcctc

SEQ ID NO: 33062 - DNA, 25 bp, Mus musculus
aacccatgattggtcatagtgcctc

SEQ ID NO: 33063 - DNA, 25 bp, Mus musculus
aacccatgcacgctgtgtgatcctt

SEQ ID NO: 33064 - DNA, 25 bp, Mus musculus
aacccatgcacggtgtgtgatcctt

SEQ ID NO: 33065 - DNA, 25 bp, Mus musculus
aacccatgcctgatagggaagcaaa

SEQ ID NO: 33066 - DNA, 25 bp, Mus musculus
aacccatgcctgttagggaagcaaa

SEQ ID NO: 33067 - DNA, 25 bp, Mus musculus
aacccatgcttaacccagagtgaaa

SEQ ID NO: 33068 - DNA, 25 bp, Mus musculus
aacccatgcttatcccagagtgaaa

SEQ ID NO: 33069 - DNA, 25 bp, Mus musculus
aacccatggcaccagtgagtatttt

SEQ ID NO: 33070 - DNA, 25 bp, Mus musculus
aacccatggcacgagtgagtatttt

SEQ ID NO: 33071 - DNA, 25 bp, Mus musculus
aacccatggctgagtattgaatagt

SEQ ID NO: 33072 - DNA, 25 bp, Mus musculus
aacccatggctgtgtattgaatagt

SEQ ID NO: 33073 - DNA, 25 bp, Mus musculus
aacccatgtgggagtataacttcat

SEQ ID NO: 33074 - DNA, 25 bp, Mus musculus
aacccatgtgggtgtataacttcat

SEQ ID NO: 33075 - DNA, 25 bp, Mus musculus
aacccattaataatcccatcccatg

SEQ ID NO: 33076 - DNA, 25 bp, Mus musculus
aacccattaatattcccatcccatg

SEQ ID NO: 33077 - DNA, 25 bp, Mus musculus
aacccattcaagatcgatttgctgt

SEQ ID NO: 33078 - DNA, 25 bp, Mus musculus
aacccattcaagttcgatttgctgt

SEQ ID NO: 33079 - DNA, 25 bp, Mus musculus
aacccattgctcaaactggccataa

SEQ ID NO: 33080 - DNA, 25 bp, Mus musculus
aacccattgctctaactggccataa

SEQ ID NO: 33081 - DNA, 25 bp, Mus musculus
aacccattggagaactggctcccat

SEQ ID NO: 33082 - DNA, 25 bp, Mus musculus
aacccattggagtactggctcccat

SEQ ID NO: 33083 - DNA, 25 bp, Mus musculus
aacccatttcggatgttcctgcctt

SEQ ID NO: 33084 - DNA, 25 bp, Mus musculus
aacccatttcggttgttcctgcctt

SEQ ID NO: 33085 - DNA, 25 bp, Mus musculus
aacccatttctgaggacccatgtgt

SEQ ID NO: 33086 - DNA, 25 bp, Mus musculus
aacccatttctgtggacccatgtgt

SEQ ID NO: 33087 - DNA, 25 bp, Mus musculus
aacccattttcaccagttgcttatt

SEQ ID NO: 33088 - DNA, 25 bp, Mus musculus
aacccattttcagcagttgcttatt

SEQ ID NO: 33089 - DNA, 25 bp, Mus musculus
aaccccaaattcctttgtgctgact

SEQ ID NO: 33090 - DNA, 25 bp, Mus musculus
aaccccaaattcgtttgtgctgact

SEQ ID NO: 33091 - DNA, 25 bp, Mus musculus
aaccccaactctatgcatttttgct

SEQ ID NO: 33092 - DNA, 25 bp, Mus musculus
aaccccaactctttgcatttttgct

SEQ ID NO: 33093 - DNA, 25 bp, Mus musculus
aaccccaagattctattcttgccat

SEQ ID NO: 33094 - DNA, 25 bp, Mus musculus
aaccccaagattgtattcttgccat

SEQ ID NO: 33095 - DNA, 25 bp, Mus musculus
aaccccaagcttctctttgttgtag

SEQ ID NO: 33096 - DNA, 25 bp, Mus musculus
aaccccaagcttgtctttgttgtag

SEQ ID NO: 33097 - DNA, 25 bp, Mus musculus
aaccccaagtggagagacagctttc

SEQ ID NO: 33098 - DNA, 25 bp, Mus musculus
aaccccaagtggcaggagagaccct

SEQ ID NO: 33099 - DNA, 25 bp, Mus musculus
aaccccaagtgggaggagagaccct

SEQ ID NO: 33100 - DNA, 25 bp, Mus musculus
aaccccaagtggtgagacagctttc

SEQ ID NO: 33101 - DNA, 25 bp, Mus musculus
aaccccaatgctcagtctgtttctc

SEQ ID NO: 33102 - DNA, 25 bp, Mus musculus
aaccccaatgctgagtctgtttctc

SEQ ID NO: 33103 - DNA, 25 bp, Mus musculus
aaccccaatggcaggtatgttgcct

SEQ ID NO: 33104 - DNA, 25 bp, Mus musculus
aaccccaatggctggtatgttgcct

SEQ ID NO: 33105 - DNA, 25 bp, Mus musculus
aaccccacaactatatctcaaatgc

SEQ ID NO: 33106 - DNA, 25 bp, Mus musculus
aaccccacaactttatctcaaatgc

SEQ ID NO: 33107 - DNA, 25 bp, Mus musculus
aaccccacaaggagacacagtacaa

SEQ ID NO: 33108 - DNA, 25 bp, Mus musculus
aaccccacaaggtgacacagtacaa

SEQ ID NO: 33109 - DNA, 25 bp, Mus musculus
aaccccacactcagaagggaagcag

SEQ ID NO: 33110 - DNA, 25 bp, Mus musculus
aaccccacactctgaagggaagcag

SEQ ID NO: 33111 - DNA, 25 bp, Mus musculus
aaccccacagctaactatttcctct

SEQ ID NO: 33112 - DNA, 25 bp, Mus musculus
aaccccacagcttactatttcctct

SEQ ID NO: 33113 - DNA, 25 bp, Mus musculus
aaccccaccaggaatacatcttcat

SEQ ID NO: 33114 - DNA, 25 bp, Mus musculus
aaccccaccaggtatacatcttcat

SEQ ID NO: 33115 - DNA, 25 bp, Mus musculus
aaccccaccattactgattactgtg

SEQ ID NO: 33116 - DNA, 25 bp, Mus musculus
aaccccaccatttctgattactgtg

SEQ ID NO: 33117 - DNA, 25 bp, Mus musculus
aaccccacctgtcactgcagagtga

SEQ ID NO: 33118 - DNA, 25 bp, Mus musculus
aaccccacctgtgactgcagagtga

SEQ ID NO: 33119 - DNA, 25 bp, Mus musculus
aaccccactctgcataatgaggcaa

SEQ ID NO: 33120 - DNA, 25 bp, Mus musculus
aaccccactctggataatgaggcaa

SEQ ID NO: 33121 - DNA, 25 bp, Mus musculus
aaccccactgcacagccgtgtgaat

SEQ ID NO: 33122 - DNA, 25 bp, Mus musculus
aaccccactgcagagccgtgtgaat

SEQ ID NO: 33123 - DNA, 25 bp, Mus musculus
aaccccactgccaggtctgatatgg

SEQ ID NO: 33124 - DNA, 25 bp, Mus musculus
aaccccactgcctggtctgatatgg

SEQ ID NO: 33125 - DNA, 25 bp, Mus musculus
aaccccacttccagtgcttaaatga

SEQ ID NO: 33126 - DNA, 25 bp, Mus musculus
aaccccacttcctgtgcttaaatga

SEQ ID NO: 33127 - DNA, 25 bp, Mus musculus
aaccccagactccaggtcagggcaa

SEQ ID NO: 33128 - DNA, 25 bp, Mus musculus
aaccccagactcgaggtcagggcaa

SEQ ID NO: 33129 - DNA, 25 bp, Mus musculus
aaccccagagctacatgcattctag

SEQ ID NO: 33130 - DNA, 25 bp, Mus musculus
aaccccagagcttcatgcattctag

SEQ ID NO: 33131 - DNA, 25 bp, Mus musculus
aaccccagagtcataacaaaagtag

SEQ ID NO: 33132 - DNA, 25 bp, Mus musculus
aaccccagagtcttaacaaaagtag

SEQ ID NO: 33133 - DNA, 25 bp, Mus musculus
aaccccagagttatcatgcctgagt

SEQ ID NO: 33134 - DNA, 25 bp, Mus musculus
aaccccagagttttcatgcctgagt

SEQ ID NO: 33135 - DNA, 25 bp, Mus musculus
aaccccagatatccagcttgtccat

SEQ ID NO: 33136 - DNA, 25 bp, Mus musculus
aaccccagatatgcagcttgtccat

SEQ ID NO: 33137 - DNA, 25 bp, Mus musculus
aaccccagatttcgctcctacaaag

SEQ ID NO: 33138 - DNA, 25 bp, Mus musculus
aaccccagatttggctcctacaaag

SEQ ID NO: 33139 - DNA, 25 bp, Mus musculus
aaccccagcaagaaacgcgaactgg

SEQ ID NO: 33140 - DNA, 25 bp, Mus musculus
aaccccagcaagtaacgcgaactgg

SEQ ID NO: 33141 - DNA, 25 bp, Mus musculus
aaccccagctataaatgtctaactt

SEQ ID NO: 33142 - DNA, 25 bp, Mus musculus
aaccccagctattaatgtctaactt

SEQ ID NO: 33143 - DNA, 25 bp, Mus musculus
aaccccagggaaacttaacattgag

SEQ ID NO: 33144 - DNA, 25 bp, Mus musculus
aaccccagggaatcttaacattgag

SEQ ID NO: 33145 - DNA, 25 bp, Mus musculus
aaccccagggatatcatcagctgac

SEQ ID NO: 33146 - DNA, 25 bp, Mus musculus
aaccccagggatttcatcagctgac

SEQ ID NO: 33147 - DNA, 25 bp, Mus musculus
aaccccaggtcgcagaggtggctca

SEQ ID NO: 33148 - DNA, 25 bp, Mus musculus
aaccccaggtcggagaggtggctca

SEQ ID NO: 33149 - DNA, 25 bp, Mus musculus
aaccccagtcatacctcggattgtt

SEQ ID NO: 33150 - DNA, 25 bp, Mus musculus
aaccccagtcattcctcggattgtt

SEQ ID NO: 33151 - DNA, 25 bp, Mus musculus
aaccccagtgctcacaggcagatga

SEQ ID NO: 33152 - DNA, 25 bp, Mus musculus
aaccccagtgctgacaggcagatga

SEQ ID NO: 33153 - DNA, 25 bp, Mus musculus
aaccccagtgggaagctgactgact

SEQ ID NO: 33154 - DNA, 25 bp, Mus musculus
aaccccagtgggtagctgactgact

SEQ ID NO: 33155 - DNA, 25 bp, Mus musculus
aaccccataatgcaagaagccccat

SEQ ID NO: 33156 - DNA, 25 bp, Mus musculus
aaccccataatggaagaagccccat

SEQ ID NO: 33157 - DNA, 25 bp, Mus musculus
aaccccatactgaacaacatgtcgc

SEQ ID NO: 33158 - DNA, 25 bp, Mus musculus
aaccccatactgtacaacatgtcgc

SEQ ID NO: 33159 - DNA, 25 bp, Mus musculus
aaccccatatcgactgaaactccta

SEQ ID NO: 33160 - DNA, 25 bp, Mus musculus
aaccccatatcgtctgaaactccta

SEQ ID NO: 33161 - DNA, 25 bp, Mus musculus
aaccccatcataagctctgtgcttg

SEQ ID NO: 33162 - DNA, 25 bp, Mus musculus
aaccccatcatatgctctgtgcttg

SEQ ID NO: 33163 - DNA, 25 bp, Mus musculus
aaccccatcatgacaagagtggcca

SEQ ID NO: 33164 - DNA, 25 bp, Mus musculus
aaccccatcatgatagcagcagcta

SEQ ID NO: 33165 - DNA, 25 bp, Mus musculus
aaccccatcatgtcaagagtggcca

SEQ ID NO: 33166 - DNA, 25 bp, Mus musculus
aaccccatcatgttagcagcagcta

SEQ ID NO: 33167 - DNA, 25 bp, Mus musculus
aaccccatcattaattgctgcctta

SEQ ID NO: 33168 - DNA, 25 bp, Mus musculus
aaccccatcattatgtcttggtgtg

SEQ ID NO: 33169 - DNA, 25 bp, Mus musculus
aaccccatcatttattgctgcctta

SEQ ID NO: 33170 - DNA, 25 bp, Mus musculus
aaccccatcattttgtcttggtgtg

SEQ ID NO: 33171 - DNA, 25 bp, Mus musculus
aaccccatcgtcaactgctggagga

SEQ ID NO: 33172 - DNA, 25 bp, Mus musculus
aaccccatcgtctactgctggagga

SEQ ID NO: 33173 - DNA, 25 bp, Mus musculus
aaccccatcgttaatgctctggtct

SEQ ID NO: 33174 - DNA, 25 bp, Mus musculus
aaccccatcgtttatgctctggtct

SEQ ID NO: 33175 - DNA, 25 bp, Mus musculus
aaccccatctgcacgtggtgtgttg

SEQ ID NO: 33176 - DNA, 25 bp, Mus musculus
aaccccatctgctcgtggtgtgttg

SEQ ID NO: 33177 - DNA, 25 bp, Mus musculus
aaccccatcttcatctctgagtaat

SEQ ID NO: 33178 - DNA, 25 bp, Mus musculus
aaccccatcttcttctctgagtaat

SEQ ID NO: 33179 - DNA, 25 bp, Mus musculus
aaccccatgaagcaggcgtggtcac

SEQ ID NO: 33180 - DNA, 25 bp, Mus musculus
aaccccatgaaggaggcgtggtcac

SEQ ID NO: 33181 - DNA, 25 bp, Mus musculus
aaccccatgaatctaagaaatgcgg

SEQ ID NO: 33182 - DNA, 25 bp, Mus musculus
aaccccatgaatgtaagaaatgcgg

SEQ ID NO: 33183 - DNA, 25 bp, Mus musculus
aaccccatgaggaagatgcgaccca

SEQ ID NO: 33184 - DNA, 25 bp, Mus musculus
aaccccatgaggtagatgcgaccca

SEQ ID NO: 33185 - DNA, 25 bp, Mus musculus
aaccccatgatgaacttgagcgtgt

SEQ ID NO: 33186 - DNA, 25 bp, Mus musculus
aaccccatgatgtacttgagcgtgt

SEQ ID NO: 33187 - DNA, 25 bp, Mus musculus
aaccccatggcaataatgggagggt

SEQ ID NO: 33188 - DNA, 25 bp, Mus musculus
aaccccatggcattaatgggagggt

SEQ ID NO: 33189 - DNA, 25 bp, Mus musculus
aaccccatggtcagagtattctgaa

SEQ ID NO: 33190 - DNA, 25 bp, Mus musculus
aaccccatggtctgagtattctgaa

SEQ ID NO: 33191 - DNA, 25 bp, Mus musculus
aaccccatggtgacagccatgtttt

SEQ ID NO: 33192 - DNA, 25 bp, Mus musculus
aaccccatggtgtcagccatgtttt

SEQ ID NO: 33193 - DNA, 25 bp, Mus musculus
aaccccatgtacatactgactgtca

SEQ ID NO: 33194 - DNA, 25 bp, Mus musculus
aaccccatgtacttactgactgtca

SEQ ID NO: 33195 - DNA, 25 bp, Mus musculus
aaccccatgtgcctgctggaatatg

SEQ ID NO: 33196 - DNA, 25 bp, Mus musculus
aaccccatgtgcgtgctggaatatg

SEQ ID NO: 33197 - DNA, 25 bp, Mus musculus
aaccccattagtatcactgagaact

SEQ ID NO: 33198 - DNA, 25 bp, Mus musculus
aaccccattagtttcactgagaact

SEQ ID NO: 33199 - DNA, 25 bp, Mus musculus
aaccccattttaatgacacagtgaa

SEQ ID NO: 33200 - DNA, 25 bp, Mus musculus
aaccccattttattgacacagtgaa

SEQ ID NO: 33201 - DNA, 25 bp, Mus musculus
aacccccaggatcatgaataaatgc

SEQ ID NO: 33202 - DNA, 25 bp, Mus musculus
aacccccaggatgatgaataaatgc

SEQ ID NO: 33203 - DNA, 25 bp, Mus musculus
aacccccaggtgatgagtccaacgg

SEQ ID NO: 33204 - DNA, 25 bp, Mus musculus
aacccccaggtgttgagtccaacgg

SEQ ID NO: 33205 - DNA, 25 bp, Mus musculus
aaccccccatagcgcttagccagct

SEQ ID NO: 33206 - DNA, 25 bp, Mus musculus
aaccccccatagggcttagccagct

SEQ ID NO: 33207 - DNA, 25 bp, Mus musculus
aacccccctcggagatggagagaag

SEQ ID NO: 33208 - DNA, 25 bp, Mus musculus
aacccccctcggtgatggagagaag

SEQ ID NO: 33209 - DNA, 25 bp, Mus musculus
aaccccgacttactgatgtactgtg

SEQ ID NO: 33210 - DNA, 25 bp, Mus musculus
aaccccgacttagtgatgtactgtg

SEQ ID NO: 33211 - DNA, 25 bp, Mus musculus
aaccccgaggccagatattatttga

SEQ ID NO: 33212 - DNA, 25 bp, Mus musculus
aaccccgaggcctgatattatttga

SEQ ID NO: 33213 - DNA, 25 bp, Mus musculus
aaccccgatcacctctaagttgatt

SEQ ID NO: 33214 - DNA, 25 bp, Mus musculus
aaccccgatcacgtctaagttgatt

SEQ ID NO: 33215 - DNA, 25 bp, Mus musculus
aaccccgatcgtcatggacatgtca

SEQ ID NO: 33216 - DNA, 25 bp, Mus musculus
aaccccgatcgtgatggacatgtca

SEQ ID NO: 33217 - DNA, 25 bp, Mus musculus
aaccccgcaagcaaagctggcagaa

SEQ ID NO: 33218 - DNA, 25 bp, Mus musculus
aaccccgcaagctaagctggcagaa

SEQ ID NO: 33219 - DNA, 25 bp, Mus musculus
aaccccgccgagctcagagttgctg

SEQ ID NO: 33220 - DNA, 25 bp, Mus musculus
aaccccgccgaggtcagagttgctg

SEQ ID NO: 33221 - DNA, 25 bp, Mus musculus
aaccccggacatcgatcagttgttt

SEQ ID NO: 33222 - DNA, 25 bp, Mus musculus
aaccccggacatggatcagttgttt

SEQ ID NO: 33223 - DNA, 25 bp, Mus musculus
aaccccggactgagcatgcccatga

SEQ ID NO: 33224 - DNA, 25 bp, Mus musculus
aaccccggactgtgcatgcccatga

SEQ ID NO: 33225 - DNA, 25 bp, Mus musculus
aaccccgtccataagtgctctgtgt

SEQ ID NO: 33226 - DNA, 25 bp, Mus musculus
aaccccgtccattagtgctctgtgt

SEQ ID NO: 33227 - DNA, 25 bp, Mus musculus
aaccccgtctgtcatgctggaaaac

SEQ ID NO: 33228 - DNA, 25 bp, Mus musculus
aaccccgtctgtgatgctggaaaac

SEQ ID NO: 33229 - DNA, 25 bp, Mus musculus
aaccccgtcttcaatgagtcgttca

SEQ ID NO: 33230 - DNA, 25 bp, Mus musculus
aaccccgtcttctatgagtcgttca

SEQ ID NO: 33231 - DNA, 25 bp, Mus musculus
aacccctaacatcaccataactgga

SEQ ID NO: 33232 - DNA, 25 bp, Mus musculus
aacccctaacatgaccataactgga

SEQ ID NO: 33233 - DNA, 25 bp, Mus musculus
aacccctaagaaacacagatctcgg

SEQ ID NO: 33234 - DNA, 25 bp, Mus musculus
aacccctaagaatcacagatctcgg

SEQ ID NO: 33235 - DNA, 25 bp, Mus musculus
aacccctaccatctaccaagaattg

SEQ ID NO: 33236 - DNA, 25 bp, Mus musculus
aacccctaccatgtaccaagaattg

SEQ ID NO: 33237 - DNA, 25 bp, Mus musculus
aacccctacgcaaatggccagtaca

SEQ ID NO: 33238 - DNA, 25 bp, Mus musculus
aacccctacgcatatggccagtaca

SEQ ID NO: 33239 - DNA, 25 bp, Mus musculus
aacccctagcctcttagaatatgag

SEQ ID NO: 33240 - DNA, 25 bp, Mus musculus
aacccctagcctgttagaatatgag

SEQ ID NO: 33241 - DNA, 25 bp, Mus musculus
aacccctagcgacttcttaaagcag

SEQ ID NO: 33242 - DNA, 25 bp, Mus musculus
aacccctagcgagttcttaaagcag

SEQ ID NO: 33243 - DNA, 25 bp, Mus musculus
aacccctataatcctctactcagtg

SEQ ID NO: 33244 - DNA, 25 bp, Mus musculus
aacccctataatgctctactcagtg

SEQ ID NO: 33245 - DNA, 25 bp, Mus musculus
aacccctatgaaattgtcgttgatg

SEQ ID NO: 33246 - DNA, 25 bp, Mus musculus
aacccctatgaatttgtcgttgatg

SEQ ID NO: 33247 - DNA, 25 bp, Mus musculus
aacccctcaaagcttcagtgcagtg

SEQ ID NO: 33248 - DNA, 25 bp, Mus musculus
aacccctcaaaggttcagtgcagtg

SEQ ID NO: 33249 - DNA, 25 bp, Mus musculus
aacccctcaagcaaaagagtgacta

SEQ ID NO: 33250 - DNA, 25 bp, Mus musculus
aacccctcaagctaaagagtgacta

SEQ ID NO: 33251 - DNA, 25 bp, Mus musculus
aacccctcaccgacagcttgatgga

SEQ ID NO: 33252 - DNA, 25 bp, Mus musculus
aacccctcaccgtcagcttgatgga

SEQ ID NO: 33253 - DNA, 25 bp, Mus musculus
aacccctcagtactgggacagcagg

SEQ ID NO: 33254 - DNA, 25 bp, Mus musculus
aacccctcagtagtgggacagcagg

SEQ ID NO: 33255 - DNA, 25 bp, Mus musculus
aacccctcattcagctagagcttca

SEQ ID NO: 33256 - DNA, 25 bp, Mus musculus
aacccctcattctgctagagcttca

SEQ ID NO: 33257 - DNA, 25 bp, Mus musculus
aacccctccaatagtgtgtttctgt

SEQ ID NO: 33258 - DNA, 25 bp, Mus musculus
aacccctccaattgtgtgtttctgt

SEQ ID NO: 33259 - DNA, 25 bp, Mus musculus
aacccctccctgcatattttatatt

SEQ ID NO: 33260 - DNA, 25 bp, Mus musculus
aacccctccctggatattttatatt

SEQ ID NO: 33261 - DNA, 25 bp, Mus musculus
aacccctcctgaagaaatgcttttg

SEQ ID NO: 33262 - DNA, 25 bp, Mus musculus
aacccctcctgatgaaatgcttttg

SEQ ID NO: 33263 - DNA, 25 bp, Mus musculus
aacccctccttacagcgtgaaagag

SEQ ID NO: 33264 - DNA, 25 bp, Mus musculus
aacccctccttagagcgtgaaagag

SEQ ID NO: 33265 - DNA, 25 bp, Mus musculus
aacccctctgcactatattgactct

SEQ ID NO: 33266 - DNA, 25 bp, Mus musculus
aacccctctgcagtatattgactct

SEQ ID NO: 33267 - DNA, 25 bp, Mus musculus
aacccctctggaacgagtcactgaa

SEQ ID NO: 33268 - DNA, 25 bp, Mus musculus
aacccctctggatcgagtcactgaa

SEQ ID NO: 33269 - DNA, 25 bp, Mus musculus
aacccctcttgcagttgatcaggct

SEQ ID NO: 33270 - DNA, 25 bp, Mus musculus
aacccctcttgctgttgatcaggct

SEQ ID NO: 33271 - DNA, 25 bp, Mus musculus
aacccctgaagcagaagtcatagct

SEQ ID NO: 33272 - DNA, 25 bp, Mus musculus
aacccctgaagctgaagtcatagct

SEQ ID NO: 33273 - DNA, 25 bp, Mus musculus
aacccctgagacactgccatatata

SEQ ID NO: 33274 - DNA, 25 bp, Mus musculus
aacccctgagactctgccatatata

SEQ ID NO: 33275 - DNA, 25 bp, Mus musculus
aacccctgagagattgtaccttcta

SEQ ID NO: 33276 - DNA, 25 bp, Mus musculus
aacccctgagagtttgtaccttcta

SEQ ID NO: 33277 - DNA, 25 bp, Mus musculus
aacccctgagccctatataaaagtg

SEQ ID NO: 33278 - DNA, 25 bp, Mus musculus
aacccctgagccgtatataaaagtg

SEQ ID NO: 33279 - DNA, 25 bp, Mus musculus
aacccctgattgctgcatgcttcaa

SEQ ID NO: 33280 - DNA, 25 bp, Mus musculus
aacccctgattggtgcatgcttcaa

SEQ ID NO: 33281 - DNA, 25 bp, Mus musculus
aacccctgcagtctctgtgaaatga

SEQ ID NO: 33282 - DNA, 25 bp, Mus musculus
aacccctgcagtgtctgtgaaatga

SEQ ID NO: 33283 - DNA, 25 bp, Mus musculus
aacccctgcccacagtatgtataca

SEQ ID NO: 33284 - DNA, 25 bp, Mus musculus
aacccctgcccagagtatgtataca

SEQ ID NO: 33285 - DNA, 25 bp, Mus musculus
aacccctggagaaacacctgctatt

SEQ ID NO: 33286 - DNA, 25 bp, Mus musculus
aacccctggagatacacctgctatt

SEQ ID NO: 33287 - DNA, 25 bp, Mus musculus
aacccctggatcaatatgggcttca

SEQ ID NO: 33288 - DNA, 25 bp, Mus musculus
aacccctggatctatatgggcttca

SEQ ID NO: 33289 - DNA, 25 bp, Mus musculus
aacccctgggttaatggatactatg

SEQ ID NO: 33290 - DNA, 25 bp, Mus musculus
aacccctgggtttatggatactatg

SEQ ID NO: 33291 - DNA, 25 bp, Mus musculus
aacccctgtagaagtggaactccac

SEQ ID NO: 33292 - DNA, 25 bp, Mus musculus
aacccctgtagatgtggaactccac

SEQ ID NO: 33293 - DNA, 25 bp, Mus musculus
aacccctgtatcaactcttagagtg

SEQ ID NO: 33294 - DNA, 25 bp, Mus musculus
aacccctgtatctactcttagagtg

SEQ ID NO: 33295 - DNA, 25 bp, Mus musculus
aacccctgtccaattcaaactatag

SEQ ID NO: 33296 - DNA, 25 bp, Mus musculus
aacccctgtccatttcaaactatag

SEQ ID NO: 33297 - DNA, 25 bp, Mus musculus
aacccctgttgtccttaggaagcat

SEQ ID NO: 33298 - DNA, 25 bp, Mus musculus
aacccctgttgtgcttaggaagcat

SEQ ID NO: 33299 - DNA, 25 bp, Mus musculus
aaccccttattcaccactgaatgga

SEQ ID NO: 33300 - DNA, 25 bp, Mus musculus
aaccccttattctccactgaatgga

SEQ ID NO: 33301 - DNA, 25 bp, Mus musculus
aaccccttattgatgagcatgttgg

SEQ ID NO: 33302 - DNA, 25 bp, Mus musculus
aaccccttattgttgagcatgttgg

SEQ ID NO: 33303 - DNA, 25 bp, Mus musculus
aaccccttcatgatcaactacagaa

SEQ ID NO: 33304 - DNA, 25 bp, Mus musculus
aaccccttcatgttcaactacagaa

SEQ ID NO: 33305 - DNA, 25 bp, Mus musculus
aaccccttcccacttatatattgtg

SEQ ID NO: 33306 - DNA, 25 bp, Mus musculus
aaccccttcccagttatatattgtg

SEQ ID NO: 33307 - DNA, 25 bp, Mus musculus
aaccccttctaacaatgcactggaa

SEQ ID NO: 33308 - DNA, 25 bp, Mus musculus
aaccccttctaagaatgcactggaa

SEQ ID NO: 33309 - DNA, 25 bp, Mus musculus
aaccccttctacaacgatgatacta

SEQ ID NO: 33310 - DNA, 25 bp, Mus musculus
aaccccttctactacgatgatacta

SEQ ID NO: 33311 - DNA, 25 bp, Mus musculus
aaccccttgtctatagcctctaatt

SEQ ID NO: 33312 - DNA, 25 bp, Mus musculus
aaccccttgtctttagcctctaatt

SEQ ID NO: 33313 - DNA, 25 bp, Mus musculus
aacccctttgctctctattggctga

SEQ ID NO: 33314 - DNA, 25 bp, Mus musculus
aacccctttgctgtctattggctga

SEQ ID NO: 33315 - DNA, 25 bp, Mus musculus
aacccctttgggaaatcagcgctat

SEQ ID NO: 33316 - DNA, 25 bp, Mus musculus
aacccctttgggagctggagagact

SEQ ID NO: 33317 - DNA, 25 bp, Mus musculus
aacccctttgggtaatcagcgctat

SEQ ID NO: 33318 - DNA, 25 bp, Mus musculus
aacccctttgggtgctggagagact

SEQ ID NO: 33319 - DNA, 25 bp, Mus musculus
aaccccttttgacagacttagtgca

SEQ ID NO: 33320 - DNA, 25 bp, Mus musculus
aaccccttttgagagacttagtgca

SEQ ID NO: 33321 - DNA, 25 bp, Mus musculus
aacccgaactgactctaaagcattt

SEQ ID NO: 33322 - DNA, 25 bp, Mus musculus
aacccgaactgagtctaaagcattt

SEQ ID NO: 33323 - DNA, 25 bp, Mus musculus
aacccgacggatcacttccatattt

SEQ ID NO: 33324 - DNA, 25 bp, Mus musculus
aacccgacggatgacttccatattt

SEQ ID NO: 33325 - DNA, 25 bp, Mus musculus
aacccgactctcaagttgcattgtt

SEQ ID NO: 33326 - DNA, 25 bp, Mus musculus
aacccgactctctagttgcattgtt

SEQ ID NO: 33327 - DNA, 25 bp, Mus musculus
aacccgagagatatgcatggcttag

SEQ ID NO: 33328 - DNA, 25 bp, Mus musculus
aacccgagagatttgcatggcttag

SEQ ID NO: 33329 - DNA, 25 bp, Mus musculus
aacccgagcaagatgaggccacaag

SEQ ID NO: 33330 - DNA, 25 bp, Mus musculus
aacccgagcaagttgaggccacaag

SEQ ID NO: 33331 - DNA, 25 bp, Mus musculus
aacccgagctatagagtgaggcact

SEQ ID NO: 33332 - DNA, 25 bp, Mus musculus
aacccgagctattgagtgaggcact

SEQ ID NO: 33333 - DNA, 25 bp, Mus musculus
aacccgatggtgcaatgtgaccctt

SEQ ID NO: 33334 - DNA, 25 bp, Mus musculus
aacccgatggtggaatgtgaccctt

SEQ ID NO: 33335 - DNA, 25 bp, Mus musculus
aacccgatgtcaaattccatacttg

SEQ ID NO: 33336 - DNA, 25 bp, Mus musculus
aacccgatgtcatattccatacttg

SEQ ID NO: 33337 - DNA, 25 bp, Mus musculus
aacccgattccgcatacaggcattt

SEQ ID NO: 33338 - DNA, 25 bp, Mus musculus
aacccgattccggatacaggcattt

SEQ ID NO: 33339 - DNA, 25 bp, Mus musculus
aacccgccggacattctgcaagaaa

SEQ ID NO: 33340 - DNA, 25 bp, Mus musculus
aacccgccggactttctgcaagaaa

SEQ ID NO: 33341 - DNA, 25 bp, Mus musculus
aacccgctatgcaaatgtgcttttg

SEQ ID NO: 33342 - DNA, 25 bp, Mus musculus
aacccgctatgctaatgtgcttttg

SEQ ID NO: 33343 - DNA, 25 bp, Mus musculus
aacccgctcaacagtgacctatagg

SEQ ID NO: 33344 - DNA, 25 bp, Mus musculus
aacccgctcaactgtgacctatagg

SEQ ID NO: 33345 - DNA, 25 bp, Mus musculus
aacccgctgcgacccatcaggaaga

SEQ ID NO: 33346 - DNA, 25 bp, Mus musculus
aacccgctgcgagccatcaggaaga

SEQ ID NO: 33347 - DNA, 25 bp, Mus musculus
aacccgctgctcaacacgtggagga

SEQ ID NO: 33348 - DNA, 25 bp, Mus musculus
aacccgctgctcaatttgcttcttg

SEQ ID NO: 33349 - DNA, 25 bp, Mus musculus
aacccgctgctctacacgtggagga

SEQ ID NO: 33350 - DNA, 25 bp, Mus musculus
aacccgctgctctatttgcttcttg

SEQ ID NO: 33351 - DNA, 25 bp, Mus musculus
aacccgctgtataaagaggccacct

SEQ ID NO: 33352 - DNA, 25 bp, Mus musculus
aacccgctgtattaagaggccacct

SEQ ID NO: 33353 - DNA, 25 bp, Mus musculus
aacccggaactgagcacatctggaa

SEQ ID NO: 33354 - DNA, 25 bp, Mus musculus
aacccggaactgtgcacatctggaa

SEQ ID NO: 33355 - DNA, 25 bp, Mus musculus
aacccggagatgattgaggacgact

SEQ ID NO: 33356 - DNA, 25 bp, Mus musculus
aacccggagatgtttgaggacgact

SEQ ID NO: 33357 - DNA, 25 bp, Mus musculus
aacccggagccacttgagtttagcg

SEQ ID NO: 33358 - DNA, 25 bp, Mus musculus
aacccggagccagttgagtttagcg

SEQ ID NO: 33359 - DNA, 25 bp, Mus musculus
aacccggccactcttatgagaaaca

SEQ ID NO: 33360 - DNA, 25 bp, Mus musculus
aacccggccactgttatgagaaaca

SEQ ID NO: 33361 - DNA, 25 bp, Mus musculus
aacccggccagccagcgtcggtgaa

SEQ ID NO: 33362 - DNA, 25 bp, Mus musculus
aacccggccagcgagcgtcggtgaa

SEQ ID NO: 33363 - DNA, 25 bp, Mus musculus
aacccgggcactcgaactactgcta

SEQ ID NO: 33364 - DNA, 25 bp, Mus musculus
aacccgggcactggaactactgcta

SEQ ID NO: 33365 - DNA, 25 bp, Mus musculus
aacccgggcagacagtggtcattgt

SEQ ID NO: 33366 - DNA, 25 bp, Mus musculus
aacccgggcagagagtggtcattgt

SEQ ID NO: 33367 - DNA, 25 bp, Mus musculus
aacccggtcagcaaggagtctaaga

SEQ ID NO: 33368 - DNA, 25 bp, Mus musculus
aacccggtcagctaggagtctaaga

SEQ ID NO: 33369 - DNA, 25 bp, Mus musculus
aacccggtgatgagcactgttgcct

SEQ ID NO: 33370 - DNA, 25 bp, Mus musculus
aacccggtgatgtgcactgttgcct

SEQ ID NO: 33371 - DNA, 25 bp, Mus musculus
aacccggtgtgaatctgttatgaat

SEQ ID NO: 33372 - DNA, 25 bp, Mus musculus
aacccggtgtgattctgttatgaat

SEQ ID NO: 33373 - DNA, 25 bp, Mus musculus
aacccgtaaatgcacagttatagat

SEQ ID NO: 33374 - DNA, 25 bp, Mus musculus
aacccgtaaatggacagttatagat

SEQ ID NO: 33375 - DNA, 25 bp, Mus musculus
aacccgtcctcgaattctgttgcag

SEQ ID NO: 33376 - DNA, 25 bp, Mus musculus
aacccgtcctcgtattctgttgcag

SEQ ID NO: 33377 - DNA, 25 bp, Mus musculus
aacccgtcggccatggcttgggcaa

SEQ ID NO: 33378 - DNA, 25 bp, Mus musculus
aacccgtcggccttggcttgggcaa

SEQ ID NO: 33379 - DNA, 25 bp, Mus musculus
aacccgtgcggcagagtgtggccat

SEQ ID NO: 33380 - DNA, 25 bp, Mus musculus
aacccgtgcggctgagtgtggccat

SEQ ID NO: 33381 - DNA, 25 bp, Mus musculus
aacccgtgctggcttgtaacttgtt

SEQ ID NO: 33382 - DNA, 25 bp, Mus musculus
aacccgtgctgggttgtaacttgtt

SEQ ID NO: 33383 - DNA, 25 bp, Mus musculus
aacccgtggttaagagaatatcctc

SEQ ID NO: 33384 - DNA, 25 bp, Mus musculus
aacccgtggttatgagaatatcctc

SEQ ID NO: 33385 - DNA, 25 bp, Mus musculus
aaccctaaactccagaccttgattg

SEQ ID NO: 33386 - DNA, 25 bp, Mus musculus
aaccctaaactcgagaccttgattg

SEQ ID NO: 33387 - DNA, 25 bp, Mus musculus
aaccctaaagaactgctggtgcgat

SEQ ID NO: 33388 - DNA, 25 bp, Mus musculus
aaccctaaagaagtgctggtgcgat

SEQ ID NO: 33389 - DNA, 25 bp, Mus musculus
aaccctaaagttcaggcatccctgg

SEQ ID NO: 33390 - DNA, 25 bp, Mus musculus
aaccctaaagttgaggcatccctgg

SEQ ID NO: 33391 - DNA, 25 bp, Mus musculus
aaccctaacataattctcttagtag

SEQ ID NO: 33392 - DNA, 25 bp, Mus musculus
aaccctaacatatttctcttagtag

SEQ ID NO: 33393 - DNA, 25 bp, Mus musculus
aaccctaacatgagagttgttcttt

SEQ ID NO: 33394 - DNA, 25 bp, Mus musculus
aaccctaacatgtgagttgttcttt

SEQ ID NO: 33395 - DNA, 25 bp, Mus musculus
aaccctaaccccacaggctgtagag

SEQ ID NO: 33396 - DNA, 25 bp, Mus musculus
aaccctaacccctcaggctgtagag

SEQ ID NO: 33397 - DNA, 25 bp, Mus musculus
aaccctaacctcatttcatgtgttg

SEQ ID NO: 33398 - DNA, 25 bp, Mus musculus
aaccctaacctcttttcatgtgttg

SEQ ID NO: 33399 - DNA, 25 bp, Mus musculus
aaccctaacctgatcaaccaatttg

SEQ ID NO: 33400 - DNA, 25 bp, Mus musculus
aaccctaacctgttcaaccaatttg

SEQ ID NO: 33401 - DNA, 25 bp, Mus musculus
aaccctaacttgctctgaactcaga

SEQ ID NO: 33402 - DNA, 25 bp, Mus musculus
aaccctaacttggtctgaactcaga

SEQ ID NO: 33403 - DNA, 25 bp, Mus musculus
aaccctaaggatcatgtcatcacaa

SEQ ID NO: 33404 - DNA, 25 bp, Mus musculus
aaccctaaggatgatgtcatcacaa

SEQ ID NO: 33405 - DNA, 25 bp, Mus musculus
aaccctaagggacaggaaattgcat

SEQ ID NO: 33406 - DNA, 25 bp, Mus musculus
aaccctaagggagaggaaattgcat

SEQ ID NO: 33407 - DNA, 25 bp, Mus musculus
aaccctaagtcaagtttcttgtccg

SEQ ID NO: 33408 - DNA, 25 bp, Mus musculus
aaccctaagtcacccctgcctgatt

SEQ ID NO: 33409 - DNA, 25 bp, Mus musculus
aaccctaagtcagccctgcctgatt

SEQ ID NO: 33410 - DNA, 25 bp, Mus musculus
aaccctaagtcatgtttcttgtccg

SEQ ID NO: 33411 - DNA, 25 bp, Mus musculus
aaccctaagttcaaagtgctgtcaa

SEQ ID NO: 33412 - DNA, 25 bp, Mus musculus
aaccctaagttctaagtgctgtcaa

SEQ ID NO: 33413 - DNA, 25 bp, Mus musculus
aaccctaattctagagctgtggtag

SEQ ID NO: 33414 - DNA, 25 bp, Mus musculus
aaccctaattcttgagctgtggtag

SEQ ID NO: 33415 - DNA, 25 bp, Mus musculus
aaccctacaaggacacaatctcgtg

SEQ ID NO: 33416 - DNA, 25 bp, Mus musculus
aaccctacaaggtcacaatctcgtg

SEQ ID NO: 33417 - DNA, 25 bp, Mus musculus
aaccctacactacagttcttggcct

SEQ ID NO: 33418 - DNA, 25 bp, Mus musculus
aaccctacactagagttcttggcct

SEQ ID NO: 33419 - DNA, 25 bp, Mus musculus
aaccctacatgacgaccctgtctag

SEQ ID NO: 33420 - DNA, 25 bp, Mus musculus
aaccctacatgaggaccctgtctag

SEQ ID NO: 33421 - DNA, 25 bp, Mus musculus
aaccctactattctgactttcatcc

SEQ ID NO: 33422 - DNA, 25 bp, Mus musculus
aaccctactattgtgactttcatcc

SEQ ID NO: 33423 - DNA, 25 bp, Mus musculus
aaccctactcaactgttatgcacac

SEQ ID NO: 33424 - DNA, 25 bp, Mus musculus
aaccctactcaagtgttatgcacac

SEQ ID NO: 33425 - DNA, 25 bp, Mus musculus
aaccctactgagcagggcctggcta

SEQ ID NO: 33426 - DNA, 25 bp, Mus musculus
aaccctactgaggagggcctggcta

SEQ ID NO: 33427 - DNA, 25 bp, Mus musculus
aaccctactttgaacatagatctct

SEQ ID NO: 33428 - DNA, 25 bp, Mus musculus
aaccctactttgtacatagatctct

SEQ ID NO: 33429 - DNA, 25 bp, Mus musculus
aaccctagaattaactggctggcac

SEQ ID NO: 33430 - DNA, 25 bp, Mus musculus
aaccctagaatttactggctggcac

SEQ ID NO: 33431 - DNA, 25 bp, Mus musculus
aaccctagacccagggaatcagtga

SEQ ID NO: 33432 - DNA, 25 bp, Mus musculus
aaccctagaccctgggaatcagtga

SEQ ID NO: 33433 - DNA, 25 bp, Mus musculus
aaccctagagtcaacaggaacttgt

SEQ ID NO: 33434 - DNA, 25 bp, Mus musculus
aaccctagagtcacaggcctactga

SEQ ID NO: 33435 - DNA, 25 bp, Mus musculus
aaccctagagtctacaggaacttgt

SEQ ID NO: 33436 - DNA, 25 bp, Mus musculus
aaccctagagtctcaggcctactga

SEQ ID NO: 33437 - DNA, 25 bp, Mus musculus
aaccctagcaccagaaggctgggac

SEQ ID NO: 33438 - DNA, 25 bp, Mus musculus
aaccctagcacctgaaggctgggac

SEQ ID NO: 33439 - DNA, 25 bp, Mus musculus
aaccctagcgaccagttctatgata

SEQ ID NO: 33440 - DNA, 25 bp, Mus musculus
aaccctagcgacgagttctatgata

SEQ ID NO: 33441 - DNA, 25 bp, Mus musculus
aaccctagcggacatcagcgatcgg

SEQ ID NO: 33442 - DNA, 25 bp, Mus musculus
aaccctagcggagatcagcgatcgg

SEQ ID NO: 33443 - DNA, 25 bp, Mus musculus
aaccctagtgtactttcttggctat

SEQ ID NO: 33444 - DNA, 25 bp, Mus musculus
aaccctagtgtagtttcttggctat

SEQ ID NO: 33445 - DNA, 25 bp, Mus musculus
aaccctatactgagaggtatgcgcc

SEQ ID NO: 33446 - DNA, 25 bp, Mus musculus
aaccctatactgtgaggtatgcgcc

SEQ ID NO: 33447 - DNA, 25 bp, Mus musculus
aaccctatcaggcaagcctcattgc

SEQ ID NO: 33448 - DNA, 25 bp, Mus musculus
aaccctatcagggaagcctcattgc

SEQ ID NO: 33449 - DNA, 25 bp, Mus musculus
aaccctatcccaaaatgtgtgtcta

SEQ ID NO: 33450 - DNA, 25 bp, Mus musculus
aaccctatcccataatgtgtgtcta

SEQ ID NO: 33451 - DNA, 25 bp, Mus musculus
aaccctatgagtccattgactgcgg

SEQ ID NO: 33452 - DNA, 25 bp, Mus musculus
aaccctatgagtgcattgactgcgg

SEQ ID NO: 33453 - DNA, 25 bp, Mus musculus
aaccctatgcttctccgtgtttata

SEQ ID NO: 33454 - DNA, 25 bp, Mus musculus
aaccctatgcttgtccgtgtttata

SEQ ID NO: 33455 - DNA, 25 bp, Mus musculus
aaccctatggagcaagaagctgcca

SEQ ID NO: 33456 - DNA, 25 bp, Mus musculus
aaccctatggaggaagaagctgcca

SEQ ID NO: 33457 - DNA, 25 bp, Mus musculus
aaccctatgtgaactcgggcatgag

SEQ ID NO: 33458 - DNA, 25 bp, Mus musculus
aaccctatgtgatctcgggcatgag

SEQ ID NO: 33459 - DNA, 25 bp, Mus musculus
aaccctattatcatgattggaacct

SEQ ID NO: 33460 - DNA, 25 bp, Mus musculus
aaccctattatcttgattggaacct

SEQ ID NO: 33461 - DNA, 25 bp, Mus musculus
aaccctatttgaatctcaccctgag

SEQ ID NO: 33462 - DNA, 25 bp, Mus musculus
aaccctatttgattctcaccctgag

SEQ ID NO: 33463 - DNA, 25 bp, Mus musculus
aaccctattttgattgatatttgat

SEQ ID NO: 33464 - DNA, 25 bp, Mus musculus
aaccctattttgtttgatatttgat

SEQ ID NO: 33465 - DNA, 25 bp, Mus musculus
aaccctcaaatacctgttgcaggca

SEQ ID NO: 33466 - DNA, 25 bp, Mus musculus
aaccctcaaatagctgttgcaggca

SEQ ID NO: 33467 - DNA, 25 bp, Mus musculus
aaccctcaacagaaaccacagacgg

SEQ ID NO: 33468 - DNA, 25 bp, Mus musculus
aaccctcaacagtaaccacagacgg

SEQ ID NO: 33469 - DNA, 25 bp, Mus musculus
aaccctcaagctctcaagtggtgag

SEQ ID NO: 33470 - DNA, 25 bp, Mus musculus
aaccctcaagctgtcaagtggtgag

SEQ ID NO: 33471 - DNA, 25 bp, Mus musculus
aaccctcacctaaacctgtgcagtg

SEQ ID NO: 33472 - DNA, 25 bp, Mus musculus
aaccctcacctatacctgtgcagtg

SEQ ID NO: 33473 - DNA, 25 bp, Mus musculus
aaccctcacctgatgtatcttgaca

SEQ ID NO: 33474 - DNA, 25 bp, Mus musculus
aaccctcacctgttgtatcttgaca

SEQ ID NO: 33475 - DNA, 25 bp, Mus musculus
aaccctcacttgcagaacgcaggag

SEQ ID NO: 33476 - DNA, 25 bp, Mus musculus
aaccctcacttggagaacgcaggag

SEQ ID NO: 33477 - DNA, 25 bp, Mus musculus
aaccctcagaggagactgatccagt

SEQ ID NO: 33478 - DNA, 25 bp, Mus musculus
aaccctcagaggtgactgatccagt

SEQ ID NO: 33479 - DNA, 25 bp, Mus musculus
aaccctcaggaactcttagtgcagg

SEQ ID NO: 33480 - DNA, 25 bp, Mus musculus
aaccctcaggaagtcttagtgcagg

SEQ ID NO: 33481 - DNA, 25 bp, Mus musculus
aaccctcatgtaattatgcctaacg

SEQ ID NO: 33482 - DNA, 25 bp, Mus musculus
aaccctcatgtatttatgcctaacg

SEQ ID NO: 33483 - DNA, 25 bp, Mus musculus
aaccctcattagactgttgctttgt

SEQ ID NO: 33484 - DNA, 25 bp, Mus musculus
aaccctcattagtctgttgctttgt

SEQ ID NO: 33485 - DNA, 25 bp, Mus musculus
aaccctcattttccagaaacactag

SEQ ID NO: 33486 - DNA, 25 bp, Mus musculus
aaccctcattttgcagaaacactag

SEQ ID NO: 33487 - DNA, 25 bp, Mus musculus
aaccctccaaatagcaggaatcact

SEQ ID NO: 33488 - DNA, 25 bp, Mus musculus
aaccctccaaattgcaggaatcact

SEQ ID NO: 33489 - DNA, 25 bp, Mus musculus
aaccctccaagcaggaatgggcgca

SEQ ID NO: 33490 - DNA, 25 bp, Mus musculus
aaccctccaagctggaatgggcgca

SEQ ID NO: 33491 - DNA, 25 bp, Mus musculus
aaccctccaatcatatttgaccttc

SEQ ID NO: 33492 - DNA, 25 bp, Mus musculus
aaccctccaatcttatttgaccttc

SEQ ID NO: 33493 - DNA, 25 bp, Mus musculus
aaccctccagaccacgaagtggtgg

SEQ ID NO: 33494 - DNA, 25 bp, Mus musculus
aaccctccagacgacgaagtggtgg

SEQ ID NO: 33495 - DNA, 25 bp, Mus musculus
aaccctccatacagttcctgcagta

SEQ ID NO: 33496 - DNA, 25 bp, Mus musculus
aaccctccatactgttcctgcagta

SEQ ID NO: 33497 - DNA, 25 bp, Mus musculus
aaccctccatagattccagtagctt

SEQ ID NO: 33498 - DNA, 25 bp, Mus musculus
aaccctccatagtttccagtagctt

SEQ ID NO: 33499 - DNA, 25 bp, Mus musculus
aaccctcccctgcaaatgatgtttg

SEQ ID NO: 33500 - DNA, 25 bp, Mus musculus
aaccctcccctggaaatgatgtttg

SEQ ID NO: 33501 - DNA, 25 bp, Mus musculus
aaccctcccgagagcgagtactaca

SEQ ID NO: 33502 - DNA, 25 bp, Mus musculus
aaccctcccgagtgcgagtactaca

SEQ ID NO: 33503 - DNA, 25 bp, Mus musculus
aaccctcctcaaacaagtctatgga

SEQ ID NO: 33504 - DNA, 25 bp, Mus musculus
aaccctcctcaatcaagtctatgga

SEQ ID NO: 33505 - DNA, 25 bp, Mus musculus
aaccctcctcagaatgtcagtaaat

SEQ ID NO: 33506 - DNA, 25 bp, Mus musculus
aaccctcctcagaattagtctcgtt

SEQ ID NO: 33507 - DNA, 25 bp, Mus musculus
aaccctcctcagtatgtcagtaaat

SEQ ID NO: 33508 - DNA, 25 bp, Mus musculus
aaccctcctcagtattagtctcgtt

SEQ ID NO: 33509 - DNA, 25 bp, Mus musculus
aaccctcctgatccagaccgtggga

SEQ ID NO: 33510 - DNA, 25 bp, Mus musculus
aaccctcctgatgcagaccgtggga

SEQ ID NO: 33511 - DNA, 25 bp, Mus musculus
aaccctcctgtgatgccttctgtaa

SEQ ID NO: 33512 - DNA, 25 bp, Mus musculus
aaccctcctgtgttgccttctgtaa

SEQ ID NO: 33513 - DNA, 25 bp, Mus musculus
aaccctccttttctattcctgatgt

SEQ ID NO: 33514 - DNA, 25 bp, Mus musculus
aaccctccttttgtattcctgatgt

SEQ ID NO: 33515 - DNA, 25 bp, Mus musculus
aaccctcgaggccatctgtaagaga

SEQ ID NO: 33516 - DNA, 25 bp, Mus musculus
aaccctcgaggcgatctgtaagaga

SEQ ID NO: 33517 - DNA, 25 bp, Mus musculus
aaccctcgccataatatcatctatc

SEQ ID NO: 33518 - DNA, 25 bp, Mus musculus
aaccctcgccattatatcatctatc

SEQ ID NO: 33519 - DNA, 25 bp, Mus musculus
aaccctcgctgtcccaaaaagatgt

SEQ ID NO: 33520 - DNA, 25 bp, Mus musculus
aaccctcgctgtgccaaaaagatgt

SEQ ID NO: 33521 - DNA, 25 bp, Mus musculus
aaccctcggcagaggctacttagga

SEQ ID NO: 33522 - DNA, 25 bp, Mus musculus
aaccctcggcagtggctacttagga

SEQ ID NO: 33523 - DNA, 25 bp, Mus musculus
aaccctctaaccagtgaggccaaag

SEQ ID NO: 33524 - DNA, 25 bp, Mus musculus
aaccctctaacctgtgaggccaaag

SEQ ID NO: 33525 - DNA, 25 bp, Mus musculus
aaccctctaggacctcatttgtggc

SEQ ID NO: 33526 - DNA, 25 bp, Mus musculus
aaccctctaggagctcatttgtggc

SEQ ID NO: 33527 - DNA, 25 bp, Mus musculus
aaccctctcagtcaatagcagcgaa

SEQ ID NO: 33528 - DNA, 25 bp, Mus musculus
aaccctctcagtgaatagcagcgaa

SEQ ID NO: 33529 - DNA, 25 bp, Mus musculus
aaccctctcgagaatttgctgtctg

SEQ ID NO: 33530 - DNA, 25 bp, Mus musculus
aaccctctcgagtatttgctgtctg

SEQ ID NO: 33531 - DNA, 25 bp, Mus musculus
aaccctctgcgccttgagatgagtc

SEQ ID NO: 33532 - DNA, 25 bp, Mus musculus
aaccctctgcgcgttgagatgagtc

SEQ ID NO: 33533 - DNA, 25 bp, Mus musculus
aaccctctgcgtatggtaaggactg

SEQ ID NO: 33534 - DNA, 25 bp, Mus musculus
aaccctctgcgtttggtaaggactg

SEQ ID NO: 33535 - DNA, 25 bp, Mus musculus
aaccctctgtccacattgtcatgaa

SEQ ID NO: 33536 - DNA, 25 bp, Mus musculus
aaccctctgtcctcattgtcatgaa

SEQ ID NO: 33537 - DNA, 25 bp, Mus musculus
aaccctctgtttcgcgatggagaat

SEQ ID NO: 33538 - DNA, 25 bp, Mus musculus
aaccctctgtttggcgatggagaat

SEQ ID NO: 33539 - DNA, 25 bp, Mus musculus
aaccctgaaaagatccagactgagt

SEQ ID NO: 33540 - DNA, 25 bp, Mus musculus
aaccctgaaaagttccagactgagt

SEQ ID NO: 33541 - DNA, 25 bp, Mus musculus
aaccctgaaacgcaaggagtggaca

SEQ ID NO: 33542 - DNA, 25 bp, Mus musculus
aaccctgaaacggaaggagtggaca

SEQ ID NO: 33543 - DNA, 25 bp, Mus musculus
aaccctgaaataaatatctctgtgt

SEQ ID NO: 33544 - DNA, 25 bp, Mus musculus
aaccctgaaatatatatctctgtgt

SEQ ID NO: 33545 - DNA, 25 bp, Mus musculus
aaccctgaaatcaccgtgtcaaaag

SEQ ID NO: 33546 - DNA, 25 bp, Mus musculus
aaccctgaaatctccgtgtcaaaag

SEQ ID NO: 33547 - DNA, 25 bp, Mus musculus
aaccctgaacaaccagggctgactg

SEQ ID NO: 33548 - DNA, 25 bp, Mus musculus
aaccctgaacaagcagggctgactg

SEQ ID NO: 33549 - DNA, 25 bp, Mus musculus
aaccctgaacttagtgattaatgtc

SEQ ID NO: 33550 - DNA, 25 bp, Mus musculus
aaccctgaactttgtgattaatgtc

SEQ ID NO: 33551 - DNA, 25 bp, Mus musculus
aaccctgaagatcctaacaaggtgc

SEQ ID NO: 33552 - DNA, 25 bp, Mus musculus
aaccctgaagatgctaacaaggtgc

SEQ ID NO: 33553 - DNA, 25 bp, Mus musculus
aaccctgaagtgctcgacatcacag

SEQ ID NO: 33554 - DNA, 25 bp, Mus musculus
aaccctgaagtggtcgacatcacag

SEQ ID NO: 33555 - DNA, 25 bp, Mus musculus
aaccctgaagttctctttggcttgt

SEQ ID NO: 33556 - DNA, 25 bp, Mus musculus
aaccctgaagttgtctttggcttgt

SEQ ID NO: 33557 - DNA, 25 bp, Mus musculus
aaccctgaatagctgaagtggcctt

SEQ ID NO: 33558 - DNA, 25 bp, Mus musculus
aaccctgaataggtgaagtggcctt

SEQ ID NO: 33559 - DNA, 25 bp, Mus musculus
aaccctgaatgtcgaggacatcctc

SEQ ID NO: 33560 - DNA, 25 bp, Mus musculus
aaccctgaatgtggaggacatcctc

SEQ ID NO: 33561 - DNA, 25 bp, Mus musculus
aaccctgacagaataatttcatgaa

SEQ ID NO: 33562 - DNA, 25 bp, Mus musculus
aaccctgacagattaatttcatgaa

SEQ ID NO: 33563 - DNA, 25 bp, Mus musculus
aaccctgaccgccttctgattggtg

SEQ ID NO: 33564 - DNA, 25 bp, Mus musculus
aaccctgaccgcgttctgattggtg

SEQ ID NO: 33565 - DNA, 25 bp, Mus musculus
aaccctgacctaagattgtattgca

SEQ ID NO: 33566 - DNA, 25 bp, Mus musculus
aaccctgacctatgattgtattgca

SEQ ID NO: 33567 - DNA, 25 bp, Mus musculus
aaccctgactccagtgtacagatgc

SEQ ID NO: 33568 - DNA, 25 bp, Mus musculus
aaccctgactcctgtgtacagatgc

SEQ ID NO: 33569 - DNA, 25 bp, Mus musculus
aaccctgactgacacaactcactaa

SEQ ID NO: 33570 - DNA, 25 bp, Mus musculus
aaccctgactgagacaactcactaa

SEQ ID NO: 33571 - DNA, 25 bp, Mus musculus
aaccctgagagactggacggccaga

SEQ ID NO: 33572 - DNA, 25 bp, Mus musculus
aaccctgagagagtggacggccaga

SEQ ID NO: 33573 - DNA, 25 bp, Mus musculus
aaccctgagctgagtgtgctgaaca

SEQ ID NO: 33574 - DNA, 25 bp, Mus musculus
aaccctgagctgtgtgtgctgaaca

SEQ ID NO: 33575 - DNA, 25 bp, Mus musculus
aaccctgaggccaaagctgtgctga

SEQ ID NO: 33576 - DNA, 25 bp, Mus musculus
aaccctgaggcctaagctgtgctga

SEQ ID NO: 33577 - DNA, 25 bp, Mus musculus
aaccctgaggtaatcccatttcctg

SEQ ID NO: 33578 - DNA, 25 bp, Mus musculus
aaccctgaggtattcccatttcctg

SEQ ID NO: 33579 - DNA, 25 bp, Mus musculus
aaccctgagtacctaggcctggatg

SEQ ID NO: 33580 - DNA, 25 bp, Mus musculus
aaccctgagtacgtaggcctggatg

SEQ ID NO: 33581 - DNA, 25 bp, Mus musculus
aaccctgagtgcctgttgctcgtgg

SEQ ID NO: 33582 - DNA, 25 bp, Mus musculus
aaccctgagtgcgtgttgctcgtgg

SEQ ID NO: 33583 - DNA, 25 bp, Mus musculus
aaccctgagttaccagctttaggct

SEQ ID NO: 33584 - DNA, 25 bp, Mus musculus
aaccctgagttagcagctttaggct

SEQ ID NO: 33585 - DNA, 25 bp, Mus musculus
aaccctgagttgatacatagtaatg

SEQ ID NO: 33586 - DNA, 25 bp, Mus musculus
aaccctgagttgttacatagtaatg

SEQ ID NO: 33587 - DNA, 25 bp, Mus musculus
aaccctgataatccagtgaatttgg

SEQ ID NO: 33588 - DNA, 25 bp, Mus musculus
aaccctgataatgcagtgaatttgg

SEQ ID NO: 33589 - DNA, 25 bp, Mus musculus
aaccctgatcctattgagttgctaa

SEQ ID NO: 33590 - DNA, 25 bp, Mus musculus
aaccctgatccttttgagttgctaa

SEQ ID NO: 33591 - DNA, 25 bp, Mus musculus
aaccctgatggtcaagtagctcccc

SEQ ID NO: 33592 - DNA, 25 bp, Mus musculus
aaccctgatggtgaagtagctcccc

SEQ ID NO: 33593 - DNA, 25 bp, Mus musculus
aaccctgattgtagattagacccaa

SEQ ID NO: 33594 - DNA, 25 bp, Mus musculus
aaccctgattgttgattagacccaa

SEQ ID NO: 33595 - DNA, 25 bp, Mus musculus
aaccctgcaaagactcggagtcgga

SEQ ID NO: 33596 - DNA, 25 bp, Mus musculus
aaccctgcaaagtctcggagtcgga

SEQ ID NO: 33597 - DNA, 25 bp, Mus musculus
aaccctgcacgtagccatgtatgga

SEQ ID NO: 33598 - DNA, 25 bp, Mus musculus
aaccctgcacgttgccatgtatgga

SEQ ID NO: 33599 - DNA, 25 bp, Mus musculus
aaccctgcactcacacagatgctga

SEQ ID NO: 33600 - DNA, 25 bp, Mus musculus
aaccctgcactctcacagatgctga

SEQ ID NO: 33601 - DNA, 25 bp, Mus musculus
aaccctgcacttaggctagagaggc

SEQ ID NO: 33602 - DNA, 25 bp, Mus musculus
aaccctgcacttcaggttcagaaaa

SEQ ID NO: 33603 - DNA, 25 bp, Mus musculus
aaccctgcacttgaggttcagaaaa

SEQ ID NO: 33604 - DNA, 25 bp, Mus musculus
aaccctgcactttggctagagaggc

SEQ ID NO: 33605 - DNA, 25 bp, Mus musculus
aaccctgcagccaggagtcctttag

SEQ ID NO: 33606 - DNA, 25 bp, Mus musculus
aaccctgcagcctggagtcctttag

SEQ ID NO: 33607 - DNA, 25 bp, Mus musculus
aaccctgccactaactgaaacttag

SEQ ID NO: 33608 - DNA, 25 bp, Mus musculus
aaccctgccacttactgaaacttag

SEQ ID NO: 33609 - DNA, 25 bp, Mus musculus
aaccctgccctcaaagatgattgaa

SEQ ID NO: 33610 - DNA, 25 bp, Mus musculus
aaccctgccctctaagatgattgaa

SEQ ID NO: 33611 - DNA, 25 bp, Mus musculus
aaccctgccctgagttggaaagcag

SEQ ID NO: 33612 - DNA, 25 bp, Mus musculus
aaccctgccctgtgttggaaagcag

SEQ ID NO: 33613 - DNA, 25 bp, Mus musculus
aaccctgcctgaagagaacttccaa

SEQ ID NO: 33614 - DNA, 25 bp, Mus musculus
aaccctgcctgatgagaacttccaa

SEQ ID NO: 33615 - DNA, 25 bp, Mus musculus
aaccctgccttcacaacattatgat

SEQ ID NO: 33616 - DNA, 25 bp, Mus musculus
aaccctgccttctcaacattatgat

SEQ ID NO: 33617 - DNA, 25 bp, Mus musculus
aaccctgccttgaagcggactctat

SEQ ID NO: 33618 - DNA, 25 bp, Mus musculus
aaccctgccttgtagcggactctat

SEQ ID NO: 33619 - DNA, 25 bp, Mus musculus
aaccctgcgttcagtagctgagtac

SEQ ID NO: 33620 - DNA, 25 bp, Mus musculus
aaccctgcgttctgtagctgagtac

SEQ ID NO: 33621 - DNA, 25 bp, Mus musculus
aaccctgctctaatttgggtctgga

SEQ ID NO: 33622 - DNA, 25 bp, Mus musculus
aaccctgctctattttgggtctgga

SEQ ID NO: 33623 - DNA, 25 bp, Mus musculus
aaccctgctctgattggagaatgga

SEQ ID NO: 33624 - DNA, 25 bp, Mus musculus
aaccctgctctgtttggagaatgga

SEQ ID NO: 33625 - DNA, 25 bp, Mus musculus
aaccctgctttgagagttctaccaa

SEQ ID NO: 33626 - DNA, 25 bp, Mus musculus
aaccctgctttgtgagttctaccaa

SEQ ID NO: 33627 - DNA, 25 bp, Mus musculus
aaccctgcttttcaaaaggtgctga

SEQ ID NO: 33628 - DNA, 25 bp, Mus musculus
aaccctgcttttgaaaaggtgctga

SEQ ID NO: 33629 - DNA, 25 bp, Mus musculus
aaccctggacggacatctcctgctg

SEQ ID NO: 33630 - DNA, 25 bp, Mus musculus
aaccctggacggtcatctcctgctg

SEQ ID NO: 33631 - DNA, 25 bp, Mus musculus
aaccctggactgatcaataacgcct

SEQ ID NO: 33632 - DNA, 25 bp, Mus musculus
aaccctggactgttcaataacgcct

SEQ ID NO: 33633 - DNA, 25 bp, Mus musculus
aaccctggagacatcagtgtggagt

SEQ ID NO: 33634 - DNA, 25 bp, Mus musculus
aaccctggagaccagtccacttact

SEQ ID NO: 33635 - DNA, 25 bp, Mus musculus
aaccctggagacgagtccacttact

SEQ ID NO: 33636 - DNA, 25 bp, Mus musculus
aaccctggagacttcagtgtggagt

SEQ ID NO: 33637 - DNA, 25 bp, Mus musculus
aaccctggaggaattgagcttgagc

SEQ ID NO: 33638 - DNA, 25 bp, Mus musculus
aaccctggaggatttgagcttgagc

SEQ ID NO: 33639 - DNA, 25 bp, Mus musculus
aaccctggcacgcacagaagtggag

SEQ ID NO: 33640 - DNA, 25 bp, Mus musculus
aaccctggcacggacagaagtggag

SEQ ID NO: 33641 - DNA, 25 bp, Mus musculus
aaccctggccaaagacgaggctctg

SEQ ID NO: 33642 - DNA, 25 bp, Mus musculus
aaccctggccaatgacgaggctctg

SEQ ID NO: 33643 - DNA, 25 bp, Mus musculus
aaccctggcttcagaagtcgagaat

SEQ ID NO: 33644 - DNA, 25 bp, Mus musculus
aaccctggcttctgaagtcgagaat

SEQ ID NO: 33645 - DNA, 25 bp, Mus musculus
aaccctgggaatccacacggtggca

SEQ ID NO: 33646 - DNA, 25 bp, Mus musculus
aaccctgggaatgcacacggtggca

SEQ ID NO: 33647 - DNA, 25 bp, Mus musculus
aaccctgggcctcatgtatgttaga

SEQ ID NO: 33648 - DNA, 25 bp, Mus musculus
aaccctgggcctgatgtatgttaga

SEQ ID NO: 33649 - DNA, 25 bp, Mus musculus
aaccctgggcgactcagtgaaacgt

SEQ ID NO: 33650 - DNA, 25 bp, Mus musculus
aaccctgggcgagtcagtgaaacgt

SEQ ID NO: 33651 - DNA, 25 bp, Mus musculus
aaccctggtattactgttatacact

SEQ ID NO: 33652 - DNA, 25 bp, Mus musculus
aaccctggtatttctgttatacact

SEQ ID NO: 33653 - DNA, 25 bp, Mus musculus
aaccctggtcctcaggcttgagcaa

SEQ ID NO: 33654 - DNA, 25 bp, Mus musculus
aaccctggtcctgaggcttgagcaa

SEQ ID NO: 33655 - DNA, 25 bp, Mus musculus
aaccctggtctacggcggaatgtgt

SEQ ID NO: 33656 - DNA, 25 bp, Mus musculus
aaccctggtctagggcggaatgtgt

SEQ ID NO: 33657 - DNA, 25 bp, Mus musculus
aaccctggtcttctggacggtcagc

SEQ ID NO: 33658 - DNA, 25 bp, Mus musculus
aaccctggtcttgtggacggtcagc

SEQ ID NO: 33659 - DNA, 25 bp, Mus musculus
aaccctggtgctaaaagatactgta

SEQ ID NO: 33660 - DNA, 25 bp, Mus musculus
aaccctggtgcttaaagatactgta

SEQ ID NO: 33661 - DNA, 25 bp, Mus musculus
aaccctgtaagcctgtggagggcta

SEQ ID NO: 33662 - DNA, 25 bp, Mus musculus
aaccctgtaagcgtgtggagggcta

SEQ ID NO: 33663 - DNA, 25 bp, Mus musculus
aaccctgtacacatttagtccctag

SEQ ID NO: 33664 - DNA, 25 bp, Mus musculus
aaccctgtacacttttagtccctag

SEQ ID NO: 33665 - DNA, 25 bp, Mus musculus
aaccctgtaggcatcaactcagttt

SEQ ID NO: 33666 - DNA, 25 bp, Mus musculus
aaccctgtaggcttcaactcagttt

SEQ ID NO: 33667 - DNA, 25 bp, Mus musculus
aaccctgtatatatttgctgactgt

SEQ ID NO: 33668 - DNA, 25 bp, Mus musculus
aaccctgtatatttttgctgactgt

SEQ ID NO: 33669 - DNA, 25 bp, Mus musculus
aaccctgtcagtaatgctcagcctg

SEQ ID NO: 33670 - DNA, 25 bp, Mus musculus
aaccctgtcagttatgctcagcctg

SEQ ID NO: 33671 - DNA, 25 bp, Mus musculus
aaccctgtcattaacgctttcagaa

SEQ ID NO: 33672 - DNA, 25 bp, Mus musculus
aaccctgtcatttacgctttcagaa

SEQ ID NO: 33673 - DNA, 25 bp, Mus musculus
aaccctgtccttagtctgcttttca

SEQ ID NO: 33674 - DNA, 25 bp, Mus musculus
aaccctgtcctttgtctgcttttca

SEQ ID NO: 33675 - DNA, 25 bp, Mus musculus
aaccctgtctctagatagtaacaac

SEQ ID NO: 33676 - DNA, 25 bp, Mus musculus
aaccctgtctcttgatagtaacaac

SEQ ID NO: 33677 - DNA, 25 bp, Mus musculus
aaccctgtgaacatttctgactatg

SEQ ID NO: 33678 - DNA, 25 bp, Mus musculus
aaccctgtgaacttttctgactatg

SEQ ID NO: 33679 - DNA, 25 bp, Mus musculus
aaccctgtgcctagctggtgagcag

SEQ ID NO: 33680 - DNA, 25 bp, Mus musculus
aaccctgtgccttgctggtgagcag

SEQ ID NO: 33681 - DNA, 25 bp, Mus musculus
aaccctgtgcgacaggagcgcgggc

SEQ ID NO: 33682 - DNA, 25 bp, Mus musculus
aaccctgtgcgagaggagcgcgggc

SEQ ID NO: 33683 - DNA, 25 bp, Mus musculus
aaccctgtgcggaaactggtattga

SEQ ID NO: 33684 - DNA, 25 bp, Mus musculus
aaccctgtgcggtaactggtattga

SEQ ID NO: 33685 - DNA, 25 bp, Mus musculus
aaccctgtgctacgaatctcacgaa

SEQ ID NO: 33686 - DNA, 25 bp, Mus musculus
aaccctgtgctaggaatctcacgaa

SEQ ID NO: 33687 - DNA, 25 bp, Mus musculus
aaccctgtggaccaggaagcgaatt

SEQ ID NO: 33688 - DNA, 25 bp, Mus musculus
aaccctgtggacgaggaagcgaatt

SEQ ID NO: 33689 - DNA, 25 bp, Mus musculus
aaccctgtgggaagatctttcttct

SEQ ID NO: 33690 - DNA, 25 bp, Mus musculus
aaccctgtgggatgatctttcttct

SEQ ID NO: 33691 - DNA, 25 bp, Mus musculus
aaccctgtgtgcctgtcggcatgaa

SEQ ID NO: 33692 - DNA, 25 bp, Mus musculus
aaccctgtgtgcgtgtcggcatgaa

SEQ ID NO: 33693 - DNA, 25 bp, Mus musculus
aaccctgttgatctgtaggcttaca

SEQ ID NO: 33694 - DNA, 25 bp, Mus musculus
aaccctgttgatgtgtaggcttaca

SEQ ID NO: 33695 - DNA, 25 bp, Mus musculus
aaccctgtttgcaaagagtagacct

SEQ ID NO: 33696 - DNA, 25 bp, Mus musculus
aaccctgtttgctaagagtagacct

SEQ ID NO: 33697 - DNA, 25 bp, Mus musculus
aaccctgtttgtagtcgtgaaagat

SEQ ID NO: 33698 - DNA, 25 bp, Mus musculus
aaccctgtttgtctatacccagatg

SEQ ID NO: 33699 - DNA, 25 bp, Mus musculus
aaccctgtttgtgtatacccagatg

SEQ ID NO: 33700 - DNA, 25 bp, Mus musculus
aaccctgtttgttgtcgtgaaagat

SEQ ID NO: 33701 - DNA, 25 bp, Mus musculus
aaccctgttttccaatctgtcattt

SEQ ID NO: 33702 - DNA, 25 bp, Mus musculus
aaccctgttttcgaatctgtcattt

SEQ ID NO: 33703 - DNA, 25 bp, Mus musculus
aacccttaagagatgtgtactgtat

SEQ ID NO: 33704 - DNA, 25 bp, Mus musculus
aacccttaagagttgtgtactgtat

SEQ ID NO: 33705 - DNA, 25 bp, Mus musculus
aacccttaagtgaacttcattcatc

SEQ ID NO: 33706 - DNA, 25 bp, Mus musculus
aacccttaagtgtacttcattcatc

SEQ ID NO: 33707 - DNA, 25 bp, Mus musculus
aacccttacagtctcttgattgtga

SEQ ID NO: 33708 - DNA, 25 bp, Mus musculus
aacccttacagtgtcttgattgtga

SEQ ID NO: 33709 - DNA, 25 bp, Mus musculus
aacccttacccactggataatatgc

SEQ ID NO: 33710 - DNA, 25 bp, Mus musculus
aacccttacccagtggataatatgc

SEQ ID NO: 33711 - DNA, 25 bp, Mus musculus
aacccttacctgattctgtcaatga

SEQ ID NO: 33712 - DNA, 25 bp, Mus musculus
aacccttacctgtttctgtcaatga

SEQ ID NO: 33713 - DNA, 25 bp, Mus musculus
aacccttacgaaaacagcgtggaag

SEQ ID NO: 33714 - DNA, 25 bp, Mus musculus
aacccttacgaatacagcgtggaag

SEQ ID NO: 33715 - DNA, 25 bp, Mus musculus
aacccttagcttacatttgtattgt

SEQ ID NO: 33716 - DNA, 25 bp, Mus musculus
aacccttagcttccatattgtgcag

SEQ ID NO: 33717 - DNA, 25 bp, Mus musculus
aacccttagcttgcatattgtgcag

SEQ ID NO: 33718 - DNA, 25 bp, Mus musculus
aacccttagctttcatttgtattgt

SEQ ID NO: 33719 - DNA, 25 bp, Mus musculus
aacccttaggctccagttggtgaga

SEQ ID NO: 33720 - DNA, 25 bp, Mus musculus
aacccttaggctctaagttctatga

SEQ ID NO: 33721 - DNA, 25 bp, Mus musculus
aacccttaggctgcagttggtgaga

SEQ ID NO: 33722 - DNA, 25 bp, Mus musculus
aacccttaggctgtaagttctatga

SEQ ID NO: 33723 - DNA, 25 bp, Mus musculus
aacccttattttctgagtatcctag

SEQ ID NO: 33724 - DNA, 25 bp, Mus musculus
aacccttattttgtgagtatcctag

SEQ ID NO: 33725 - DNA, 25 bp, Mus musculus
aacccttcaaacatctggtgacact

SEQ ID NO: 33726 - DNA, 25 bp, Mus musculus
aacccttcaaacttctggtgacact

SEQ ID NO: 33727 - DNA, 25 bp, Mus musculus
aacccttcacataccattacaaaat

SEQ ID NO: 33728 - DNA, 25 bp, Mus musculus
aacccttcacattccattacaaaat

SEQ ID NO: 33729 - DNA, 25 bp, Mus musculus
aacccttcactaacatttccagtgc

SEQ ID NO: 33730 - DNA, 25 bp, Mus musculus
aacccttcactatcatttccagtgc

SEQ ID NO: 33731 - DNA, 25 bp, Mus musculus
aacccttcatccatcactggaataa

SEQ ID NO: 33732 - DNA, 25 bp, Mus musculus
aacccttcatccttcactggaataa

SEQ ID NO: 33733 - DNA, 25 bp, Mus musculus
aacccttcatttcctgatctgacaa

SEQ ID NO: 33734 - DNA, 25 bp, Mus musculus
aacccttcatttgctgatctgacaa

SEQ ID NO: 33735 - DNA, 25 bp, Mus musculus
aacccttccaggcaatccatgctga

SEQ ID NO: 33736 - DNA, 25 bp, Mus musculus
aacccttccagggaatccatgctga

SEQ ID NO: 33737 - DNA, 25 bp, Mus musculus
aacccttccggcataatcagtgagt

SEQ ID NO: 33738 - DNA, 25 bp, Mus musculus
aacccttccggcttaatcagtgagt

SEQ ID NO: 33739 - DNA, 25 bp, Mus musculus
aacccttcctgcagattattgtgat

SEQ ID NO: 33740 - DNA, 25 bp, Mus musculus
aacccttcctgctgattattgtgat

SEQ ID NO: 33741 - DNA, 25 bp, Mus musculus
aacccttccttcaagacagtgactt

SEQ ID NO: 33742 - DNA, 25 bp, Mus musculus
aacccttccttcaatatggagcctt

SEQ ID NO: 33743 - DNA, 25 bp, Mus musculus
aacccttccttctagacagtgactt

SEQ ID NO: 33744 - DNA, 25 bp, Mus musculus
aacccttccttctatatggagcctt

SEQ ID NO: 33745 - DNA, 25 bp, Mus musculus
aacccttctatcatcaaagatcaca

SEQ ID NO: 33746 - DNA, 25 bp, Mus musculus
aacccttctatcttcaaagatcaca

SEQ ID NO: 33747 - DNA, 25 bp, Mus musculus
aacccttctcccaagctggaagctt

SEQ ID NO: 33748 - DNA, 25 bp, Mus musculus
aacccttctccctagctggaagctt

SEQ ID NO: 33749 - DNA, 25 bp, Mus musculus
aacccttctctcaccactccaggag

SEQ ID NO: 33750 - DNA, 25 bp, Mus musculus
aacccttctctctccactccaggag

SEQ ID NO: 33751 - DNA, 25 bp, Mus musculus
aacccttctctgattgctgtggcta

SEQ ID NO: 33752 - DNA, 25 bp, Mus musculus
aacccttctctgtttgctgtggcta

SEQ ID NO: 33753 - DNA, 25 bp, Mus musculus
aacccttctgaactccattactgtt

SEQ ID NO: 33754 - DNA, 25 bp, Mus musculus
aacccttctgaagtccattactgtt

SEQ ID NO: 33755 - DNA, 25 bp, Mus musculus
aacccttctgacactgcatgaggtt

SEQ ID NO: 33756 - DNA, 25 bp, Mus musculus
aacccttctgactctgcatgaggtt

SEQ ID NO: 33757 - DNA, 25 bp, Mus musculus
aacccttctgggagtcatccgtagc

SEQ ID NO: 33758 - DNA, 25 bp, Mus musculus
aacccttctgggtgtcatccgtagc

SEQ ID NO: 33759 - DNA, 25 bp, Mus musculus
aacccttcttatcaagttccctgca

SEQ ID NO: 33760 - DNA, 25 bp, Mus musculus
aacccttcttatgaagttccctgca

SEQ ID NO: 33761 - DNA, 25 bp, Mus musculus
aacccttgaaatcatgtcgcgtcgc

SEQ ID NO: 33762 - DNA, 25 bp, Mus musculus
aacccttgaaatgatgtcgcgtcgc

SEQ ID NO: 33763 - DNA, 25 bp, Mus musculus
aacccttgagaaattgagggctcaa

SEQ ID NO: 33764 - DNA, 25 bp, Mus musculus
aacccttgagaatttgagggctcaa

SEQ ID NO: 33765 - DNA, 25 bp, Mus musculus
aacccttgagagcatgttcccagtg

SEQ ID NO: 33766 - DNA, 25 bp, Mus musculus
aacccttgagaggatgttcccagtg

SEQ ID NO: 33767 - DNA, 25 bp, Mus musculus
aacccttgagttatagatgagaagt

SEQ ID NO: 33768 - DNA, 25 bp, Mus musculus
aacccttgagttctttgagatcaca

SEQ ID NO: 33769 - DNA, 25 bp, Mus musculus
aacccttgagttgtttgagatcaca

SEQ ID NO: 33770 - DNA, 25 bp, Mus musculus
aacccttgagttttagatgagaagt

SEQ ID NO: 33771 - DNA, 25 bp, Mus musculus
aacccttgcaagagaacacccagag

SEQ ID NO: 33772 - DNA, 25 bp, Mus musculus
aacccttgcaagtgaacacccagag

SEQ ID NO: 33773 - DNA, 25 bp, Mus musculus
aacccttgcattaatggactctgga

SEQ ID NO: 33774 - DNA, 25 bp, Mus musculus
aacccttgcatttatggactctgga

SEQ ID NO: 33775 - DNA, 25 bp, Mus musculus
aacccttgcctcaaagatcttcagt

SEQ ID NO: 33776 - DNA, 25 bp, Mus musculus
aacccttgcctctaagatcttcagt

SEQ ID NO: 33777 - DNA, 25 bp, Mus musculus
aacccttgctgcaatttccgacagg

SEQ ID NO: 33778 - DNA, 25 bp, Mus musculus
aacccttgctgctatttccgacagg

SEQ ID NO: 33779 - DNA, 25 bp, Mus musculus
aacccttggaggctctgtgttgttg

SEQ ID NO: 33780 - DNA, 25 bp, Mus musculus
aacccttggagggtctgtgttgttg

SEQ ID NO: 33781 - DNA, 25 bp, Mus musculus
aacccttgggcactgggaagtagca

SEQ ID NO: 33782 - DNA, 25 bp, Mus musculus
aacccttgggcagtgggaagtagca

SEQ ID NO: 33783 - DNA, 25 bp, Mus musculus
aacccttgtcctagtatttcacttg

SEQ ID NO: 33784 - DNA, 25 bp, Mus musculus
aacccttgtccttgtatttcacttg

SEQ ID NO: 33785 - DNA, 25 bp, Mus musculus
aacccttgtgccatggagggtgctg

SEQ ID NO: 33786 - DNA, 25 bp, Mus musculus
aacccttgtgccttggagggtgctg

SEQ ID NO: 33787 - DNA, 25 bp, Mus musculus
aaccctttataacccaacattcatg

SEQ ID NO: 33788 - DNA, 25 bp, Mus musculus
aaccctttataagccaacattcatg

SEQ ID NO: 33789 - DNA, 25 bp, Mus musculus
aaccctttcaagcagcgaatctgca

SEQ ID NO: 33790 - DNA, 25 bp, Mus musculus
aaccctttcaaggagcgaatctgca

SEQ ID NO: 33791 - DNA, 25 bp, Mus musculus
aaccctttcactccgtattggatat

SEQ ID NO: 33792 - DNA, 25 bp, Mus musculus
aaccctttcactgcgtattggatat

SEQ ID NO: 33793 - DNA, 25 bp, Mus musculus
aaccctttcagcagccaattttgaa

SEQ ID NO: 33794 - DNA, 25 bp, Mus musculus
aaccctttcagctgccaattttgaa

SEQ ID NO: 33795 - DNA, 25 bp, Mus musculus
aaccctttcctgactgacacctgga

SEQ ID NO: 33796 - DNA, 25 bp, Mus musculus
aaccctttcctgtctgacacctgga

SEQ ID NO: 33797 - DNA, 25 bp, Mus musculus
aaccctttctccagtgacttacaga

SEQ ID NO: 33798 - DNA, 25 bp, Mus musculus
aaccctttctcctgtgacttacaga

SEQ ID NO: 33799 - DNA, 25 bp, Mus musculus
aaccctttctgcctttgaaatggag

SEQ ID NO: 33800 - DNA, 25 bp, Mus musculus
aaccctttctgcgtttgaaatggag

SEQ ID NO: 33801 - DNA, 25 bp, Mus musculus
aaccctttgagacatgggctttcca

SEQ ID NO: 33802 - DNA, 25 bp, Mus musculus
aaccctttgagagatgggctttcca

SEQ ID NO: 33803 - DNA, 25 bp, Mus musculus
aaccctttggatcctaagctcgtgt

SEQ ID NO: 33804 - DNA, 25 bp, Mus musculus
aaccctttggatgctaagctcgtgt

SEQ ID NO: 33805 - DNA, 25 bp, Mus musculus
aaccctttggctcgcactgacagag

SEQ ID NO: 33806 - DNA, 25 bp, Mus musculus
aaccctttggctggcactgacagag

SEQ ID NO: 33807 - DNA, 25 bp, Mus musculus
aaccctttgtgcctaaatccaactg

SEQ ID NO: 33808 - DNA, 25 bp, Mus musculus
aaccctttgtgcgtaaatccaactg

SEQ ID NO: 33809 - DNA, 25 bp, Mus musculus
aacccttttgtgaccttcattgatc

SEQ ID NO: 33810 - DNA, 25 bp, Mus musculus
aacccttttgtgtccttcattgatc

SEQ ID NO: 33811 - DNA, 25 bp, Mus musculus
aaccgaaaagttccagcttgggcat

SEQ ID NO: 33812 - DNA, 25 bp, Mus musculus
aaccgaaaagttgcagcttgggcat

SEQ ID NO: 33813 - DNA, 25 bp, Mus musculus
aaccgaaacctcaagcctgacagaa

SEQ ID NO: 33814 - DNA, 25 bp, Mus musculus
aaccgaaacctctagcctgacagaa

SEQ ID NO: 33815 - DNA, 25 bp, Mus musculus
aaccgaacctcaactcttagttggg

SEQ ID NO: 33816 - DNA, 25 bp, Mus musculus
aaccgaacctcatctcttagttggg

SEQ ID NO: 33817 - DNA, 25 bp, Mus musculus
aaccgaactgtcacactaaaagaag

SEQ ID NO: 33818 - DNA, 25 bp, Mus musculus
aaccgaactgtctcactaaaagaag

SEQ ID NO: 33819 - DNA, 25 bp, Mus musculus
aaccgaagacagatcttcttgtggg

SEQ ID NO: 33820 - DNA, 25 bp, Mus musculus
aaccgaagacagttcttcttgtggg

SEQ ID NO: 33821 - DNA, 25 bp, Mus musculus
aaccgaagatccactattctcttaa

SEQ ID NO: 33822 - DNA, 25 bp, Mus musculus
aaccgaagatcctctattctcttaa

SEQ ID NO: 33823 - DNA, 25 bp, Mus musculus
aaccgaagccttcctgcacctgagt

SEQ ID NO: 33824 - DNA, 25 bp, Mus musculus
aaccgaagccttgctgcacctgagt

SEQ ID NO: 33825 - DNA, 25 bp, Mus musculus
aaccgaagtggtctcttgttgccaa

SEQ ID NO: 33826 - DNA, 25 bp, Mus musculus
aaccgaagtggtgtcttgttgccaa

SEQ ID NO: 33827 - DNA, 25 bp, Mus musculus
aaccgaatgctcagagttggccacg

SEQ ID NO: 33828 - DNA, 25 bp, Mus musculus
aaccgaatgctctgagttggccacg

SEQ ID NO: 33829 - DNA, 25 bp, Mus musculus
aaccgacaactgactaggtcccaga

SEQ ID NO: 33830 - DNA, 25 bp, Mus musculus
aaccgacaactgtctaggtcccaga

SEQ ID NO: 33831 - DNA, 25 bp, Mus musculus
aaccgacacctgatgtcaggcggcg

SEQ ID NO: 33832 - DNA, 25 bp, Mus musculus
aaccgacacctgttgtcaggcggcg

SEQ ID NO: 33833 - DNA, 25 bp, Mus musculus
aaccgacacttgcagggcagctttg

SEQ ID NO: 33834 - DNA, 25 bp, Mus musculus
aaccgacacttggagggcagctttg

SEQ ID NO: 33835 - DNA, 25 bp, Mus musculus
aaccgacagtctaaagcagtgctcc

SEQ ID NO: 33836 - DNA, 25 bp, Mus musculus
aaccgacagtcttaagcagtgctcc

SEQ ID NO: 33837 - DNA, 25 bp, Mus musculus
aaccgacattggctcatgctgtatc

SEQ ID NO: 33838 - DNA, 25 bp, Mus musculus
aaccgacattgggtcatgctgtatc

SEQ ID NO: 33839 - DNA, 25 bp, Mus musculus
aaccgacctagacggcagtgaggca

SEQ ID NO: 33840 - DNA, 25 bp, Mus musculus
aaccgacctagagggcagtgaggca

SEQ ID NO: 33841 - DNA, 25 bp, Mus musculus
aaccgactggtcacgttctggacaa

SEQ ID NO: 33842 - DNA, 25 bp, Mus musculus
aaccgactggtctcgttctggacaa

SEQ ID NO: 33843 - DNA, 25 bp, Mus musculus
aaccgactgttgcatcgtcagcgat

SEQ ID NO: 33844 - DNA, 25 bp, Mus musculus
aaccgactgttggatcgtcagcgat

SEQ ID NO: 33845 - DNA, 25 bp, Mus musculus
aaccgactttcacagcttagttgtt

SEQ ID NO: 33846 - DNA, 25 bp, Mus musculus
aaccgactttcagagcttagttgtt

SEQ ID NO: 33847 - DNA, 25 bp, Mus musculus
aaccgagaaggtcccaaagctctgg

SEQ ID NO: 33848 - DNA, 25 bp, Mus musculus
aaccgagaaggtgccaaagctctgg

SEQ ID NO: 33849 - DNA, 25 bp, Mus musculus
aaccgagaattcctctgcgctgagg

SEQ ID NO: 33850 - DNA, 25 bp, Mus musculus
aaccgagaattcgtctgcgctgagg

SEQ ID NO: 33851 - DNA, 25 bp, Mus musculus
aaccgagacacacaggagaccttgc

SEQ ID NO: 33852 - DNA, 25 bp, Mus musculus
aaccgagacacagaggagaccttgc

SEQ ID NO: 33853 - DNA, 25 bp, Mus musculus
aaccgagacctgcaggcgcatgttc

SEQ ID NO: 33854 - DNA, 25 bp, Mus musculus
aaccgagacctggaggcgcatgttc

SEQ ID NO: 33855 - DNA, 25 bp, Mus musculus
aaccgagataggctgaggacttatt

SEQ ID NO: 33856 - DNA, 25 bp, Mus musculus
aaccgagatagggtgaggacttatt

SEQ ID NO: 33857 - DNA, 25 bp, Mus musculus
aaccgagcctgcagttaaagcccaa

SEQ ID NO: 33858 - DNA, 25 bp, Mus musculus
aaccgagcctgctgttaaagcccaa

SEQ ID NO: 33859 - DNA, 25 bp, Mus musculus
aaccgagctctcaagggtccaagga

SEQ ID NO: 33860 - DNA, 25 bp, Mus musculus
aaccgagctctctagggtccaagga

SEQ ID NO: 33861 - DNA, 25 bp, Mus musculus
aaccgagctgagaacttggatagac

SEQ ID NO: 33862 - DNA, 25 bp, Mus musculus
aaccgagctgagtacttggatagac

SEQ ID NO: 33863 - DNA, 25 bp, Mus musculus
aaccgaggagcaaatctgcacagct

SEQ ID NO: 33864 - DNA, 25 bp, Mus musculus
aaccgaggagcatatctgcacagct

SEQ ID NO: 33865 - DNA, 25 bp, Mus musculus
aaccgagggttactacatgaacact

SEQ ID NO: 33866 - DNA, 25 bp, Mus musculus
aaccgagggttactatgtatgactg

SEQ ID NO: 33867 - DNA, 25 bp, Mus musculus
aaccgagggttagtacatgaacact

SEQ ID NO: 33868 - DNA, 25 bp, Mus musculus
aaccgagggttagtatgtatgactg

SEQ ID NO: 33869 - DNA, 25 bp, Mus musculus
aaccgaggtcacagcaattggagcc

SEQ ID NO: 33870 - DNA, 25 bp, Mus musculus
aaccgaggtcactgcaattggagcc

SEQ ID NO: 33871 - DNA, 25 bp, Mus musculus
aaccgagtaaccatgctgtatggca

SEQ ID NO: 33872 - DNA, 25 bp, Mus musculus
aaccgagtaaccttgctgtatggca

SEQ ID NO: 33873 - DNA, 25 bp, Mus musculus
aaccgagtaagcctttgtgtcaaga

SEQ ID NO: 33874 - DNA, 25 bp, Mus musculus
aaccgagtaagcgtttgtgtcaaga

SEQ ID NO: 33875 - DNA, 25 bp, Mus musculus
aaccgagtggccactatgttacaca

SEQ ID NO: 33876 - DNA, 25 bp, Mus musculus
aaccgagtggcctctatgttacaca

SEQ ID NO: 33877 - DNA, 25 bp, Mus musculus
aaccgagtgggaagcatggattaga

SEQ ID NO: 33878 - DNA, 25 bp, Mus musculus
aaccgagtgggatgcatggattaga

SEQ ID NO: 33879 - DNA, 25 bp, Mus musculus
aaccgagtttccagccaaggcagtg

SEQ ID NO: 33880 - DNA, 25 bp, Mus musculus
aaccgagtttcctgccaaggcagtg

SEQ ID NO: 33881 - DNA, 25 bp, Mus musculus
aaccgatagtgcactctctgggtaa

SEQ ID NO: 33882 - DNA, 25 bp, Mus musculus
aaccgatagtgctctctctgggtaa

SEQ ID NO: 33883 - DNA, 25 bp, Mus musculus
aaccgatcctcacattggatggcta

SEQ ID NO: 33884 - DNA, 25 bp, Mus musculus
aaccgatcctcagattggatggcta

SEQ ID NO: 33885 - DNA, 25 bp, Mus musculus
aaccgatccttgagctttgcctctg

SEQ ID NO: 33886 - DNA, 25 bp, Mus musculus
aaccgatccttgtgctttgcctctg

SEQ ID NO: 33887 - DNA, 25 bp, Mus musculus
aaccgatgaactagtttggtggagc

SEQ ID NO: 33888 - DNA, 25 bp, Mus musculus
aaccgatgaacttgtttggtggagc

SEQ ID NO: 33889 - DNA, 25 bp, Mus musculus
aaccgatgatcactttgacttccat

SEQ ID NO: 33890 - DNA, 25 bp, Mus musculus
aaccgatgatcagtttgacttccat

SEQ ID NO: 33891 - DNA, 25 bp, Mus musculus
aaccgatggctgagtgggactgcta

SEQ ID NO: 33892 - DNA, 25 bp, Mus musculus
aaccgatggctgtgtgggactgcta

SEQ ID NO: 33893 - DNA, 25 bp, Mus musculus
aaccgatgttgcctgtggactagaa

SEQ ID NO: 33894 - DNA, 25 bp, Mus musculus
aaccgatgttgcgtgtggactagaa

SEQ ID NO: 33895 - DNA, 25 bp, Mus musculus
aaccgattcgtcagtgttggaccac

SEQ ID NO: 33896 - DNA, 25 bp, Mus musculus
aaccgattcgtctgtgttggaccac

SEQ ID NO: 33897 - DNA, 25 bp, Mus musculus
aaccgattcttccttcaatttagtg

SEQ ID NO: 33898 - DNA, 25 bp, Mus musculus
aaccgattcttcgttcaatttagtg

SEQ ID NO: 33899 - DNA, 25 bp, Mus musculus
aaccgattgtgaagcttagtgtgaa

SEQ ID NO: 33900 - DNA, 25 bp, Mus musculus
aaccgattgtgatgcttagtgtgaa

SEQ ID NO: 33901 - DNA, 25 bp, Mus musculus
aaccgcaaactacctctcaggaaag

SEQ ID NO: 33902 - DNA, 25 bp, Mus musculus
aaccgcaaactagctctcaggaaag

SEQ ID NO: 33903 - DNA, 25 bp, Mus musculus
aaccgcaagcgtcctgctaatgaaa

SEQ ID NO: 33904 - DNA, 25 bp, Mus musculus
aaccgcaagcgtgctgctaatgaaa

SEQ ID NO: 33905 - DNA, 25 bp, Mus musculus
aaccgcaagctcctctgtgtgctga

SEQ ID NO: 33906 - DNA, 25 bp, Mus musculus
aaccgcaagctcgtctgtgtgctga

SEQ ID NO: 33907 - DNA, 25 bp, Mus musculus
aaccgcaataaaaccaactctcatc

SEQ ID NO: 33908 - DNA, 25 bp, Mus musculus
aaccgcaataaatccaactctcatc

SEQ ID NO: 33909 - DNA, 25 bp, Mus musculus
aaccgcaatccccaagcatcttggg

SEQ ID NO: 33910 - DNA, 25 bp, Mus musculus
aaccgcaatcccgaagcatcttggg

SEQ ID NO: 33911 - DNA, 25 bp, Mus musculus
aaccgcaatctcctgtatattttct

SEQ ID NO: 33912 - DNA, 25 bp, Mus musculus
aaccgcaatctcgtgtatattttct

SEQ ID NO: 33913 - DNA, 25 bp, Mus musculus
aaccgcacgcgactctcaagggaga

SEQ ID NO: 33914 - DNA, 25 bp, Mus musculus
aaccgcacgcgagtctcaagggaga

SEQ ID NO: 33915 - DNA, 25 bp, Mus musculus
aaccgcactgggattagctttcttt

SEQ ID NO: 33916 - DNA, 25 bp, Mus musculus
aaccgcactgggtttagctttcttt

SEQ ID NO: 33917 - DNA, 25 bp, Mus musculus
aaccgcagaggtattgtctgtcgtc

SEQ ID NO: 33918 - DNA, 25 bp, Mus musculus
aaccgcagaggttttgtctgtcgtc

SEQ ID NO: 33919 - DNA, 25 bp, Mus musculus
aaccgcaggcttatgatggagcagt

SEQ ID NO: 33920 - DNA, 25 bp, Mus musculus
aaccgcaggcttttgatggagcagt

SEQ ID NO: 33921 - DNA, 25 bp, Mus musculus
aaccgcagtgccatttgacatgatc

SEQ ID NO: 33922 - DNA, 25 bp, Mus musculus
aaccgcagtgccttttgacatgatc

SEQ ID NO: 33923 - DNA, 25 bp, Mus musculus
aaccgcataggaaccatgtatttat

SEQ ID NO: 33924 - DNA, 25 bp, Mus musculus
aaccgcataggatccatgtatttat

SEQ ID NO: 33925 - DNA, 25 bp, Mus musculus
aaccgcatatagacagccctccgga

SEQ ID NO: 33926 - DNA, 25 bp, Mus musculus
aaccgcatatagtcagccctccgga

SEQ ID NO: 33927 - DNA, 25 bp, Mus musculus
aaccgcattgccatttcatttgata

SEQ ID NO: 33928 - DNA, 25 bp, Mus musculus
aaccgcattgccttttcatttgata

SEQ ID NO: 33929 - DNA, 25 bp, Mus musculus
aaccgccaagagctgttagcacatt

SEQ ID NO: 33930 - DNA, 25 bp, Mus musculus
aaccgccaagaggtgttagcacatt

SEQ ID NO: 33931 - DNA, 25 bp, Mus musculus
aaccgccacagtatccagaactctg

SEQ ID NO: 33932 - DNA, 25 bp, Mus musculus
aaccgccacagtttccagaactctg

SEQ ID NO: 33933 - DNA, 25 bp, Mus musculus
aaccgccagtagcaactctgaagtg

SEQ ID NO: 33934 - DNA, 25 bp, Mus musculus
aaccgccagtaggaactctgaagtg

SEQ ID NO: 33935 - DNA, 25 bp, Mus musculus
aaccgcccaaccaatggtggtgaga

SEQ ID NO: 33936 - DNA, 25 bp, Mus musculus
aaccgcccaacctatggtggtgaga

SEQ ID NO: 33937 - DNA, 25 bp, Mus musculus
aaccgccctggcagtgagatgtgta

SEQ ID NO: 33938 - DNA, 25 bp, Mus musculus
aaccgccctggctgtgagatgtgta

SEQ ID NO: 33939 - DNA, 25 bp, Mus musculus
aaccgccctgttctgaatattttgt

SEQ ID NO: 33940 - DNA, 25 bp, Mus musculus
aaccgccctgttgtgaatattttgt

SEQ ID NO: 33941 - DNA, 25 bp, Mus musculus
aaccgccggattatacgtggccgat

SEQ ID NO: 33942 - DNA, 25 bp, Mus musculus
aaccgccggattttacgtggccgat

SEQ ID NO: 33943 - DNA, 25 bp, Mus musculus
aaccgcctagttctcggcacagttg

SEQ ID NO: 33944 - DNA, 25 bp, Mus musculus
aaccgcctagttgtcggcacagttg

SEQ ID NO: 33945 - DNA, 25 bp, Mus musculus
aaccgccttgctcgcgagaaggtag

SEQ ID NO: 33946 - DNA, 25 bp, Mus musculus
aaccgccttgctggcgagaaggtag

SEQ ID NO: 33947 - DNA, 25 bp, Mus musculus
aaccgccttttgacctctgcagaag

SEQ ID NO: 33948 - DNA, 25 bp, Mus musculus
aaccgccttttgtcctctgcagaag

SEQ ID NO: 33949 - DNA, 25 bp, Mus musculus
aaccgcgcctgtaatgtgaaatcct

SEQ ID NO: 33950 - DNA, 25 bp, Mus musculus
aaccgcgcctgttatgtgaaatcct

SEQ ID NO: 33951 - DNA, 25 bp, Mus musculus
aaccgcggccagaagacattgtcaa

SEQ ID NO: 33952 - DNA, 25 bp, Mus musculus
aaccgcggccagtagacattgtcaa

SEQ ID NO: 33953 - DNA, 25 bp, Mus musculus
aaccgcgtggttaattacatctgtg

SEQ ID NO: 33954 - DNA, 25 bp, Mus musculus
aaccgcgtggtttattacatctgtg

SEQ ID NO: 33955 - DNA, 25 bp, Mus musculus
aaccgctacaaccatgaagggcata

SEQ ID NO: 33956 - DNA, 25 bp, Mus musculus
aaccgctacaacgatgaagggcata

SEQ ID NO: 33957 - DNA, 25 bp, Mus musculus
aaccgctagcaacccaacgaggagg

SEQ ID NO: 33958 - DNA, 25 bp, Mus musculus
aaccgctagcaagccaacgaggagg

SEQ ID NO: 33959 - DNA, 25 bp, Mus musculus
aaccgctcaccactagttgtttcag

SEQ ID NO: 33960 - DNA, 25 bp, Mus musculus
aaccgctcaccagtagttgtttcag

SEQ ID NO: 33961 - DNA, 25 bp, Mus musculus
aaccgctccagacggatggtctcat

SEQ ID NO: 33962 - DNA, 25 bp, Mus musculus
aaccgctccagagggatggtctcat

SEQ ID NO: 33963 - DNA, 25 bp, Mus musculus
aaccgctcgtgtctggcctgtggca

SEQ ID NO: 33964 - DNA, 25 bp, Mus musculus
aaccgctcgtgtgtggcctgtggca

SEQ ID NO: 33965 - DNA, 25 bp, Mus musculus
aaccgctgcagacatgcgtagtgct

SEQ ID NO: 33966 - DNA, 25 bp, Mus musculus
aaccgctgcagagatgcgtagtgct

SEQ ID NO: 33967 - DNA, 25 bp, Mus musculus
aaccgctgctatacttgcataggtc

SEQ ID NO: 33968 - DNA, 25 bp, Mus musculus
aaccgctgctattcttgcataggtc

SEQ ID NO: 33969 - DNA, 25 bp, Mus musculus
aaccgctgctttccagggtatggca

SEQ ID NO: 33970 - DNA, 25 bp, Mus musculus
aaccgctgctttgcagggtatggca

SEQ ID NO: 33971 - DNA, 25 bp, Mus musculus
aaccgcttgagcatctggaactatg

SEQ ID NO: 33972 - DNA, 25 bp, Mus musculus
aaccgcttgagcttctggaactatg

SEQ ID NO: 33973 - DNA, 25 bp, Mus musculus
aaccgcttttaacggctggagccat

SEQ ID NO: 33974 - DNA, 25 bp, Mus musculus
aaccgcttttaagggctggagccat

SEQ ID NO: 33975 - DNA, 25 bp, Mus musculus
aaccggaaaattctctgtttgcact

SEQ ID NO: 33976 - DNA, 25 bp, Mus musculus
aaccggaaaattgtctgtttgcact

SEQ ID NO: 33977 - DNA, 25 bp, Mus musculus
aaccggaatgccacatacttgggat

SEQ ID NO: 33978 - DNA, 25 bp, Mus musculus
aaccggaatgcctcatacttgggat

SEQ ID NO: 33979 - DNA, 25 bp, Mus musculus
aaccggagacgcaaaggcagcttca

SEQ ID NO: 33980 - DNA, 25 bp, Mus musculus
aaccggagacgctaaggcagcttca

SEQ ID NO: 33981 - DNA, 25 bp, Mus musculus
aaccggagcctacatggaattccct

SEQ ID NO: 33982 - DNA, 25 bp, Mus musculus
aaccggagcctagatggaattccct

SEQ ID NO: 33983 - DNA, 25 bp, Mus musculus
aaccggaggagcaaggagcccctct

SEQ ID NO: 33984 - DNA, 25 bp, Mus musculus
aaccggaggagctaggagcccctct

SEQ ID NO: 33985 - DNA, 25 bp, Mus musculus
aaccggatccatacacctacgatta

SEQ ID NO: 33986 - DNA, 25 bp, Mus musculus
aaccggatccattcacctacgatta

SEQ ID NO: 33987 - DNA, 25 bp, Mus musculus
aaccggatgatcatttcatttgcaa

SEQ ID NO: 33988 - DNA, 25 bp, Mus musculus
aaccggatgatcttttcatttgcaa

SEQ ID NO: 33989 - DNA, 25 bp, Mus musculus
aaccggatgggaatcccctggagcg

SEQ ID NO: 33990 - DNA, 25 bp, Mus musculus
aaccggatgggattcccctggagcg

SEQ ID NO: 33991 - DNA, 25 bp, Mus musculus
aaccggattggccaaatagcttctg

SEQ ID NO: 33992 - DNA, 25 bp, Mus musculus
aaccggattggcgaaatagcttctg

SEQ ID NO: 33993 - DNA, 25 bp, Mus musculus
aaccggcaggaaatgtgactcgtga

SEQ ID NO: 33994 - DNA, 25 bp, Mus musculus
aaccggcaggaattgtgactcgtga

SEQ ID NO: 33995 - DNA, 25 bp, Mus musculus
aaccggcatagtactgactctgtac

SEQ ID NO: 33996 - DNA, 25 bp, Mus musculus
aaccggcatagttctgactctgtac

SEQ ID NO: 33997 - DNA, 25 bp, Mus musculus
aaccggcatctccaggatgggtgct

SEQ ID NO: 33998 - DNA, 25 bp, Mus musculus
aaccggcatctcgaggatgggtgct

SEQ ID NO: 33999 - DNA, 25 bp, Mus musculus
aaccggccagcacagctacgcatcc

SEQ ID NO: 34000 - DNA, 25 bp, Mus musculus
aaccggccagcagagctacgcatcc

SEQ ID NO: 34001 - DNA, 25 bp, Mus musculus
aaccggccagtacaatagtgtctct

SEQ ID NO: 34002 - DNA, 25 bp, Mus musculus
aaccggccagtagaatagtgtctct

SEQ ID NO: 34003 - DNA, 25 bp, Mus musculus
aaccggcctgttccttgggtgtcag

SEQ ID NO: 34004 - DNA, 25 bp, Mus musculus
aaccggcctgttgcttgggtgtcag

SEQ ID NO: 34005 - DNA, 25 bp, Mus musculus
aaccggcgacggcagtctccatgct

SEQ ID NO: 34006 - DNA, 25 bp, Mus musculus
aaccggcgacgggagtctccatgct

SEQ ID NO: 34007 - DNA, 25 bp, Mus musculus
aaccggcggacactcagttagcgaa

SEQ ID NO: 34008 - DNA, 25 bp, Mus musculus
aaccggcggacagtcagttagcgaa

SEQ ID NO: 34009 - DNA, 25 bp, Mus musculus
aaccggctagacagctatgcacaca

SEQ ID NO: 34010 - DNA, 25 bp, Mus musculus
aaccggctagactgctatgcacaca

SEQ ID NO: 34011 - DNA, 25 bp, Mus musculus
aaccggctgtccatcaaagtcgagg

SEQ ID NO: 34012 - DNA, 25 bp, Mus musculus
aaccggctgtccttcaaagtcgagg

SEQ ID NO: 34013 - DNA, 25 bp, Mus musculus
aaccggcttatgctcaacttcaata

SEQ ID NO: 34014 - DNA, 25 bp, Mus musculus
aaccggcttatggtcaacttcaata

SEQ ID NO: 34015 - DNA, 25 bp, Mus musculus
aaccgggacaagaattcacacctgc

SEQ ID NO: 34016 - DNA, 25 bp, Mus musculus
aaccgggacaagtattcacacctgc

SEQ ID NO: 34017 - DNA, 25 bp, Mus musculus
aaccgggagatcaagtcatttgtta

SEQ ID NO: 34018 - DNA, 25 bp, Mus musculus
aaccgggagatctagtcatttgtta

SEQ ID NO: 34019 - DNA, 25 bp, Mus musculus
aaccgggagtctctgattgtgttca

SEQ ID NO: 34020 - DNA, 25 bp, Mus musculus
aaccgggagtctgtgattgtgttca

SEQ ID NO: 34021 - DNA, 25 bp, Mus musculus
aaccgggattctcctttgacaggct

SEQ ID NO: 34022 - DNA, 25 bp, Mus musculus
aaccgggattctgctttgacaggct

SEQ ID NO: 34023 - DNA, 25 bp, Mus musculus
aaccgggcacaaaggccatcagttt

SEQ ID NO: 34024 - DNA, 25 bp, Mus musculus
aaccgggcacaatggccatcagttt

SEQ ID NO: 34025 - DNA, 25 bp, Mus musculus
aaccgggccatcaattgcctgtata

SEQ ID NO: 34026 - DNA, 25 bp, Mus musculus
aaccgggccatctattgcctgtata

SEQ ID NO: 34027 - DNA, 25 bp, Mus musculus
aaccgggctctgctggagaacattg

SEQ ID NO: 34028 - DNA, 25 bp, Mus musculus
aaccgggctctggtggagaacattg

SEQ ID NO: 34029 - DNA, 25 bp, Mus musculus
aaccgggtaatgagcatgaggcccc

SEQ ID NO: 34030 - DNA, 25 bp, Mus musculus
aaccgggtaatgtgcatgaggcccc

SEQ ID NO: 34031 - DNA, 25 bp, Mus musculus
aaccgggtactcactgtgcattgta

SEQ ID NO: 34032 - DNA, 25 bp, Mus musculus
aaccgggtactcatagagaaactct

SEQ ID NO: 34033 - DNA, 25 bp, Mus musculus
aaccgggtactctctgtgcattgta

SEQ ID NO: 34034 - DNA, 25 bp, Mus musculus
aaccgggtactcttagagaaactct

SEQ ID NO: 34035 - DNA, 25 bp, Mus musculus
aaccgggtgaggaggatcctatagt

SEQ ID NO: 34036 - DNA, 25 bp, Mus musculus
aaccgggtgaggtggatcctatagt

SEQ ID NO: 34037 - DNA, 25 bp, Mus musculus
aaccggtcacacctaactcatttag

SEQ ID NO: 34038 - DNA, 25 bp, Mus musculus
aaccggtcacacgtaactcatttag

SEQ ID NO: 34039 - DNA, 25 bp, Mus musculus
aaccggtgacatctcttggctcaca

SEQ ID NO: 34040 - DNA, 25 bp, Mus musculus
aaccggtgacatgtcttggctcaca

SEQ ID NO: 34041 - DNA, 25 bp, Mus musculus
aaccggtgaccgagactgggcatgt

SEQ ID NO: 34042 - DNA, 25 bp, Mus musculus
aaccggtgaccgtgactgggcatgt

SEQ ID NO: 34043 - DNA, 25 bp, Mus musculus
aaccggtgatagatgatttttaatg

SEQ ID NO: 34044 - DNA, 25 bp, Mus musculus
aaccggtgatagttgatttttaatg

SEQ ID NO: 34045 - DNA, 25 bp, Mus musculus
aaccggttccatcctgcacatagga

SEQ ID NO: 34046 - DNA, 25 bp, Mus musculus
aaccggttccatgctgcacatagga

SEQ ID NO: 34047 - DNA, 25 bp, Mus musculus
aaccggttggagatgaacttagaga

SEQ ID NO: 34048 - DNA, 25 bp, Mus musculus
aaccggttggagttgaacttagaga

SEQ ID NO: 34049 - DNA, 25 bp, Mus musculus
aaccggttgtttccatgtttgaatg

SEQ ID NO: 34050 - DNA, 25 bp, Mus musculus
aaccggttgtttgcatgtttgaatg

SEQ ID NO: 34051 - DNA, 25 bp, Mus musculus
aaccgtactgctcctaatcattgta

SEQ ID NO: 34052 - DNA, 25 bp, Mus musculus
aaccgtactgctgctaatcattgta

SEQ ID NO: 34053 - DNA, 25 bp, Mus musculus
aaccgtacttgccaccagtttagtg

SEQ ID NO: 34054 - DNA, 25 bp, Mus musculus
aaccgtacttgcgaccagtttagtg

SEQ ID NO: 34055 - DNA, 25 bp, Mus musculus
aaccgtaggcgtacgtgttgattga

SEQ ID NO: 34056 - DNA, 25 bp, Mus musculus
aaccgtaggcgttcgtgttgattga

SEQ ID NO: 34057 - DNA, 25 bp, Mus musculus
aaccgtatcttcattcttgtaggag

SEQ ID NO: 34058 - DNA, 25 bp, Mus musculus
aaccgtatcttctttcttgtaggag

SEQ ID NO: 34059 - DNA, 25 bp, Mus musculus
aaccgtatgtgtagccagggcaaca

SEQ ID NO: 34060 - DNA, 25 bp, Mus musculus
aaccgtatgtgttgccagggcaaca

SEQ ID NO: 34061 - DNA, 25 bp, Mus musculus
aaccgtattcacatccagcatatag

SEQ ID NO: 34062 - DNA, 25 bp, Mus musculus
aaccgtattcacttccagcatatag

SEQ ID NO: 34063 - DNA, 25 bp, Mus musculus
aaccgtatttccacaccattagact

SEQ ID NO: 34064 - DNA, 25 bp, Mus musculus
aaccgtatttcctcaccattagact

SEQ ID NO: 34065 - DNA, 25 bp, Mus musculus
aaccgtcagctaagcggattgtcta

SEQ ID NO: 34066 - DNA, 25 bp, Mus musculus
aaccgtcagctatgcggattgtcta

SEQ ID NO: 34067 - DNA, 25 bp, Mus musculus
aaccgtcagttgcttcagcatacca

SEQ ID NO: 34068 - DNA, 25 bp, Mus musculus
aaccgtcagttggttcagcatacca

SEQ ID NO: 34069 - DNA, 25 bp, Mus musculus
aaccgtcatccaaatgcatccagca

SEQ ID NO: 34070 - DNA, 25 bp, Mus musculus
aaccgtcatccatatgcatccagca

SEQ ID NO: 34071 - DNA, 25 bp, Mus musculus
aaccgtcatctaccctaagaaatag

SEQ ID NO: 34072 - DNA, 25 bp, Mus musculus
aaccgtcatctagcctaagaaatag

SEQ ID NO: 34073 - DNA, 25 bp, Mus musculus
aaccgtccaggaacagattgcatgt

SEQ ID NO: 34074 - DNA, 25 bp, Mus musculus
aaccgtccaggatcagattgcatgt

SEQ ID NO: 34075 - DNA, 25 bp, Mus musculus
aaccgtctagacagtagggcactaa

SEQ ID NO: 34076 - DNA, 25 bp, Mus musculus
aaccgtctagactgtagggcactaa

SEQ ID NO: 34077 - DNA, 25 bp, Mus musculus
aaccgtctccctcttgttgacaaat

SEQ ID NO: 34078 - DNA, 25 bp, Mus musculus
aaccgtctccctgttgttgacaaat

SEQ ID NO: 34079 - DNA, 25 bp, Mus musculus
aaccgtctcttaagttcttttgctg

SEQ ID NO: 34080 - DNA, 25 bp, Mus musculus
aaccgtctcttatgttcttttgctg

SEQ ID NO: 34081 - DNA, 25 bp, Mus musculus
aaccgtctgcctctcagtggacagg

SEQ ID NO: 34082 - DNA, 25 bp, Mus musculus
aaccgtctgcctgtcagtggacagg

SEQ ID NO: 34083 - DNA, 25 bp, Mus musculus
aaccgtctggatcaatctgtctgtg

SEQ ID NO: 34084 - DNA, 25 bp, Mus musculus
aaccgtctggatgaatctgtctgtg

SEQ ID NO: 34085 - DNA, 25 bp, Mus musculus
aaccgtctgtggagtttctgctgca

SEQ ID NO: 34086 - DNA, 25 bp, Mus musculus
aaccgtctgtggtgtttctgctgca

SEQ ID NO: 34087 - DNA, 25 bp, Mus musculus
aaccgtcttgctctctgtgtataga

SEQ ID NO: 34088 - DNA, 25 bp, Mus musculus
aaccgtcttgctgtctgtgtataga

SEQ ID NO: 34089 - DNA, 25 bp, Mus musculus
aaccgtgaccttcaagtcctatcag

SEQ ID NO: 34090 - DNA, 25 bp, Mus musculus
aaccgtgaccttgaagtcctatcag

SEQ ID NO: 34091 - DNA, 25 bp, Mus musculus
aaccgtgaggctaatctagctgcta

SEQ ID NO: 34092 - DNA, 25 bp, Mus musculus
aaccgtgaggcttatctagctgcta

SEQ ID NO: 34093 - DNA, 25 bp, Mus musculus
aaccgtgagggtcctctttgtgact

SEQ ID NO: 34094 - DNA, 25 bp, Mus musculus
aaccgtgagggtgctctttgtgact

SEQ ID NO: 34095 - DNA, 25 bp, Mus musculus
aaccgtgataaacacaaggaactgg

SEQ ID NO: 34096 - DNA, 25 bp, Mus musculus
aaccgtgataaagacaaggaactgg

SEQ ID NO: 34097 - DNA, 25 bp, Mus musculus
aaccgtgatctgatcttacgttgtc

SEQ ID NO: 34098 - DNA, 25 bp, Mus musculus
aaccgtgatctgttcttacgttgtc

SEQ ID NO: 34099 - DNA, 25 bp, Mus musculus
aaccgtgatgtgaacaagctgcctc

SEQ ID NO: 34100 - DNA, 25 bp, Mus musculus
aaccgtgatgtgtacaagctgcctc

SEQ ID NO: 34101 - DNA, 25 bp, Mus musculus
aaccgtgatgttcagtttcgaggca

SEQ ID NO: 34102 - DNA, 25 bp, Mus musculus
aaccgtgatgttgagtttcgaggca

SEQ ID NO: 34103 - DNA, 25 bp, Mus musculus
aaccgtgcagcgacctgagctccag

SEQ ID NO: 34104 - DNA, 25 bp, Mus musculus
aaccgtgcagcgtcctgagctccag

SEQ ID NO: 34105 - DNA, 25 bp, Mus musculus
aaccgtgcagttagggaaagtatct

SEQ ID NO: 34106 - DNA, 25 bp, Mus musculus
aaccgtgcagtttgggaaagtatct

SEQ ID NO: 34107 - DNA, 25 bp, Mus musculus
aaccgtgccctgatggttctcagaa

SEQ ID NO: 34108 - DNA, 25 bp, Mus musculus
aaccgtgccctgttggttctcagaa

SEQ ID NO: 34109 - DNA, 25 bp, Mus musculus
aaccgtgctcataagcagttatcaa

SEQ ID NO: 34110 - DNA, 25 bp, Mus musculus
aaccgtgctcattagcagttatcaa

SEQ ID NO: 34111 - DNA, 25 bp, Mus musculus
aaccgtggagatatgctctgaccgt

SEQ ID NO: 34112 - DNA, 25 bp, Mus musculus
aaccgtggagatttgctctgaccgt

SEQ ID NO: 34113 - DNA, 25 bp, Mus musculus
aaccgtggcccacctggtggatctg

SEQ ID NO: 34114 - DNA, 25 bp, Mus musculus
aaccgtggcccagctggtggatctg

SEQ ID NO: 34115 - DNA, 25 bp, Mus musculus
aaccgtggcctaattattggcttca

SEQ ID NO: 34116 - DNA, 25 bp, Mus musculus
aaccgtggcctatttattggcttca

SEQ ID NO: 34117 - DNA, 25 bp, Mus musculus
aaccgtgggatcagaacgttacaat

SEQ ID NO: 34118 - DNA, 25 bp, Mus musculus
aaccgtgggatctgaacgttacaat

SEQ ID NO: 34119 - DNA, 25 bp, Mus musculus
aaccgtggtcatcaacatttttatc

SEQ ID NO: 34120 - DNA, 25 bp, Mus musculus
aaccgtggtcatgaacatttttatc

SEQ ID NO: 34121 - DNA, 25 bp, Mus musculus
aaccgtgtgcagctagctctatttt

SEQ ID NO: 34122 - DNA, 25 bp, Mus musculus
aaccgtgtgcaggtagctctatttt

SEQ ID NO: 34123 - DNA, 25 bp, Mus musculus
aaccgtgtggctcatggtcttgtga

SEQ ID NO: 34124 - DNA, 25 bp, Mus musculus
aaccgtgtggctgatggtcttgtga

SEQ ID NO: 34125 - DNA, 25 bp, Mus musculus
aaccgttacaatatcctgttgctgt

SEQ ID NO: 34126 - DNA, 25 bp, Mus musculus
aaccgttacaatttcctgttgctgt

SEQ ID NO: 34127 - DNA, 25 bp, Mus musculus
aaccgttagcccactgtagaattca

SEQ ID NO: 34128 - DNA, 25 bp, Mus musculus
aaccgttagccctctgtagaattca

SEQ ID NO: 34129 - DNA, 25 bp, Mus musculus
aaccgttagtcactcattccgtcta

SEQ ID NO: 34130 - DNA, 25 bp, Mus musculus
aaccgttagtcagtcattccgtcta

SEQ ID NO: 34131 - DNA, 25 bp, Mus musculus
aaccgttatatcagccagtttgctc

SEQ ID NO: 34132 - DNA, 25 bp, Mus musculus
aaccgttatatctgccagtttgctc

SEQ ID NO: 34133 - DNA, 25 bp, Mus musculus
aaccgttattgccttgtatgatgct

SEQ ID NO: 34134 - DNA, 25 bp, Mus musculus
aaccgttattgcgttgtatgatgct

SEQ ID NO: 34135 - DNA, 25 bp, Mus musculus
aaccgttctcaaaacgagtatgagc

SEQ ID NO: 34136 - DNA, 25 bp, Mus musculus
aaccgttctcaatacgagtatgagc

SEQ ID NO: 34137 - DNA, 25 bp, Mus musculus
aaccgttcttacatgcttaagcctc

SEQ ID NO: 34138 - DNA, 25 bp, Mus musculus
aaccgttcttacttgcttaagcctc

SEQ ID NO: 34139 - DNA, 25 bp, Mus musculus
aaccgttcttgcaccacttagtcat

SEQ ID NO: 34140 - DNA, 25 bp, Mus musculus
aaccgttcttgctccacttagtcat

SEQ ID NO: 34141 - DNA, 25 bp, Mus musculus
aaccgttggagcatagagtaatgca

SEQ ID NO: 34142 - DNA, 25 bp, Mus musculus
aaccgttggagcttagagtaatgca

SEQ ID NO: 34143 - DNA, 25 bp, Mus musculus
aaccgttgtttacgccctgcaagca

SEQ ID NO: 34144 - DNA, 25 bp, Mus musculus
aaccgttgtttaggccctgcaagca

SEQ ID NO: 34145 - DNA, 25 bp, Mus musculus
aaccgtttgcacagaaagcagcact

SEQ ID NO: 34146 - DNA, 25 bp, Mus musculus
aaccgtttgcactgaaagcagcact

SEQ ID NO: 34147 - DNA, 25 bp, Mus musculus
aaccgtttggcaacttcagtacaca

SEQ ID NO: 34148 - DNA, 25 bp, Mus musculus
aaccgtttggcatcttcagtacaca

SEQ ID NO: 34149 - DNA, 25 bp, Mus musculus
aacctaaaagccaatcttcacacct

SEQ ID NO: 34150 - DNA, 25 bp, Mus musculus
aacctaaaagcctatcttcacacct

SEQ ID NO: 34151 - DNA, 25 bp, Mus musculus
aacctaaaatacacagcccgtcatc

SEQ ID NO: 34152 - DNA, 25 bp, Mus musculus
aacctaaaatactcagcccgtcatc

SEQ ID NO: 34153 - DNA, 25 bp, Mus musculus
aacctaacacgtattgccagagaag

SEQ ID NO: 34154 - DNA, 25 bp, Mus musculus
aacctaacacgttttgccagagaag

SEQ ID NO: 34155 - DNA, 25 bp, Mus musculus
aacctaacagttcacaatttttcat

SEQ ID NO: 34156 - DNA, 25 bp, Mus musculus
aacctaacagttgacaatttttcat

SEQ ID NO: 34157 - DNA, 25 bp, Mus musculus
aacctaaccagaatgctttgcacag

SEQ ID NO: 34158 - DNA, 25 bp, Mus musculus
aacctaaccagattgctttgcacag

SEQ ID NO: 34159 - DNA, 25 bp, Mus musculus
aacctaacccaaatcactagatgct

SEQ ID NO: 34160 - DNA, 25 bp, Mus musculus
aacctaacccaattcactagatgct

SEQ ID NO: 34161 - DNA, 25 bp, Mus musculus
aacctaacctgacctatagtctctg

SEQ ID NO: 34162 - DNA, 25 bp, Mus musculus
aacctaacctgagctatagtctctg

SEQ ID NO: 34163 - DNA, 25 bp, Mus musculus
aacctaactgtcaaatccccaatca

SEQ ID NO: 34164 - DNA, 25 bp, Mus musculus
aacctaactgtctaatccccaatca

SEQ ID NO: 34165 - DNA, 25 bp, Mus musculus
aacctaagagccaccagcacttcag

SEQ ID NO: 34166 - DNA, 25 bp, Mus musculus
aacctaagagcctccagcacttcag

SEQ ID NO: 34167 - DNA, 25 bp, Mus musculus
aacctaagagctatggcagcctttg

SEQ ID NO: 34168 - DNA, 25 bp, Mus musculus
aacctaagagctttggcagcctttg

SEQ ID NO: 34169 - DNA, 25 bp, Mus musculus
aacctaagctacactcaccagagaa

SEQ ID NO: 34170 - DNA, 25 bp, Mus musculus
aacctaagctactctcaccagagaa

SEQ ID NO: 34171 - DNA, 25 bp, Mus musculus
aacctaaggtgactgtctgcgggaa

SEQ ID NO: 34172 - DNA, 25 bp, Mus musculus
aacctaaggtgagtgtctgcgggaa

SEQ ID NO: 34173 - DNA, 25 bp, Mus musculus
aacctaagtgttcctgtgaatctca

SEQ ID NO: 34174 - DNA, 25 bp, Mus musculus
aacctaagtgttgctgtgaatctca

SEQ ID NO: 34175 - DNA, 25 bp, Mus musculus
aacctaatacgcctgggtccactgg

SEQ ID NO: 34176 - DNA, 25 bp, Mus musculus
aacctaatacgcgtgggtccactgg

SEQ ID NO: 34177 - DNA, 25 bp, Mus musculus
aacctaatcagtctcccagtagttg

SEQ ID NO: 34178 - DNA, 25 bp, Mus musculus
aacctaatcagtgtcccagtagttg

SEQ ID NO: 34179 - DNA, 25 bp, Mus musculus
aacctaattgctctaatatttctgc

SEQ ID NO: 34180 - DNA, 25 bp, Mus musculus
aacctaattgctgtaatatttctgc

SEQ ID NO: 34181 - DNA, 25 bp, Mus musculus
aacctacaaatgactggtcctagct

SEQ ID NO: 34182 - DNA, 25 bp, Mus musculus
aacctacaaatgtctggtcctagct

SEQ ID NO: 34183 - DNA, 25 bp, Mus musculus
aacctacaagaccagcagtgagctt

SEQ ID NO: 34184 - DNA, 25 bp, Mus musculus
aacctacaagacgagcagtgagctt

SEQ ID NO: 34185 - DNA, 25 bp, Mus musculus
aacctacacatcaacctgactgaag

SEQ ID NO: 34186 - DNA, 25 bp, Mus musculus
aacctacacatctacctgactgaag

SEQ ID NO: 34187 - DNA, 25 bp, Mus musculus
aacctacagtctccaggagctcggt

SEQ ID NO: 34188 - DNA, 25 bp, Mus musculus
aacctacagtctgcaggagctcggt

SEQ ID NO: 34189 - DNA, 25 bp, Mus musculus
aacctacatacaagcctggagcgag

SEQ ID NO: 34190 - DNA, 25 bp, Mus musculus
aacctacatacatgcctggagcgag

SEQ ID NO: 34191 - DNA, 25 bp, Mus musculus
aacctacatactcctgaaacctctt

SEQ ID NO: 34192 - DNA, 25 bp, Mus musculus
aacctacatactgctgaaacctctt

SEQ ID NO: 34193 - DNA, 25 bp, Mus musculus
aacctacatgtacgaatttcagtct

SEQ ID NO: 34194 - DNA, 25 bp, Mus musculus
aacctacatgtaggaatttcagtct

SEQ ID NO: 34195 - DNA, 25 bp, Mus musculus
aacctaccagctaactctggagact

SEQ ID NO: 34196 - DNA, 25 bp, Mus musculus
aacctaccagctctgcgagtggctt

SEQ ID NO: 34197 - DNA, 25 bp, Mus musculus
aacctaccagctgtgcgagtggctt

SEQ ID NO: 34198 - DNA, 25 bp, Mus musculus
aacctaccagcttactctggagact

SEQ ID NO: 34199 - DNA, 25 bp, Mus musculus
aacctacccagaaggtgttgaagtg

SEQ ID NO: 34200 - DNA, 25 bp, Mus musculus
aacctacccagatggtgttgaagtg

SEQ ID NO: 34201 - DNA, 25 bp, Mus musculus
aacctacccatcatcaagctgaaag

SEQ ID NO: 34202 - DNA, 25 bp, Mus musculus
aacctacccatcttcaagctgaaag

SEQ ID NO: 34203 - DNA, 25 bp, Mus musculus
aacctacctctactgaatcacttat

SEQ ID NO: 34204 - DNA, 25 bp, Mus musculus
aacctacctctagtgaatcacttat

SEQ ID NO: 34205 - DNA, 25 bp, Mus musculus
aacctacctgagctttcagcggctt

SEQ ID NO: 34206 - DNA, 25 bp, Mus musculus
aacctacctgaggtttcagcggctt

SEQ ID NO: 34207 - DNA, 25 bp, Mus musculus
aacctacctgctattacttgccaag

SEQ ID NO: 34208 - DNA, 25 bp, Mus musculus
aacctacctgcttttacttgccaag

SEQ ID NO: 34209 - DNA, 25 bp, Mus musculus
aacctacggcctcgagtatgctttg

SEQ ID NO: 34210 - DNA, 25 bp, Mus musculus
aacctacggcctggagtatgctttg

SEQ ID NO: 34211 - DNA, 25 bp, Mus musculus
aacctacgtgatatccttttacaag

SEQ ID NO: 34212 - DNA, 25 bp, Mus musculus
aacctacgtgatttccttttacaag

SEQ ID NO: 34213 - DNA, 25 bp, Mus musculus
aacctactacttacttgatactcat

SEQ ID NO: 34214 - DNA, 25 bp, Mus musculus
aacctactactttcttgatactcat

SEQ ID NO: 34215 - DNA, 25 bp, Mus musculus
aacctactccttcttgatttacacg

SEQ ID NO: 34216 - DNA, 25 bp, Mus musculus
aacctactccttgttgatttacacg

SEQ ID NO: 34217 - DNA, 25 bp, Mus musculus
aacctactctcgatgtccgtgatga

SEQ ID NO: 34218 - DNA, 25 bp, Mus musculus
aacctactctcgttgtccgtgatga

SEQ ID NO: 34219 - DNA, 25 bp, Mus musculus
aacctactgcacaaggccttgtggc

SEQ ID NO: 34220 - DNA, 25 bp, Mus musculus
aacctactgcactaggccttgtggc

SEQ ID NO: 34221 - DNA, 25 bp, Mus musculus
aacctagaagccagcctcagttaaa

SEQ ID NO: 34222 - DNA, 25 bp, Mus musculus
aacctagaagcctgcctcagttaaa

SEQ ID NO: 34223 - DNA, 25 bp, Mus musculus
aacctagaagctcaagtcctctcca

SEQ ID NO: 34224 - DNA, 25 bp, Mus musculus
aacctagaagctgaagtcctctcca

SEQ ID NO: 34225 - DNA, 25 bp, Mus musculus
aacctagacaccatagctgtgtttc

SEQ ID NO: 34226 - DNA, 25 bp, Mus musculus
aacctagacaccttagctgtgtttc

SEQ ID NO: 34227 - DNA, 25 bp, Mus musculus
aacctagacagccatcgcaatgtga

SEQ ID NO: 34228 - DNA, 25 bp, Mus musculus
aacctagacagcgatcgcaatgtga

SEQ ID NO: 34229 - DNA, 25 bp, Mus musculus
aacctagagcgcactgattcaatga

SEQ ID NO: 34230 - DNA, 25 bp, Mus musculus
aacctagagcgctctgattcaatga

SEQ ID NO: 34231 - DNA, 25 bp, Mus musculus
aacctagaggtccagtgttcttctt

SEQ ID NO: 34232 - DNA, 25 bp, Mus musculus
aacctagaggtcgagtgttcttctt

SEQ ID NO: 34233 - DNA, 25 bp, Mus musculus
aacctagagtagctggaaccatttt

SEQ ID NO: 34234 - DNA, 25 bp, Mus musculus
aacctagagtaggtggaaccatttt

SEQ ID NO: 34235 - DNA, 25 bp, Mus musculus
aacctagagtcacccagagtcttag

SEQ ID NO: 34236 - DNA, 25 bp, Mus musculus
aacctagagtcagccagagtcttag

SEQ ID NO: 34237 - DNA, 25 bp, Mus musculus
aacctagatattaggcttttgtgat

SEQ ID NO: 34238 - DNA, 25 bp, Mus musculus
aacctagatatttggcttttgtgat

SEQ ID NO: 34239 - DNA, 25 bp, Mus musculus
aacctagatccacatgtattcaatc

SEQ ID NO: 34240 - DNA, 25 bp, Mus musculus
aacctagatccagatgtattcaatc

SEQ ID NO: 34241 - DNA, 25 bp, Mus musculus
aacctagatcccaaaccctgggctg

SEQ ID NO: 34242 - DNA, 25 bp, Mus musculus
aacctagatccctaaccctgggctg

SEQ ID NO: 34243 - DNA, 25 bp, Mus musculus
aacctagatgagctgtccgtgggat

SEQ ID NO: 34244 - DNA, 25 bp, Mus musculus
aacctagatgaggtgtccgtgggat

SEQ ID NO: 34245 - DNA, 25 bp, Mus musculus
aacctagcaaacacatgcggtttct

SEQ ID NO: 34246 - DNA, 25 bp, Mus musculus
aacctagcaaactcatgcggtttct

SEQ ID NO: 34247 - DNA, 25 bp, Mus musculus
aacctagcaggtctcatttctcggc

SEQ ID NO: 34248 - DNA, 25 bp, Mus musculus
aacctagcaggtgtcatttctcggc

SEQ ID NO: 34249 - DNA, 25 bp, Mus musculus
aacctagcgaggaacgtgcaatgct

SEQ ID NO: 34250 - DNA, 25 bp, Mus musculus
aacctagcgaggtacgtgcaatgct

SEQ ID NO: 34251 - DNA, 25 bp, Mus musculus
aacctagcgtgacaacactcgagct

SEQ ID NO: 34252 - DNA, 25 bp, Mus musculus
aacctagcgtgagaacactcgagct

SEQ ID NO: 34253 - DNA, 25 bp, Mus musculus
aacctagctgtcatctcagggcctg

SEQ ID NO: 34254 - DNA, 25 bp, Mus musculus
aacctagctgtcttctcagggcctg

SEQ ID NO: 34255 - DNA, 25 bp, Mus musculus
aacctaggaagtcccacaagtgctg

SEQ ID NO: 34256 - DNA, 25 bp, Mus musculus
aacctaggaagtgccacaagtgctg

SEQ ID NO: 34257 - DNA, 25 bp, Mus musculus
aacctaggacacataggtccccttg

SEQ ID NO: 34258 - DNA, 25 bp, Mus musculus
aacctaggacacttaggtccccttg

SEQ ID NO: 34259 - DNA, 25 bp, Mus musculus
aacctaggcccgacatacatatatt

SEQ ID NO: 34260 - DNA, 25 bp, Mus musculus
aacctaggcccgtcatacatatatt

SEQ ID NO: 34261 - DNA, 25 bp, Mus musculus
aacctaggctcccttggaagctgaa

SEQ ID NO: 34262 - DNA, 25 bp, Mus musculus
aacctaggctccgttggaagctgaa

SEQ ID NO: 34263 - DNA, 25 bp, Mus musculus
aacctaggctttaacatggcaccct

SEQ ID NO: 34264 - DNA, 25 bp, Mus musculus
aacctaggcttttacatggcaccct

SEQ ID NO: 34265 - DNA, 25 bp, Mus musculus
aacctagggaggatgccctggacgc

SEQ ID NO: 34266 - DNA, 25 bp, Mus musculus
aacctagggaggttgccctggacgc

SEQ ID NO: 34267 - DNA, 25 bp, Mus musculus
aacctagggcagcaagcaatacttc

SEQ ID NO: 34268 - DNA, 25 bp, Mus musculus
aacctagggcaggaagcaatacttc

SEQ ID NO: 34269 - DNA, 25 bp, Mus musculus
aacctaggtaggcacgctgcggttt

SEQ ID NO: 34270 - DNA, 25 bp, Mus musculus
aacctaggtagggacgctgcggttt

SEQ ID NO: 34271 - DNA, 25 bp, Mus musculus
aacctaggtcgtctcccatgtggga

SEQ ID NO: 34272 - DNA, 25 bp, Mus musculus
aacctaggtcgtgtcccatgtggga

SEQ ID NO: 34273 - DNA, 25 bp, Mus musculus
aacctaggtgctccaaggtgggcca

SEQ ID NO: 34274 - DNA, 25 bp, Mus musculus
aacctaggtgctgcaaggtgggcca

SEQ ID NO: 34275 - DNA, 25 bp, Mus musculus
aacctagtcaccaatcagagcagca

SEQ ID NO: 34276 - DNA, 25 bp, Mus musculus
aacctagtcacctatcagagcagca

SEQ ID NO: 34277 - DNA, 25 bp, Mus musculus
aacctagtccgtccctctgagagga

SEQ ID NO: 34278 - DNA, 25 bp, Mus musculus
aacctagtccgtgcctctgagagga

SEQ ID NO: 34279 - DNA, 25 bp, Mus musculus
aacctagtgcgtaatgcctaagcat

SEQ ID NO: 34280 - DNA, 25 bp, Mus musculus
aacctagtgcgttatgcctaagcat

SEQ ID NO: 34281 - DNA, 25 bp, Mus musculus
aacctagtgctgagtgtatcttgac

SEQ ID NO: 34282 - DNA, 25 bp, Mus musculus
aacctagtgctgtgtgtatcttgac

SEQ ID NO: 34283 - DNA, 25 bp, Mus musculus
aacctagtggccatccatgacttct

SEQ ID NO: 34284 - DNA, 25 bp, Mus musculus
aacctagtggccttccatgacttct

SEQ ID NO: 34285 - DNA, 25 bp, Mus musculus
aacctagtgtttaccacatctccat

SEQ ID NO: 34286 - DNA, 25 bp, Mus musculus
aacctagtgttttccacatctccat

SEQ ID NO: 34287 - DNA, 25 bp, Mus musculus
aacctatacaacatggtctgctcct

SEQ ID NO: 34288 - DNA, 25 bp, Mus musculus
aacctatacaacttggtctgctcct

SEQ ID NO: 34289 - DNA, 25 bp, Mus musculus
aacctatactctatgaccgtttgat

SEQ ID NO: 34290 - DNA, 25 bp, Mus musculus
aacctatactctttgaccgtttgat

SEQ ID NO: 34291 - DNA, 25 bp, Mus musculus
aacctatagtggcacgtgcctactt

SEQ ID NO: 34292 - DNA, 25 bp, Mus musculus
aacctatagtgggacgtgcctactt

SEQ ID NO: 34293 - DNA, 25 bp, Mus musculus
aacctatcactgaggcaaaggccaa

SEQ ID NO: 34294 - DNA, 25 bp, Mus musculus
aacctatcactgtggcaaaggccaa

SEQ ID NO: 34295 - DNA, 25 bp, Mus musculus
aacctatcagtgcagctctggaagc

SEQ ID NO: 34296 - DNA, 25 bp, Mus musculus
aacctatcagtggagctctggaagc

SEQ ID NO: 34297 - DNA, 25 bp, Mus musculus
aacctatccagtactatacatccag

SEQ ID NO: 34298 - DNA, 25 bp, Mus musculus
aacctatccagttctatacatccag

SEQ ID NO: 34299 - DNA, 25 bp, Mus musculus
aacctatccctacgacatggctggt

SEQ ID NO: 34300 - DNA, 25 bp, Mus musculus
aacctatccctaggacatggctggt

SEQ ID NO: 34301 - DNA, 25 bp, Mus musculus
aacctatgagaaacggaggggccga

SEQ ID NO: 34302 - DNA, 25 bp, Mus musculus
aacctatgagaatcggaggggccga

SEQ ID NO: 34303 - DNA, 25 bp, Mus musculus
aacctatgagtacctcacgagattg

SEQ ID NO: 34304 - DNA, 25 bp, Mus musculus
aacctatgagtagctcacgagattg

SEQ ID NO: 34305 - DNA, 25 bp, Mus musculus
aacctatgtataaaccctttcctct

SEQ ID NO: 34306 - DNA, 25 bp, Mus musculus
aacctatgtatataccctttcctct

SEQ ID NO: 34307 - DNA, 25 bp, Mus musculus
aacctatgtcccctgaagagcaacc

SEQ ID NO: 34308 - DNA, 25 bp, Mus musculus
aacctatgtcccgtgaagagcaacc

SEQ ID NO: 34309 - DNA, 25 bp, Mus musculus
aacctatgtgccatggagttctcag

SEQ ID NO: 34310 - DNA, 25 bp, Mus musculus
aacctatgtgccttggagttctcag

SEQ ID NO: 34311 - DNA, 25 bp, Mus musculus
aacctatgttatcttcttttacagt

SEQ ID NO: 34312 - DNA, 25 bp, Mus musculus
aacctatgttatgttcttttacagt

SEQ ID NO: 34313 - DNA, 25 bp, Mus musculus
aacctattagtcagaaacgtcctat

SEQ ID NO: 34314 - DNA, 25 bp, Mus musculus
aacctattagtctgaaacgtcctat

SEQ ID NO: 34315 - DNA, 25 bp, Mus musculus
aacctattgcaaaatcacctgacga

SEQ ID NO: 34316 - DNA, 25 bp, Mus musculus
aacctattgcaatatcacctgacga

SEQ ID NO: 34317 - DNA, 25 bp, Mus musculus
aacctattgcagatgtccttgttgc

SEQ ID NO: 34318 - DNA, 25 bp, Mus musculus
aacctattgcagttgtccttgttgc

SEQ ID NO: 34319 - DNA, 25 bp, Mus musculus
aacctatttaggagttcaaagcata

SEQ ID NO: 34320 - DNA, 25 bp, Mus musculus
aacctatttaggtgttcaaagcata

SEQ ID NO: 34321 - DNA, 25 bp, Mus musculus
aacctatttcatctcgtgtgttcct

SEQ ID NO: 34322 - DNA, 25 bp, Mus musculus
aacctatttcatgtcgtgtgttcct

SEQ ID NO: 34323 - DNA, 25 bp, Mus musculus
aacctcaaaagtccccatcatctat

SEQ ID NO: 34324 - DNA, 25 bp, Mus musculus
aacctcaaaagtgcccatcatctat

SEQ ID NO: 34325 - DNA, 25 bp, Mus musculus
aacctcaaaatgctgtgagctcctg

SEQ ID NO: 34326 - DNA, 25 bp, Mus musculus
aacctcaaaatggtgtgagctcctg

SEQ ID NO: 34327 - DNA, 25 bp, Mus musculus
aacctcaaagatctgtcacacacac

SEQ ID NO: 34328 - DNA, 25 bp, Mus musculus
aacctcaaagatgtgtcacacacac

SEQ ID NO: 34329 - DNA, 25 bp, Mus musculus
aacctcaaaggccaacattgtggga

SEQ ID NO: 34330 - DNA, 25 bp, Mus musculus
aacctcaaaggcgaacattgtggga

SEQ ID NO: 34331 - DNA, 25 bp, Mus musculus
aacctcaacggcaagaagagttcct

SEQ ID NO: 34332 - DNA, 25 bp, Mus musculus
aacctcaacggctagaagagttcct

SEQ ID NO: 34333 - DNA, 25 bp, Mus musculus
aacctcaactgtatctagtttgctc

SEQ ID NO: 34334 - DNA, 25 bp, Mus musculus
aacctcaactgtttctagtttgctc

SEQ ID NO: 34335 - DNA, 25 bp, Mus musculus
aacctcaagacaaaattgttctcaa

SEQ ID NO: 34336 - DNA, 25 bp, Mus musculus
aacctcaagacataattgttctcaa

SEQ ID NO: 34337 - DNA, 25 bp, Mus musculus
aacctcaagagacctaccgcacagt

SEQ ID NO: 34338 - DNA, 25 bp, Mus musculus
aacctcaagagagctaccgcacagt

SEQ ID NO: 34339 - DNA, 25 bp, Mus musculus
aacctcaagcaacgatttcatgttg

SEQ ID NO: 34340 - DNA, 25 bp, Mus musculus
aacctcaagcaaggatttcatgttg

SEQ ID NO: 34341 - DNA, 25 bp, Mus musculus
aacctcaagcccagcagcgaagagt

SEQ ID NO: 34342 - DNA, 25 bp, Mus musculus
aacctcaagccctgcagcgaagagt

SEQ ID NO: 34343 - DNA, 25 bp, Mus musculus
aacctcaagggcaaacactgatcag

SEQ ID NO: 34344 - DNA, 25 bp, Mus musculus
aacctcaagggctaacactgatcag

SEQ ID NO: 34345 - DNA, 25 bp, Mus musculus
aacctcaataatacattcctgacag

SEQ ID NO: 34346 - DNA, 25 bp, Mus musculus
aacctcaataattcattcctgacag

SEQ ID NO: 34347 - DNA, 25 bp, Mus musculus
aacctcaatgccctactcatgatga

SEQ ID NO: 34348 - DNA, 25 bp, Mus musculus
aacctcaatgccgtactcatgatga

SEQ ID NO: 34349 - DNA, 25 bp, Mus musculus
aacctcaatgctatgagcccataga

SEQ ID NO: 34350 - DNA, 25 bp, Mus musculus
aacctcaatgctttgagcccataga

SEQ ID NO: 34351 - DNA, 25 bp, Mus musculus
aacctcacaatgagggcagctgcca

SEQ ID NO: 34352 - DNA, 25 bp, Mus musculus
aacctcacaatgtgggcagctgcca

SEQ ID NO: 34353 - DNA, 25 bp, Mus musculus
aacctcacacagctgctctctaata

SEQ ID NO: 34354 - DNA, 25 bp, Mus musculus
aacctcacacaggtgctctctaata

SEQ ID NO: 34355 - DNA, 25 bp, Mus musculus
aacctcacagaaccctggagtttct

SEQ ID NO: 34356 - DNA, 25 bp, Mus musculus
aacctcacagaagcctggagtttct

SEQ ID NO: 34357 - DNA, 25 bp, Mus musculus
aacctcacatgcacgaaggctttga

SEQ ID NO: 34358 - DNA, 25 bp, Mus musculus
aacctcacatgctcgaaggctttga

SEQ ID NO: 34359 - DNA, 25 bp, Mus musculus
aacctcaccaatcagcagacacggg

SEQ ID NO: 34360 - DNA, 25 bp, Mus musculus
aacctcaccaatgagcagacacggg

SEQ ID NO: 34361 - DNA, 25 bp, Mus musculus
aacctcaccgacagcctgttggaga

SEQ ID NO: 34362 - DNA, 25 bp, Mus musculus
aacctcaccgactgcctgttggaga

SEQ ID NO: 34363 - DNA, 25 bp, Mus musculus
aacctcacgtttaccacagtcagat

SEQ ID NO: 34364 - DNA, 25 bp, Mus musculus
aacctcacgttttccacagtcagat

SEQ ID NO: 34365 - DNA, 25 bp, Mus musculus
aacctcactaggaaactgatatggc

SEQ ID NO: 34366 - DNA, 25 bp, Mus musculus
aacctcactaggtaactgatatggc

SEQ ID NO: 34367 - DNA, 25 bp, Mus musculus
aacctcagaatgctcacctactatg

SEQ ID NO: 34368 - DNA, 25 bp, Mus musculus
aacctcagaatggtcacctactatg

SEQ ID NO: 34369 - DNA, 25 bp, Mus musculus
aacctcagacaacgacacgtcggta

SEQ ID NO: 34370 - DNA, 25 bp, Mus musculus
aacctcagacaaggacacgtcggta

SEQ ID NO: 34371 - DNA, 25 bp, Mus musculus
aacctcagagcccatgggctctata

SEQ ID NO: 34372 - DNA, 25 bp, Mus musculus
aacctcagagccgatgggctctata

SEQ ID NO: 34373 - DNA, 25 bp, Mus musculus
aacctcagcaggcaccctgggagga

SEQ ID NO: 34374 - DNA, 25 bp, Mus musculus
aacctcagcaggcattttgattggc

SEQ ID NO: 34375 - DNA, 25 bp, Mus musculus
aacctcagcagggaccctgggagga

SEQ ID NO: 34376 - DNA, 25 bp, Mus musculus
aacctcagcagggattttgattggc

SEQ ID NO: 34377 - DNA, 25 bp, Mus musculus
aacctcagcagtagtatgtgaagca

SEQ ID NO: 34378 - DNA, 25 bp, Mus musculus
aacctcagcagttgtatgtgaagca

SEQ ID NO: 34379 - DNA, 25 bp, Mus musculus
aacctcagcattctgcacgataaga

SEQ ID NO: 34380 - DNA, 25 bp, Mus musculus
aacctcagcattgtgcacgataaga

SEQ ID NO: 34381 - DNA, 25 bp, Mus musculus
aacctcagcgttccaaggccgggat

SEQ ID NO: 34382 - DNA, 25 bp, Mus musculus
aacctcagcgttgcaaggccgggat

SEQ ID NO: 34383 - DNA, 25 bp, Mus musculus
aacctcagctcgataggcaggaaga

SEQ ID NO: 34384 - DNA, 25 bp, Mus musculus
aacctcagctcgcatatctggctac

SEQ ID NO: 34385 - DNA, 25 bp, Mus musculus
aacctcagctcggatatctggctac

SEQ ID NO: 34386 - DNA, 25 bp, Mus musculus
aacctcagctcgttaggcaggaaga

SEQ ID NO: 34387 - DNA, 25 bp, Mus musculus
aacctcaggcaaattcatgagaaag

SEQ ID NO: 34388 - DNA, 25 bp, Mus musculus
aacctcaggcaatttcatgagaaag

SEQ ID NO: 34389 - DNA, 25 bp, Mus musculus
aacctcagggccaccagggtgacaa

SEQ ID NO: 34390 - DNA, 25 bp, Mus musculus
aacctcagggcctccagggtgacaa

SEQ ID NO: 34391 - DNA, 25 bp, Mus musculus
aacctcagtaatctagtgggtttga

SEQ ID NO: 34392 - DNA, 25 bp, Mus musculus
aacctcagtaatgtagtgggtttga

SEQ ID NO: 34393 - DNA, 25 bp, Mus musculus
aacctcagtaggaggagaccagcca

SEQ ID NO: 34394 - DNA, 25 bp, Mus musculus
aacctcagtaggtggagaccagcca

SEQ ID NO: 34395 - DNA, 25 bp, Mus musculus
aacctcagtcaaagggattttccct

SEQ ID NO: 34396 - DNA, 25 bp, Mus musculus
aacctcagtcaatgggattttccct

SEQ ID NO: 34397 - DNA, 25 bp, Mus musculus
aacctcagtgagctcgtctacctgg

SEQ ID NO: 34398 - DNA, 25 bp, Mus musculus
aacctcagtgaggtcgtctacctgg

SEQ ID NO: 34399 - DNA, 25 bp, Mus musculus
aacctcagtgggattgcactacact

SEQ ID NO: 34400 - DNA, 25 bp, Mus musculus
aacctcagtgggtttgcactacact

SEQ ID NO: 34401 - DNA, 25 bp, Mus musculus
aacctcataaaccttcctgtcagta

SEQ ID NO: 34402 - DNA, 25 bp, Mus musculus
aacctcataaacgttcctgtcagta

SEQ ID NO: 34403 - DNA, 25 bp, Mus musculus
aacctcataatcatggaacttgggc

SEQ ID NO: 34404 - DNA, 25 bp, Mus musculus
aacctcataatcttggaacttgggc

SEQ ID NO: 34405 - DNA, 25 bp, Mus musculus
aacctcataattaatctcctggcct

SEQ ID NO: 34406 - DNA, 25 bp, Mus musculus
aacctcataatttatctcctggcct

SEQ ID NO: 34407 - DNA, 25 bp, Mus musculus
aacctcatatggagtttttatagtg

SEQ ID NO: 34408 - DNA, 25 bp, Mus musculus
aacctcatatggtgtttttatagtg

SEQ ID NO: 34409 - DNA, 25 bp, Mus musculus
aacctcatatttagatggccggact

SEQ ID NO: 34410 - DNA, 25 bp, Mus musculus
aacctcatattttgatggccggact

SEQ ID NO: 34411 - DNA, 25 bp, Mus musculus
aacctcatccgtcacaaccgtgttg

SEQ ID NO: 34412 - DNA, 25 bp, Mus musculus
aacctcatccgtgacaaccgtgttg

SEQ ID NO: 34413 - DNA, 25 bp, Mus musculus
aacctcatctttagtgttcaacact

SEQ ID NO: 34414 - DNA, 25 bp, Mus musculus
aacctcatcttttgtgttcaacact

SEQ ID NO: 34415 - DNA, 25 bp, Mus musculus
aacctcatgatcatacagtaggatg

SEQ ID NO: 34416 - DNA, 25 bp, Mus musculus
aacctcatgatcttacagtaggatg

SEQ ID NO: 34417 - DNA, 25 bp, Mus musculus
aacctcatgccacaattagctccaa

SEQ ID NO: 34418 - DNA, 25 bp, Mus musculus
aacctcatgccagaattagctccaa

SEQ ID NO: 34419 - DNA, 25 bp, Mus musculus
aacctcatgcccatgttaatgggca

SEQ ID NO: 34420 - DNA, 25 bp, Mus musculus
aacctcatgcccttgttaatgggca

SEQ ID NO: 34421 - DNA, 25 bp, Mus musculus
aacctcatgctaatttatagaatta

SEQ ID NO: 34422 - DNA, 25 bp, Mus musculus
aacctcatgctattttatagaatta

SEQ ID NO: 34423 - DNA, 25 bp, Mus musculus
aacctcatgggacaaggctacaaag

SEQ ID NO: 34424 - DNA, 25 bp, Mus musculus
aacctcatgggagaaggctacaaag

SEQ ID NO: 34425 - DNA, 25 bp, Mus musculus
aacctcatgggccagctctgtggaa

SEQ ID NO: 34426 - DNA, 25 bp, Mus musculus
aacctcatgggcgagctctgtggaa

SEQ ID NO: 34427 - DNA, 25 bp, Mus musculus
aacctcattgagagttagtttcctc

SEQ ID NO: 34428 - DNA, 25 bp, Mus musculus
aacctcattgagtgttagtttcctc

SEQ ID NO: 34429 - DNA, 25 bp, Mus musculus
aacctcattggcaggcactgtgaca

SEQ ID NO: 34430 - DNA, 25 bp, Mus musculus
aacctcattggctggcactgtgaca

SEQ ID NO: 34431 - DNA, 25 bp, Mus musculus
aacctcattgttctgggccgatacc

SEQ ID NO: 34432 - DNA, 25 bp, Mus musculus
aacctcattgttgtgggccgatacc

SEQ ID NO: 34433 - DNA, 25 bp, Mus musculus
aacctcatttcaaccattcactgtg

SEQ ID NO: 34434 - DNA, 25 bp, Mus musculus
aacctcatttcatccattcactgtg

SEQ ID NO: 34435 - DNA, 25 bp, Mus musculus
aacctcattttgaactcgctcatga

SEQ ID NO: 34436 - DNA, 25 bp, Mus musculus
aacctcattttgcccagctcataaa

SEQ ID NO: 34437 - DNA, 25 bp, Mus musculus
aacctcattttggccagctcataaa

SEQ ID NO: 34438 - DNA, 25 bp, Mus musculus
aacctcattttgtactcgctcatga

SEQ ID NO: 34439 - DNA, 25 bp, Mus musculus
aacctccaagagaatcatactgtga

SEQ ID NO: 34440 - DNA, 25 bp, Mus musculus
aacctccaagagtatcatactgtga

SEQ ID NO: 34441 - DNA, 25 bp, Mus musculus
aacctccaccgaagcagtccaagag

SEQ ID NO: 34442 - DNA, 25 bp, Mus musculus
aacctccaccgatgcagtccaagag

SEQ ID NO: 34443 - DNA, 25 bp, Mus musculus
aacctccagccacaatgctaagtgt

SEQ ID NO: 34444 - DNA, 25 bp, Mus musculus
aacctccagccagaatgctaagtgt

SEQ ID NO: 34445 - DNA, 25 bp, Mus musculus
aacctccagcgacccagtagttaag

SEQ ID NO: 34446 - DNA, 25 bp, Mus musculus
aacctccagcgagccagtagttaag

SEQ ID NO: 34447 - DNA, 25 bp, Mus musculus
aacctccagtttacagccactttat

SEQ ID NO: 34448 - DNA, 25 bp, Mus musculus
aacctccagtttcagacgacaagaa

SEQ ID NO: 34449 - DNA, 25 bp, Mus musculus
aacctccagtttgagacgacaagaa

SEQ ID NO: 34450 - DNA, 25 bp, Mus musculus
aacctccagttttcagccactttat

SEQ ID NO: 34451 - DNA, 25 bp, Mus musculus
aacctccatgagctcagactattgc

SEQ ID NO: 34452 - DNA, 25 bp, Mus musculus
aacctccatgaggtcagactattgc

SEQ ID NO: 34453 - DNA, 25 bp, Mus musculus
aacctcccaagcatacagttagcag

SEQ ID NO: 34454 - DNA, 25 bp, Mus musculus
aacctcccaagcttacagttagcag

SEQ ID NO: 34455 - DNA, 25 bp, Mus musculus
aacctcccagaaagagcacagcctg

SEQ ID NO: 34456 - DNA, 25 bp, Mus musculus
aacctcccagaatgagcacagcctg

SEQ ID NO: 34457 - DNA, 25 bp, Mus musculus
aacctccccactcttttcagagaca

SEQ ID NO: 34458 - DNA, 25 bp, Mus musculus
aacctccccactgttttcagagaca

SEQ ID NO: 34459 - DNA, 25 bp, Mus musculus
aacctccctctgattttcaaatgct

SEQ ID NO: 34460 - DNA, 25 bp, Mus musculus
aacctccctctgtttttcaaatgct

SEQ ID NO: 34461 - DNA, 25 bp, Mus musculus
aacctccgacctctagcatagtgag

SEQ ID NO: 34462 - DNA, 25 bp, Mus musculus
aacctccgacctgtagcatagtgag

SEQ ID NO: 34463 - DNA, 25 bp, Mus musculus
aacctccgcctgattgagagcctgt

SEQ ID NO: 34464 - DNA, 25 bp, Mus musculus
aacctccgcctgtttgagagcctgt

SEQ ID NO: 34465 - DNA, 25 bp, Mus musculus
aacctccggaatacattacgcgttg

SEQ ID NO: 34466 - DNA, 25 bp, Mus musculus
aacctccggaattcattacgcgttg

SEQ ID NO: 34467 - DNA, 25 bp, Mus musculus
aacctccggattatgatccagtatc

SEQ ID NO: 34468 - DNA, 25 bp, Mus musculus
aacctccggattttgatccagtatc

SEQ ID NO: 34469 - DNA, 25 bp, Mus musculus
aacctccgtgaacttggcctgtgga

SEQ ID NO: 34470 - DNA, 25 bp, Mus musculus
aacctccgtgaagttggcctgtgga

SEQ ID NO: 34471 - DNA, 25 bp, Mus musculus
aacctcctacagatcctagtgttat

SEQ ID NO: 34472 - DNA, 25 bp, Mus musculus
aacctcctacagttcctagtgttat

SEQ ID NO: 34473 - DNA, 25 bp, Mus musculus
aacctcctagtcatcttctatgtgt

SEQ ID NO: 34474 - DNA, 25 bp, Mus musculus
aacctcctagtcttcttctatgtgt

SEQ ID NO: 34475 - DNA, 25 bp, Mus musculus
aacctcctcacaatacaacacaagt

SEQ ID NO: 34476 - DNA, 25 bp, Mus musculus
aacctcctcacattacaacacaagt

SEQ ID NO: 34477 - DNA, 25 bp, Mus musculus
aacctcctcattacatttggtgtcc

SEQ ID NO: 34478 - DNA, 25 bp, Mus musculus
aacctcctcatttcatttggtgtcc

SEQ ID NO: 34479 - DNA, 25 bp, Mus musculus
aacctcctcgagctcggaactaatg

SEQ ID NO: 34480 - DNA, 25 bp, Mus musculus
aacctcctcgaggtcggaactaatg

SEQ ID NO: 34481 - DNA, 25 bp, Mus musculus
aacctcctctcactgtaagccagga

SEQ ID NO: 34482 - DNA, 25 bp, Mus musculus
aacctcctctcagtgtaagccagga

SEQ ID NO: 34483 - DNA, 25 bp, Mus musculus
aacctcctgagcatttcctgtgtgt

SEQ ID NO: 34484 - DNA, 25 bp, Mus musculus
aacctcctgagcttttcctgtgtgt

SEQ ID NO: 34485 - DNA, 25 bp, Mus musculus
aacctcctggttacagttgctgtag

SEQ ID NO: 34486 - DNA, 25 bp, Mus musculus
aacctcctggtttcagttgctgtag

SEQ ID NO: 34487 - DNA, 25 bp, Mus musculus
aacctcgaaaagagagacgattctg

SEQ ID NO: 34488 - DNA, 25 bp, Mus musculus
aacctcgaaaagtgagacgattctg

SEQ ID NO: 34489 - DNA, 25 bp, Mus musculus
aacctcgaaataaccagcggctgcc

SEQ ID NO: 34490 - DNA, 25 bp, Mus musculus
aacctcgaaatatccagcggctgcc

SEQ ID NO: 34491 - DNA, 25 bp, Mus musculus
aacctcgagttgctgatctgaagaa

SEQ ID NO: 34492 - DNA, 25 bp, Mus musculus
aacctcgagttggtgatctgaagaa

SEQ ID NO: 34493 - DNA, 25 bp, Mus musculus
aacctcgctgaaccatctgcagaaa

SEQ ID NO: 34494 - DNA, 25 bp, Mus musculus
aacctcgctgaagcatctgcagaaa

SEQ ID NO: 34495 - DNA, 25 bp, Mus musculus
aacctcggaatcctcactgtggaga

SEQ ID NO: 34496 - DNA, 25 bp, Mus musculus
aacctcggaatcgtcactgtggaga

SEQ ID NO: 34497 - DNA, 25 bp, Mus musculus
aacctcggattcacacagaacctgg

SEQ ID NO: 34498 - DNA, 25 bp, Mus musculus
aacctcggattctcacagaacctgg

SEQ ID NO: 34499 - DNA, 25 bp, Mus musculus
aacctcggcggacgagtcgtgacca

SEQ ID NO: 34500 - DNA, 25 bp, Mus musculus
aacctcggcggaggagtcgtgacca

SEQ ID NO: 34501 - DNA, 25 bp, Mus musculus
aacctcggcgttcagcagagtcagg

SEQ ID NO: 34502 - DNA, 25 bp, Mus musculus
aacctcggcgttgagcagagtcagg

SEQ ID NO: 34503 - DNA, 25 bp, Mus musculus
aacctcgtagcaacagcaataccgg

SEQ ID NO: 34504 - DNA, 25 bp, Mus musculus
aacctcgtagcatcagcaataccgg

SEQ ID NO: 34505 - DNA, 25 bp, Mus musculus
aacctcgtattacatgatgcagaag

SEQ ID NO: 34506 - DNA, 25 bp, Mus musculus
aacctcgtattagatgatgcagaag

SEQ ID NO: 34507 - DNA, 25 bp, Mus musculus
aacctcgtcccgatggactacagga

SEQ ID NO: 34508 - DNA, 25 bp, Mus musculus
aacctcgtcccgttggactacagga

SEQ ID NO: 34509 - DNA, 25 bp, Mus musculus
aacctcgtgggcaaaagtcatcttg

SEQ ID NO: 34510 - DNA, 25 bp, Mus musculus
aacctcgtgggctaaagtcatcttg

SEQ ID NO: 34511 - DNA, 25 bp, Mus musculus
aacctcgttactacagcagtctttt

SEQ ID NO: 34512 - DNA, 25 bp, Mus musculus
aacctcgttacttcagcagtctttt

SEQ ID NO: 34513 - DNA, 25 bp, Mus musculus
aacctcgttagtcggctctttatat

SEQ ID NO: 34514 - DNA, 25 bp, Mus musculus
aacctcgttagtgggctctttatat

SEQ ID NO: 34515 - DNA, 25 bp, Mus musculus
aacctctaagggatccaggcagctt

SEQ ID NO: 34516 - DNA, 25 bp, Mus musculus
aacctctaagggttccaggcagctt

SEQ ID NO: 34517 - DNA, 25 bp, Mus musculus
aacctctacactcccttgaatgaat

SEQ ID NO: 34518 - DNA, 25 bp, Mus musculus
aacctctacactgccttgaatgaat

SEQ ID NO: 34519 - DNA, 25 bp, Mus musculus
aacctctactttagtaatggcggca

SEQ ID NO: 34520 - DNA, 25 bp, Mus musculus
aacctctacttttgtaatggcggca

SEQ ID NO: 34521 - DNA, 25 bp, Mus musculus
aacctctagctgagtatcccttagt

SEQ ID NO: 34522 - DNA, 25 bp, Mus musculus
aacctctagctgatatcagcattgg

SEQ ID NO: 34523 - DNA, 25 bp, Mus musculus
aacctctagctgtgtatcccttagt

SEQ ID NO: 34524 - DNA, 25 bp, Mus musculus
aacctctagctgttatcagcattgg

SEQ ID NO: 34525 - DNA, 25 bp, Mus musculus
aacctctagggtcgtcttcagatca

SEQ ID NO: 34526 - DNA, 25 bp, Mus musculus
aacctctagggtggtcttcagatca

SEQ ID NO: 34527 - DNA, 25 bp, Mus musculus
aacctctaggtcaactctgtgccag

SEQ ID NO: 34528 - DNA, 25 bp, Mus musculus
aacctctaggtctactctgtgccag

SEQ ID NO: 34529 - DNA, 25 bp, Mus musculus
aacctctatgtaacattgtgtgcac

SEQ ID NO: 34530 - DNA, 25 bp, Mus musculus
aacctctatgtatcattgtgtgcac

SEQ ID NO: 34531 - DNA, 25 bp, Mus musculus
aacctctatgtcatatctggtctga

SEQ ID NO: 34532 - DNA, 25 bp, Mus musculus
aacctctatgtcttatctggtctga

SEQ ID NO: 34533 - DNA, 25 bp, Mus musculus
aacctctcagcaacttaggactgtt

SEQ ID NO: 34534 - DNA, 25 bp, Mus musculus
aacctctcagcatcttaggactgtt

SEQ ID NO: 34535 - DNA, 25 bp, Mus musculus
aacctctcattgaacctagtaccac

SEQ ID NO: 34536 - DNA, 25 bp, Mus musculus
aacctctcattgtacctagtaccac

SEQ ID NO: 34537 - DNA, 25 bp, Mus musculus
aacctctccgacattagatgctcta

SEQ ID NO: 34538 - DNA, 25 bp, Mus musculus
aacctctccgactttagatgctcta

SEQ ID NO: 34539 - DNA, 25 bp, Mus musculus
aacctctctaggagcaattccgatg

SEQ ID NO: 34540 - DNA, 25 bp, Mus musculus
aacctctctaggtgcaattccgatg

SEQ ID NO: 34541 - DNA, 25 bp, Mus musculus
aacctctctcacattctagatggga

SEQ ID NO: 34542 - DNA, 25 bp, Mus musculus
aacctctctcactttctagatggga

SEQ ID NO: 34543 - DNA, 25 bp, Mus musculus
aacctctctcttcccttagttgaaa

SEQ ID NO: 34544 - DNA, 25 bp, Mus musculus
aacctctctcttgccttagttgaaa

SEQ ID NO: 34545 - DNA, 25 bp, Mus musculus
aacctctctgatcctgtgaagtagt

SEQ ID NO: 34546 - DNA, 25 bp, Mus musculus
aacctctctgatgctgtgaagtagt

SEQ ID NO: 34547 - DNA, 25 bp, Mus musculus
aacctctgaaaaactgactaagtgg

SEQ ID NO: 34548 - DNA, 25 bp, Mus musculus
aacctctgaaaaagccaacctctgg

SEQ ID NO: 34549 - DNA, 25 bp, Mus musculus
aacctctgaaaatctgactaagtgg

SEQ ID NO: 34550 - DNA, 25 bp, Mus musculus
aacctctgaaaatgccaacctctgg

SEQ ID NO: 34551 - DNA, 25 bp, Mus musculus
aacctctgagcaactaagtcttgtg

SEQ ID NO: 34552 - DNA, 25 bp, Mus musculus
aacctctgagcatctaagtcttgtg

SEQ ID NO: 34553 - DNA, 25 bp, Mus musculus
aacctctgagggacagcaagctgca

SEQ ID NO: 34554 - DNA, 25 bp, Mus musculus
aacctctgagggtcagcaagctgca

SEQ ID NO: 34555 - DNA, 25 bp, Mus musculus
aacctctgatctacgttcagaacca

SEQ ID NO: 34556 - DNA, 25 bp, Mus musculus
aacctctgatcttcgttcagaacca

SEQ ID NO: 34557 - DNA, 25 bp, Mus musculus
aacctctgatttatcgggagctgaa

SEQ ID NO: 34558 - DNA, 25 bp, Mus musculus
aacctctgatttttcgggagctgaa

SEQ ID NO: 34559 - DNA, 25 bp, Mus musculus
aacctctgcaacagcctctgcaggc

SEQ ID NO: 34560 - DNA, 25 bp, Mus musculus
aacctctgcaactgcctctgcaggc

SEQ ID NO: 34561 - DNA, 25 bp, Mus musculus
aacctctgcaagagcgaccaattct

SEQ ID NO: 34562 - DNA, 25 bp, Mus musculus
aacctctgcaagtgcgaccaattct

SEQ ID NO: 34563 - DNA, 25 bp, Mus musculus
aacctctgccctaaaccatgtgact

SEQ ID NO: 34564 - DNA, 25 bp, Mus musculus
aacctctgcccttaaccatgtgact

SEQ ID NO: 34565 - DNA, 25 bp, Mus musculus
aacctctgcctccagatttgtggga

SEQ ID NO: 34566 - DNA, 25 bp, Mus musculus
aacctctgcctcgagatttgtggga

SEQ ID NO: 34567 - DNA, 25 bp, Mus musculus
aacctctgcggtacagctgctttga

SEQ ID NO: 34568 - DNA, 25 bp, Mus musculus
aacctctgcggttcagctgctttga

SEQ ID NO: 34569 - DNA, 25 bp, Mus musculus
aacctctgctaaccttatttgacgg

SEQ ID NO: 34570 - DNA, 25 bp, Mus musculus
aacctctgctaagcttatttgacgg

SEQ ID NO: 34571 - DNA, 25 bp, Mus musculus
aacctctgggagctattccactgac

SEQ ID NO: 34572 - DNA, 25 bp, Mus musculus
aacctctgggaggtattccactgac

SEQ ID NO: 34573 - DNA, 25 bp, Mus musculus
aacctctgtagccatatgtccctgt

SEQ ID NO: 34574 - DNA, 25 bp, Mus musculus
aacctctgtagcgatatgtccctgt

SEQ ID NO: 34575 - DNA, 25 bp, Mus musculus
aacctctgtttgagtaacacttaat

SEQ ID NO: 34576 - DNA, 25 bp, Mus musculus
aacctctgtttgtgtaacacttaat

SEQ ID NO: 34577 - DNA, 25 bp, Mus musculus
aacctcttatagaataggcaggccg

SEQ ID NO: 34578 - DNA, 25 bp, Mus musculus
aacctcttatagtataggcaggccg

SEQ ID NO: 34579 - DNA, 25 bp, Mus musculus
aacctcttcaccaagtaccggaatg

SEQ ID NO: 34580 - DNA, 25 bp, Mus musculus
aacctcttcacctagtaccggaatg

SEQ ID NO: 34581 - DNA, 25 bp, Mus musculus
aacctcttccagactgagaacacag

SEQ ID NO: 34582 - DNA, 25 bp, Mus musculus
aacctcttccagtctgagaacacag

SEQ ID NO: 34583 - DNA, 25 bp, Mus musculus
aacctcttcgttagttcatcacttg

SEQ ID NO: 34584 - DNA, 25 bp, Mus musculus
aacctcttcgtttgttcatcacttg

SEQ ID NO: 34585 - DNA, 25 bp, Mus musculus
aacctcttcttgatgctgattccgg

SEQ ID NO: 34586 - DNA, 25 bp, Mus musculus
aacctcttcttgttgctgattccgg

SEQ ID NO: 34587 - DNA, 25 bp, Mus musculus
aacctcttgggtaggctgtgagaac

SEQ ID NO: 34588 - DNA, 25 bp, Mus musculus
aacctcttgggttggctgtgagaac

SEQ ID NO: 34589 - DNA, 25 bp, Mus musculus
aacctcttgtcaagtcctgaacagc

SEQ ID NO: 34590 - DNA, 25 bp, Mus musculus
aacctcttgtcatgtcctgaacagc

SEQ ID NO: 34591 - DNA, 25 bp, Mus musculus
aacctctttcccacaactgtgctgt

SEQ ID NO: 34592 - DNA, 25 bp, Mus musculus
aacctctttccctcaactgtgctgt

SEQ ID NO: 34593 - DNA, 25 bp, Mus musculus
aacctctttctacgtgacaaatcga

SEQ ID NO: 34594 - DNA, 25 bp, Mus musculus
aacctctttctaggtgacaaatcga

SEQ ID NO: 34595 - DNA, 25 bp, Mus musculus
aacctctttgcaaacagttcacgga

SEQ ID NO: 34596 - DNA, 25 bp, Mus musculus
aacctctttgcatacagttcacgga

SEQ ID NO: 34597 - DNA, 25 bp, Mus musculus
aacctctttgtgctgctagagcaag

SEQ ID NO: 34598 - DNA, 25 bp, Mus musculus
aacctctttgtggtgctagagcaag

SEQ ID NO: 34599 - DNA, 25 bp, Mus musculus
aacctctttgttctacctgcactga

SEQ ID NO: 34600 - DNA, 25 bp, Mus musculus
aacctctttgttgtacctgcactga

SEQ ID NO: 34601 - DNA, 25 bp, Mus musculus
aacctgaaatgcatagagacataga

SEQ ID NO: 34602 - DNA, 25 bp, Mus musculus
aacctgaaatgcttagagacataga

SEQ ID NO: 34603 - DNA, 25 bp, Mus musculus
aacctgaacccacaccatcgggagg

SEQ ID NO: 34604 - DNA, 25 bp, Mus musculus
aacctgaacccagaccatcgggagg

SEQ ID NO: 34605 - DNA, 25 bp, Mus musculus
aacctgaagacccacactcgaattc

SEQ ID NO: 34606 - DNA, 25 bp, Mus musculus
aacctgaagaccgacactcgaattc

SEQ ID NO: 34607 - DNA, 25 bp, Mus musculus
aacctgaagattcgtgcccctatgg

SEQ ID NO: 34608 - DNA, 25 bp, Mus musculus
aacctgaagattggtgcccctatgg

SEQ ID NO: 34609 - DNA, 25 bp, Mus musculus
aacctgaagctgaccgactttggct

SEQ ID NO: 34610 - DNA, 25 bp, Mus musculus
aacctgaagctgtccgactttggct

SEQ ID NO: 34611 - DNA, 25 bp, Mus musculus
aacctgaaggctatcatgtgccgtt

SEQ ID NO: 34612 - DNA, 25 bp, Mus musculus
aacctgaaggctttcatgtgccgtt

SEQ ID NO: 34613 - DNA, 25 bp, Mus musculus
aacctgaaggtgctccttagtttct

SEQ ID NO: 34614 - DNA, 25 bp, Mus musculus
aacctgaaggtggtccttagtttct

SEQ ID NO: 34615 - DNA, 25 bp, Mus musculus
aacctgaatccacttctacctatgt

SEQ ID NO: 34616 - DNA, 25 bp, Mus musculus
aacctgaatccagttctacctatgt

SEQ ID NO: 34617 - DNA, 25 bp, Mus musculus
aacctgaatggacgaacaggagcag

SEQ ID NO: 34618 - DNA, 25 bp, Mus musculus
aacctgaatggaggaacaggagcag

SEQ ID NO: 34619 - DNA, 25 bp, Mus musculus
aacctgaattcaaccttagacccat

SEQ ID NO: 34620 - DNA, 25 bp, Mus musculus
aacctgaattcatccttagacccat

SEQ ID NO: 34621 - DNA, 25 bp, Mus musculus
aacctgaattctattgcatagcata

SEQ ID NO: 34622 - DNA, 25 bp, Mus musculus
aacctgaattcttttgcatagcata

SEQ ID NO: 34623 - DNA, 25 bp, Mus musculus
aacctgacaaggctgtatccattat

SEQ ID NO: 34624 - DNA, 25 bp, Mus musculus
aacctgacaagggtgtatccattat

SEQ ID NO: 34625 - DNA, 25 bp, Mus musculus
aacctgacagccatcaagacagtgt

SEQ ID NO: 34626 - DNA, 25 bp, Mus musculus
aacctgacagccttcaagacagtgt

SEQ ID NO: 34627 - DNA, 25 bp, Mus musculus
aacctgacattcaatgctcatctga

SEQ ID NO: 34628 - DNA, 25 bp, Mus musculus
aacctgacattctatgctcatctga

SEQ ID NO: 34629 - DNA, 25 bp, Mus musculus
aacctgaccatactggaaccagaca

SEQ ID NO: 34630 - DNA, 25 bp, Mus musculus
aacctgaccatagtggaaccagaca

SEQ ID NO: 34631 - DNA, 25 bp, Mus musculus
aacctgacctatcgcaatcatttgc

SEQ ID NO: 34632 - DNA, 25 bp, Mus musculus
aacctgacctatggcaatcatttgc

SEQ ID NO: 34633 - DNA, 25 bp, Mus musculus
aacctgactgctaggaatctgctca

SEQ ID NO: 34634 - DNA, 25 bp, Mus musculus
aacctgactgcttggaatctgctca

SEQ ID NO: 34635 - DNA, 25 bp, Mus musculus
aacctgactggtagttctatttctg

SEQ ID NO: 34636 - DNA, 25 bp, Mus musculus
aacctgactggttgttctatttctg

SEQ ID NO: 34637 - DNA, 25 bp, Mus musculus
aacctgacttacatgcactgtgatc

SEQ ID NO: 34638 - DNA, 25 bp, Mus musculus
aacctgacttacttgcactgtgatc

SEQ ID NO: 34639 - DNA, 25 bp, Mus musculus
aacctgagaggtacctttgtgtggt

SEQ ID NO: 34640 - DNA, 25 bp, Mus musculus
aacctgagaggttcctttgtgtggt

SEQ ID NO: 34641 - DNA, 25 bp, Mus musculus
aacctgagatcaaactgagagcact

SEQ ID NO: 34642 - DNA, 25 bp, Mus musculus
aacctgagatcatactgagagcact

SEQ ID NO: 34643 - DNA, 25 bp, Mus musculus
aacctgagattcaaatagctccctg

SEQ ID NO: 34644 - DNA, 25 bp, Mus musculus
aacctgagattctaatagctccctg

SEQ ID NO: 34645 - DNA, 25 bp, Mus musculus
aacctgagatttctgtgctgatccc

SEQ ID NO: 34646 - DNA, 25 bp, Mus musculus
aacctgagatttgtgtgctgatccc

SEQ ID NO: 34647 - DNA, 25 bp, Mus musculus
aacctgagcatgattgttttgtctg

SEQ ID NO: 34648 - DNA, 25 bp, Mus musculus
aacctgagcatgtttgttttgtctg

SEQ ID NO: 34649 - DNA, 25 bp, Mus musculus
aacctgagctctaagctgctgctga

SEQ ID NO: 34650 - DNA, 25 bp, Mus musculus
aacctgagctcttagctgctgctga

SEQ ID NO: 34651 - DNA, 25 bp, Mus musculus
aacctgagctttctctgaacagatc

SEQ ID NO: 34652 - DNA, 25 bp, Mus musculus
aacctgagctttgtctgaacagatc

SEQ ID NO: 34653 - DNA, 25 bp, Mus musculus
aacctgaggcctacatactcatgca

SEQ ID NO: 34654 - DNA, 25 bp, Mus musculus
aacctgaggccttcatactcatgca

SEQ ID NO: 34655 - DNA, 25 bp, Mus musculus
aacctgaggtggagccatatttggt

SEQ ID NO: 34656 - DNA, 25 bp, Mus musculus
aacctgaggtggtgccatatttggt

SEQ ID NO: 34657 - DNA, 25 bp, Mus musculus
aacctgaggttacttccattgttgc

SEQ ID NO: 34658 - DNA, 25 bp, Mus musculus
aacctgaggttagttccattgttgc

SEQ ID NO: 34659 - DNA, 25 bp, Mus musculus
aacctgagtacaacagtcattgctg

SEQ ID NO: 34660 - DNA, 25 bp, Mus musculus
aacctgagtacatcagtcattgctg

SEQ ID NO: 34661 - DNA, 25 bp, Mus musculus
aacctgagtcttcagatgctgagag

SEQ ID NO: 34662 - DNA, 25 bp, Mus musculus
aacctgagtcttgagatgctgagag

SEQ ID NO: 34663 - DNA, 25 bp, Mus musculus
aacctgagtgagatcgcagacctgt

SEQ ID NO: 34664 - DNA, 25 bp, Mus musculus
aacctgagtgagttcgcagacctgt

SEQ ID NO: 34665 - DNA, 25 bp, Mus musculus
aacctgagtgccatatgcagcttgt

SEQ ID NO: 34666 - DNA, 25 bp, Mus musculus
aacctgagtgccttatgcagcttgt

SEQ ID NO: 34667 - DNA, 25 bp, Mus musculus
aacctgagtgctagccagtatgcag

SEQ ID NO: 34668 - DNA, 25 bp, Mus musculus
aacctgagtgcttgccagtatgcag

SEQ ID NO: 34669 - DNA, 25 bp, Mus musculus
aacctgagttcaccacagcgggaat

SEQ ID NO: 34670 - DNA, 25 bp, Mus musculus
aacctgagttcagcacagcgggaat

SEQ ID NO: 34671 - DNA, 25 bp, Mus musculus
aacctgagtttgagctctgcagccc

SEQ ID NO: 34672 - DNA, 25 bp, Mus musculus
aacctgagtttgtgctctgcagccc

SEQ ID NO: 34673 - DNA, 25 bp, Mus musculus
aacctgatcaagacaaagtgcgcgt

SEQ ID NO: 34674 - DNA, 25 bp, Mus musculus
aacctgatcaagtcaaagtgcgcgt

SEQ ID NO: 34675 - DNA, 25 bp, Mus musculus
aacctgatccgcaaagactacttag

SEQ ID NO: 34676 - DNA, 25 bp, Mus musculus
aacctgatccgctaagactacttag

SEQ ID NO: 34677 - DNA, 25 bp, Mus musculus
aacctgatgcaactcgctgtgcgta

SEQ ID NO: 34678 - DNA, 25 bp, Mus musculus
aacctgatgcaagtcgctgtgcgta

SEQ ID NO: 34679 - DNA, 25 bp, Mus musculus
aacctgatgcggaagttctaagtga

SEQ ID NO: 34680 - DNA, 25 bp, Mus musculus
aacctgatgcggtagttctaagtga

SEQ ID NO: 34681 - DNA, 25 bp, Mus musculus
aacctgatggtgaattgggaggcca

SEQ ID NO: 34682 - DNA, 25 bp, Mus musculus
aacctgatggtgatcccctgtaatc

SEQ ID NO: 34683 - DNA, 25 bp, Mus musculus
aacctgatggtgtattgggaggcca

SEQ ID NO: 34684 - DNA, 25 bp, Mus musculus
aacctgatggtgttcccctgtaatc

SEQ ID NO: 34685 - DNA, 25 bp, Mus musculus
aacctgattattattcccagcaccc

SEQ ID NO: 34686 - DNA, 25 bp, Mus musculus
aacctgattatttttcccagcaccc

SEQ ID NO: 34687 - DNA, 25 bp, Mus musculus
aacctgattcagagtcacagtggaa

SEQ ID NO: 34688 - DNA, 25 bp, Mus musculus
aacctgattcagtgtcacagtggaa

SEQ ID NO: 34689 - DNA, 25 bp, Mus musculus
aacctgattcggctcttctctgaag

SEQ ID NO: 34690 - DNA, 25 bp, Mus musculus
aacctgattcgggtcttctctgaag

SEQ ID NO: 34691 - DNA, 25 bp, Mus musculus
aacctgattgtccatcagcgaactc

SEQ ID NO: 34692 - DNA, 25 bp, Mus musculus
aacctgattgtcgatcagcgaactc

SEQ ID NO: 34693 - DNA, 25 bp, Mus musculus
aacctgattttcaagtacatttcac

SEQ ID NO: 34694 - DNA, 25 bp, Mus musculus
aacctgattttctagtacatttcac

SEQ ID NO: 34695 - DNA, 25 bp, Mus musculus
aacctgcaagaaacagaactgttga

SEQ ID NO: 34696 - DNA, 25 bp, Mus musculus
aacctgcaagaatcagaactgttga

SEQ ID NO: 34697 - DNA, 25 bp, Mus musculus
aacctgcaccggcacgagaagatcc

SEQ ID NO: 34698 - DNA, 25 bp, Mus musculus
aacctgcaccgggacgagaagatcc

SEQ ID NO: 34699 - DNA, 25 bp, Mus musculus
aacctgcacttcacattattggaac

SEQ ID NO: 34700 - DNA, 25 bp, Mus musculus
aacctgcacttctcattattggaac

SEQ ID NO: 34701 - DNA, 25 bp, Mus musculus
aacctgcactttaaaatcctgtcaa

SEQ ID NO: 34702 - DNA, 25 bp, Mus musculus
aacctgcacttttaaatcctgtcaa

SEQ ID NO: 34703 - DNA, 25 bp, Mus musculus
aacctgcagactaagcccgtggacc

SEQ ID NO: 34704 - DNA, 25 bp, Mus musculus
aacctgcagacttagcccgtggacc

SEQ ID NO: 34705 - DNA, 25 bp, Mus musculus
aacctgcagagacctgccattttgt

SEQ ID NO: 34706 - DNA, 25 bp, Mus musculus
aacctgcagagagctgccattttgt

SEQ ID NO: 34707 - DNA, 25 bp, Mus musculus
aacctgcagctgaaaaacctgtcgt

SEQ ID NO: 34708 - DNA, 25 bp, Mus musculus
aacctgcagctgtaaaacctgtcgt

SEQ ID NO: 34709 - DNA, 25 bp, Mus musculus
aacctgcagcttaagtggtcagcca

SEQ ID NO: 34710 - DNA, 25 bp, Mus musculus
aacctgcagctttagtggtcagcca

SEQ ID NO: 34711 - DNA, 25 bp, Mus musculus
aacctgcaggaaagcctccttagta

SEQ ID NO: 34712 - DNA, 25 bp, Mus musculus
aacctgcaggaatgcctccttagta

SEQ ID NO: 34713 - DNA, 25 bp, Mus musculus
aacctgcaggatacctaggtctaat

SEQ ID NO: 34714 - DNA, 25 bp, Mus musculus
aacctgcaggattcctaggtctaat

SEQ ID NO: 34715 - DNA, 25 bp, Mus musculus
aacctgcagggtcactcatctaaag

SEQ ID NO: 34716 - DNA, 25 bp, Mus musculus
aacctgcagggtgactcatctaaag

SEQ ID NO: 34717 - DNA, 25 bp, Mus musculus
aacctgcagtccatctttgagaggg

SEQ ID NO: 34718 - DNA, 25 bp, Mus musculus
aacctgcagtccttctttgagaggg

SEQ ID NO: 34719 - DNA, 25 bp, Mus musculus
aacctgcagtttctcaacttctgtt

SEQ ID NO: 34720 - DNA, 25 bp, Mus musculus
aacctgcagtttgtcaacttctgtt

SEQ ID NO: 34721 - DNA, 25 bp, Mus musculus
aacctgcatacaagtgcttgttcac

SEQ ID NO: 34722 - DNA, 25 bp, Mus musculus
aacctgcatacatgtgcttgttcac

SEQ ID NO: 34723 - DNA, 25 bp, Mus musculus
aacctgccagatcagatctaccatg

SEQ ID NO: 34724 - DNA, 25 bp, Mus musculus
aacctgccagatgagatctaccatg

SEQ ID NO: 34725 - DNA, 25 bp, Mus musculus
aacctgccattaaacaacttgctat

SEQ ID NO: 34726 - DNA, 25 bp, Mus musculus
aacctgccattatacaacttgctat

SEQ ID NO: 34727 - DNA, 25 bp, Mus musculus
aacctgccctgaaaggagatgcatt

SEQ ID NO: 34728 - DNA, 25 bp, Mus musculus
aacctgccctgataggagatgcatt

SEQ ID NO: 34729 - DNA, 25 bp, Mus musculus
aacctgcccttcaaacaaactgctt

SEQ ID NO: 34730 - DNA, 25 bp, Mus musculus
aacctgcccttctaacaaactgctt

SEQ ID NO: 34731 - DNA, 25 bp, Mus musculus
aacctgcctgagagtcactctcaga

SEQ ID NO: 34732 - DNA, 25 bp, Mus musculus
aacctgcctgagtgtcactctcaga

SEQ ID NO: 34733 - DNA, 25 bp, Mus musculus
aacctgccttacattagagccttac

SEQ ID NO: 34734 - DNA, 25 bp, Mus musculus
aacctgccttactttagagccttac

SEQ ID NO: 34735 - DNA, 25 bp, Mus musculus
aacctgccttctctgtttttagaat

SEQ ID NO: 34736 - DNA, 25 bp, Mus musculus
aacctgccttctgtgtttttagaat

SEQ ID NO: 34737 - DNA, 25 bp, Mus musculus
aacctgctaacgagtcaaacttcca

SEQ ID NO: 34738 - DNA, 25 bp, Mus musculus
aacctgctaacgtgtcaaacttcca

SEQ ID NO: 34739 - DNA, 25 bp, Mus musculus
aacctgctatgtcagtctgcttgta

SEQ ID NO: 34740 - DNA, 25 bp, Mus musculus
aacctgctatgtgagtctgcttgta

SEQ ID NO: 34741 - DNA, 25 bp, Mus musculus
aacctgctcataccttttgtcaaaa

SEQ ID NO: 34742 - DNA, 25 bp, Mus musculus
aacctgctcatagcttttgtcaaaa

SEQ ID NO: 34743 - DNA, 25 bp, Mus musculus
aacctgctccagatatccatgacaa

SEQ ID NO: 34744 - DNA, 25 bp, Mus musculus
aacctgctccagttatccatgacaa

SEQ ID NO: 34745 - DNA, 25 bp, Mus musculus
aacctgctccccaaatagtgcaaat

SEQ ID NO: 34746 - DNA, 25 bp, Mus musculus
aacctgctcccctaatagtgcaaat

SEQ ID NO: 34747 - DNA, 25 bp, Mus musculus
aacctgctctgtccggtagtaagta

SEQ ID NO: 34748 - DNA, 25 bp, Mus musculus
aacctgctctgtgcggtagtaagta

SEQ ID NO: 34749 - DNA, 25 bp, Mus musculus
aacctgctgaagagagtgcacttga

SEQ ID NO: 34750 - DNA, 25 bp, Mus musculus
aacctgctgaagtgagtgcacttga

SEQ ID NO: 34751 - DNA, 25 bp, Mus musculus
aacctgctgataaagggcatctttg

SEQ ID NO: 34752 - DNA, 25 bp, Mus musculus
aacctgctgatatagggcatctttg

SEQ ID NO: 34753 - DNA, 25 bp, Mus musculus
aacctgctgcaaattagaacatctt

SEQ ID NO: 34754 - DNA, 25 bp, Mus musculus
aacctgctgcaatttagaacatctt

SEQ ID NO: 34755 - DNA, 25 bp, Mus musculus
aacctgctggcaaagatcaatggca

SEQ ID NO: 34756 - DNA, 25 bp, Mus musculus
aacctgctggcatagatcaatggca

SEQ ID NO: 34757 - DNA, 25 bp, Mus musculus
aacctgctggccaggacatgcgtgt

SEQ ID NO: 34758 - DNA, 25 bp, Mus musculus
aacctgctggccctggagactgcaa

SEQ ID NO: 34759 - DNA, 25 bp, Mus musculus
aacctgctggccgtggagactgcaa

SEQ ID NO: 34760 - DNA, 25 bp, Mus musculus
aacctgctggcctggacatgcgtgt

SEQ ID NO: 34761 - DNA, 25 bp, Mus musculus
aacctgctgggcaaaaatgccttgg

SEQ ID NO: 34762 - DNA, 25 bp, Mus musculus
aacctgctgggcaagtgggcctatc

SEQ ID NO: 34763 - DNA, 25 bp, Mus musculus
aacctgctgggctaaaatgccttgg

SEQ ID NO: 34764 - DNA, 25 bp, Mus musculus
aacctgctgggctagtgggcctatc

SEQ ID NO: 34765 - DNA, 25 bp, Mus musculus
aacctgctgtgaagactaatgtaga

SEQ ID NO: 34766 - DNA, 25 bp, Mus musculus
aacctgctgtgatgactaatgtaga

SEQ ID NO: 34767 - DNA, 25 bp, Mus musculus
aacctgctgtggagggattgtgctt

SEQ ID NO: 34768 - DNA, 25 bp, Mus musculus
aacctgctgtggtgggattgtgctt

SEQ ID NO: 34769 - DNA, 25 bp, Mus musculus
aacctgctgttcattgtttcacaca

SEQ ID NO: 34770 - DNA, 25 bp, Mus musculus
aacctgctgttctttgtttcacaca

SEQ ID NO: 34771 - DNA, 25 bp, Mus musculus
aacctgcttaatcctgcttctgtga

SEQ ID NO: 34772 - DNA, 25 bp, Mus musculus
aacctgcttaatgctgcttctgtga

SEQ ID NO: 34773 - DNA, 25 bp, Mus musculus
aacctgcttaggatcctagttagag

SEQ ID NO: 34774 - DNA, 25 bp, Mus musculus
aacctgcttaggttcctagttagag

SEQ ID NO: 34775 - DNA, 25 bp, Mus musculus
aacctgcttataccagttgtagaag

SEQ ID NO: 34776 - DNA, 25 bp, Mus musculus
aacctgcttatagcagttgtagaag

SEQ ID NO: 34777 - DNA, 25 bp, Mus musculus
aacctgcttcacagtatcaataaag

SEQ ID NO: 34778 - DNA, 25 bp, Mus musculus
aacctgcttcactgtatcaataaag

SEQ ID NO: 34779 - DNA, 25 bp, Mus musculus
aacctgcttcatcttgtaactcaaa

SEQ ID NO: 34780 - DNA, 25 bp, Mus musculus
aacctgcttcatgttgtaactcaaa

SEQ ID NO: 34781 - DNA, 25 bp, Mus musculus
aacctgcttcccaggaagactaagg

SEQ ID NO: 34782 - DNA, 25 bp, Mus musculus
aacctgcttccctggaagactaagg

SEQ ID NO: 34783 - DNA, 25 bp, Mus musculus
aacctgcttctactaggggaggcaa

SEQ ID NO: 34784 - DNA, 25 bp, Mus musculus
aacctgcttctagtaggggaggcaa

SEQ ID NO: 34785 - DNA, 25 bp, Mus musculus
aacctgcttgaaatccttattgctt

SEQ ID NO: 34786 - DNA, 25 bp, Mus musculus
aacctgcttgaattccttattgctt

SEQ ID NO: 34787 - DNA, 25 bp, Mus musculus
aacctgcttgagcttctgtgcatgt

SEQ ID NO: 34788 - DNA, 25 bp, Mus musculus
aacctgcttgaggttctgtgcatgt

SEQ ID NO: 34789 - DNA, 25 bp, Mus musculus
aacctgcttgttcgctgtgatctgc

SEQ ID NO: 34790 - DNA, 25 bp, Mus musculus
aacctgcttgttggctgtgatctgc

SEQ ID NO: 34791 - DNA, 25 bp, Mus musculus
aacctgctttaaatgctacacatgt

SEQ ID NO: 34792 - DNA, 25 bp, Mus musculus
aacctgctttaattgctacacatgt

SEQ ID NO: 34793 - DNA, 25 bp, Mus musculus
aacctgcttttgcttacctgtaatt

SEQ ID NO: 34794 - DNA, 25 bp, Mus musculus
aacctgcttttggttacctgtaatt

SEQ ID NO: 34795 - DNA, 25 bp, Mus musculus
aacctggacactaccactgtaagct

SEQ ID NO: 34796 - DNA, 25 bp, Mus musculus
aacctggacacttccactgtaagct

SEQ ID NO: 34797 - DNA, 25 bp, Mus musculus
aacctggacatccttgtcaatccca

SEQ ID NO: 34798 - DNA, 25 bp, Mus musculus
aacctggacatcgttgtcaatccca

SEQ ID NO: 34799 - DNA, 25 bp, Mus musculus
aacctggaccatatactcctgagga

SEQ ID NO: 34800 - DNA, 25 bp, Mus musculus
aacctggaccatttactcctgagga

SEQ ID NO: 34801 - DNA, 25 bp, Mus musculus
aacctggaccgtatccggcattgga

SEQ ID NO: 34802 - DNA, 25 bp, Mus musculus
aacctggaccgtttccggcattgga

SEQ ID NO: 34803 - DNA, 25 bp, Mus musculus
aacctggactacatgtgaatgtctc

SEQ ID NO: 34804 - DNA, 25 bp, Mus musculus
aacctggactacttgtgaatgtctc

SEQ ID NO: 34805 - DNA, 25 bp, Mus musculus
aacctggactgcagatttttcttcc

SEQ ID NO: 34806 - DNA, 25 bp, Mus musculus
aacctggactgctgatttttcttcc

SEQ ID NO: 34807 - DNA, 25 bp, Mus musculus
aacctggagaagacgcgcctgaaga

SEQ ID NO: 34808 - DNA, 25 bp, Mus musculus
aacctggagaagtcgcgcctgaaga

SEQ ID NO: 34809 - DNA, 25 bp, Mus musculus
aacctggagacaaggtggctgctag

SEQ ID NO: 34810 - DNA, 25 bp, Mus musculus
aacctggagacatggtggctgctag

SEQ ID NO: 34811 - DNA, 25 bp, Mus musculus
aacctggaggtcctgttgcacctgg

SEQ ID NO: 34812 - DNA, 25 bp, Mus musculus
aacctggaggtcgtgttgcacctgg

SEQ ID NO: 34813 - DNA, 25 bp, Mus musculus
aacctggagtaaattctgtagaaca

SEQ ID NO: 34814 - DNA, 25 bp, Mus musculus
aacctggagtaatttctgtagaaca

SEQ ID NO: 34815 - DNA, 25 bp, Mus musculus
aacctggagttgaatgcctcctacg

SEQ ID NO: 34816 - DNA, 25 bp, Mus musculus
aacctggagttgtatgcctcctacg

SEQ ID NO: 34817 - DNA, 25 bp, Mus musculus
aacctggatggcctcaggtgtgccc

SEQ ID NO: 34818 - DNA, 25 bp, Mus musculus
aacctggatggcgtcaggtgtgccc

SEQ ID NO: 34819 - DNA, 25 bp, Mus musculus
aacctggattctaaatggaatttgc

SEQ ID NO: 34820 - DNA, 25 bp, Mus musculus
aacctggattcttaatggaatttgc

SEQ ID NO: 34821 - DNA, 25 bp, Mus musculus
aacctggcaagtagaccggtgctgt

SEQ ID NO: 34822 - DNA, 25 bp, Mus musculus
aacctggcaagttgaccggtgctgt

SEQ ID NO: 34823 - DNA, 25 bp, Mus musculus
aacctggcacttattggcactctgg

SEQ ID NO: 34824 - DNA, 25 bp, Mus musculus
aacctggcactttttggcactctgg

SEQ ID NO: 34825 - DNA, 25 bp, Mus musculus
aacctggcagttctttaagtcacta

SEQ ID NO: 34826 - DNA, 25 bp, Mus musculus
aacctggcagttgtttaagtcacta

SEQ ID NO: 34827 - DNA, 25 bp, Mus musculus
aacctggcatcaagcacctttagaa

SEQ ID NO: 34828 - DNA, 25 bp, Mus musculus
aacctggcatcatgcacctttagaa

SEQ ID NO: 34829 - DNA, 25 bp, Mus musculus
aacctggccgatcattaagatgact

SEQ ID NO: 34830 - DNA, 25 bp, Mus musculus
aacctggccgatgattaagatgact

SEQ ID NO: 34831 - DNA, 25 bp, Mus musculus
aacctggcctaaatgcagactcctt

SEQ ID NO: 34832 - DNA, 25 bp, Mus musculus
aacctggcctaattgcagactcctt

SEQ ID NO: 34833 - DNA, 25 bp, Mus musculus
aacctggcctacatgggtggctcag

SEQ ID NO: 34834 - DNA, 25 bp, Mus musculus
aacctggcctacatttcactcagca

SEQ ID NO: 34835 - DNA, 25 bp, Mus musculus
aacctggcctacttgggtggctcag

SEQ ID NO: 34836 - DNA, 25 bp, Mus musculus
aacctggcctacttttcactcagca

SEQ ID NO: 34837 - DNA, 25 bp, Mus musculus
aacctggcctttattgtgcactggc

SEQ ID NO: 34838 - DNA, 25 bp, Mus musculus
aacctggccttttttgtgcactggc

SEQ ID NO: 34839 - DNA, 25 bp, Mus musculus
aacctggcgcccaatgaaccagaat

SEQ ID NO: 34840 - DNA, 25 bp, Mus musculus
aacctggcgccctatgaaccagaat

SEQ ID NO: 34841 - DNA, 25 bp, Mus musculus
aacctggcgcggatacggcacgtga

SEQ ID NO: 34842 - DNA, 25 bp, Mus musculus
aacctggcgcggttacggcacgtga

SEQ ID NO: 34843 - DNA, 25 bp, Mus musculus
aacctggctagaatgctgattggat

SEQ ID NO: 34844 - DNA, 25 bp, Mus musculus
aacctggctagattgctgattggat

SEQ ID NO: 34845 - DNA, 25 bp, Mus musculus
aacctggctagtcctccatgtatga

SEQ ID NO: 34846 - DNA, 25 bp, Mus musculus
aacctggctagtgctccatgtatga

SEQ ID NO: 34847 - DNA, 25 bp, Mus musculus
aacctggctctacgaccaggtggaa

SEQ ID NO: 34848 - DNA, 25 bp, Mus musculus
aacctggctctaggaccaggtggaa

SEQ ID NO: 34849 - DNA, 25 bp, Mus musculus
aacctggctgccatagagcatcaga

SEQ ID NO: 34850 - DNA, 25 bp, Mus musculus
aacctggctgccttagagcatcaga

SEQ ID NO: 34851 - DNA, 25 bp, Mus musculus
aacctggctggcctcgcttgtagag

SEQ ID NO: 34852 - DNA, 25 bp, Mus musculus
aacctggctggcgtcgcttgtagag

SEQ ID NO: 34853 - DNA, 25 bp, Mus musculus
aacctggctgggagcctggagaata

SEQ ID NO: 34854 - DNA, 25 bp, Mus musculus
aacctggctgggtgcctggagaata

SEQ ID NO: 34855 - DNA, 25 bp, Mus musculus
aacctggctggtctgtgacttgcta

SEQ ID NO: 34856 - DNA, 25 bp, Mus musculus
aacctggctggtgtgtgacttgcta

SEQ ID NO: 34857 - DNA, 25 bp, Mus musculus
aacctgggacccaaagtgactgagg

SEQ ID NO: 34858 - DNA, 25 bp, Mus musculus
aacctgggaccctaagtgactgagg

SEQ ID NO: 34859 - DNA, 25 bp, Mus musculus
aacctgggagacagcttcctggcaa

SEQ ID NO: 34860 - DNA, 25 bp, Mus musculus
aacctgggagactgcttcctggcaa

SEQ ID NO: 34861 - DNA, 25 bp, Mus musculus
aacctgggagccatggtcacgatgc

SEQ ID NO: 34862 - DNA, 25 bp, Mus musculus
aacctgggagccttggtcacgatgc

SEQ ID NO: 34863 - DNA, 25 bp, Mus musculus
aacctgggagctagctttctgttta

SEQ ID NO: 34864 - DNA, 25 bp, Mus musculus
aacctgggagcttgctttctgttta

SEQ ID NO: 34865 - DNA, 25 bp, Mus musculus
aacctgggcaatattgctgtagaac

SEQ ID NO: 34866 - DNA, 25 bp, Mus musculus
aacctgggcaattttgctgtagaac

SEQ ID NO: 34867 - DNA, 25 bp, Mus musculus
aacctgggcagacttctactgggat

SEQ ID NO: 34868 - DNA, 25 bp, Mus musculus
aacctgggcagagttctactgggat

SEQ ID NO: 34869 - DNA, 25 bp, Mus musculus
aacctgggcaggagtgagcactttc

SEQ ID NO: 34870 - DNA, 25 bp, Mus musculus
aacctgggcaggtgtgagcactttc

SEQ ID NO: 34871 - DNA, 25 bp, Mus musculus
aacctgggcataagttttattggta

SEQ ID NO: 34872 - DNA, 25 bp, Mus musculus
aacctgggcatatgttttattggta

SEQ ID NO: 34873 - DNA, 25 bp, Mus musculus
aacctgggcccaaatatcattcttg

SEQ ID NO: 34874 - DNA, 25 bp, Mus musculus
aacctgggcccatatatcattcttg

SEQ ID NO: 34875 - DNA, 25 bp, Mus musculus
aacctgggccttaatgtgtaattct

SEQ ID NO: 34876 - DNA, 25 bp, Mus musculus
aacctgggcctttatgtgtaattct

SEQ ID NO: 34877 - DNA, 25 bp, Mus musculus
aacctgggctccaaactgaggacaa

SEQ ID NO: 34878 - DNA, 25 bp, Mus musculus
aacctgggctcctaactgaggacaa

SEQ ID NO: 34879 - DNA, 25 bp, Mus musculus
aacctgggctgtcacgtgcagcaca

SEQ ID NO: 34880 - DNA, 25 bp, Mus musculus
aacctgggctgtctagtgaattcca

SEQ ID NO: 34881 - DNA, 25 bp, Mus musculus
aacctgggctgtgacgtgcagcaca

SEQ ID NO: 34882 - DNA, 25 bp, Mus musculus
aacctgggctgtgtagtgaattcca

SEQ ID NO: 34883 - DNA, 25 bp, Mus musculus
aacctgggcttcactttgatcactt

SEQ ID NO: 34884 - DNA, 25 bp, Mus musculus
aacctgggcttctctttgatcactt

SEQ ID NO: 34885 - DNA, 25 bp, Mus musculus
aacctgggctttacagttgcagtaa

SEQ ID NO: 34886 - DNA, 25 bp, Mus musculus
aacctgggcttttcagttgcagtaa

SEQ ID NO: 34887 - DNA, 25 bp, Mus musculus
aacctgggtaatagtcaccaagctc

SEQ ID NO: 34888 - DNA, 25 bp, Mus musculus
aacctgggtaattgtcaccaagctc

SEQ ID NO: 34889 - DNA, 25 bp, Mus musculus
aacctgggtatgctgagacgttgat

SEQ ID NO: 34890 - DNA, 25 bp, Mus musculus
aacctgggtatggtgagacgttgat

SEQ ID NO: 34891 - DNA, 25 bp, Mus musculus
aacctgggtcacacacagaaagcag

SEQ ID NO: 34892 - DNA, 25 bp, Mus musculus
aacctgggtcactcacagaaagcag

SEQ ID NO: 34893 - DNA, 25 bp, Mus musculus
aacctgggtcctatgcttgtaaagc

SEQ ID NO: 34894 - DNA, 25 bp, Mus musculus
aacctgggtcctttgcttgtaaagc

SEQ ID NO: 34895 - DNA, 25 bp, Mus musculus
aacctgggtcgcatcggcgtcatca

SEQ ID NO: 34896 - DNA, 25 bp, Mus musculus
aacctgggtcgcttcggcgtcatca

SEQ ID NO: 34897 - DNA, 25 bp, Mus musculus
aacctgggtgtgactcagtgtgcag

SEQ ID NO: 34898 - DNA, 25 bp, Mus musculus
aacctgggtgtgtctcagtgtgcag

SEQ ID NO: 34899 - DNA, 25 bp, Mus musculus
aacctgggtgttcacaagtgtttat

SEQ ID NO: 34900 - DNA, 25 bp, Mus musculus
aacctgggtgttgacaagtgtttat

SEQ ID NO: 34901 - DNA, 25 bp, Mus musculus
aacctgggtttcagctgcacactct

SEQ ID NO: 34902 - DNA, 25 bp, Mus musculus
aacctgggtttctgctgcacactct

SEQ ID NO: 34903 - DNA, 25 bp, Mus musculus
aacctggtaaaaatgctgctcttga

SEQ ID NO: 34904 - DNA, 25 bp, Mus musculus
aacctggtaaaattgctgctcttga

SEQ ID NO: 34905 - DNA, 25 bp, Mus musculus
aacctggtaactctgttcattattc

SEQ ID NO: 34906 - DNA, 25 bp, Mus musculus
aacctggtaactgtgttcattattc

SEQ ID NO: 34907 - DNA, 25 bp, Mus musculus
aacctggtagcccattttgtttatg

SEQ ID NO: 34908 - DNA, 25 bp, Mus musculus
aacctggtagccgattttgtttatg

SEQ ID NO: 34909 - DNA, 25 bp, Mus musculus
aacctggtagctaataactttctgt

SEQ ID NO: 34910 - DNA, 25 bp, Mus musculus
aacctggtagcttataactttctgt

SEQ ID NO: 34911 - DNA, 25 bp, Mus musculus
aacctggtcaacacatgaagacatc

SEQ ID NO: 34912 - DNA, 25 bp, Mus musculus
aacctggtcaactcatgaagacatc

SEQ ID NO: 34913 - DNA, 25 bp, Mus musculus
aacctggtcatcacggtagtgtaaa

SEQ ID NO: 34914 - DNA, 25 bp, Mus musculus
aacctggtcatctcggtagtgtaaa

SEQ ID NO: 34915 - DNA, 25 bp, Mus musculus
aacctggtgattcatttaactagac

SEQ ID NO: 34916 - DNA, 25 bp, Mus musculus
aacctggtgattgatttaactagac

SEQ ID NO: 34917 - DNA, 25 bp, Mus musculus
aacctggtgcggctgaacatttcac

SEQ ID NO: 34918 - DNA, 25 bp, Mus musculus
aacctggtgcgggtgaacatttcac

SEQ ID NO: 34919 - DNA, 25 bp, Mus musculus
aacctggtgcttccagtatagctgt

SEQ ID NO: 34920 - DNA, 25 bp, Mus musculus
aacctggtgcttgcagtatagctgt

SEQ ID NO: 34921 - DNA, 25 bp, Mus musculus
aacctggtgggccaccgttgtgcaa

SEQ ID NO: 34922 - DNA, 25 bp, Mus musculus
aacctggtgggcgaccgttgtgcaa

SEQ ID NO: 34923 - DNA, 25 bp, Mus musculus
aacctggtgtgaaggtcttctttac

SEQ ID NO: 34924 - DNA, 25 bp, Mus musculus
aacctggtgtgatggtcttctttac

SEQ ID NO: 34925 - DNA, 25 bp, Mus musculus
aacctggtgtgcagtcactctggga

SEQ ID NO: 34926 - DNA, 25 bp, Mus musculus
aacctggtgtgctgtcactctggga

SEQ ID NO: 34927 - DNA, 25 bp, Mus musculus
aacctggtgttcctgtacctgctgt

SEQ ID NO: 34928 - DNA, 25 bp, Mus musculus
aacctggtgttcgtgtacctgctgt

SEQ ID NO: 34929 - DNA, 25 bp, Mus musculus
aacctggttaccatcataattatga

SEQ ID NO: 34930 - DNA, 25 bp, Mus musculus
aacctggttaccttcataattatga

SEQ ID NO: 34931 - DNA, 25 bp, Mus musculus
aacctggttatacatccagtatcta

SEQ ID NO: 34932 - DNA, 25 bp, Mus musculus
aacctggttatagatccagtatcta

SEQ ID NO: 34933 - DNA, 25 bp, Mus musculus
aacctggttattccatgtccaacta

SEQ ID NO: 34934 - DNA, 25 bp, Mus musculus
aacctggttattgcatgtccaacta

SEQ ID NO: 34935 - DNA, 25 bp, Mus musculus
aacctgtaacatacaagtctttaca

SEQ ID NO: 34936 - DNA, 25 bp, Mus musculus
aacctgtaacattcaagtctttaca

SEQ ID NO: 34937 - DNA, 25 bp, Mus musculus
aacctgtacagacgctggaatccca

SEQ ID NO: 34938 - DNA, 25 bp, Mus musculus
aacctgtacagaggctggaatccca

SEQ ID NO: 34939 - DNA, 25 bp, Mus musculus
aacctgtacaggaaagtgtggcggc

SEQ ID NO: 34940 - DNA, 25 bp, Mus musculus
aacctgtacaggtaagtgtggcggc

SEQ ID NO: 34941 - DNA, 25 bp, Mus musculus
aacctgtactgccttctgtttgagt

SEQ ID NO: 34942 - DNA, 25 bp, Mus musculus
aacctgtactgcgttctgtttgagt

SEQ ID NO: 34943 - DNA, 25 bp, Mus musculus
aacctgtagactcttaagccctctt

SEQ ID NO: 34944 - DNA, 25 bp, Mus musculus
aacctgtagactgttaagccctctt

SEQ ID NO: 34945 - DNA, 25 bp, Mus musculus
aacctgtagttgctgcacaaaaaat

SEQ ID NO: 34946 - DNA, 25 bp, Mus musculus
aacctgtagttggtgcacaaaaaat

SEQ ID NO: 34947 - DNA, 25 bp, Mus musculus
aacctgtagtttcatactcccatgt

SEQ ID NO: 34948 - DNA, 25 bp, Mus musculus
aacctgtagtttgatactcccatgt

SEQ ID NO: 34949 - DNA, 25 bp, Mus musculus
aacctgtatataactatcgcacaat

SEQ ID NO: 34950 - DNA, 25 bp, Mus musculus
aacctgtatataatatttgaccttt

SEQ ID NO: 34951 - DNA, 25 bp, Mus musculus
aacctgtatatatctatcgcacaat

SEQ ID NO: 34952 - DNA, 25 bp, Mus musculus
aacctgtatatattatttgaccttt

SEQ ID NO: 34953 - DNA, 25 bp, Mus musculus
aacctgtatatcaattttggaactc

SEQ ID NO: 34954 - DNA, 25 bp, Mus musculus
aacctgtatatctattttggaactc

SEQ ID NO: 34955 - DNA, 25 bp, Mus musculus
aacctgtatcatcttcctaataaga

SEQ ID NO: 34956 - DNA, 25 bp, Mus musculus
aacctgtatcatgttcctaataaga

SEQ ID NO: 34957 - DNA, 25 bp, Mus musculus
aacctgtatcttactgctgattctg

SEQ ID NO: 34958 - DNA, 25 bp, Mus musculus
aacctgtatctttctgctgattctg

SEQ ID NO: 34959 - DNA, 25 bp, Mus musculus
aacctgtatgttactgctctcaatg

SEQ ID NO: 34960 - DNA, 25 bp, Mus musculus
aacctgtatgtttctgctctcaatg

SEQ ID NO: 34961 - DNA, 25 bp, Mus musculus
aacctgtattcacctttgtatttga

SEQ ID NO: 34962 - DNA, 25 bp, Mus musculus
aacctgtattcagctttgtatttga

SEQ ID NO: 34963 - DNA, 25 bp, Mus musculus
aacctgtcaatgattcatcgttgtg

SEQ ID NO: 34964 - DNA, 25 bp, Mus musculus
aacctgtcaatgtttcatcgttgtg

SEQ ID NO: 34965 - DNA, 25 bp, Mus musculus
aacctgtcacacagtctgtagacca

SEQ ID NO: 34966 - DNA, 25 bp, Mus musculus
aacctgtcacactgtctgtagacca

SEQ ID NO: 34967 - DNA, 25 bp, Mus musculus
aacctgtcagttctgatccctttgg

SEQ ID NO: 34968 - DNA, 25 bp, Mus musculus
aacctgtcagttgtgatccctttgg

SEQ ID NO: 34969 - DNA, 25 bp, Mus musculus
aacctgtcatggagtggccaccact

SEQ ID NO: 34970 - DNA, 25 bp, Mus musculus
aacctgtcatggtgtggccaccact

SEQ ID NO: 34971 - DNA, 25 bp, Mus musculus
aacctgtcattaaagctgtcgctgg

SEQ ID NO: 34972 - DNA, 25 bp, Mus musculus
aacctgtcattatagctgtcgctgg

SEQ ID NO: 34973 - DNA, 25 bp, Mus musculus
aacctgtccctgattcgagggtgag

SEQ ID NO: 34974 - DNA, 25 bp, Mus musculus
aacctgtccctgtttcgagggtgag

SEQ ID NO: 34975 - DNA, 25 bp, Mus musculus
aacctgtcctacactctagacatta

SEQ ID NO: 34976 - DNA, 25 bp, Mus musculus
aacctgtcctactctctagacatta

SEQ ID NO: 34977 - DNA, 25 bp, Mus musculus
aacctgtcgcttccctctaggagga

SEQ ID NO: 34978 - DNA, 25 bp, Mus musculus
aacctgtcgcttgcctctaggagga

SEQ ID NO: 34979 - DNA, 25 bp, Mus musculus
aacctgtctactagtgatccttcta

SEQ ID NO: 34980 - DNA, 25 bp, Mus musculus
aacctgtctacttgtgatccttcta

SEQ ID NO: 34981 - DNA, 25 bp, Mus musculus
aacctgtctaggagatggagccctc

SEQ ID NO: 34982 - DNA, 25 bp, Mus musculus
aacctgtctaggtgatggagccctc

SEQ ID NO: 34983 - DNA, 25 bp, Mus musculus
aacctgtctcttagcaatcttatga

SEQ ID NO: 34984 - DNA, 25 bp, Mus musculus
aacctgtctctttgcaatcttatga

SEQ ID NO: 34985 - DNA, 25 bp, Mus musculus
aacctgtctgaccttatctatacct

SEQ ID NO: 34986 - DNA, 25 bp, Mus musculus
aacctgtctgacgttatctatacct

SEQ ID NO: 34987 - DNA, 25 bp, Mus musculus
aacctgtctgagcaagtggcccggc

SEQ ID NO: 34988 - DNA, 25 bp, Mus musculus
aacctgtctgaggaagtggcccggc

SEQ ID NO: 34989 - DNA, 25 bp, Mus musculus
aacctgtctgtaatgccgaatctgg

SEQ ID NO: 34990 - DNA, 25 bp, Mus musculus
aacctgtctgtattgccgaatctgg

SEQ ID NO: 34991 - DNA, 25 bp, Mus musculus
aacctgtgaaccagcctgtacttgg

SEQ ID NO: 34992 - DNA, 25 bp, Mus musculus
aacctgtgaacctgcctgtacttgg

SEQ ID NO: 34993 - DNA, 25 bp, Mus musculus
aacctgtgaagtcatcaagtcccca

SEQ ID NO: 34994 - DNA, 25 bp, Mus musculus
aacctgtgaagtgatcaagtcccca

SEQ ID NO: 34995 - DNA, 25 bp, Mus musculus
aacctgtgactgacttaatgtcttc

SEQ ID NO: 34996 - DNA, 25 bp, Mus musculus
aacctgtgactgtcttaatgtcttc

SEQ ID NO: 34997 - DNA, 25 bp, Mus musculus
aacctgtgatggcaaccccgcataa

SEQ ID NO: 34998 - DNA, 25 bp, Mus musculus
aacctgtgatgggaaccccgcataa

SEQ ID NO: 34999 - DNA, 25 bp, Mus musculus
aacctgtgcaacaaacatagtgaag

SEQ ID NO: 35000 - DNA, 25 bp, Mus musculus
aacctgtgcaacaggttgggtggct

SEQ ID NO: 35001 - DNA, 25 bp, Mus musculus
aacctgtgcaacctcaactatggtg

SEQ ID NO: 35002 - DNA, 25 bp, Mus musculus
aacctgtgcaacgtcaactatggtg

SEQ ID NO: 35003 - DNA, 25 bp, Mus musculus
aacctgtgcaactaacatagtgaag

SEQ ID NO: 35004 - DNA, 25 bp, Mus musculus
aacctgtgcaactggttgggtggct

SEQ ID NO: 35005 - DNA, 25 bp, Mus musculus
aacctgtgcaccattggctgttctt

SEQ ID NO: 35006 - DNA, 25 bp, Mus musculus
aacctgtgcacctttggctgttctt

SEQ ID NO: 35007 - DNA, 25 bp, Mus musculus
aacctgtgcctgaaaatgagctccg

SEQ ID NO: 35008 - DNA, 25 bp, Mus musculus
aacctgtgcctgtaaatgagctccg

SEQ ID NO: 35009 - DNA, 25 bp, Mus musculus
aacctgtgcgaacaagggctccttc

SEQ ID NO: 35010 - DNA, 25 bp, Mus musculus
aacctgtgcgaagaagggctccttc

SEQ ID NO: 35011 - DNA, 25 bp, Mus musculus
aacctgtgctaactagtagggtcat

SEQ ID NO: 35012 - DNA, 25 bp, Mus musculus
aacctgtgctaagtagtagggtcat

SEQ ID NO: 35013 - DNA, 25 bp, Mus musculus
aacctgtgctttcaaatgatctcaa

SEQ ID NO: 35014 - DNA, 25 bp, Mus musculus
aacctgtgctttgaaatgatctcaa

SEQ ID NO: 35015 - DNA, 25 bp, Mus musculus
aacctgtggcacagcttggtgagac

SEQ ID NO: 35016 - DNA, 25 bp, Mus musculus
aacctgtggcactgcttggtgagac

SEQ ID NO: 35017 - DNA, 25 bp, Mus musculus
aacctgtggcatagatccgtggatc

SEQ ID NO: 35018 - DNA, 25 bp, Mus musculus
aacctgtggcatatagcatgttctt

SEQ ID NO: 35019 - DNA, 25 bp, Mus musculus
aacctgtggcattgatccgtggatc

SEQ ID NO: 35020 - DNA, 25 bp, Mus musculus
aacctgtggcatttagcatgttctt

SEQ ID NO: 35021 - DNA, 25 bp, Mus musculus
aacctgtgggtcaggttgtctcagc

SEQ ID NO: 35022 - DNA, 25 bp, Mus musculus
aacctgtgggtcagtgggctgtcct

SEQ ID NO: 35023 - DNA, 25 bp, Mus musculus
aacctgtgggtctggttgtctcagc

SEQ ID NO: 35024 - DNA, 25 bp, Mus musculus
aacctgtgggtctgtgggctgtcct

SEQ ID NO: 35025 - DNA, 25 bp, Mus musculus
aacctgtgttaacacttgtcacact

SEQ ID NO: 35026 - DNA, 25 bp, Mus musculus
aacctgtgttaagacttgtcacact

SEQ ID NO: 35027 - DNA, 25 bp, Mus musculus
aacctgtgttgcctgctttaagtct

SEQ ID NO: 35028 - DNA, 25 bp, Mus musculus
aacctgtgttgcgtgctttaagtct

SEQ ID NO: 35029 - DNA, 25 bp, Mus musculus
aacctgttaaatccatataatgtta

SEQ ID NO: 35030 - DNA, 25 bp, Mus musculus
aacctgttaaatgcatataatgtta

SEQ ID NO: 35031 - DNA, 25 bp, Mus musculus
aacctgttagtgagatctgtggaga

SEQ ID NO: 35032 - DNA, 25 bp, Mus musculus
aacctgttagtgtgatctgtggaga

SEQ ID NO: 35033 - DNA, 25 bp, Mus musculus
aacctgttcagcagtgttagatgcc

SEQ ID NO: 35034 - DNA, 25 bp, Mus musculus
aacctgttcagctgtgttagatgcc

SEQ ID NO: 35035 - DNA, 25 bp, Mus musculus
aacctgttcatactgggtgggcgct

SEQ ID NO: 35036 - DNA, 25 bp, Mus musculus
aacctgttcatagtgggtgggcgct

SEQ ID NO: 35037 - DNA, 25 bp, Mus musculus
aacctgttcccacctttgtctaggg

SEQ ID NO: 35038 - DNA, 25 bp, Mus musculus
aacctgttcccagctttgtctaggg

SEQ ID NO: 35039 - DNA, 25 bp, Mus musculus
aacctgttctggagaagccatgcct

SEQ ID NO: 35040 - DNA, 25 bp, Mus musculus
aacctgttctggtgaagccatgcct

SEQ ID NO: 35041 - DNA, 25 bp, Mus musculus
aacctgttgcacactcagtgacgag

SEQ ID NO: 35042 - DNA, 25 bp, Mus musculus
aacctgttgcactctcagtgacgag

SEQ ID NO: 35043 - DNA, 25 bp, Mus musculus
aacctgttgcagagcttgattggat

SEQ ID NO: 35044 - DNA, 25 bp, Mus musculus
aacctgttgcagtgcttgattggat

SEQ ID NO: 35045 - DNA, 25 bp, Mus musculus
aacctgttgctgctcatagccacat

SEQ ID NO: 35046 - DNA, 25 bp, Mus musculus
aacctgttgctggtcatagccacat

SEQ ID NO: 35047 - DNA, 25 bp, Mus musculus
aacctgttggttcaagacgctggga

SEQ ID NO: 35048 - DNA, 25 bp, Mus musculus
aacctgttggttgaagacgctggga

SEQ ID NO: 35049 - DNA, 25 bp, Mus musculus
aacctgttgtgtactgtagagggcc

SEQ ID NO: 35050 - DNA, 25 bp, Mus musculus
aacctgttgtgttctgtagagggcc

SEQ ID NO: 35051 - DNA, 25 bp, Mus musculus
aacctgttttgacgtcgtgagtgtc

SEQ ID NO: 35052 - DNA, 25 bp, Mus musculus
aacctgttttgaggtcgtgagtgtc

SEQ ID NO: 35053 - DNA, 25 bp, Mus musculus
aaccttaaacacctatgcagtcatg

SEQ ID NO: 35054 - DNA, 25 bp, Mus musculus
aaccttaaacacgtatgcagtcatg

SEQ ID NO: 35055 - DNA, 25 bp, Mus musculus
aaccttaataaccttggagctgtca

SEQ ID NO: 35056 - DNA, 25 bp, Mus musculus
aaccttaataacgttggagctgtca

SEQ ID NO: 35057 - DNA, 25 bp, Mus musculus
aaccttaatagcagatccgcatgtg

SEQ ID NO: 35058 - DNA, 25 bp, Mus musculus
aaccttaatagctgatccgcatgtg

SEQ ID NO: 35059 - DNA, 25 bp, Mus musculus
aaccttaatgcaccacattctcaga

SEQ ID NO: 35060 - DNA, 25 bp, Mus musculus
aaccttaatgcagcacattctcaga

SEQ ID NO: 35061 - DNA, 25 bp, Mus musculus
aaccttaatgctaacttgcccttgg

SEQ ID NO: 35062 - DNA, 25 bp, Mus musculus
aaccttaatgcttacttgcccttgg

SEQ ID NO: 35063 - DNA, 25 bp, Mus musculus
aaccttaatttgatatgacatctct

SEQ ID NO: 35064 - DNA, 25 bp, Mus musculus
aaccttaatttgttatgacatctct

SEQ ID NO: 35065 - DNA, 25 bp, Mus musculus
aaccttacaaagcaactgtgcaaga

SEQ ID NO: 35066 - DNA, 25 bp, Mus musculus
aaccttacaaaggaactgtgcaaga

SEQ ID NO: 35067 - DNA, 25 bp, Mus musculus
aaccttacaattacttgacatatgt

SEQ ID NO: 35068 - DNA, 25 bp, Mus musculus
aaccttacaatttcttgacatatgt

SEQ ID NO: 35069 - DNA, 25 bp, Mus musculus
aaccttacccttactgtacagatgt

SEQ ID NO: 35070 - DNA, 25 bp, Mus musculus
aaccttaccctttctgtacagatgt

SEQ ID NO: 35071 - DNA, 25 bp, Mus musculus
aaccttactgtgctactgtatgcac

SEQ ID NO: 35072 - DNA, 25 bp, Mus musculus
aaccttactgtggtactgtatgcac

SEQ ID NO: 35073 - DNA, 25 bp, Mus musculus
aaccttacttagatcaggcatgcac

SEQ ID NO: 35074 - DNA, 25 bp, Mus musculus
aaccttacttagttcaggcatgcac

SEQ ID NO: 35075 - DNA, 25 bp, Mus musculus
aaccttacttgtactcatttggagt

SEQ ID NO: 35076 - DNA, 25 bp, Mus musculus
aaccttacttgttctcatttggagt

SEQ ID NO: 35077 - DNA, 25 bp, Mus musculus
aaccttagaacgctctttggccata

SEQ ID NO: 35078 - DNA, 25 bp, Mus musculus
aaccttagaacggtctttggccata

SEQ ID NO: 35079 - DNA, 25 bp, Mus musculus
aaccttagaactccttggacactgg

SEQ ID NO: 35080 - DNA, 25 bp, Mus musculus
aaccttagaactgcttggacactgg

SEQ ID NO: 35081 - DNA, 25 bp, Mus musculus
aaccttagagatctaacttgagagc

SEQ ID NO: 35082 - DNA, 25 bp, Mus musculus
aaccttagagatgtaacttgagagc

SEQ ID NO: 35083 - DNA, 25 bp, Mus musculus
aaccttagagcacatggctggccgt

SEQ ID NO: 35084 - DNA, 25 bp, Mus musculus
aaccttagagcagatggctggccgt

SEQ ID NO: 35085 - DNA, 25 bp, Mus musculus
aaccttagcttgagcacattccttt

SEQ ID NO: 35086 - DNA, 25 bp, Mus musculus
aaccttagcttgtgcacattccttt

SEQ ID NO: 35087 - DNA, 25 bp, Mus musculus
aaccttaggttgaggttcgagctgt

SEQ ID NO: 35088 - DNA, 25 bp, Mus musculus
aaccttaggttgtggttcgagctgt

SEQ ID NO: 35089 - DNA, 25 bp, Mus musculus
aaccttagtataaagcttctgagtg

SEQ ID NO: 35090 - DNA, 25 bp, Mus musculus
aaccttagtatatagcttctgagtg

SEQ ID NO: 35091 - DNA, 25 bp, Mus musculus
aaccttatagtgcagcctcctgctg

SEQ ID NO: 35092 - DNA, 25 bp, Mus musculus
aaccttatagtggagcctcctgctg

SEQ ID NO: 35093 - DNA, 25 bp, Mus musculus
aaccttatcaggcttttgttctgta

SEQ ID NO: 35094 - DNA, 25 bp, Mus musculus
aaccttatcagggttttgttctgta

SEQ ID NO: 35095 - DNA, 25 bp, Mus musculus
aaccttatcgtcaacatcatctgcg

SEQ ID NO: 35096 - DNA, 25 bp, Mus musculus
aaccttatcgtctacatcatctgcg

SEQ ID NO: 35097 - DNA, 25 bp, Mus musculus
aaccttatctgaacatttcagtggg

SEQ ID NO: 35098 - DNA, 25 bp, Mus musculus
aaccttatctgatcatttcagtggg

SEQ ID NO: 35099 - DNA, 25 bp, Mus musculus
aaccttatgagtctagcgaatgcga

SEQ ID NO: 35100 - DNA, 25 bp, Mus musculus
aaccttatgagtctatgatctgtgg

SEQ ID NO: 35101 - DNA, 25 bp, Mus musculus
aaccttatgagtgtagcgaatgcga

SEQ ID NO: 35102 - DNA, 25 bp, Mus musculus
aaccttatgagtgtatgatctgtgg

SEQ ID NO: 35103 - DNA, 25 bp, Mus musculus
aaccttatggctagagttcaagtcc

SEQ ID NO: 35104 - DNA, 25 bp, Mus musculus
aaccttatggcttgagttcaagtcc

SEQ ID NO: 35105 - DNA, 25 bp, Mus musculus
aaccttatttgcctttaattctgtg

SEQ ID NO: 35106 - DNA, 25 bp, Mus musculus
aaccttatttgcgtttaattctgtg

SEQ ID NO: 35107 - DNA, 25 bp, Mus musculus
aaccttattttgaacagacagcttt

SEQ ID NO: 35108 - DNA, 25 bp, Mus musculus
aaccttattttgtacagacagcttt

SEQ ID NO: 35109 - DNA, 25 bp, Mus musculus
aaccttcaaaataggcttgctctgt

SEQ ID NO: 35110 - DNA, 25 bp, Mus musculus
aaccttcaaaattggcttgctctgt

SEQ ID NO: 35111 - DNA, 25 bp, Mus musculus
aaccttcaatggacctcgggccctg

SEQ ID NO: 35112 - DNA, 25 bp, Mus musculus
aaccttcaatggtcctcgggccctg

SEQ ID NO: 35113 - DNA, 25 bp, Mus musculus
aaccttcacacgctagactcagaga

SEQ ID NO: 35114 - DNA, 25 bp, Mus musculus
aaccttcacacggtagactcagaga

SEQ ID NO: 35115 - DNA, 25 bp, Mus musculus
aaccttcactaaccagcattgctgt

SEQ ID NO: 35116 - DNA, 25 bp, Mus musculus
aaccttcactaagcagcattgctgt

SEQ ID NO: 35117 - DNA, 25 bp, Mus musculus
aaccttcactttagctaccttgata

SEQ ID NO: 35118 - DNA, 25 bp, Mus musculus
aaccttcacttttgctaccttgata

SEQ ID NO: 35119 - DNA, 25 bp, Mus musculus
aaccttcatagacccattgccaacg

SEQ ID NO: 35120 - DNA, 25 bp, Mus musculus
aaccttcatagagccattgccaacg

SEQ ID NO: 35121 - DNA, 25 bp, Mus musculus
aaccttcatctaaattctacttggc

SEQ ID NO: 35122 - DNA, 25 bp, Mus musculus
aaccttcatctaaattctgtcttct

SEQ ID NO: 35123 - DNA, 25 bp, Mus musculus
aaccttcatctatattctacttggc

SEQ ID NO: 35124 - DNA, 25 bp, Mus musculus
aaccttcatctatattctgtcttct

SEQ ID NO: 35125 - DNA, 25 bp, Mus musculus
aaccttcatgccacttaaaatttat

SEQ ID NO: 35126 - DNA, 25 bp, Mus musculus
aaccttcatgcctcttaaaatttat

SEQ ID NO: 35127 - DNA, 25 bp, Mus musculus
aaccttcatttcctttgcagacaaa

SEQ ID NO: 35128 - DNA, 25 bp, Mus musculus
aaccttcatttcgtttgcagacaaa

SEQ ID NO: 35129 - DNA, 25 bp, Mus musculus
aaccttccaaggctgccaagctgta

SEQ ID NO: 35130 - DNA, 25 bp, Mus musculus
aaccttccaagggtgccaagctgta

SEQ ID NO: 35131 - DNA, 25 bp, Mus musculus
aaccttccatgcagaggctgcatgc

SEQ ID NO: 35132 - DNA, 25 bp, Mus musculus
aaccttccatgctgaggctgcatgc

SEQ ID NO: 35133 - DNA, 25 bp, Mus musculus
aaccttccatgtactacagattctg

SEQ ID NO: 35134 - DNA, 25 bp, Mus musculus
aaccttccatgttctacagattctg

SEQ ID NO: 35135 - DNA, 25 bp, Mus musculus
aaccttcccaatctttcaagttgtg

SEQ ID NO: 35136 - DNA, 25 bp, Mus musculus
aaccttcccaatgtttcaagttgtg

SEQ ID NO: 35137 - DNA, 25 bp, Mus musculus
aaccttcccacaagcagtatgcttg

SEQ ID NO: 35138 - DNA, 25 bp, Mus musculus
aaccttcccacatgcagtatgcttg

SEQ ID NO: 35139 - DNA, 25 bp, Mus musculus
aaccttcctaggcacttagttggag

SEQ ID NO: 35140 - DNA, 25 bp, Mus musculus
aaccttcctagggacttagttggag

SEQ ID NO: 35141 - DNA, 25 bp, Mus musculus
aaccttcctgatcaatctgtttaag

SEQ ID NO: 35142 - DNA, 25 bp, Mus musculus
aaccttcctgatgaatctgtttaag

SEQ ID NO: 35143 - DNA, 25 bp, Mus musculus
aaccttcctgtgagtcttacatgta

SEQ ID NO: 35144 - DNA, 25 bp, Mus musculus
aaccttcctgtgtgtcttacatgta

SEQ ID NO: 35145 - DNA, 25 bp, Mus musculus
aaccttccttctcatttgcctgccc

SEQ ID NO: 35146 - DNA, 25 bp, Mus musculus
aaccttccttctgatttgcctgccc

SEQ ID NO: 35147 - DNA, 25 bp, Mus musculus
aaccttcgacatagccgtggtggac

SEQ ID NO: 35148 - DNA, 25 bp, Mus musculus
aaccttcgacattgccgtggtggac

SEQ ID NO: 35149 - DNA, 25 bp, Mus musculus
aaccttcgatgaagtctggaggctc

SEQ ID NO: 35150 - DNA, 25 bp, Mus musculus
aaccttcgatgatgtctggaggctc

SEQ ID NO: 35151 - DNA, 25 bp, Mus musculus
aaccttctaatgcagctttgtggat

SEQ ID NO: 35152 - DNA, 25 bp, Mus musculus
aaccttctaatggagctttgtggat

SEQ ID NO: 35153 - DNA, 25 bp, Mus musculus
aaccttctagctcagtagtgtgcta

SEQ ID NO: 35154 - DNA, 25 bp, Mus musculus
aaccttctagctgagtagtgtgcta

SEQ ID NO: 35155 - DNA, 25 bp, Mus musculus
aaccttctattaatactagggctgt

SEQ ID NO: 35156 - DNA, 25 bp, Mus musculus
aaccttctattattactagggctgt

SEQ ID NO: 35157 - DNA, 25 bp, Mus musculus
aaccttctattgatctcttatcacc

SEQ ID NO: 35158 - DNA, 25 bp, Mus musculus
aaccttctattgttctcttatcacc

SEQ ID NO: 35159 - DNA, 25 bp, Mus musculus
aaccttctcatacatgccgtgccat

SEQ ID NO: 35160 - DNA, 25 bp, Mus musculus
aaccttctcatagatgccgtgccat

SEQ ID NO: 35161 - DNA, 25 bp, Mus musculus
aaccttctccccattaagtgagtgt

SEQ ID NO: 35162 - DNA, 25 bp, Mus musculus
aaccttctcccctttaagtgagtgt

SEQ ID NO: 35163 - DNA, 25 bp, Mus musculus
aaccttctcggtctttgtctagcta

SEQ ID NO: 35164 - DNA, 25 bp, Mus musculus
aaccttctcggtgtttgtctagcta

SEQ ID NO: 35165 - DNA, 25 bp, Mus musculus
aaccttctctatctgctttagctag

SEQ ID NO: 35166 - DNA, 25 bp, Mus musculus
aaccttctctatgtgctttagctag

SEQ ID NO: 35167 - DNA, 25 bp, Mus musculus
aaccttctctttcgctaagttggtg

SEQ ID NO: 35168 - DNA, 25 bp, Mus musculus
aaccttctctttggctaagttggtg

SEQ ID NO: 35169 - DNA, 25 bp, Mus musculus
aaccttctgcagatctcgttttaga

SEQ ID NO: 35170 - DNA, 25 bp, Mus musculus
aaccttctgcagattggcaggctca

SEQ ID NO: 35171 - DNA, 25 bp, Mus musculus
aaccttctgcagttctcgttttaga

SEQ ID NO: 35172 - DNA, 25 bp, Mus musculus
aaccttctgcagtttggcaggctca

SEQ ID NO: 35173 - DNA, 25 bp, Mus musculus
aaccttctgggtctgacttgtgagt

SEQ ID NO: 35174 - DNA, 25 bp, Mus musculus
aaccttctgggtgtgacttgtgagt

SEQ ID NO: 35175 - DNA, 25 bp, Mus musculus
aaccttcttagtactctgttgcatg

SEQ ID NO: 35176 - DNA, 25 bp, Mus musculus
aaccttcttagttctctgttgcatg

SEQ ID NO: 35177 - DNA, 25 bp, Mus musculus
aaccttcttcttctgcgtggcaatg

SEQ ID NO: 35178 - DNA, 25 bp, Mus musculus
aaccttcttcttgtgcgtggcaatg

SEQ ID NO: 35179 - DNA, 25 bp, Mus musculus
aaccttcttgctcctctggagggag

SEQ ID NO: 35180 - DNA, 25 bp, Mus musculus
aaccttcttgctgctctggagggag

SEQ ID NO: 35181 - DNA, 25 bp, Mus musculus
aaccttcttgttagtaagcatctgg

SEQ ID NO: 35182 - DNA, 25 bp, Mus musculus
aaccttcttgttatagatcagtctg

SEQ ID NO: 35183 - DNA, 25 bp, Mus musculus
aaccttcttgtttgtaagcatctgg

SEQ ID NO: 35184 - DNA, 25 bp, Mus musculus
aaccttcttgttttagatcagtctg

SEQ ID NO: 35185 - DNA, 25 bp, Mus musculus
aaccttgaaaataactagccttgca

SEQ ID NO: 35186 - DNA, 25 bp, Mus musculus
aaccttgaaaattactagccttgca

SEQ ID NO: 35187 - DNA, 25 bp, Mus musculus
aaccttgaatggaacctacctgtga

SEQ ID NO: 35188 - DNA, 25 bp, Mus musculus
aaccttgaatggtacctacctgtga

SEQ ID NO: 35189 - DNA, 25 bp, Mus musculus
aaccttgaatttctcagcccactac

SEQ ID NO: 35190 - DNA, 25 bp, Mus musculus
aaccttgaatttgtcagcccactac

SEQ ID NO: 35191 - DNA, 25 bp, Mus musculus
aaccttgacagtattttcaatgaat

SEQ ID NO: 35192 - DNA, 25 bp, Mus musculus
aaccttgacagttttttcaatgaat

SEQ ID NO: 35193 - DNA, 25 bp, Mus musculus
aaccttgagaaactcctctaggcta

SEQ ID NO: 35194 - DNA, 25 bp, Mus musculus
aaccttgagaaagtcctctaggcta

SEQ ID NO: 35195 - DNA, 25 bp, Mus musculus
aaccttgaggacagactgacctttg

SEQ ID NO: 35196 - DNA, 25 bp, Mus musculus
aaccttgaggactgactgacctttg

SEQ ID NO: 35197 - DNA, 25 bp, Mus musculus
aaccttgagggaaacccatgtgacg

SEQ ID NO: 35198 - DNA, 25 bp, Mus musculus
aaccttgagggatacccatgtgacg

SEQ ID NO: 35199 - DNA, 25 bp, Mus musculus
aaccttgagtagaaccctcgatcca

SEQ ID NO: 35200 - DNA, 25 bp, Mus musculus
aaccttgagtagtaccctcgatcca

SEQ ID NO: 35201 - DNA, 25 bp, Mus musculus
aaccttgcagtcaaaatgccactag

SEQ ID NO: 35202 - DNA, 25 bp, Mus musculus
aaccttgcagtctaaatgccactag

SEQ ID NO: 35203 - DNA, 25 bp, Mus musculus
aaccttgcagttctatgtagaggga

SEQ ID NO: 35204 - DNA, 25 bp, Mus musculus
aaccttgcagttgtatgtagaggga

SEQ ID NO: 35205 - DNA, 25 bp, Mus musculus
aaccttgcataactcctcattctac

SEQ ID NO: 35206 - DNA, 25 bp, Mus musculus
aaccttgcataagtcctcattctac

SEQ ID NO: 35207 - DNA, 25 bp, Mus musculus
aaccttgcatcaatggatcttgaac

SEQ ID NO: 35208 - DNA, 25 bp, Mus musculus
aaccttgcatcattggatcttgaac

SEQ ID NO: 35209 - DNA, 25 bp, Mus musculus
aaccttgcatggaagcctagtgtct

SEQ ID NO: 35210 - DNA, 25 bp, Mus musculus
aaccttgcatggtagcctagtgtct

SEQ ID NO: 35211 - DNA, 25 bp, Mus musculus
aaccttgcattaatctgcagttgca

SEQ ID NO: 35212 - DNA, 25 bp, Mus musculus
aaccttgcattattctgcagttgca

SEQ ID NO: 35213 - DNA, 25 bp, Mus musculus
aaccttgccatccagagtgcctgca

SEQ ID NO: 35214 - DNA, 25 bp, Mus musculus
aaccttgccatcgagagtgcctgca

SEQ ID NO: 35215 - DNA, 25 bp, Mus musculus
aaccttgctaacaggtcttatgcca

SEQ ID NO: 35216 - DNA, 25 bp, Mus musculus
aaccttgctaactggtcttatgcca

SEQ ID NO: 35217 - DNA, 25 bp, Mus musculus
aaccttgctgagacttcctggaaat

SEQ ID NO: 35218 - DNA, 25 bp, Mus musculus
aaccttgctgagtcttcctggaaat

SEQ ID NO: 35219 - DNA, 25 bp, Mus musculus
aaccttgctgcccttctgttagatt

SEQ ID NO: 35220 - DNA, 25 bp, Mus musculus
aaccttgctgccgttctgttagatt

SEQ ID NO: 35221 - DNA, 25 bp, Mus musculus
aaccttgctgtactaaatgtccctc

SEQ ID NO: 35222 - DNA, 25 bp, Mus musculus
aaccttgctgtagtaaatgtccctc

SEQ ID NO: 35223 - DNA, 25 bp, Mus musculus
aaccttgctgtgattctggtacttt

SEQ ID NO: 35224 - DNA, 25 bp, Mus musculus
aaccttgctgtgtttctggtacttt

SEQ ID NO: 35225 - DNA, 25 bp, Mus musculus
aaccttgctgttaatactcgactga

SEQ ID NO: 35226 - DNA, 25 bp, Mus musculus
aaccttgctgtttatactcgactga

SEQ ID NO: 35227 - DNA, 25 bp, Mus musculus
aaccttgcttgacagtgacatgaca

SEQ ID NO: 35228 - DNA, 25 bp, Mus musculus
aaccttgcttgagagtgacatgaca

SEQ ID NO: 35229 - DNA, 25 bp, Mus musculus
aaccttgcttgtatcagcaacgtgg

SEQ ID NO: 35230 - DNA, 25 bp, Mus musculus
aaccttgcttgtttcagcaacgtgg

SEQ ID NO: 35231 - DNA, 25 bp, Mus musculus
aaccttggaagaattcttggtgcat

SEQ ID NO: 35232 - DNA, 25 bp, Mus musculus
aaccttggaagatttcttggtgcat

SEQ ID NO: 35233 - DNA, 25 bp, Mus musculus
aaccttggacaaaggccatgaggaa

SEQ ID NO: 35234 - DNA, 25 bp, Mus musculus
aaccttggacaatggccatgaggaa

SEQ ID NO: 35235 - DNA, 25 bp, Mus musculus
aaccttggcaaaaggagaccgcagt

SEQ ID NO: 35236 - DNA, 25 bp, Mus musculus
aaccttggcaaatggagaccgcagt

SEQ ID NO: 35237 - DNA, 25 bp, Mus musculus
aaccttggcaacacttgttatctga

SEQ ID NO: 35238 - DNA, 25 bp, Mus musculus
aaccttggcaactcttgttatctga

SEQ ID NO: 35239 - DNA, 25 bp, Mus musculus
aaccttggcacaaggatctatttga

SEQ ID NO: 35240 - DNA, 25 bp, Mus musculus
aaccttggcacatggatctatttga

SEQ ID NO: 35241 - DNA, 25 bp, Mus musculus
aaccttggcatgactctgccatggt

SEQ ID NO: 35242 - DNA, 25 bp, Mus musculus
aaccttggcatgtctctgccatggt

SEQ ID NO: 35243 - DNA, 25 bp, Mus musculus
aaccttggccagctggctattcagc

SEQ ID NO: 35244 - DNA, 25 bp, Mus musculus
aaccttggccaggtggctattcagc

SEQ ID NO: 35245 - DNA, 25 bp, Mus musculus
aaccttggcgatacaattcgcgtga

SEQ ID NO: 35246 - DNA, 25 bp, Mus musculus
aaccttggcgattcaattcgcgtga

SEQ ID NO: 35247 - DNA, 25 bp, Mus musculus
aaccttggctacatgcagtttatgt

SEQ ID NO: 35248 - DNA, 25 bp, Mus musculus
aaccttggctacttgcagtttatgt

SEQ ID NO: 35249 - DNA, 25 bp, Mus musculus
aaccttgggaccaatacatacactg

SEQ ID NO: 35250 - DNA, 25 bp, Mus musculus
aaccttgggacctatacatacactg

SEQ ID NO: 35251 - DNA, 25 bp, Mus musculus
aaccttgggctgcacctaagtctat

SEQ ID NO: 35252 - DNA, 25 bp, Mus musculus
aaccttgggctggacctaagtctat

SEQ ID NO: 35253 - DNA, 25 bp, Mus musculus
aaccttggtatgcagtgtggctgac

SEQ ID NO: 35254 - DNA, 25 bp, Mus musculus
aaccttggtatggagtgtggctgac

SEQ ID NO: 35255 - DNA, 25 bp, Mus musculus
aaccttggtggtctgaaataattga

SEQ ID NO: 35256 - DNA, 25 bp, Mus musculus
aaccttggtggtgtgaaataattga

SEQ ID NO: 35257 - DNA, 25 bp, Mus musculus
aaccttggttatactgaacttggat

SEQ ID NO: 35258 - DNA, 25 bp, Mus musculus
aaccttggttattctgaacttggat

SEQ ID NO: 35259 - DNA, 25 bp, Mus musculus
aaccttgtaaggctgctttgtacag

SEQ ID NO: 35260 - DNA, 25 bp, Mus musculus
aaccttgtaagggtgctttgtacag

SEQ ID NO: 35261 - DNA, 25 bp, Mus musculus
aaccttgtaatcctaatcttgcttc

SEQ ID NO: 35262 - DNA, 25 bp, Mus musculus
aaccttgtaatcgtaatcttgcttc

SEQ ID NO: 35263 - DNA, 25 bp, Mus musculus
aaccttgtacgtactgtgtcttaag

SEQ ID NO: 35264 - DNA, 25 bp, Mus musculus
aaccttgtacgttctgtgtcttaag

SEQ ID NO: 35265 - DNA, 25 bp, Mus musculus
aaccttgtagctactgcaattccat

SEQ ID NO: 35266 - DNA, 25 bp, Mus musculus
aaccttgtagcttctgcaattccat

SEQ ID NO: 35267 - DNA, 25 bp, Mus musculus
aaccttgtagttatggattttgaca

SEQ ID NO: 35268 - DNA, 25 bp, Mus musculus
aaccttgtagttttggattttgaca

SEQ ID NO: 35269 - DNA, 25 bp, Mus musculus
aaccttgtataaccaccacactggg

SEQ ID NO: 35270 - DNA, 25 bp, Mus musculus
aaccttgtataagcaccacactggg

SEQ ID NO: 35271 - DNA, 25 bp, Mus musculus
aaccttgtcatgaccagacttctac

SEQ ID NO: 35272 - DNA, 25 bp, Mus musculus
aaccttgtcatgtccagacttctac

SEQ ID NO: 35273 - DNA, 25 bp, Mus musculus
aaccttgtgactagttgtggtttga

SEQ ID NO: 35274 - DNA, 25 bp, Mus musculus
aaccttgtgacttgttgtggtttga

SEQ ID NO: 35275 - DNA, 25 bp, Mus musculus
aaccttgtggagctgatctacctag

SEQ ID NO: 35276 - DNA, 25 bp, Mus musculus
aaccttgtggaggtgatctacctag

SEQ ID NO: 35277 - DNA, 25 bp, Mus musculus
aaccttgttactacctgacggcagg

SEQ ID NO: 35278 - DNA, 25 bp, Mus musculus
aaccttgttacttcctgacggcagg

SEQ ID NO: 35279 - DNA, 25 bp, Mus musculus
aaccttgttcagagactgtagccag

SEQ ID NO: 35280 - DNA, 25 bp, Mus musculus
aaccttgttcagtgactgtagccag

SEQ ID NO: 35281 - DNA, 25 bp, Mus musculus
aaccttgttgagacgatcagatgct

SEQ ID NO: 35282 - DNA, 25 bp, Mus musculus
aaccttgttgagtcgatcagatgct

SEQ ID NO: 35283 - DNA, 25 bp, Mus musculus
aaccttgttgccatttataagcagg

SEQ ID NO: 35284 - DNA, 25 bp, Mus musculus
aaccttgttgccttttataagcagg

SEQ ID NO: 35285 - DNA, 25 bp, Mus musculus
aaccttgtttagagtaatgcttgta

SEQ ID NO: 35286 - DNA, 25 bp, Mus musculus
aaccttgtttagtgtaatgcttgta

SEQ ID NO: 35287 - DNA, 25 bp, Mus musculus
aaccttgtttcacataacctctcaa

SEQ ID NO: 35288 - DNA, 25 bp, Mus musculus
aaccttgtttcagataacctctcaa

SEQ ID NO: 35289 - DNA, 25 bp, Mus musculus
aaccttgtttgcactgagacctgtc

SEQ ID NO: 35290 - DNA, 25 bp, Mus musculus
aaccttgtttgctctgagacctgtc

SEQ ID NO: 35291 - DNA, 25 bp, Mus musculus
aaccttgttttgagattgggctctc

SEQ ID NO: 35292 - DNA, 25 bp, Mus musculus
aaccttgttttgtgattgggctctc

SEQ ID NO: 35293 - DNA, 25 bp, Mus musculus
aacctttaaggtagacatgggctca

SEQ ID NO: 35294 - DNA, 25 bp, Mus musculus
aacctttaaggttgacatgggctca

SEQ ID NO: 35295 - DNA, 25 bp, Mus musculus
aacctttaatccacatgagcagtta

SEQ ID NO: 35296 - DNA, 25 bp, Mus musculus
aacctttaatcctcatgagcagtta

SEQ ID NO: 35297 - DNA, 25 bp, Mus musculus
aacctttaccatcaacattgctctg

SEQ ID NO: 35298 - DNA, 25 bp, Mus musculus
aacctttaccatgaacattgctctg

SEQ ID NO: 35299 - DNA, 25 bp, Mus musculus
aacctttacccaacttggctgacat

SEQ ID NO: 35300 - DNA, 25 bp, Mus musculus
aacctttacccatcttggctgacat

SEQ ID NO: 35301 - DNA, 25 bp, Mus musculus
aacctttaccgacaattgcttcagc

SEQ ID NO: 35302 - DNA, 25 bp, Mus musculus
aacctttaccgagaattgcttcagc

SEQ ID NO: 35303 - DNA, 25 bp, Mus musculus
aacctttatgttcagccagagcctc

SEQ ID NO: 35304 - DNA, 25 bp, Mus musculus
aacctttatgttctggataggcaca

SEQ ID NO: 35305 - DNA, 25 bp, Mus musculus
aacctttatgttgagccagagcctc

SEQ ID NO: 35306 - DNA, 25 bp, Mus musculus
aacctttatgttgtggataggcaca

SEQ ID NO: 35307 - DNA, 25 bp, Mus musculus
aacctttattaactgactggctgag

SEQ ID NO: 35308 - DNA, 25 bp, Mus musculus
aacctttattaagtgactggctgag

SEQ ID NO: 35309 - DNA, 25 bp, Mus musculus
aacctttcacgtcatcagtgtggca

SEQ ID NO: 35310 - DNA, 25 bp, Mus musculus
aacctttcacgtgatcagtgtggca

SEQ ID NO: 35311 - DNA, 25 bp, Mus musculus
aacctttcactgacggagggcttct

SEQ ID NO: 35312 - DNA, 25 bp, Mus musculus
aacctttcactgtcggagggcttct

SEQ ID NO: 35313 - DNA, 25 bp, Mus musculus
aacctttcaggccaattggcagaaa

SEQ ID NO: 35314 - DNA, 25 bp, Mus musculus
aacctttcaggcgaattggcagaaa

SEQ ID NO: 35315 - DNA, 25 bp, Mus musculus
aacctttcagttccattgtcaacct

SEQ ID NO: 35316 - DNA, 25 bp, Mus musculus
aacctttcagttgcattgtcaacct

SEQ ID NO: 35317 - DNA, 25 bp, Mus musculus
aacctttcatgtcagttatactaac

SEQ ID NO: 35318 - DNA, 25 bp, Mus musculus
aacctttcatgtgagttatactaac

SEQ ID NO: 35319 - DNA, 25 bp, Mus musculus
aacctttccaacagcatatacaatg

SEQ ID NO: 35320 - DNA, 25 bp, Mus musculus
aacctttccaactgcatatacaatg

SEQ ID NO: 35321 - DNA, 25 bp, Mus musculus
aacctttccctaccataaacatgct

SEQ ID NO: 35322 - DNA, 25 bp, Mus musculus
aacctttccctagcataaacatgct

SEQ ID NO: 35323 - DNA, 25 bp, Mus musculus
aacctttcccttccctgaatgagat

SEQ ID NO: 35324 - DNA, 25 bp, Mus musculus
aacctttcccttgcctgaatgagat

SEQ ID NO: 35325 - DNA, 25 bp, Mus musculus
aacctttcgaaacctaatatcccag

SEQ ID NO: 35326 - DNA, 25 bp, Mus musculus
aacctttcgaaagctaatatcccag

SEQ ID NO: 35327 - DNA, 25 bp, Mus musculus
aacctttctatgctagcaacctaat

SEQ ID NO: 35328 - DNA, 25 bp, Mus musculus
aacctttctatggtagcaacctaat

SEQ ID NO: 35329 - DNA, 25 bp, Mus musculus
aacctttctgaaagtaccccagtgg

SEQ ID NO: 35330 - DNA, 25 bp, Mus musculus
aacctttctgaatgtaccccagtgg

SEQ ID NO: 35331 - DNA, 25 bp, Mus musculus
aacctttctgggatgtgctgaccca

SEQ ID NO: 35332 - DNA, 25 bp, Mus musculus
aacctttctgggttgtgctgaccca

SEQ ID NO: 35333 - DNA, 25 bp, Mus musculus
aacctttcttttcggcgtgacgctg

SEQ ID NO: 35334 - DNA, 25 bp, Mus musculus
aacctttcttttgggcgtgacgctg

SEQ ID NO: 35335 - DNA, 25 bp, Mus musculus
aacctttgaataaagtcttttgcat

SEQ ID NO: 35336 - DNA, 25 bp, Mus musculus
aacctttgaatatagtcttttgcat

SEQ ID NO: 35337 - DNA, 25 bp, Mus musculus
aacctttgacttcactattgagact

SEQ ID NO: 35338 - DNA, 25 bp, Mus musculus
aacctttgacttgactattgagact

SEQ ID NO: 35339 - DNA, 25 bp, Mus musculus
aacctttgctgaatagctgcaccta

SEQ ID NO: 35340 - DNA, 25 bp, Mus musculus
aacctttgctgattagctgcaccta

SEQ ID NO: 35341 - DNA, 25 bp, Mus musculus
aacctttgctgtcaactccaatgaa

SEQ ID NO: 35342 - DNA, 25 bp, Mus musculus
aacctttgctgtgaactccaatgaa

SEQ ID NO: 35343 - DNA, 25 bp, Mus musculus
aacctttggccacgtgagtacccat

SEQ ID NO: 35344 - DNA, 25 bp, Mus musculus
aacctttggccaggtgagtacccat

SEQ ID NO: 35345 - DNA, 25 bp, Mus musculus
aacctttggtgtcaatctcttcctt

SEQ ID NO: 35346 - DNA, 25 bp, Mus musculus
aacctttggtgtgaatctcttcctt

SEQ ID NO: 35347 - DNA, 25 bp, Mus musculus
aacctttgtcacagattcttcagcc

SEQ ID NO: 35348 - DNA, 25 bp, Mus musculus
aacctttgtcactgattcttcagcc

SEQ ID NO: 35349 - DNA, 25 bp, Mus musculus
aacctttgtcttcctcatacattga

SEQ ID NO: 35350 - DNA, 25 bp, Mus musculus
aacctttgtcttgctcatacattga

SEQ ID NO: 35351 - DNA, 25 bp, Mus musculus
aacctttgtgacatggtattataca

SEQ ID NO: 35352 - DNA, 25 bp, Mus musculus
aacctttgtgacttggtattataca

SEQ ID NO: 35353 - DNA, 25 bp, Mus musculus
aacctttgttgtaatccactggctg

SEQ ID NO: 35354 - DNA, 25 bp, Mus musculus
aacctttgttgtacccagtttgcat

SEQ ID NO: 35355 - DNA, 25 bp, Mus musculus
aacctttgttgttatccactggctg

SEQ ID NO: 35356 - DNA, 25 bp, Mus musculus
aacctttgttgttcccagtttgcat

SEQ ID NO: 35357 - DNA, 25 bp, Mus musculus
aaccttttaatcacatgtctcactg

SEQ ID NO: 35358 - DNA, 25 bp, Mus musculus
aaccttttaatctcatgtctcactg

SEQ ID NO: 35359 - DNA, 25 bp, Mus musculus
aaccttttataactgctctcttaag

SEQ ID NO: 35360 - DNA, 25 bp, Mus musculus
aaccttttataagtgctctcttaag

SEQ ID NO: 35361 - DNA, 25 bp, Mus musculus
aaccttttcataagagatgagttgt

SEQ ID NO: 35362 - DNA, 25 bp, Mus musculus
aaccttttcatatgagatgagttgt

SEQ ID NO: 35363 - DNA, 25 bp, Mus musculus
aaccttttctctcatttgctgcttt

SEQ ID NO: 35364 - DNA, 25 bp, Mus musculus
aaccttttctctgatttgctgcttt

SEQ ID NO: 35365 - DNA, 25 bp, Mus musculus
aaccttttgataatcatgatctcta

SEQ ID NO: 35366 - DNA, 25 bp, Mus musculus
aaccttttgatattcatgatctcta

SEQ ID NO: 35367 - DNA, 25 bp, Mus musculus
aaccttttgccccatgacagtgatc

SEQ ID NO: 35368 - DNA, 25 bp, Mus musculus
aaccttttgcccgatgacagtgatc

SEQ ID NO: 35369 - DNA, 25 bp, Mus musculus
aacctttttatcacagtgctggcaa

SEQ ID NO: 35370 - DNA, 25 bp, Mus musculus
aacctttttatctcagtgctggcaa

SEQ ID NO: 35371 - DNA, 25 bp, Mus musculus
aacgaaaacgctcgttagcaccgca

SEQ ID NO: 35372 - DNA, 25 bp, Mus musculus
aacgaaaacgctggttagcaccgca

SEQ ID NO: 35373 - DNA, 25 bp, Mus musculus
aacgaaaagcttcacaaccctcctg

SEQ ID NO: 35374 - DNA, 25 bp, Mus musculus
aacgaaaagcttgacaaccctcctg

SEQ ID NO: 35375 - DNA, 25 bp, Mus musculus
aacgaaacactacagcagtccaaca

SEQ ID NO: 35376 - DNA, 25 bp, Mus musculus
aacgaaacactagagcagtccaaca

SEQ ID NO: 35377 - DNA, 25 bp, Mus musculus
aacgaaactaccacggctagcattt

SEQ ID NO: 35378 - DNA, 25 bp, Mus musculus
aacgaaactacctcggctagcattt

SEQ ID NO: 35379 - DNA, 25 bp, Mus musculus
aacgaaagctacaagaaggcaccta

SEQ ID NO: 35380 - DNA, 25 bp, Mus musculus
aacgaaagctactagaaggcaccta

SEQ ID NO: 35381 - DNA, 25 bp, Mus musculus
aacgaaatcaaaacaatgcgcaaaa

SEQ ID NO: 35382 - DNA, 25 bp, Mus musculus
aacgaaatcaaatcaatgcgcaaaa

SEQ ID NO: 35383 - DNA, 25 bp, Mus musculus
aacgaaatctgtcaagtccctgaac

SEQ ID NO: 35384 - DNA, 25 bp, Mus musculus
aacgaaatctgtgaagtccctgaac

SEQ ID NO: 35385 - DNA, 25 bp, Mus musculus
aacgaacaagagaagctgagggaat

SEQ ID NO: 35386 - DNA, 25 bp, Mus musculus
aacgaacaagagtagctgagggaat

SEQ ID NO: 35387 - DNA, 25 bp, Mus musculus
aacgaacttttgaacagaattgtga

SEQ ID NO: 35388 - DNA, 25 bp, Mus musculus
aacgaacttttgtacagaattgtga

SEQ ID NO: 35389 - DNA, 25 bp, Mus musculus
aacgaagacctgatgtgctcatgca

SEQ ID NO: 35390 - DNA, 25 bp, Mus musculus
aacgaagacctgttgtgctcatgca

SEQ ID NO: 35391 - DNA, 25 bp, Mus musculus
aacgaagagtagcatctcccctggc

SEQ ID NO: 35392 - DNA, 25 bp, Mus musculus
aacgaagagtaggatctcccctggc

SEQ ID NO: 35393 - DNA, 25 bp, Mus musculus
aacgaagatgaaccctccactgacc

SEQ ID NO: 35394 - DNA, 25 bp, Mus musculus
aacgaagatgaagcctccactgacc

SEQ ID NO: 35395 - DNA, 25 bp, Mus musculus
aacgaagccaagatcctgacctttg

SEQ ID NO: 35396 - DNA, 25 bp, Mus musculus
aacgaagccaagttcctgacctttg

SEQ ID NO: 35397 - DNA, 25 bp, Mus musculus
aacgaagccactcttttgacatggg

SEQ ID NO: 35398 - DNA, 25 bp, Mus musculus
aacgaagccactgttttgacatggg

SEQ ID NO: 35399 - DNA, 25 bp, Mus musculus
aacgaagcgtgcatttgtccttatc

SEQ ID NO: 35400 - DNA, 25 bp, Mus musculus
aacgaagcgtgcttttgtccttatc

SEQ ID NO: 35401 - DNA, 25 bp, Mus musculus
aacgaagctgccatgtctcttcaag

SEQ ID NO: 35402 - DNA, 25 bp, Mus musculus
aacgaagctgccttgtctcttcaag

SEQ ID NO: 35403 - DNA, 25 bp, Mus musculus
aacgaagctgcgctgaacacggtgc

SEQ ID NO: 35404 - DNA, 25 bp, Mus musculus
aacgaagctgcggtgaacacggtgc

SEQ ID NO: 35405 - DNA, 25 bp, Mus musculus
aacgaaggagccacaatccactatc

SEQ ID NO: 35406 - DNA, 25 bp, Mus musculus
aacgaaggagcctcaatccactatc

SEQ ID NO: 35407 - DNA, 25 bp, Mus musculus
aacgaaggcctaagtatgtgcttgc

SEQ ID NO: 35408 - DNA, 25 bp, Mus musculus
aacgaaggcctatgtatgtgcttgc

SEQ ID NO: 35409 - DNA, 25 bp, Mus musculus
aacgaaggcgtcatcatcatgggca

SEQ ID NO: 35410 - DNA, 25 bp, Mus musculus
aacgaaggcgtcttcatcatgggca

SEQ ID NO: 35411 - DNA, 25 bp, Mus musculus
aacgaaggtccgacactgtgttctc

SEQ ID NO: 35412 - DNA, 25 bp, Mus musculus
aacgaaggtccgtcactgtgttctc

SEQ ID NO: 35413 - DNA, 25 bp, Mus musculus
aacgaaggtgtactatatggctggt

SEQ ID NO: 35414 - DNA, 25 bp, Mus musculus
aacgaaggtgtagtatatggctggt

SEQ ID NO: 35415 - DNA, 25 bp, Mus musculus
aacgaagtgctacaaaccaacctct

SEQ ID NO: 35416 - DNA, 25 bp, Mus musculus
aacgaagtgctagaaaccaacctct

SEQ ID NO: 35417 - DNA, 25 bp, Mus musculus
aacgaagtggtcaagttctctgcct

SEQ ID NO: 35418 - DNA, 25 bp, Mus musculus
aacgaagtggtctagttctctgcct

SEQ ID NO: 35419 - DNA, 25 bp, Mus musculus
aacgaagtgtctccagctaggctct

SEQ ID NO: 35420 - DNA, 25 bp, Mus musculus
aacgaagtgtctgcagctaggctct

SEQ ID NO: 35421 - DNA, 25 bp, Mus musculus
aacgaatgactcctttgcttctaca

SEQ ID NO: 35422 - DNA, 25 bp, Mus musculus
aacgaatgactcgtttgcttctaca

SEQ ID NO: 35423 - DNA, 25 bp, Mus musculus
aacgaatgctctcagggttgggaat

SEQ ID NO: 35424 - DNA, 25 bp, Mus musculus
aacgaatgctctgagggttgggaat

SEQ ID NO: 35425 - DNA, 25 bp, Mus musculus
aacgaatgtacccttgtgcatgctg

SEQ ID NO: 35426 - DNA, 25 bp, Mus musculus
aacgaatgtaccgttgtgcatgctg

SEQ ID NO: 35427 - DNA, 25 bp, Mus musculus
aacgaatgtggtagggcaaatcccg

SEQ ID NO: 35428 - DNA, 25 bp, Mus musculus
aacgaatgtggttgggcaaatcccg

SEQ ID NO: 35429 - DNA, 25 bp, Mus musculus
aacgaattctggattggcaaccccg

SEQ ID NO: 35430 - DNA, 25 bp, Mus musculus
aacgaattctggtttggcaaccccg

SEQ ID NO: 35431 - DNA, 25 bp, Mus musculus
aacgaatttaccatattgagtgctt

SEQ ID NO: 35432 - DNA, 25 bp, Mus musculus
aacgaatttaccttattgagtgctt

SEQ ID NO: 35433 - DNA, 25 bp, Mus musculus
aacgacaactgtacaccaagcttat

SEQ ID NO: 35434 - DNA, 25 bp, Mus musculus
aacgacaactgttcaccaagcttat

SEQ ID NO: 35435 - DNA, 25 bp, Mus musculus
aacgacaatgcccatttgcctcttt

SEQ ID NO: 35436 - DNA, 25 bp, Mus musculus
aacgacaatgccgatttgcctcttt

SEQ ID NO: 35437 - DNA, 25 bp, Mus musculus
aacgacaattatactccgagcatga

SEQ ID NO: 35438 - DNA, 25 bp, Mus musculus
aacgacaattattctccgagcatga

SEQ ID NO: 35439 - DNA, 25 bp, Mus musculus
aacgacacaatacagcttcgggagt

SEQ ID NO: 35440 - DNA, 25 bp, Mus musculus
aacgacacaatagagcttcgggagt

SEQ ID NO: 35441 - DNA, 25 bp, Mus musculus
aacgacaccagtcgtttgttacaat

SEQ ID NO: 35442 - DNA, 25 bp, Mus musculus
aacgacaccagtggtttgttacaat

SEQ ID NO: 35443 - DNA, 25 bp, Mus musculus
aacgacacccaactgcagatcatct

SEQ ID NO: 35444 - DNA, 25 bp, Mus musculus
aacgacacccaagtgcagatcatct

SEQ ID NO: 35445 - DNA, 25 bp, Mus musculus
aacgacacgaagcatcactgccggg

SEQ ID NO: 35446 - DNA, 25 bp, Mus musculus
aacgacacgaaggatcactgccggg

SEQ ID NO: 35447 - DNA, 25 bp, Mus musculus
aacgacagatgcagagctcgctgct

SEQ ID NO: 35448 - DNA, 25 bp, Mus musculus
aacgacagatgctgagctcgctgct

SEQ ID NO: 35449 - DNA, 25 bp, Mus musculus
aacgacagcatcactatgacacaag

SEQ ID NO: 35450 - DNA, 25 bp, Mus musculus
aacgacagcatctctatgacacaag

SEQ ID NO: 35451 - DNA, 25 bp, Mus musculus
aacgacagtttcacctctgctcaaa

SEQ ID NO: 35452 - DNA, 25 bp, Mus musculus
aacgacagtttctcctctgctcaaa

SEQ ID NO: 35453 - DNA, 25 bp, Mus musculus
aacgacataattcttgcttaggctt

SEQ ID NO: 35454 - DNA, 25 bp, Mus musculus
aacgacataattgttgcttaggctt

SEQ ID NO: 35455 - DNA, 25 bp, Mus musculus
aacgacatcaccaacgaccaatata

SEQ ID NO: 35456 - DNA, 25 bp, Mus musculus
aacgacatcacctacgaccaatata

SEQ ID NO: 35457 - DNA, 25 bp, Mus musculus
aacgacatctttagagctggcctca

SEQ ID NO: 35458 - DNA, 25 bp, Mus musculus
aacgacatcttttgagctggcctca

SEQ ID NO: 35459 - DNA, 25 bp, Mus musculus
aacgacatgaaccattatgctctct

SEQ ID NO: 35460 - DNA, 25 bp, Mus musculus
aacgacatgaacgattatgctctct

SEQ ID NO: 35461 - DNA, 25 bp, Mus musculus
aacgacattatgatgctcaagctct

SEQ ID NO: 35462 - DNA, 25 bp, Mus musculus
aacgacattatgttgctcaagctct

SEQ ID NO: 35463 - DNA, 25 bp, Mus musculus
aacgaccaagttaccgagatctaga

SEQ ID NO: 35464 - DNA, 25 bp, Mus musculus
aacgaccaagtttccgagatctaga

SEQ ID NO: 35465 - DNA, 25 bp, Mus musculus
aacgaccagtgtcgtgctgcattct

SEQ ID NO: 35466 - DNA, 25 bp, Mus musculus
aacgaccagtgtggtgctgcattct

SEQ ID NO: 35467 - DNA, 25 bp, Mus musculus
aacgaccatcgactttgttacccag

SEQ ID NO: 35468 - DNA, 25 bp, Mus musculus
aacgaccatcgagtttgttacccag

SEQ ID NO: 35469 - DNA, 25 bp, Mus musculus
aacgaccatttgaaagccagcgctt

SEQ ID NO: 35470 - DNA, 25 bp, Mus musculus
aacgaccatttgtaagccagcgctt

SEQ ID NO: 35471 - DNA, 25 bp, Mus musculus
aacgacctaagcatattcagccatt

SEQ ID NO: 35472 - DNA, 25 bp, Mus musculus
aacgacctaagcttattcagccatt

SEQ ID NO: 35473 - DNA, 25 bp, Mus musculus
aacgacctattacctgggctgcaga

SEQ ID NO: 35474 - DNA, 25 bp, Mus musculus
aacgacctattagctgggctgcaga

SEQ ID NO: 35475 - DNA, 25 bp, Mus musculus
aacgacctcggccacaaagataaca

SEQ ID NO: 35476 - DNA, 25 bp, Mus musculus
aacgacctcggcgacaaagataaca

SEQ ID NO: 35477 - DNA, 25 bp, Mus musculus
aacgacctctgcatcgcggtgcagt

SEQ ID NO: 35478 - DNA, 25 bp, Mus musculus
aacgacctctgcttcgcggtgcagt

SEQ ID NO: 35479 - DNA, 25 bp, Mus musculus
aacgacctctggatgcacatgtgtg

SEQ ID NO: 35480 - DNA, 25 bp, Mus musculus
aacgacctctggttgcacatgtgtg

SEQ ID NO: 35481 - DNA, 25 bp, Mus musculus
aacgacctgcacatatgtcgcgagt

SEQ ID NO: 35482 - DNA, 25 bp, Mus musculus
aacgacctgcacttatgtcgcgagt

SEQ ID NO: 35483 - DNA, 25 bp, Mus musculus
aacgacctggttagttatgctgaaa

SEQ ID NO: 35484 - DNA, 25 bp, Mus musculus
aacgacctggtttgttatgctgaaa

SEQ ID NO: 35485 - DNA, 25 bp, Mus musculus
aacgaccttccgcaaacagctgtga

SEQ ID NO: 35486 - DNA, 25 bp, Mus musculus
aacgaccttccggaaacagctgtga

SEQ ID NO: 35487 - DNA, 25 bp, Mus musculus
aacgaccttgatcaagacctggagc

SEQ ID NO: 35488 - DNA, 25 bp, Mus musculus
aacgaccttgatgaagacctggagc

SEQ ID NO: 35489 - DNA, 25 bp, Mus musculus
aacgacgaagttcgctatccccgct

SEQ ID NO: 35490 - DNA, 25 bp, Mus musculus
aacgacgaagttggctatccccgct

SEQ ID NO: 35491 - DNA, 25 bp, Mus musculus
aacgacgacttcagctggcagcagt

SEQ ID NO: 35492 - DNA, 25 bp, Mus musculus
aacgacgacttctgctggcagcagt

SEQ ID NO: 35493 - DNA, 25 bp, Mus musculus
aacgacgagaccattgccaaagcca

SEQ ID NO: 35494 - DNA, 25 bp, Mus musculus
aacgacgagacctttgccaaagcca

SEQ ID NO: 35495 - DNA, 25 bp, Mus musculus
aacgacgagtggagtcagtaccatt

SEQ ID NO: 35496 - DNA, 25 bp, Mus musculus
aacgacgagtggtgtcagtaccatt

SEQ ID NO: 35497 - DNA, 25 bp, Mus musculus
aacgacgatgatcctttcttccggg

SEQ ID NO: 35498 - DNA, 25 bp, Mus musculus
aacgacgatgatgctttcttccggg

SEQ ID NO: 35499 - DNA, 25 bp, Mus musculus
aacgacgccattctggtggagcagt

SEQ ID NO: 35500 - DNA, 25 bp, Mus musculus
aacgacgccattgtggtggagcagt

SEQ ID NO: 35501 - DNA, 25 bp, Mus musculus
aacgacgctcagaagatgctgtaca

SEQ ID NO: 35502 - DNA, 25 bp, Mus musculus
aacgacgctcagtagatgctgtaca

SEQ ID NO: 35503 - DNA, 25 bp, Mus musculus
aacgacgctttcagcctcaggagac

SEQ ID NO: 35504 - DNA, 25 bp, Mus musculus
aacgacgctttctgcctcaggagac

SEQ ID NO: 35505 - DNA, 25 bp, Mus musculus
aacgacggcgtcaatgaatgagttt

SEQ ID NO: 35506 - DNA, 25 bp, Mus musculus
aacgacggcgtctatgaatgagttt

SEQ ID NO: 35507 - DNA, 25 bp, Mus musculus
aacgacgtccgccaggttgttgaag

SEQ ID NO: 35508 - DNA, 25 bp, Mus musculus
aacgacgtccgcgaggttgttgaag

SEQ ID NO: 35509 - DNA, 25 bp, Mus musculus
aacgactacttgcttgttagcactg

SEQ ID NO: 35510 - DNA, 25 bp, Mus musculus
aacgactacttggttgttagcactg

SEQ ID NO: 35511 - DNA, 25 bp, Mus musculus
aacgactatattctctttcggaagg

SEQ ID NO: 35512 - DNA, 25 bp, Mus musculus
aacgactatattgtctttcggaagg

SEQ ID NO: 35513 - DNA, 25 bp, Mus musculus
aacgactcatacactttcttttgcc

SEQ ID NO: 35514 - DNA, 25 bp, Mus musculus
aacgactcatactctttcttttgcc

SEQ ID NO: 35515 - DNA, 25 bp, Mus musculus
aacgactccatccaagcacagaaga

SEQ ID NO: 35516 - DNA, 25 bp, Mus musculus
aacgactccatcgaagcacagaaga

SEQ ID NO: 35517 - DNA, 25 bp, Mus musculus
aacgactccgttctggacatggcaa

SEQ ID NO: 35518 - DNA, 25 bp, Mus musculus
aacgactccgttgtggacatggcaa

SEQ ID NO: 35519 - DNA, 25 bp, Mus musculus
aacgactcgggcactgttgtcatca

SEQ ID NO: 35520 - DNA, 25 bp, Mus musculus
aacgactcgggctctgttgtcatca

SEQ ID NO: 35521 - DNA, 25 bp, Mus musculus
aacgactggcgaccatcagagtgcg

SEQ ID NO: 35522 - DNA, 25 bp, Mus musculus
aacgactggcgagcatcagagtgcg

SEQ ID NO: 35523 - DNA, 25 bp, Mus musculus
aacgactggcttcgccactgctgaa

SEQ ID NO: 35524 - DNA, 25 bp, Mus musculus
aacgactggcttggccactgctgaa

SEQ ID NO: 35525 - DNA, 25 bp, Mus musculus
aacgactgtgatacagcagctctgt

SEQ ID NO: 35526 - DNA, 25 bp, Mus musculus
aacgactgtgattcagcagctctgt

SEQ ID NO: 35527 - DNA, 25 bp, Mus musculus
aacgacttaagtcagcctgggctac

SEQ ID NO: 35528 - DNA, 25 bp, Mus musculus
aacgacttaagtgagcctgggctac

SEQ ID NO: 35529 - DNA, 25 bp, Mus musculus
aacgacttgctacgtcagtgggcag

SEQ ID NO: 35530 - DNA, 25 bp, Mus musculus
aacgacttgctaggtcagtgggcag

SEQ ID NO: 35531 - DNA, 25 bp, Mus musculus
aacgagaaccgaccatgcagtggca

SEQ ID NO: 35532 - DNA, 25 bp, Mus musculus
aacgagaaccgagcatgcagtggca

SEQ ID NO: 35533 - DNA, 25 bp, Mus musculus
aacgagaactgaaaggagcaccaat

SEQ ID NO: 35534 - DNA, 25 bp, Mus musculus
aacgagaactgataggagcaccaat

SEQ ID NO: 35535 - DNA, 25 bp, Mus musculus
aacgagaaggccatggtgaccgaga

SEQ ID NO: 35536 - DNA, 25 bp, Mus musculus
aacgagaaggccttggtgaccgaga

SEQ ID NO: 35537 - DNA, 25 bp, Mus musculus
aacgagaattacagacacttgtgag

SEQ ID NO: 35538 - DNA, 25 bp, Mus musculus
aacgagaattactgacacttgtgag

SEQ ID NO: 35539 - DNA, 25 bp, Mus musculus
aacgagacaaatccagccttgacaa

SEQ ID NO: 35540 - DNA, 25 bp, Mus musculus
aacgagacaaatgcagccttgacaa

SEQ ID NO: 35541 - DNA, 25 bp, Mus musculus
aacgagacaggacacagtgtgttgt

SEQ ID NO: 35542 - DNA, 25 bp, Mus musculus
aacgagacaggagacagtgtgttgt

SEQ ID NO: 35543 - DNA, 25 bp, Mus musculus
aacgagacgcgaagtgttctccacc

SEQ ID NO: 35544 - DNA, 25 bp, Mus musculus
aacgagacgcgatgtgttctccacc

SEQ ID NO: 35545 - DNA, 25 bp, Mus musculus
aacgagagcaaaccccgcgtgcggt

SEQ ID NO: 35546 - DNA, 25 bp, Mus musculus
aacgagagcaaagcccgcgtgcggt

SEQ ID NO: 35547 - DNA, 25 bp, Mus musculus
aacgagaggaacctcgcacaccagg

SEQ ID NO: 35548 - DNA, 25 bp, Mus musculus
aacgagaggaacgtcgcacaccagg

SEQ ID NO: 35549 - DNA, 25 bp, Mus musculus
aacgagaggctgctcagcgctgcac

SEQ ID NO: 35550 - DNA, 25 bp, Mus musculus
aacgagaggctggtcagcgctgcac

SEQ ID NO: 35551 - DNA, 25 bp, Mus musculus
aacgagatactcaatatgtggcaag

SEQ ID NO: 35552 - DNA, 25 bp, Mus musculus
aacgagatactctatatgtggcaag

SEQ ID NO: 35553 - DNA, 25 bp, Mus musculus
aacgagatagtcagtttgtttcctg

SEQ ID NO: 35554 - DNA, 25 bp, Mus musculus
aacgagatagtctgtttgtttcctg

SEQ ID NO: 35555 - DNA, 25 bp, Mus musculus
aacgagatcaagatgccagcatttg

SEQ ID NO: 35556 - DNA, 25 bp, Mus musculus
aacgagatcaagttgccagcatttg

SEQ ID NO: 35557 - DNA, 25 bp, Mus musculus
aacgagatccaccacaagaccgaga

SEQ ID NO: 35558 - DNA, 25 bp, Mus musculus
aacgagatccacgacaagaccgaga

SEQ ID NO: 35559 - DNA, 25 bp, Mus musculus
aacgagatccatccgacagtagctt

SEQ ID NO: 35560 - DNA, 25 bp, Mus musculus
aacgagatccatgcgacagtagctt

SEQ ID NO: 35561 - DNA, 25 bp, Mus musculus
aacgagatggatactgctcagctct

SEQ ID NO: 35562 - DNA, 25 bp, Mus musculus
aacgagatggattctgctcagctct

SEQ ID NO: 35563 - DNA, 25 bp, Mus musculus
aacgagattagcaattcccagagaa

SEQ ID NO: 35564 - DNA, 25 bp, Mus musculus
aacgagattagctattcccagagaa

SEQ ID NO: 35565 - DNA, 25 bp, Mus musculus
aacgagcaaggcacttccatgtgct

SEQ ID NO: 35566 - DNA, 25 bp, Mus musculus
aacgagcaaggctcttccatgtgct

SEQ ID NO: 35567 - DNA, 25 bp, Mus musculus
aacgagcacgtgctggtcttgcaga

SEQ ID NO: 35568 - DNA, 25 bp, Mus musculus
aacgagcacgtggtggtcttgcaga

SEQ ID NO: 35569 - DNA, 25 bp, Mus musculus
aacgagcagatcaaacaggatacaa

SEQ ID NO: 35570 - DNA, 25 bp, Mus musculus
aacgagcagatctaacaggatacaa

SEQ ID NO: 35571 - DNA, 25 bp, Mus musculus
aacgagcataaaacacccactggag

SEQ ID NO: 35572 - DNA, 25 bp, Mus musculus
aacgagcataaatcacccactggag

SEQ ID NO: 35573 - DNA, 25 bp, Mus musculus
aacgagcatttccaggctttgtcca

SEQ ID NO: 35574 - DNA, 25 bp, Mus musculus
aacgagcatttcgaggctttgtcca

SEQ ID NO: 35575 - DNA, 25 bp, Mus musculus
aacgagccagatatcctatgcacac

SEQ ID NO: 35576 - DNA, 25 bp, Mus musculus
aacgagccagatttcctatgcacac

SEQ ID NO: 35577 - DNA, 25 bp, Mus musculus
aacgagccccacataaagcgtccaa

SEQ ID NO: 35578 - DNA, 25 bp, Mus musculus
aacgagccccacttaaagcgtccaa

SEQ ID NO: 35579 - DNA, 25 bp, Mus musculus
aacgagccctgtatctaacaattcg

SEQ ID NO: 35580 - DNA, 25 bp, Mus musculus
aacgagccctgtttctaacaattcg

SEQ ID NO: 35581 - DNA, 25 bp, Mus musculus
aacgagccttataacttcatatcaa

SEQ ID NO: 35582 - DNA, 25 bp, Mus musculus
aacgagccttattacttcatatcaa

SEQ ID NO: 35583 - DNA, 25 bp, Mus musculus
aacgagcgagctacactagacatag

SEQ ID NO: 35584 - DNA, 25 bp, Mus musculus
aacgagcgagcttcactagacatag

SEQ ID NO: 35585 - DNA, 25 bp, Mus musculus
aacgagcgcgttaggatgtagatct

SEQ ID NO: 35586 - DNA, 25 bp, Mus musculus
aacgagcgcgtttggatgtagatct

SEQ ID NO: 35587 - DNA, 25 bp, Mus musculus
aacgagctccgtcttttaacataag

SEQ ID NO: 35588 - DNA, 25 bp, Mus musculus
aacgagctccgtgttttaacataag

SEQ ID NO: 35589 - DNA, 25 bp, Mus musculus
aacgagctgcagaatcaacctttag

SEQ ID NO: 35590 - DNA, 25 bp, Mus musculus
aacgagctgcagtatcaacctttag

SEQ ID NO: 35591 - DNA, 25 bp, Mus musculus
aacgagcttccgcacttggttgcac

SEQ ID NO: 35592 - DNA, 25 bp, Mus musculus
aacgagcttccggacttggttgcac

SEQ ID NO: 35593 - DNA, 25 bp, Mus musculus
aacgagcttggcctgtgtgttttag

SEQ ID NO: 35594 - DNA, 25 bp, Mus musculus
aacgagcttggcgtgtgtgttttag

SEQ ID NO: 35595 - DNA, 25 bp, Mus musculus
aacgagctttctatggtgagaggca

SEQ ID NO: 35596 - DNA, 25 bp, Mus musculus
aacgagctttctttggtgagaggca

SEQ ID NO: 35597 - DNA, 25 bp, Mus musculus
aacgaggaccagaccatgggcaact

SEQ ID NO: 35598 - DNA, 25 bp, Mus musculus
aacgaggaccagtccatgggcaact

SEQ ID NO: 35599 - DNA, 25 bp, Mus musculus
aacgaggagcaaagatcaggagcat

SEQ ID NO: 35600 - DNA, 25 bp, Mus musculus
aacgaggagcaatgatcaggagcat

SEQ ID NO: 35601 - DNA, 25 bp, Mus musculus
aacgaggatggcctcttccgaatcc

SEQ ID NO: 35602 - DNA, 25 bp, Mus musculus
aacgaggatggcgtcttccgaatcc

SEQ ID NO: 35603 - DNA, 25 bp, Mus musculus
aacgaggccaagacaggtgctgaca

SEQ ID NO: 35604 - DNA, 25 bp, Mus musculus
aacgaggccaagtcaggtgctgaca

SEQ ID NO: 35605 - DNA, 25 bp, Mus musculus
aacgaggctccacaagagatgctaa

SEQ ID NO: 35606 - DNA, 25 bp, Mus musculus
aacgaggctccagaagagatgctaa

SEQ ID NO: 35607 - DNA, 25 bp, Mus musculus
aacgagggacacatgagccgtgaaa

SEQ ID NO: 35608 - DNA, 25 bp, Mus musculus
aacgagggacacttgagccgtgaaa

SEQ ID NO: 35609 - DNA, 25 bp, Mus musculus
aacgagggcaacatcattgccttct

SEQ ID NO: 35610 - DNA, 25 bp, Mus musculus
aacgagggcaacttcattgccttct

SEQ ID NO: 35611 - DNA, 25 bp, Mus musculus
aacgaggtagggaccctgtgccatt

SEQ ID NO: 35612 - DNA, 25 bp, Mus musculus
aacgaggtagggtccctgtgccatt

SEQ ID NO: 35613 - DNA, 25 bp, Mus musculus
aacgagtacctccacaggatcggac

SEQ ID NO: 35614 - DNA, 25 bp, Mus musculus
aacgagtacctcgacaggatcggac

SEQ ID NO: 35615 - DNA, 25 bp, Mus musculus
aacgagtagtttctgtctatgcctc

SEQ ID NO: 35616 - DNA, 25 bp, Mus musculus
aacgagtagtttgtgtctatgcctc

SEQ ID NO: 35617 - DNA, 25 bp, Mus musculus
aacgagtcacgtcggattgctaaaa

SEQ ID NO: 35618 - DNA, 25 bp, Mus musculus
aacgagtcacgtgggattgctaaaa

SEQ ID NO: 35619 - DNA, 25 bp, Mus musculus
aacgagtccagccacaactttgaaa

SEQ ID NO: 35620 - DNA, 25 bp, Mus musculus
aacgagtccagcgacaactttgaaa

SEQ ID NO: 35621 - DNA, 25 bp, Mus musculus
aacgagtccgatcgcgctctaccat

SEQ ID NO: 35622 - DNA, 25 bp, Mus musculus
aacgagtccgatggcgctctaccat

SEQ ID NO: 35623 - DNA, 25 bp, Mus musculus
aacgagtgacccaggcgctgcggtc

SEQ ID NO: 35624 - DNA, 25 bp, Mus musculus
aacgagtgaccctggcgctgcggtc

SEQ ID NO: 35625 - DNA, 25 bp, Mus musculus
aacgagtgactcagccagtgtgatt

SEQ ID NO: 35626 - DNA, 25 bp, Mus musculus
aacgagtgactctgccagtgtgatt

SEQ ID NO: 35627 - DNA, 25 bp, Mus musculus
aacgagtgattgctgtgctgtccct

SEQ ID NO: 35628 - DNA, 25 bp, Mus musculus
aacgagtgattggtgtgctgtccct

SEQ ID NO: 35629 - DNA, 25 bp, Mus musculus
aacgagtgctgtcccagttatagcc

SEQ ID NO: 35630 - DNA, 25 bp, Mus musculus
aacgagtgctgtgccagttatagcc

SEQ ID NO: 35631 - DNA, 25 bp, Mus musculus
aacgagtgtgttatctgcaacgcaa

SEQ ID NO: 35632 - DNA, 25 bp, Mus musculus
aacgagtgtgttttctgcaacgcaa

SEQ ID NO: 35633 - DNA, 25 bp, Mus musculus
aacgagttgaacatggttgttgcca

SEQ ID NO: 35634 - DNA, 25 bp, Mus musculus
aacgagttgaacttggttgttgcca

SEQ ID NO: 35635 - DNA, 25 bp, Mus musculus
aacgagtttccgctcctactttgca

SEQ ID NO: 35636 - DNA, 25 bp, Mus musculus
aacgagtttccggtcctactttgca

SEQ ID NO: 35637 - DNA, 25 bp, Mus musculus
aacgatacaaatcagcagccagaag

SEQ ID NO: 35638 - DNA, 25 bp, Mus musculus
aacgatacaaatgagcagccagaag

SEQ ID NO: 35639 - DNA, 25 bp, Mus musculus
aacgatatagttcctgtcaggatta

SEQ ID NO: 35640 - DNA, 25 bp, Mus musculus
aacgatatagttgctgtcaggatta

SEQ ID NO: 35641 - DNA, 25 bp, Mus musculus
aacgatatcatgaacacggcacgcc

SEQ ID NO: 35642 - DNA, 25 bp, Mus musculus
aacgatatcatgtacacggcacgcc

SEQ ID NO: 35643 - DNA, 25 bp, Mus musculus
aacgatatggctacagtcaccagct

SEQ ID NO: 35644 - DNA, 25 bp, Mus musculus
aacgatatggcttcagtcaccagct

SEQ ID NO: 35645 - DNA, 25 bp, Mus musculus
aacgatattccaccctctcttgtat

SEQ ID NO: 35646 - DNA, 25 bp, Mus musculus
aacgatattccagcctctcttgtat

SEQ ID NO: 35647 - DNA, 25 bp, Mus musculus
aacgatcagtgaaggacgccggccc

SEQ ID NO: 35648 - DNA, 25 bp, Mus musculus
aacgatcagtgatggacgccggccc

SEQ ID NO: 35649 - DNA, 25 bp, Mus musculus
aacgatccccttcagactgttctgt

SEQ ID NO: 35650 - DNA, 25 bp, Mus musculus
aacgatccccttgagactgttctgt

SEQ ID NO: 35651 - DNA, 25 bp, Mus musculus
aacgatctatccagcctcagttgag

SEQ ID NO: 35652 - DNA, 25 bp, Mus musculus
aacgatctatcctgcctcagttgag

SEQ ID NO: 35653 - DNA, 25 bp, Mus musculus
aacgatctgccccatggtgttttta

SEQ ID NO: 35654 - DNA, 25 bp, Mus musculus
aacgatctgcccgatggtgttttta

SEQ ID NO: 35655 - DNA, 25 bp, Mus musculus
aacgatctttaaacttctctcatag

SEQ ID NO: 35656 - DNA, 25 bp, Mus musculus
aacgatctttaatcttctctcatag

SEQ ID NO: 35657 - DNA, 25 bp, Mus musculus
aacgatgacatcatggcacgagcct

SEQ ID NO: 35658 - DNA, 25 bp, Mus musculus
aacgatgacatcttggcacgagcct

SEQ ID NO: 35659 - DNA, 25 bp, Mus musculus
aacgatgacattatgcaggttcaat

SEQ ID NO: 35660 - DNA, 25 bp, Mus musculus
aacgatgacattttgcaggttcaat

SEQ ID NO: 35661 - DNA, 25 bp, Mus musculus
aacgatgacctcctggacttctctg

SEQ ID NO: 35662 - DNA, 25 bp, Mus musculus
aacgatgacctcgtggacttctctg

SEQ ID NO: 35663 - DNA, 25 bp, Mus musculus
aacgatgactatccctctctgcagg

SEQ ID NO: 35664 - DNA, 25 bp, Mus musculus
aacgatgactatgcctctctgcagg

SEQ ID NO: 35665 - DNA, 25 bp, Mus musculus
aacgatgagatccaggccggcatag

SEQ ID NO: 35666 - DNA, 25 bp, Mus musculus
aacgatgagatcgaggccggcatag

SEQ ID NO: 35667 - DNA, 25 bp, Mus musculus
aacgatgagattagctctcctgctc

SEQ ID NO: 35668 - DNA, 25 bp, Mus musculus
aacgatgagatttgctctcctgctc

SEQ ID NO: 35669 - DNA, 25 bp, Mus musculus
aacgatgatttcaataaatacctag

SEQ ID NO: 35670 - DNA, 25 bp, Mus musculus
aacgatgatttctataaatacctag

SEQ ID NO: 35671 - DNA, 25 bp, Mus musculus
aacgatgccatgattttatgtccat

SEQ ID NO: 35672 - DNA, 25 bp, Mus musculus
aacgatgccatgtttttatgtccat

SEQ ID NO: 35673 - DNA, 25 bp, Mus musculus
aacgatgccgtgattcctgccatga

SEQ ID NO: 35674 - DNA, 25 bp, Mus musculus
aacgatgccgtgtttcctgccatga

SEQ ID NO: 35675 - DNA, 25 bp, Mus musculus
aacgatgcctatcgagcacttgact

SEQ ID NO: 35676 - DNA, 25 bp, Mus musculus
aacgatgcctatggagcacttgact

SEQ ID NO: 35677 - DNA, 25 bp, Mus musculus
aacgatgcctgtaccaaaatggctc

SEQ ID NO: 35678 - DNA, 25 bp, Mus musculus
aacgatgcctgttccaaaatggctc

SEQ ID NO: 35679 - DNA, 25 bp, Mus musculus
aacgatgctactcgtatcctttcaa

SEQ ID NO: 35680 - DNA, 25 bp, Mus musculus
aacgatgctactggtatcctttcaa

SEQ ID NO: 35681 - DNA, 25 bp, Mus musculus
aacgatgctaggcacgtctggtcct

SEQ ID NO: 35682 - DNA, 25 bp, Mus musculus
aacgatgctagggacgtctggtcct

SEQ ID NO: 35683 - DNA, 25 bp, Mus musculus
aacgatgctagtagctggattcatt

SEQ ID NO: 35684 - DNA, 25 bp, Mus musculus
aacgatgctagttgctggattcatt

SEQ ID NO: 35685 - DNA, 25 bp, Mus musculus
aacgatgctctcagcatccgggaga

SEQ ID NO: 35686 - DNA, 25 bp, Mus musculus
aacgatgctctctgcatccgggaga

SEQ ID NO: 35687 - DNA, 25 bp, Mus musculus
aacgatgctctgaagatccaactga

SEQ ID NO: 35688 - DNA, 25 bp, Mus musculus
aacgatgctctgtagatccaactga

SEQ ID NO: 35689 - DNA, 25 bp, Mus musculus
aacgatgctcttacatttgcacaaa

SEQ ID NO: 35690 - DNA, 25 bp, Mus musculus
aacgatgctctttcatttgcacaaa

SEQ ID NO: 35691 - DNA, 25 bp, Mus musculus
aacgatgctgttcttcaatgttaca

SEQ ID NO: 35692 - DNA, 25 bp, Mus musculus
aacgatgctgttgttcaatgttaca

SEQ ID NO: 35693 - DNA, 25 bp, Mus musculus
aacgatggacacagcggccttggaa

SEQ ID NO: 35694 - DNA, 25 bp, Mus musculus
aacgatggacactgcggccttggaa

SEQ ID NO: 35695 - DNA, 25 bp, Mus musculus
aacgatggccgaattgactatgacg

SEQ ID NO: 35696 - DNA, 25 bp, Mus musculus
aacgatggccgatttgactatgacg

SEQ ID NO: 35697 - DNA, 25 bp, Mus musculus
aacgatgggcttctgtttatctttt

SEQ ID NO: 35698 - DNA, 25 bp, Mus musculus
aacgatgggcttgtgtttatctttt

SEQ ID NO: 35699 - DNA, 25 bp, Mus musculus
aacgatgtaagtctagccctccagg

SEQ ID NO: 35700 - DNA, 25 bp, Mus musculus
aacgatgtaagtgtagccctccagg

SEQ ID NO: 35701 - DNA, 25 bp, Mus musculus
aacgatgtagagaattttgcccctg

SEQ ID NO: 35702 - DNA, 25 bp, Mus musculus
aacgatgtagagtattttgcccctg

SEQ ID NO: 35703 - DNA, 25 bp, Mus musculus
aacgatgtcccgcacttattactag

SEQ ID NO: 35704 - DNA, 25 bp, Mus musculus
aacgatgtcccggacttattactag

SEQ ID NO: 35705 - DNA, 25 bp, Mus musculus
aacgatgtctggagttttctacgtc

SEQ ID NO: 35706 - DNA, 25 bp, Mus musculus
aacgatgtctggtgttttctacgtc

SEQ ID NO: 35707 - DNA, 25 bp, Mus musculus
aacgatgtgtggagccacctgtctg

SEQ ID NO: 35708 - DNA, 25 bp, Mus musculus
aacgatgtgtggtgccacctgtctg

SEQ ID NO: 35709 - DNA, 25 bp, Mus musculus
aacgatgttttgctgcctggattgt

SEQ ID NO: 35710 - DNA, 25 bp, Mus musculus
aacgatgttttggtgcctggattgt

SEQ ID NO: 35711 - DNA, 25 bp, Mus musculus
aacgattcacacaattttgtgctca

SEQ ID NO: 35712 - DNA, 25 bp, Mus musculus
aacgattcacactattttgtgctca

SEQ ID NO: 35713 - DNA, 25 bp, Mus musculus
aacgattcagtcagtgccgtgatcc

SEQ ID NO: 35714 - DNA, 25 bp, Mus musculus
aacgattcagtctgtgccgtgatcc

SEQ ID NO: 35715 - DNA, 25 bp, Mus musculus
aacgattccctgcttatgactctga

SEQ ID NO: 35716 - DNA, 25 bp, Mus musculus
aacgattccctggttatgactctga

SEQ ID NO: 35717 - DNA, 25 bp, Mus musculus
aacgattgctttcaaagtccacccg

SEQ ID NO: 35718 - DNA, 25 bp, Mus musculus
aacgattgctttgaaagtccacccg

SEQ ID NO: 35719 - DNA, 25 bp, Mus musculus
aacgattggtgtcctttctgtggtc

SEQ ID NO: 35720 - DNA, 25 bp, Mus musculus
aacgattggtgtgctttctgtggtc

SEQ ID NO: 35721 - DNA, 25 bp, Mus musculus
aacgattgtggaatgaggaaccaac

SEQ ID NO: 35722 - DNA, 25 bp, Mus musculus
aacgattgtggattgaggaaccaac

SEQ ID NO: 35723 - DNA, 25 bp, Mus musculus
aacgatttaacccttgatcgggctg

SEQ ID NO: 35724 - DNA, 25 bp, Mus musculus
aacgatttaaccgttgatcgggctg

SEQ ID NO: 35725 - DNA, 25 bp, Mus musculus
aacgatttatacactcattttacaa

SEQ ID NO: 35726 - DNA, 25 bp, Mus musculus
aacgatttatactctcattttacaa

SEQ ID NO: 35727 - DNA, 25 bp, Mus musculus
aacgatttcctgactgactggagat

SEQ ID NO: 35728 - DNA, 25 bp, Mus musculus
aacgatttcctgtctgactggagat

SEQ ID NO: 35729 - DNA, 25 bp, Mus musculus
aacgatttgggtatcatagtaactg

SEQ ID NO: 35730 - DNA, 25 bp, Mus musculus
aacgatttgggtttcatagtaactg

SEQ ID NO: 35731 - DNA, 25 bp, Mus musculus
aacgattttatcctaagagcagtgg

SEQ ID NO: 35732 - DNA, 25 bp, Mus musculus
aacgattttatcgtaagagcagtgg

SEQ ID NO: 35733 - DNA, 25 bp, Mus musculus
aacgatttttcaccatagtcaacaa

SEQ ID NO: 35734 - DNA, 25 bp, Mus musculus
aacgatttttcagcatagtcaacaa

SEQ ID NO: 35735 - DNA, 25 bp, Mus musculus
aacgcaactctgaccttgctgtgat

SEQ ID NO: 35736 - DNA, 25 bp, Mus musculus
aacgcaactctgtccttgctgtgat

SEQ ID NO: 35737 - DNA, 25 bp, Mus musculus
aacgcaagagtccttatgtcgccat

SEQ ID NO: 35738 - DNA, 25 bp, Mus musculus
aacgcaagagtcgttatgtcgccat

SEQ ID NO: 35739 - DNA, 25 bp, Mus musculus
aacgcaagcagccttctggtcaatg

SEQ ID NO: 35740 - DNA, 25 bp, Mus musculus
aacgcaagcagcgttctggtcaatg

SEQ ID NO: 35741 - DNA, 25 bp, Mus musculus
aacgcaagcgaaagtgaccctcaca

SEQ ID NO: 35742 - DNA, 25 bp, Mus musculus
aacgcaagcgaatgtgaccctcaca

SEQ ID NO: 35743 - DNA, 25 bp, Mus musculus
aacgcaagcgtaccacagttaatga

SEQ ID NO: 35744 - DNA, 25 bp, Mus musculus
aacgcaagcgtagcacagttaatga

SEQ ID NO: 35745 - DNA, 25 bp, Mus musculus
aacgcaaggctccagttccagggtc

SEQ ID NO: 35746 - DNA, 25 bp, Mus musculus
aacgcaaggctcgagttccagggtc

SEQ ID NO: 35747 - DNA, 25 bp, Mus musculus
aacgcaagggataggtatgtactac

SEQ ID NO: 35748 - DNA, 25 bp, Mus musculus
aacgcaagggattggtatgtactac

SEQ ID NO: 35749 - DNA, 25 bp, Mus musculus
aacgcaatacttaacacttgttgga

SEQ ID NO: 35750 - DNA, 25 bp, Mus musculus
aacgcaatactttacacttgttgga

SEQ ID NO: 35751 - DNA, 25 bp, Mus musculus
aacgcaatcaaaccaagcttgcaag

SEQ ID NO: 35752 - DNA, 25 bp, Mus musculus
aacgcaatcaaagcaagcttgcaag

SEQ ID NO: 35753 - DNA, 25 bp, Mus musculus
aacgcaatcagtaaatccgctcagg

SEQ ID NO: 35754 - DNA, 25 bp, Mus musculus
aacgcaatcagttaatccgctcagg

SEQ ID NO: 35755 - DNA, 25 bp, Mus musculus
aacgcaatgggtaatcttggataac

SEQ ID NO: 35756 - DNA, 25 bp, Mus musculus
aacgcaatgggttatcttggataac

SEQ ID NO: 35757 - DNA, 25 bp, Mus musculus
aacgcaatggtgctctggtacccaa

SEQ ID NO: 35758 - DNA, 25 bp, Mus musculus
aacgcaatggtggtctggtacccaa

SEQ ID NO: 35759 - DNA, 25 bp, Mus musculus
aacgcaatgttgaagaacgccgaca

SEQ ID NO: 35760 - DNA, 25 bp, Mus musculus
aacgcaatgttgtagaacgccgaca

SEQ ID NO: 35761 - DNA, 25 bp, Mus musculus
aacgcaattctcatggcacctggga

SEQ ID NO: 35762 - DNA, 25 bp, Mus musculus
aacgcaattctcttggcacctggga

SEQ ID NO: 35763 - DNA, 25 bp, Mus musculus
aacgcacagacacttttggagaccg

SEQ ID NO: 35764 - DNA, 25 bp, Mus musculus
aacgcacagacagttttggagaccg

SEQ ID NO: 35765 - DNA, 25 bp, Mus musculus
aacgcacattgtcttggattcaatc

SEQ ID NO: 35766 - DNA, 25 bp, Mus musculus
aacgcacattgtgttggattcaatc

SEQ ID NO: 35767 - DNA, 25 bp, Mus musculus
aacgcaccaagaaggtcggcatcgt

SEQ ID NO: 35768 - DNA, 25 bp, Mus musculus
aacgcaccaagatggtcggcatcgt

SEQ ID NO: 35769 - DNA, 25 bp, Mus musculus
aacgcaccaaggcttttccaggagg

SEQ ID NO: 35770 - DNA, 25 bp, Mus musculus
aacgcaccaagggttttccaggagg

SEQ ID NO: 35771 - DNA, 25 bp, Mus musculus
aacgcacccgatactcttaatgtga

SEQ ID NO: 35772 - DNA, 25 bp, Mus musculus
aacgcacccgattctcttaatgtga

SEQ ID NO: 35773 - DNA, 25 bp, Mus musculus
aacgcacggtgcagcgaggccagaa

SEQ ID NO: 35774 - DNA, 25 bp, Mus musculus
aacgcacggtgctgcgaggccagaa

SEQ ID NO: 35775 - DNA, 25 bp, Mus musculus
aacgcactggctctaatgtttatta

SEQ ID NO: 35776 - DNA, 25 bp, Mus musculus
aacgcactggctgtaatgtttatta

SEQ ID NO: 35777 - DNA, 25 bp, Mus musculus
aacgcactgtagaataatggctctg

SEQ ID NO: 35778 - DNA, 25 bp, Mus musculus
aacgcactgtagtataatggctctg

SEQ ID NO: 35779 - DNA, 25 bp, Mus musculus
aacgcacttgaaagtctggtctgac

SEQ ID NO: 35780 - DNA, 25 bp, Mus musculus
aacgcacttgaatgtctggtctgac

SEQ ID NO: 35781 - DNA, 25 bp, Mus musculus
aacgcacttgctaaagtgtgcccca

SEQ ID NO: 35782 - DNA, 25 bp, Mus musculus
aacgcacttgcttaagtgtgcccca

SEQ ID NO: 35783 - DNA, 25 bp, Mus musculus
aacgcactttaacagaccatggcct

SEQ ID NO: 35784 - DNA, 25 bp, Mus musculus
aacgcactttaagagaccatggcct

SEQ ID NO: 35785 - DNA, 25 bp, Mus musculus
aacgcagaagctactcaaatacttg

SEQ ID NO: 35786 - DNA, 25 bp, Mus musculus
aacgcagaagcttctcaaatacttg

SEQ ID NO: 35787 - DNA, 25 bp, Mus musculus
aacgcagaggcacgctgatccctgt

SEQ ID NO: 35788 - DNA, 25 bp, Mus musculus
aacgcagaggcaggctgatccctgt

SEQ ID NO: 35789 - DNA, 25 bp, Mus musculus
aacgcagagtgaccaacatcctgga

SEQ ID NO: 35790 - DNA, 25 bp, Mus musculus
aacgcagagtgagcaacatcctgga

SEQ ID NO: 35791 - DNA, 25 bp, Mus musculus
aacgcagagttgacatgtgttttct

SEQ ID NO: 35792 - DNA, 25 bp, Mus musculus
aacgcagagttgtcatgtgttttct

SEQ ID NO: 35793 - DNA, 25 bp, Mus musculus
aacgcagatattaccatcatgatcg

SEQ ID NO: 35794 - DNA, 25 bp, Mus musculus
aacgcagatatttccatcatgatcg

SEQ ID NO: 35795 - DNA, 25 bp, Mus musculus
aacgcagcaacacaaggccgtgagt

SEQ ID NO: 35796 - DNA, 25 bp, Mus musculus
aacgcagcaacagaaggccgtgagt

SEQ ID NO: 35797 - DNA, 25 bp, Mus musculus
aacgcagcaagaccaagatcactgt

SEQ ID NO: 35798 - DNA, 25 bp, Mus musculus
aacgcagcaagagcaagatcactgt

SEQ ID NO: 35799 - DNA, 25 bp, Mus musculus
aacgcagcacagagtcctccgctta

SEQ ID NO: 35800 - DNA, 25 bp, Mus musculus
aacgcagcacagtgtcctccgctta

SEQ ID NO: 35801 - DNA, 25 bp, Mus musculus
aacgcagcacatacggtaacctttg

SEQ ID NO: 35802 - DNA, 25 bp, Mus musculus
aacgcagcacattcggtaacctttg

SEQ ID NO: 35803 - DNA, 25 bp, Mus musculus
aacgcagccaccaccagtcggaggg

SEQ ID NO: 35804 - DNA, 25 bp, Mus musculus
aacgcagccacctccagtcggaggg

SEQ ID NO: 35805 - DNA, 25 bp, Mus musculus
aacgcagccctcaagaagttggact

SEQ ID NO: 35806 - DNA, 25 bp, Mus musculus
aacgcagccctctagaagttggact

SEQ ID NO: 35807 - DNA, 25 bp, Mus musculus
aacgcagcgaagattctgcccatca

SEQ ID NO: 35808 - DNA, 25 bp, Mus musculus
aacgcagcgaagtttctgcccatca

SEQ ID NO: 35809 - DNA, 25 bp, Mus musculus
aacgcagcgttcattctggtccatt

SEQ ID NO: 35810 - DNA, 25 bp, Mus musculus
aacgcagcgttctttctggtccatt

SEQ ID NO: 35811 - DNA, 25 bp, Mus musculus
aacgcagctggtaaatgtccagtaa

SEQ ID NO: 35812 - DNA, 25 bp, Mus musculus
aacgcagctggttaatgtccagtaa

SEQ ID NO: 35813 - DNA, 25 bp, Mus musculus
aacgcagctgtgcagtagccaacat

SEQ ID NO: 35814 - DNA, 25 bp, Mus musculus
aacgcagctgtggagtagccaacat

SEQ ID NO: 35815 - DNA, 25 bp, Mus musculus
aacgcaggagaacctacacataacg

SEQ ID NO: 35816 - DNA, 25 bp, Mus musculus
aacgcaggagaagctacacataacg

SEQ ID NO: 35817 - DNA, 25 bp, Mus musculus
aacgcaggctggcaggtcaagttct

SEQ ID NO: 35818 - DNA, 25 bp, Mus musculus
aacgcaggctgggaggtcaagttct

SEQ ID NO: 35819 - DNA, 25 bp, Mus musculus
aacgcagggaatcttcacgccttca

SEQ ID NO: 35820 - DNA, 25 bp, Mus musculus
aacgcagggaatgttcacgccttca

SEQ ID NO: 35821 - DNA, 25 bp, Mus musculus
aacgcagggcatatgcaagcagatc

SEQ ID NO: 35822 - DNA, 25 bp, Mus musculus
aacgcagggcatttgcaagcagatc

SEQ ID NO: 35823 - DNA, 25 bp, Mus musculus
aacgcagggctgagttctaccacca

SEQ ID NO: 35824 - DNA, 25 bp, Mus musculus
aacgcagggctgtgttctaccacca

SEQ ID NO: 35825 - DNA, 25 bp, Mus musculus
aacgcagggttccagacctagagga

SEQ ID NO: 35826 - DNA, 25 bp, Mus musculus
aacgcagggttcgagacctagagga

SEQ ID NO: 35827 - DNA, 25 bp, Mus musculus
aacgcagtctccaggttagcacaaa

SEQ ID NO: 35828 - DNA, 25 bp, Mus musculus
aacgcagtctcctggttagcacaaa

SEQ ID NO: 35829 - DNA, 25 bp, Mus musculus
aacgcagtgcacatcaagggaccat

SEQ ID NO: 35830 - DNA, 25 bp, Mus musculus
aacgcagtgcacttcaagggaccat

SEQ ID NO: 35831 - DNA, 25 bp, Mus musculus
aacgcagtgcccattaaatgtcttc

SEQ ID NO: 35832 - DNA, 25 bp, Mus musculus
aacgcagtgccctttaaatgtcttc

SEQ ID NO: 35833 - DNA, 25 bp, Mus musculus
aacgcagtgctcacagcagtagtga

SEQ ID NO: 35834 - DNA, 25 bp, Mus musculus
aacgcagtgctctcagcagtagtga

SEQ ID NO: 35835 - DNA, 25 bp, Mus musculus
aacgcagtggttcctatctcaggga

SEQ ID NO: 35836 - DNA, 25 bp, Mus musculus
aacgcagtggttgctatctcaggga

SEQ ID NO: 35837 - DNA, 25 bp, Mus musculus
aacgcagtgtgcattagggctcttg

SEQ ID NO: 35838 - DNA, 25 bp, Mus musculus
aacgcagtgtgctttagggctcttg

SEQ ID NO: 35839 - DNA, 25 bp, Mus musculus
aacgcagttaaaccccaagcttcca

SEQ ID NO: 35840 - DNA, 25 bp, Mus musculus
aacgcagttaaagcccaagcttcca

SEQ ID NO: 35841 - DNA, 25 bp, Mus musculus
aacgcatacagacccctaacagagt

SEQ ID NO: 35842 - DNA, 25 bp, Mus musculus
aacgcatacagagccctaacagagt

SEQ ID NO: 35843 - DNA, 25 bp, Mus musculus
aacgcatagcatctttacatctctt

SEQ ID NO: 35844 - DNA, 25 bp, Mus musculus
aacgcatagcatgtttacatctctt

SEQ ID NO: 35845 - DNA, 25 bp, Mus musculus
aacgcatctacaccagcctgtgaaa

SEQ ID NO: 35846 - DNA, 25 bp, Mus musculus
aacgcatctacagcagcctgtgaaa

SEQ ID NO: 35847 - DNA, 25 bp, Mus musculus
aacgcatctgtgagttcctgggccg

SEQ ID NO: 35848 - DNA, 25 bp, Mus musculus
aacgcatctgtgtgttcctgggccg

SEQ ID NO: 35849 - DNA, 25 bp, Mus musculus
aacgcatgacttagttcatagctgc

SEQ ID NO: 35850 - DNA, 25 bp, Mus musculus
aacgcatgactttgttcatagctgc

SEQ ID NO: 35851 - DNA, 25 bp, Mus musculus
aacgcatgcagtatgactttcagta

SEQ ID NO: 35852 - DNA, 25 bp, Mus musculus
aacgcatgcagtttgactttcagta

SEQ ID NO: 35853 - DNA, 25 bp, Mus musculus
aacgcatgggtcaggctttgctgtg

SEQ ID NO: 35854 - DNA, 25 bp, Mus musculus
aacgcatgggtctggctttgctgtg

SEQ ID NO: 35855 - DNA, 25 bp, Mus musculus
aacgcatgtactcgagcttgctttc

SEQ ID NO: 35856 - DNA, 25 bp, Mus musculus
aacgcatgtactggagcttgctttc

SEQ ID NO: 35857 - DNA, 25 bp, Mus musculus
aacgcattcgtaatgaacaggtgca

SEQ ID NO: 35858 - DNA, 25 bp, Mus musculus
aacgcattcgtattgaacaggtgca

SEQ ID NO: 35859 - DNA, 25 bp, Mus musculus
aacgccaaacacacctggagctctg

SEQ ID NO: 35860 - DNA, 25 bp, Mus musculus
aacgccaaacactcctggagctctg

SEQ ID NO: 35861 - DNA, 25 bp, Mus musculus
aacgccaaagagcaccctagtttat

SEQ ID NO: 35862 - DNA, 25 bp, Mus musculus
aacgccaaagaggaccctagtttat

SEQ ID NO: 35863 - DNA, 25 bp, Mus musculus
aacgccacgtccaagttcatggagt

SEQ ID NO: 35864 - DNA, 25 bp, Mus musculus
aacgccacgtcctagttcatggagt

SEQ ID NO: 35865 - DNA, 25 bp, Mus musculus
aacgccagacttcagggtaacactc

SEQ ID NO: 35866 - DNA, 25 bp, Mus musculus
aacgccagacttgagggtaacactc

SEQ ID NO: 35867 - DNA, 25 bp, Mus musculus
aacgccagcgccatgaaacagctga

SEQ ID NO: 35868 - DNA, 25 bp, Mus musculus
aacgccagcgccttgaaacagctga

SEQ ID NO: 35869 - DNA, 25 bp, Mus musculus
aacgccagctgtatcacctgggagg

SEQ ID NO: 35870 - DNA, 25 bp, Mus musculus
aacgccagctgtttcacctgggagg

SEQ ID NO: 35871 - DNA, 25 bp, Mus musculus
aacgccaggattatgtattctgttt

SEQ ID NO: 35872 - DNA, 25 bp, Mus musculus
aacgccaggattttgtattctgttt

SEQ ID NO: 35873 - DNA, 25 bp, Mus musculus
aacgccagtggtcctacttcagact

SEQ ID NO: 35874 - DNA, 25 bp, Mus musculus
aacgccagtggtgctacttcagact

SEQ ID NO: 35875 - DNA, 25 bp, Mus musculus
aacgccatccttaactaagtacgct

SEQ ID NO: 35876 - DNA, 25 bp, Mus musculus
aacgccatcctttactaagtacgct

SEQ ID NO: 35877 - DNA, 25 bp, Mus musculus
aacgccatctgcagatgagcatcga

SEQ ID NO: 35878 - DNA, 25 bp, Mus musculus
aacgccatctgctgatgagcatcga

SEQ ID NO: 35879 - DNA, 25 bp, Mus musculus
aacgccatgactcaagaggccatcc

SEQ ID NO: 35880 - DNA, 25 bp, Mus musculus
aacgccatgactgaagaggccatcc

SEQ ID NO: 35881 - DNA, 25 bp, Mus musculus
aacgccatggtcagagcaacctatg

SEQ ID NO: 35882 - DNA, 25 bp, Mus musculus
aacgccatggtctgagcaacctatg

SEQ ID NO: 35883 - DNA, 25 bp, Mus musculus
aacgccattgccaggttacttgttt

SEQ ID NO: 35884 - DNA, 25 bp, Mus musculus
aacgccattgcctggttacttgttt

SEQ ID NO: 35885 - DNA, 25 bp, Mus musculus
aacgccattgtcatctcttttggag

SEQ ID NO: 35886 - DNA, 25 bp, Mus musculus
aacgccattgtcttctcttttggag

SEQ ID NO: 35887 - DNA, 25 bp, Mus musculus
aacgcccactgaattttgcacaagg

SEQ ID NO: 35888 - DNA, 25 bp, Mus musculus
aacgcccactgatttttgcacaagg

SEQ ID NO: 35889 - DNA, 25 bp, Mus musculus
aacgcccgacgtatttgctctgaag

SEQ ID NO: 35890 - DNA, 25 bp, Mus musculus
aacgcccgacgtttttgctctgaag

SEQ ID NO: 35891 - DNA, 25 bp, Mus musculus
aacgccctcatcaggagggtttgga

SEQ ID NO: 35892 - DNA, 25 bp, Mus musculus
aacgccctcatctggagggtttgga

SEQ ID NO: 35893 - DNA, 25 bp, Mus musculus
aacgccctccttaagatttctcagt

SEQ ID NO: 35894 - DNA, 25 bp, Mus musculus
aacgccctcctttagatttctcagt

SEQ ID NO: 35895 - DNA, 25 bp, Mus musculus
aacgccctctctaggtgtatatgaa

SEQ ID NO: 35896 - DNA, 25 bp, Mus musculus
aacgccctctcttggtgtatatgaa

SEQ ID NO: 35897 - DNA, 25 bp, Mus musculus
aacgccctgaatatcttcagtacgg

SEQ ID NO: 35898 - DNA, 25 bp, Mus musculus
aacgccctgaatttcttcagtacgg

SEQ ID NO: 35899 - DNA, 25 bp, Mus musculus
aacgccgaagggaaagctgaactgt

SEQ ID NO: 35900 - DNA, 25 bp, Mus musculus
aacgccgaagggtaagctgaactgt

SEQ ID NO: 35901 - DNA, 25 bp, Mus musculus
aacgccgaatatacgcaacttcgca

SEQ ID NO: 35902 - DNA, 25 bp, Mus musculus
aacgccgaatattcgcaacttcgca

SEQ ID NO: 35903 - DNA, 25 bp, Mus musculus
aacgccgacaagcagccctgtgaga

SEQ ID NO: 35904 - DNA, 25 bp, Mus musculus
aacgccgacaaggagccctgtgaga

SEQ ID NO: 35905 - DNA, 25 bp, Mus musculus
aacgccgacatcatttgccagacag

SEQ ID NO: 35906 - DNA, 25 bp, Mus musculus
aacgccgacatcttttgccagacag

SEQ ID NO: 35907 - DNA, 25 bp, Mus musculus
aacgccgccaacagaggtgggagca

SEQ ID NO: 35908 - DNA, 25 bp, Mus musculus
aacgccgccaactgaggtgggagca

SEQ ID NO: 35909 - DNA, 25 bp, Mus musculus
aacgccgctcccatggataagattc

SEQ ID NO: 35910 - DNA, 25 bp, Mus musculus
aacgccgctcccttggataagattc

SEQ ID NO: 35911 - DNA, 25 bp, Mus musculus
aacgccgtgatgctgttttgtaaca

SEQ ID NO: 35912 - DNA, 25 bp, Mus musculus
aacgccgtgatggtgttttgtaaca

SEQ ID NO: 35913 - DNA, 25 bp, Mus musculus
aacgccgttgatagaggagcagcct

SEQ ID NO: 35914 - DNA, 25 bp, Mus musculus
aacgccgttgattgaggagcagcct

SEQ ID NO: 35915 - DNA, 25 bp, Mus musculus
aacgcctataagacaggacctggga

SEQ ID NO: 35916 - DNA, 25 bp, Mus musculus
aacgcctataagtcaggacctggga

SEQ ID NO: 35917 - DNA, 25 bp, Mus musculus
aacgcctatggtacctactgttatt

SEQ ID NO: 35918 - DNA, 25 bp, Mus musculus
aacgcctatggttcctactgttatt

SEQ ID NO: 35919 - DNA, 25 bp, Mus musculus
aacgcctcagtgaggtaaagtctct

SEQ ID NO: 35920 - DNA, 25 bp, Mus musculus
aacgcctcagtgtggtaaagtctct

SEQ ID NO: 35921 - DNA, 25 bp, Mus musculus
aacgcctcatgacagtgcctggcac

SEQ ID NO: 35922 - DNA, 25 bp, Mus musculus
aacgcctcatgagagtgcctggcac

SEQ ID NO: 35923 - DNA, 25 bp, Mus musculus
aacgcctcctacatggatcctggag

SEQ ID NO: 35924 - DNA, 25 bp, Mus musculus
aacgcctcctacttggatcctggag

SEQ ID NO: 35925 - DNA, 25 bp, Mus musculus
aacgcctcctatcttgtggatcgag

SEQ ID NO: 35926 - DNA, 25 bp, Mus musculus
aacgcctcctatgttgtggatcgag

SEQ ID NO: 35927 - DNA, 25 bp, Mus musculus
aacgcctggctaagctgcaggagca

SEQ ID NO: 35928 - DNA, 25 bp, Mus musculus
aacgcctggctatgctgcaggagca

SEQ ID NO: 35929 - DNA, 25 bp, Mus musculus
aacgcctgggacagccttggcacgc

SEQ ID NO: 35930 - DNA, 25 bp, Mus musculus
aacgcctgggactgccttggcacgc

SEQ ID NO: 35931 - DNA, 25 bp, Mus musculus
aacgcctgttcacaggagcgtgcta

SEQ ID NO: 35932 - DNA, 25 bp, Mus musculus
aacgcctgttcagaggagcgtgcta

SEQ ID NO: 35933 - DNA, 25 bp, Mus musculus
aacgccttacccattggcagaatgc

SEQ ID NO: 35934 - DNA, 25 bp, Mus musculus
aacgccttaccctttggcagaatgc

SEQ ID NO: 35935 - DNA, 25 bp, Mus musculus
aacgccttgataacctgcacagtga

SEQ ID NO: 35936 - DNA, 25 bp, Mus musculus
aacgccttgatatcctgcacagtga

SEQ ID NO: 35937 - DNA, 25 bp, Mus musculus
aacgccttgtacattgtgcgcgcaa

SEQ ID NO: 35938 - DNA, 25 bp, Mus musculus
aacgccttgtactttgtgcgcgcaa

SEQ ID NO: 35939 - DNA, 25 bp, Mus musculus
aacgcctttcacatttgtagatggt

SEQ ID NO: 35940 - DNA, 25 bp, Mus musculus
aacgcctttcacttttgtagatggt

SEQ ID NO: 35941 - DNA, 25 bp, Mus musculus
aacgccttttaactgtgtctgaaca

SEQ ID NO: 35942 - DNA, 25 bp, Mus musculus
aacgccttttaagtgtgtctgaaca

SEQ ID NO: 35943 - DNA, 25 bp, Mus musculus
aacgcgatgactcagttacaagcta

SEQ ID NO: 35944 - DNA, 25 bp, Mus musculus
aacgcgatgactgagttacaagcta

SEQ ID NO: 35945 - DNA, 25 bp, Mus musculus
aacgcgatgtacaggctcggactta

SEQ ID NO: 35946 - DNA, 25 bp, Mus musculus
aacgcgatgtactggctcggactta

SEQ ID NO: 35947 - DNA, 25 bp, Mus musculus
aacgcgcaagcacttctgttcttgt

SEQ ID NO: 35948 - DNA, 25 bp, Mus musculus
aacgcgcaagcagttctgttcttgt

SEQ ID NO: 35949 - DNA, 25 bp, Mus musculus
aacgcgcactgacacgaatcgaatg

SEQ ID NO: 35950 - DNA, 25 bp, Mus musculus
aacgcgcactgagacgaatcgaatg

SEQ ID NO: 35951 - DNA, 25 bp, Mus musculus
aacgcgcataggaacaggaggcagc

SEQ ID NO: 35952 - DNA, 25 bp, Mus musculus
aacgcgcataggtacaggaggcagc

SEQ ID NO: 35953 - DNA, 25 bp, Mus musculus
aacgcgccgtggagaaactcattga

SEQ ID NO: 35954 - DNA, 25 bp, Mus musculus
aacgcgccgtggtgaaactcattga

SEQ ID NO: 35955 - DNA, 25 bp, Mus musculus
aacgcgctgataataacggtggcca

SEQ ID NO: 35956 - DNA, 25 bp, Mus musculus
aacgcgctgatattaacggtggcca

SEQ ID NO: 35957 - DNA, 25 bp, Mus musculus
aacgcgctgggaatttgctctaaac

SEQ ID NO: 35958 - DNA, 25 bp, Mus musculus
aacgcgctgggattttgctctaaac

SEQ ID NO: 35959 - DNA, 25 bp, Mus musculus
aacgcggaaggcaggtacaatctct

SEQ ID NO: 35960 - DNA, 25 bp, Mus musculus
aacgcggaaggctggtacaatctct

SEQ ID NO: 35961 - DNA, 25 bp, Mus musculus
aacgcggcgatcaccactttaagaa

SEQ ID NO: 35962 - DNA, 25 bp, Mus musculus
aacgcggcgatctccactttaagaa

SEQ ID NO: 35963 - DNA, 25 bp, Mus musculus
aacgcgggcctccttgtttctcgcg

SEQ ID NO: 35964 - DNA, 25 bp, Mus musculus
aacgcgggcctcgttgtttctcgcg

SEQ ID NO: 35965 - DNA, 25 bp, Mus musculus
aacgcgtccggaacatgggtggcac

SEQ ID NO: 35966 - DNA, 25 bp, Mus musculus
aacgcgtccggatcatgggtggcac

SEQ ID NO: 35967 - DNA, 25 bp, Mus musculus
aacgcgtgtaagcagcttgccatat

SEQ ID NO: 35968 - DNA, 25 bp, Mus musculus
aacgcgtgtaaggagcttgccatat

SEQ ID NO: 35969 - DNA, 25 bp, Mus musculus
aacgcgttcacgaagggaaactgag

SEQ ID NO: 35970 - DNA, 25 bp, Mus musculus
aacgcgttcacgtagggaaactgag

SEQ ID NO: 35971 - DNA, 25 bp, Mus musculus
aacgcgtttctgaggcagtcgtaca

SEQ ID NO: 35972 - DNA, 25 bp, Mus musculus
aacgcgtttctgtggcagtcgtaca

SEQ ID NO: 35973 - DNA, 25 bp, Mus musculus
aacgctaaaggtaaaacggcatctg

SEQ ID NO: 35974 - DNA, 25 bp, Mus musculus
aacgctaaaggttaaacggcatctg

SEQ ID NO: 35975 - DNA, 25 bp, Mus musculus
aacgctacgtctcctgtagttccat

SEQ ID NO: 35976 - DNA, 25 bp, Mus musculus
aacgctacgtctgctgtagttccat

SEQ ID NO: 35977 - DNA, 25 bp, Mus musculus
aacgctactcacaggattttgcaga

SEQ ID NO: 35978 - DNA, 25 bp, Mus musculus
aacgctactcactggattttgcaga

SEQ ID NO: 35979 - DNA, 25 bp, Mus musculus
aacgctactgggatcaggtgacgct

SEQ ID NO: 35980 - DNA, 25 bp, Mus musculus
aacgctactgggttcaggtgacgct

SEQ ID NO: 35981 - DNA, 25 bp, Mus musculus
aacgctacttaaaccaatgggttct

SEQ ID NO: 35982 - DNA, 25 bp, Mus musculus
aacgctacttaatccaatgggttct

SEQ ID NO: 35983 - DNA, 25 bp, Mus musculus
aacgctataagcatatcttctggac

SEQ ID NO: 35984 - DNA, 25 bp, Mus musculus
aacgctataagcttatcttctggac

SEQ ID NO: 35985 - DNA, 25 bp, Mus musculus
aacgctatctttatcaaaattccaa

SEQ ID NO: 35986 - DNA, 25 bp, Mus musculus
aacgctatctttttcaaaattccaa

SEQ ID NO: 35987 - DNA, 25 bp, Mus musculus
aacgctatgaggagccacatcctga

SEQ ID NO: 35988 - DNA, 25 bp, Mus musculus
aacgctatgaggtgccacatcctga

SEQ ID NO: 35989 - DNA, 25 bp, Mus musculus
aacgctcactttctaaggtggctgc

SEQ ID NO: 35990 - DNA, 25 bp, Mus musculus
aacgctcactttgtaaggtggctgc

SEQ ID NO: 35991 - DNA, 25 bp, Mus musculus
aacgctcagagcatacagttttctt

SEQ ID NO: 35992 - DNA, 25 bp, Mus musculus
aacgctcagagcttacagttttctt

SEQ ID NO: 35993 - DNA, 25 bp, Mus musculus
aacgctcaggaaacatcaggtgggt

SEQ ID NO: 35994 - DNA, 25 bp, Mus musculus
aacgctcaggaatcatcaggtgggt

SEQ ID NO: 35995 - DNA, 25 bp, Mus musculus
aacgctcagggcatcctggataagg

SEQ ID NO: 35996 - DNA, 25 bp, Mus musculus
aacgctcagggcttcctggataagg

SEQ ID NO: 35997 - DNA, 25 bp, Mus musculus
aacgctccaaggctcaactctgttt

SEQ ID NO: 35998 - DNA, 25 bp, Mus musculus
aacgctccaagggtcaactctgttt

SEQ ID NO: 35999 - DNA, 25 bp, Mus musculus
aacgctcctgttcctcatcattcta

SEQ ID NO: 36000 - DNA, 25 bp, Mus musculus
aacgctcctgttgctcatcattcta

SEQ ID NO: 36001 - DNA, 25 bp, Mus musculus
aacgctcgtgtgatcaagtggctat

SEQ ID NO: 36002 - DNA, 25 bp, Mus musculus
aacgctcgtgtgttcaagtggctat

SEQ ID NO: 36003 - DNA, 25 bp, Mus musculus
aacgctctaagtcaagttctgcact

SEQ ID NO: 36004 - DNA, 25 bp, Mus musculus
aacgctctaagtgaagttctgcact

SEQ ID NO: 36005 - DNA, 25 bp, Mus musculus
aacgctctatgacgaaagctgttct

SEQ ID NO: 36006 - DNA, 25 bp, Mus musculus
aacgctctatgaggaaagctgttct

SEQ ID NO: 36007 - DNA, 25 bp, Mus musculus
aacgctctcaggcagcactgtggtt

SEQ ID NO: 36008 - DNA, 25 bp, Mus musculus
aacgctctcagggagcactgtggtt

SEQ ID NO: 36009 - DNA, 25 bp, Mus musculus
aacgctcttcagcaggtggttgcac

SEQ ID NO: 36010 - DNA, 25 bp, Mus musculus
aacgctcttcaggaggtggttgcac

SEQ ID NO: 36011 - DNA, 25 bp, Mus musculus
aacgctgacaacaactccgggatgg

SEQ ID NO: 36012 - DNA, 25 bp, Mus musculus
aacgctgacaactactccgggatgg

SEQ ID NO: 36013 - DNA, 25 bp, Mus musculus
aacgctgagagcacgtgtttactaa

SEQ ID NO: 36014 - DNA, 25 bp, Mus musculus
aacgctgagagctcgtgtttactaa

SEQ ID NO: 36015 - DNA, 25 bp, Mus musculus
aacgctgagcttctattagtgttaa

SEQ ID NO: 36016 - DNA, 25 bp, Mus musculus
aacgctgagcttgtattagtgttaa

SEQ ID NO: 36017 - DNA, 25 bp, Mus musculus
aacgctgaggctccacctgagaatc

SEQ ID NO: 36018 - DNA, 25 bp, Mus musculus
aacgctgaggctgcacctgagaatc

SEQ ID NO: 36019 - DNA, 25 bp, Mus musculus
aacgctgcaaccagggtataaatat

SEQ ID NO: 36020 - DNA, 25 bp, Mus musculus
aacgctgcaacctgggtataaatat

SEQ ID NO: 36021 - DNA, 25 bp, Mus musculus
aacgctgcacgtctgtttgtgaaac

SEQ ID NO: 36022 - DNA, 25 bp, Mus musculus
aacgctgcacgtgtgtttgtgaaac

SEQ ID NO: 36023 - DNA, 25 bp, Mus musculus
aacgctgcagaacaacatatgtata

SEQ ID NO: 36024 - DNA, 25 bp, Mus musculus
aacgctgcagaagaacatatgtata

SEQ ID NO: 36025 - DNA, 25 bp, Mus musculus
aacgctgcagagattctcatcctgg

SEQ ID NO: 36026 - DNA, 25 bp, Mus musculus
aacgctgcagagtttctcatcctgg

SEQ ID NO: 36027 - DNA, 25 bp, Mus musculus
aacgctgccatcagcttttcaaaag

SEQ ID NO: 36028 - DNA, 25 bp, Mus musculus
aacgctgccatctgcttttcaaaag

SEQ ID NO: 36029 - DNA, 25 bp, Mus musculus
aacgctgcccttcccgaagtggaaa

SEQ ID NO: 36030 - DNA, 25 bp, Mus musculus
aacgctgcccttgccgaagtggaaa

SEQ ID NO: 36031 - DNA, 25 bp, Mus musculus
aacgctgcggtgagagtttcccggt

SEQ ID NO: 36032 - DNA, 25 bp, Mus musculus
aacgctgcggtgtgagtttcccggt

SEQ ID NO: 36033 - DNA, 25 bp, Mus musculus
aacgctgctcttcaatctgggctat

SEQ ID NO: 36034 - DNA, 25 bp, Mus musculus
aacgctgctcttgaatctgggctat

SEQ ID NO: 36035 - DNA, 25 bp, Mus musculus
aacgctgcttgcatggcattggtgg

SEQ ID NO: 36036 - DNA, 25 bp, Mus musculus
aacgctgcttgcttggcattggtgg

SEQ ID NO: 36037 - DNA, 25 bp, Mus musculus
aacgctggaaagacacctgggaccg

SEQ ID NO: 36038 - DNA, 25 bp, Mus musculus
aacgctggaaagtcacctgggaccg

SEQ ID NO: 36039 - DNA, 25 bp, Mus musculus
aacgctggagaacagctgacttttg

SEQ ID NO: 36040 - DNA, 25 bp, Mus musculus
aacgctggagaagagctgacttttg

SEQ ID NO: 36041 - DNA, 25 bp, Mus musculus
aacgctggctccagcgcaggaaaat

SEQ ID NO: 36042 - DNA, 25 bp, Mus musculus
aacgctggctcctgcgcaggaaaat

SEQ ID NO: 36043 - DNA, 25 bp, Mus musculus
aacgctggctggctttgaagctcac

SEQ ID NO: 36044 - DNA, 25 bp, Mus musculus
aacgctggctgggtttgaagctcac

SEQ ID NO: 36045 - DNA, 25 bp, Mus musculus
aacgctgggatcaaactggcctgca

SEQ ID NO: 36046 - DNA, 25 bp, Mus musculus
aacgctgggatctaactggcctgca

SEQ ID NO: 36047 - DNA, 25 bp, Mus musculus
aacgctggtagcagttctccatgag

SEQ ID NO: 36048 - DNA, 25 bp, Mus musculus
aacgctggtagctgttctccatgag

SEQ ID NO: 36049 - DNA, 25 bp, Mus musculus
aacgctggtctgacttgagagccat

SEQ ID NO: 36050 - DNA, 25 bp, Mus musculus
aacgctggtctgtcttgagagccat

SEQ ID NO: 36051 - DNA, 25 bp, Mus musculus
aacgctgtcgaactacttctcaatt

SEQ ID NO: 36052 - DNA, 25 bp, Mus musculus
aacgctgtcgaagtacttctcaatt

SEQ ID NO: 36053 - DNA, 25 bp, Mus musculus
aacgctgtctttcggcatctctttt

SEQ ID NO: 36054 - DNA, 25 bp, Mus musculus
aacgctgtctttgggcatctctttt

SEQ ID NO: 36055 - DNA, 25 bp, Mus musculus
aacgctgtgcatccaaagtaccaag

SEQ ID NO: 36056 - DNA, 25 bp, Mus musculus
aacgctgtgcatgcaaagtaccaag

SEQ ID NO: 36057 - DNA, 25 bp, Mus musculus
aacgctgtgctcacacattgtctgg

SEQ ID NO: 36058 - DNA, 25 bp, Mus musculus
aacgctgtgctctcacattgtctgg

SEQ ID NO: 36059 - DNA, 25 bp, Mus musculus
aacgctgtgctgagtggtgtcttta

SEQ ID NO: 36060 - DNA, 25 bp, Mus musculus
aacgctgtgctgtgtggtgtcttta

SEQ ID NO: 36061 - DNA, 25 bp, Mus musculus
aacgctgtggagatttttccttgtg

SEQ ID NO: 36062 - DNA, 25 bp, Mus musculus
aacgctgtggagttttttccttgtg

SEQ ID NO: 36063 - DNA, 25 bp, Mus musculus
aacgctgtggttcgagctgtcccct

SEQ ID NO: 36064 - DNA, 25 bp, Mus musculus
aacgctgtggttggagctgtcccct

SEQ ID NO: 36065 - DNA, 25 bp, Mus musculus
aacgctgttcccatgcatcccaaca

SEQ ID NO: 36066 - DNA, 25 bp, Mus musculus
aacgctgttcccttgcatcccaaca

SEQ ID NO: 36067 - DNA, 25 bp, Mus musculus
aacgctgttgggaagcagattacaa

SEQ ID NO: 36068 - DNA, 25 bp, Mus musculus
aacgctgttgggtagcagattacaa

SEQ ID NO: 36069 - DNA, 25 bp, Mus musculus
aacgctgttggtcctagctgtggtt

SEQ ID NO: 36070 - DNA, 25 bp, Mus musculus
aacgctgttggtgctagctgtggtt

SEQ ID NO: 36071 - DNA, 25 bp, Mus musculus
aacgctgtttctcgaagttggccat

SEQ ID NO: 36072 - DNA, 25 bp, Mus musculus
aacgctgtttctggaagttggccat

SEQ ID NO: 36073 - DNA, 25 bp, Mus musculus
aacgctgtttgtctcctgatgatgg

SEQ ID NO: 36074 - DNA, 25 bp, Mus musculus
aacgctgtttgtgtcctgatgatgg

SEQ ID NO: 36075 - DNA, 25 bp, Mus musculus
aacgcttaatgtcatcctcgtcaga

SEQ ID NO: 36076 - DNA, 25 bp, Mus musculus
aacgcttaatgtgatcctcgtcaga

SEQ ID NO: 36077 - DNA, 25 bp, Mus musculus
aacgcttaccctcaagagcatttgt

SEQ ID NO: 36078 - DNA, 25 bp, Mus musculus
aacgcttaccctgaagagcatttgt

SEQ ID NO: 36079 - DNA, 25 bp, Mus musculus
aacgcttcattgcaggcctaatgga

SEQ ID NO: 36080 - DNA, 25 bp, Mus musculus
aacgcttcattggaggcctaatgga

SEQ ID NO: 36081 - DNA, 25 bp, Mus musculus
aacgcttcgagaagttccgggagct

SEQ ID NO: 36082 - DNA, 25 bp, Mus musculus
aacgcttcgagatgttccgggagct

SEQ ID NO: 36083 - DNA, 25 bp, Mus musculus
aacgcttgcattagatgtagggctc

SEQ ID NO: 36084 - DNA, 25 bp, Mus musculus
aacgcttgcatttgatgtagggctc

SEQ ID NO: 36085 - DNA, 25 bp, Mus musculus
aacgcttgcggcaatgggaggccca

SEQ ID NO: 36086 - DNA, 25 bp, Mus musculus
aacgcttgcggctatgggaggccca

SEQ ID NO: 36087 - DNA, 25 bp, Mus musculus
aacgcttgtatcagaatagggacag

SEQ ID NO: 36088 - DNA, 25 bp, Mus musculus
aacgcttgtatctgaatagggacag

SEQ ID NO: 36089 - DNA, 25 bp, Mus musculus
aacgcttgtgtgcatcagttcacca

SEQ ID NO: 36090 - DNA, 25 bp, Mus musculus
aacgcttgtgtggatcagttcacca

SEQ ID NO: 36091 - DNA, 25 bp, Mus musculus
aacgctttaaaaattctgctacaga

SEQ ID NO: 36092 - DNA, 25 bp, Mus musculus
aacgctttaaaatttctgctacaga

SEQ ID NO: 36093 - DNA, 25 bp, Mus musculus
aacgctttagcaatgattccctagg

SEQ ID NO: 36094 - DNA, 25 bp, Mus musculus
aacgctttagcattgattccctagg

SEQ ID NO: 36095 - DNA, 25 bp, Mus musculus
aacgctttagtcatcaggaactttg

SEQ ID NO: 36096 - DNA, 25 bp, Mus musculus
aacgctttagtcttcaggaactttg

SEQ ID NO: 36097 - DNA, 25 bp, Mus musculus
aacgctttcaacaccagccactgtt

SEQ ID NO: 36098 - DNA, 25 bp, Mus musculus
aacgctttcaactccagccactgtt

SEQ ID NO: 36099 - DNA, 25 bp, Mus musculus
aacgctttctaacgagtcgcagtca

SEQ ID NO: 36100 - DNA, 25 bp, Mus musculus
aacgctttctaaggagtcgcagtca

SEQ ID NO: 36101 - DNA, 25 bp, Mus musculus
aacgctttgcagacatcgtcccaac

SEQ ID NO: 36102 - DNA, 25 bp, Mus musculus
aacgctttgcagtcatcgtcccaac

SEQ ID NO: 36103 - DNA, 25 bp, Mus musculus
aacgctttgcatcacggtggcctgt

SEQ ID NO: 36104 - DNA, 25 bp, Mus musculus
aacgctttgcatgacggtggcctgt

SEQ ID NO: 36105 - DNA, 25 bp, Mus musculus
aacgctttgggcatgttcttcagtt

SEQ ID NO: 36106 - DNA, 25 bp, Mus musculus
aacgctttgggcttgttcttcagtt

SEQ ID NO: 36107 - DNA, 25 bp, Mus musculus
aacgctttgtgtaagcatgctgcaa

SEQ ID NO: 36108 - DNA, 25 bp, Mus musculus
aacgctttgtgttagcatgctgcaa

SEQ ID NO: 36109 - DNA, 25 bp, Mus musculus
aacgcttttcttcagttacttgtga

SEQ ID NO: 36110 - DNA, 25 bp, Mus musculus
aacgcttttcttgagttacttgtga

SEQ ID NO: 36111 - DNA, 25 bp, Mus musculus
aacggaaagtctaccagcacagaga

SEQ ID NO: 36112 - DNA, 25 bp, Mus musculus
aacggaaagtcttccagcacagaga

SEQ ID NO: 36113 - DNA, 25 bp, Mus musculus
aacggaaatcggacctgtcgtcttg

SEQ ID NO: 36114 - DNA, 25 bp, Mus musculus
aacggaaatcggtcctgtcgtcttg

SEQ ID NO: 36115 - DNA, 25 bp, Mus musculus
aacggaacactgatgttttcctgtg

SEQ ID NO: 36116 - DNA, 25 bp, Mus musculus
aacggaacactgttgttttcctgtg

SEQ ID NO: 36117 - DNA, 25 bp, Mus musculus
aacggaaccagtctgtcaaggccct

SEQ ID NO: 36118 - DNA, 25 bp, Mus musculus
aacggaaccagtgtgtcaaggccct

SEQ ID NO: 36119 - DNA, 25 bp, Mus musculus
aacggaactgctacttcgcgctcag

SEQ ID NO: 36120 - DNA, 25 bp, Mus musculus
aacggaactgcttcttcgcgctcag

SEQ ID NO: 36121 - DNA, 25 bp, Mus musculus
aacggaagactgagatgacccctat

SEQ ID NO: 36122 - DNA, 25 bp, Mus musculus
aacggaagactgtgatgacccctat

SEQ ID NO: 36123 - DNA, 25 bp, Mus musculus
aacggaagctggagacatctgcctc

SEQ ID NO: 36124 - DNA, 25 bp, Mus musculus
aacggaagctggtgacatctgcctc

SEQ ID NO: 36125 - DNA, 25 bp, Mus musculus
aacggaaggtcaactgcctgctcaa

SEQ ID NO: 36126 - DNA, 25 bp, Mus musculus
aacggaaggtcatctgcctgctcaa

SEQ ID NO: 36127 - DNA, 25 bp, Mus musculus
aacggaagtgcaacacggccacgtg

SEQ ID NO: 36128 - DNA, 25 bp, Mus musculus
aacggaagtgcatcacggccacgtg

SEQ ID NO: 36129 - DNA, 25 bp, Mus musculus
aacggaatcatgagcggtgaggttt

SEQ ID NO: 36130 - DNA, 25 bp, Mus musculus
aacggaatcatgtgcggtgaggttt

SEQ ID NO: 36131 - DNA, 25 bp, Mus musculus
aacggaatgagtacagccagccctg

SEQ ID NO: 36132 - DNA, 25 bp, Mus musculus
aacggaatgagttcagccagccctg

SEQ ID NO: 36133 - DNA, 25 bp, Mus musculus
aacggaatgccaaggtccaagccag

SEQ ID NO: 36134 - DNA, 25 bp, Mus musculus
aacggaatgccatggtccaagccag

SEQ ID NO: 36135 - DNA, 25 bp, Mus musculus
aacggaattgtaaaagggctctgta

SEQ ID NO: 36136 - DNA, 25 bp, Mus musculus
aacggaattgtataagggctctgta

SEQ ID NO: 36137 - DNA, 25 bp, Mus musculus
aacggacacactagccagattttct

SEQ ID NO: 36138 - DNA, 25 bp, Mus musculus
aacggacacacttgccagattttct

SEQ ID NO: 36139 - DNA, 25 bp, Mus musculus
aacggacagcatcaaatgctgagca

SEQ ID NO: 36140 - DNA, 25 bp, Mus musculus
aacggacagcatgaaatgctgagca

SEQ ID NO: 36141 - DNA, 25 bp, Mus musculus
aacggacataacctgggaagagcca

SEQ ID NO: 36142 - DNA, 25 bp, Mus musculus
aacggacataacgtgggaagagcca

SEQ ID NO: 36143 - DNA, 25 bp, Mus musculus
aacggacatccacgccatcttgcag

SEQ ID NO: 36144 - DNA, 25 bp, Mus musculus
aacggacatccaggccatcttgcag

SEQ ID NO: 36145 - DNA, 25 bp, Mus musculus
aacggacccatgcactatgtctaga

SEQ ID NO: 36146 - DNA, 25 bp, Mus musculus
aacggacccatggactatgtctaga

SEQ ID NO: 36147 - DNA, 25 bp, Mus musculus
aacggacggtggacacctggacacg

SEQ ID NO: 36148 - DNA, 25 bp, Mus musculus
aacggacggtggtcacctggacacg

SEQ ID NO: 36149 - DNA, 25 bp, Mus musculus
aacggacgtgctaggatctggatca

SEQ ID NO: 36150 - DNA, 25 bp, Mus musculus
aacggacgtgcttggatctggatca

SEQ ID NO: 36151 - DNA, 25 bp, Mus musculus
aacggactacatagttggacctcat

SEQ ID NO: 36152 - DNA, 25 bp, Mus musculus
aacggactacattgttggacctcat

SEQ ID NO: 36153 - DNA, 25 bp, Mus musculus
aacggactcaggctgggtcttccag

SEQ ID NO: 36154 - DNA, 25 bp, Mus musculus
aacggactcagggtgggtcttccag

SEQ ID NO: 36155 - DNA, 25 bp, Mus musculus
aacggactcctgagccccagagata

SEQ ID NO: 36156 - DNA, 25 bp, Mus musculus
aacggactcctgtgccccagagata

SEQ ID NO: 36157 - DNA, 25 bp, Mus musculus
aacggactgtgtaactatgactcaa

SEQ ID NO: 36158 - DNA, 25 bp, Mus musculus
aacggactgtgttactatgactcaa

SEQ ID NO: 36159 - DNA, 25 bp, Mus musculus
aacggacttatgctattttatactc

SEQ ID NO: 36160 - DNA, 25 bp, Mus musculus
aacggacttatggtattttatactc

SEQ ID NO: 36161 - DNA, 25 bp, Mus musculus
aacggacttccactgagcgatatga

SEQ ID NO: 36162 - DNA, 25 bp, Mus musculus
aacggacttccagtgagcgatatga

SEQ ID NO: 36163 - DNA, 25 bp, Mus musculus
aacggacttcttcaggcttatgcag

SEQ ID NO: 36164 - DNA, 25 bp, Mus musculus
aacggacttcttgaggcttatgcag

SEQ ID NO: 36165 - DNA, 25 bp, Mus musculus
aacggagaaaagctcgctgttcccg

SEQ ID NO: 36166 - DNA, 25 bp, Mus musculus
aacggagaaaaggtcgctgttcccg

SEQ ID NO: 36167 - DNA, 25 bp, Mus musculus
aacggagaagaccagcagacagcct

SEQ ID NO: 36168 - DNA, 25 bp, Mus musculus
aacggagaagacgagcagacagcct

SEQ ID NO: 36169 - DNA, 25 bp, Mus musculus
aacggagaagccagtttcataaatc

SEQ ID NO: 36170 - DNA, 25 bp, Mus musculus
aacggagaagccctggacatcattt

SEQ ID NO: 36171 - DNA, 25 bp, Mus musculus
aacggagaagccgtggacatcattt

SEQ ID NO: 36172 - DNA, 25 bp, Mus musculus
aacggagaagcctgtttcataaatc

SEQ ID NO: 36173 - DNA, 25 bp, Mus musculus
aacggagaccatacctcgtcagaaa

SEQ ID NO: 36174 - DNA, 25 bp, Mus musculus
aacggagaccattcctcgtcagaaa

SEQ ID NO: 36175 - DNA, 25 bp, Mus musculus
aacggagaccctaaacttgtggcat

SEQ ID NO: 36176 - DNA, 25 bp, Mus musculus
aacggagacccttaacttgtggcat

SEQ ID NO: 36177 - DNA, 25 bp, Mus musculus
aacggagactgtccatgcatctgca

SEQ ID NO: 36178 - DNA, 25 bp, Mus musculus
aacggagactgtgcatgcatctgca

SEQ ID NO: 36179 - DNA, 25 bp, Mus musculus
aacggagagaatccgctctgtttcc

SEQ ID NO: 36180 - DNA, 25 bp, Mus musculus
aacggagagaatgcgctctgtttcc

SEQ ID NO: 36181 - DNA, 25 bp, Mus musculus
aacggagagattctcctcgcccctt

SEQ ID NO: 36182 - DNA, 25 bp, Mus musculus
aacggagagattgtcctcgcccctt

SEQ ID NO: 36183 - DNA, 25 bp, Mus musculus
aacggagatccccagatgatgagct

SEQ ID NO: 36184 - DNA, 25 bp, Mus musculus
aacggagatcccgagatgatgagct

SEQ ID NO: 36185 - DNA, 25 bp, Mus musculus
aacggagatgctaatatttcccaag

SEQ ID NO: 36186 - DNA, 25 bp, Mus musculus
aacggagatgcttatatttcccaag

SEQ ID NO: 36187 - DNA, 25 bp, Mus musculus
aacggagatggcacaacgtgccggc

SEQ ID NO: 36188 - DNA, 25 bp, Mus musculus
aacggagatggctcaacgtgccggc

SEQ ID NO: 36189 - DNA, 25 bp, Mus musculus
aacggagcacccagttacatcagcg

SEQ ID NO: 36190 - DNA, 25 bp, Mus musculus
aacggagcaccctgttacatcagcg

SEQ ID NO: 36191 - DNA, 25 bp, Mus musculus
aacggagccgatacctgatgttcac

SEQ ID NO: 36192 - DNA, 25 bp, Mus musculus
aacggagccgattcctgatgttcac

SEQ ID NO: 36193 - DNA, 25 bp, Mus musculus
aacggagctcagatgacagactgct

SEQ ID NO: 36194 - DNA, 25 bp, Mus musculus
aacggagctcagttgacagactgct

SEQ ID NO: 36195 - DNA, 25 bp, Mus musculus
aacggaggacagcagccttcctggt

SEQ ID NO: 36196 - DNA, 25 bp, Mus musculus
aacggaggacagctgggtcccaact

SEQ ID NO: 36197 - DNA, 25 bp, Mus musculus
aacggaggacaggagccttcctggt

SEQ ID NO: 36198 - DNA, 25 bp, Mus musculus
aacggaggacaggtgggtcccaact

SEQ ID NO: 36199 - DNA, 25 bp, Mus musculus
aacggaggtcagcactgctgcagat

SEQ ID NO: 36200 - DNA, 25 bp, Mus musculus
aacggaggtcaggactgctgcagat

SEQ ID NO: 36201 - DNA, 25 bp, Mus musculus
aacggagtcatactttttcgatgaa

SEQ ID NO: 36202 - DNA, 25 bp, Mus musculus
aacggagtcatagtttttcgatgaa

SEQ ID NO: 36203 - DNA, 25 bp, Mus musculus
aacggagtggcaagccttcatcgat

SEQ ID NO: 36204 - DNA, 25 bp, Mus musculus
aacggagtggcatgccttcatcgat

SEQ ID NO: 36205 - DNA, 25 bp, Mus musculus
aacggagtgtgaagctcagttcccc

SEQ ID NO: 36206 - DNA, 25 bp, Mus musculus
aacggagtgtgatgctcagttcccc

SEQ ID NO: 36207 - DNA, 25 bp, Mus musculus
aacggatcaagaatgccgccaccaa

SEQ ID NO: 36208 - DNA, 25 bp, Mus musculus
aacggatcaagattgccgccaccaa

SEQ ID NO: 36209 - DNA, 25 bp, Mus musculus
aacggatcagccaataagtgactaa

SEQ ID NO: 36210 - DNA, 25 bp, Mus musculus
aacggatcagcctataagtgactaa

SEQ ID NO: 36211 - DNA, 25 bp, Mus musculus
aacggatcccaactccaaactgata

SEQ ID NO: 36212 - DNA, 25 bp, Mus musculus
aacggatcccaagtccaaactgata

SEQ ID NO: 36213 - DNA, 25 bp, Mus musculus
aacggatcttgacaggcagcgcttc

SEQ ID NO: 36214 - DNA, 25 bp, Mus musculus
aacggatcttgagaggcagcgcttc

SEQ ID NO: 36215 - DNA, 25 bp, Mus musculus
aacggatgacatataggccatcttg

SEQ ID NO: 36216 - DNA, 25 bp, Mus musculus
aacggatgacatttaggccatcttg

SEQ ID NO: 36217 - DNA, 25 bp, Mus musculus
aacggatgagacaccacacatggaa

SEQ ID NO: 36218 - DNA, 25 bp, Mus musculus
aacggatgagactccacacatggaa

SEQ ID NO: 36219 - DNA, 25 bp, Mus musculus
aacggatgcacacgctgctggccaa

SEQ ID NO: 36220 - DNA, 25 bp, Mus musculus
aacggatgcacaggctgctggccaa

SEQ ID NO: 36221 - DNA, 25 bp, Mus musculus
aacggatgtctcaggagaaaccata

SEQ ID NO: 36222 - DNA, 25 bp, Mus musculus
aacggatgtctctggagaaaccata

SEQ ID NO: 36223 - DNA, 25 bp, Mus musculus
aacggatgtttgagtcaccccatat

SEQ ID NO: 36224 - DNA, 25 bp, Mus musculus
aacggatgtttgtgtcaccccatat

SEQ ID NO: 36225 - DNA, 25 bp, Mus musculus
aacggattcggaacagatccaccct

SEQ ID NO: 36226 - DNA, 25 bp, Mus musculus
aacggattcggatcagatccaccct

SEQ ID NO: 36227 - DNA, 25 bp, Mus musculus
aacggatttgataccctcagtgaaa

SEQ ID NO: 36228 - DNA, 25 bp, Mus musculus
aacggatttgattccctcagtgaaa

SEQ ID NO: 36229 - DNA, 25 bp, Mus musculus
aacggcaacaacatcatctctgaga

SEQ ID NO: 36230 - DNA, 25 bp, Mus musculus
aacggcaacaacttcatctctgaga

SEQ ID NO: 36231 - DNA, 25 bp, Mus musculus
aacggcaactcgcaccctcgtggat

SEQ ID NO: 36232 - DNA, 25 bp, Mus musculus
aacggcaactcggaccctcgtggat

SEQ ID NO: 36233 - DNA, 25 bp, Mus musculus
aacggcaatgagcagcactgtccct

SEQ ID NO: 36234 - DNA, 25 bp, Mus musculus
aacggcaatgaggagcactgtccct

SEQ ID NO: 36235 - DNA, 25 bp, Mus musculus
aacggcacagtgacttggttagtat

SEQ ID NO: 36236 - DNA, 25 bp, Mus musculus
aacggcacagtgtcttggttagtat

SEQ ID NO: 36237 - DNA, 25 bp, Mus musculus
aacggcaccaagatacctgtcagaa

SEQ ID NO: 36238 - DNA, 25 bp, Mus musculus
aacggcaccaagttacctgtcagaa

SEQ ID NO: 36239 - DNA, 25 bp, Mus musculus
aacggcacctaccagttcttgtata

SEQ ID NO: 36240 - DNA, 25 bp, Mus musculus
aacggcacctacgagttcttgtata

SEQ ID NO: 36241 - DNA, 25 bp, Mus musculus
aacggcacggtgatggtcagcccta

SEQ ID NO: 36242 - DNA, 25 bp, Mus musculus
aacggcacggtgttggtcagcccta

SEQ ID NO: 36243 - DNA, 25 bp, Mus musculus
aacggcactacaatcgaaggacatg

SEQ ID NO: 36244 - DNA, 25 bp, Mus musculus
aacggcactacattcgaaggacatg

SEQ ID NO: 36245 - DNA, 25 bp, Mus musculus
aacggcagaactctaaccgctgtgt

SEQ ID NO: 36246 - DNA, 25 bp, Mus musculus
aacggcagaactgtaaccgctgtgt

SEQ ID NO: 36247 - DNA, 25 bp, Mus musculus
aacggcagagtgacagttaaatcgc

SEQ ID NO: 36248 - DNA, 25 bp, Mus musculus
aacggcagagtgtcagttaaatcgc

SEQ ID NO: 36249 - DNA, 25 bp, Mus musculus
aacggcagcaggaacacgctttgca

SEQ ID NO: 36250 - DNA, 25 bp, Mus musculus
aacggcagcaggtacacgctttgca

SEQ ID NO: 36251 - DNA, 25 bp, Mus musculus
aacggcagcatcagtcccaaggcag

SEQ ID NO: 36252 - DNA, 25 bp, Mus musculus
aacggcagcatctgtcccaaggcag

SEQ ID NO: 36253 - DNA, 25 bp, Mus musculus
aacggcagcattaataaccctgaag

SEQ ID NO: 36254 - DNA, 25 bp, Mus musculus
aacggcagcatttataaccctgaag

SEQ ID NO: 36255 - DNA, 25 bp, Mus musculus
aacggcaggcagagatcatggacat

SEQ ID NO: 36256 - DNA, 25 bp, Mus musculus
aacggcaggcagtgatcatggacat

SEQ ID NO: 36257 - DNA, 25 bp, Mus musculus
aacggcaggcccattgtggccagaa

SEQ ID NO: 36258 - DNA, 25 bp, Mus musculus
aacggcaggccctttgtggccagaa

SEQ ID NO: 36259 - DNA, 25 bp, Mus musculus
aacggcatcaatagagtgttcagct

SEQ ID NO: 36260 - DNA, 25 bp, Mus musculus
aacggcatcaattgagtgttcagct

SEQ ID NO: 36261 - DNA, 25 bp, Mus musculus
aacggcatcccactcacaagcagag

SEQ ID NO: 36262 - DNA, 25 bp, Mus musculus
aacggcatcccagtcacaagcagag

SEQ ID NO: 36263 - DNA, 25 bp, Mus musculus
aacggcatgcctccggggctttcca

SEQ ID NO: 36264 - DNA, 25 bp, Mus musculus
aacggcatgcctgcggggctttcca

SEQ ID NO: 36265 - DNA, 25 bp, Mus musculus
aacggcatgtcaactgccacgtaag

SEQ ID NO: 36266 - DNA, 25 bp, Mus musculus
aacggcatgtcatctgccacgtaag

SEQ ID NO: 36267 - DNA, 25 bp, Mus musculus
aacggcatttgcagcgccgggaact

SEQ ID NO: 36268 - DNA, 25 bp, Mus musculus
aacggcatttgctgcgccgggaact

SEQ ID NO: 36269 - DNA, 25 bp, Mus musculus
aacggccaagctagtggttctgagc

SEQ ID NO: 36270 - DNA, 25 bp, Mus musculus
aacggccaagcttgtggttctgagc

SEQ ID NO: 36271 - DNA, 25 bp, Mus musculus
aacggccaaggcagctcgaaatgac

SEQ ID NO: 36272 - DNA, 25 bp, Mus musculus
aacggccaaggctgctcgaaatgac

SEQ ID NO: 36273 - DNA, 25 bp, Mus musculus
aacggccacgtgactgtctttgagt

SEQ ID NO: 36274 - DNA, 25 bp, Mus musculus
aacggccacgtgtctgtctttgagt

SEQ ID NO: 36275 - DNA, 25 bp, Mus musculus
aacggccagtttcaacattgtacaa

SEQ ID NO: 36276 - DNA, 25 bp, Mus musculus
aacggccagtttgaacattgtacaa

SEQ ID NO: 36277 - DNA, 25 bp, Mus musculus
aacggcccagagaaggatgcaagaa

SEQ ID NO: 36278 - DNA, 25 bp, Mus musculus
aacggcccagagtaggatgcaagaa

SEQ ID NO: 36279 - DNA, 25 bp, Mus musculus
aacggcccaggcaatgtcggtacag

SEQ ID NO: 36280 - DNA, 25 bp, Mus musculus
aacggcccaggctatgtcggtacag

SEQ ID NO: 36281 - DNA, 25 bp, Mus musculus
aacggccgatctctcatcatgtgaa

SEQ ID NO: 36282 - DNA, 25 bp, Mus musculus
aacggccgatctgtcatcatgtgaa

SEQ ID NO: 36283 - DNA, 25 bp, Mus musculus
aacggccggcagaagtacagcgctt

SEQ ID NO: 36284 - DNA, 25 bp, Mus musculus
aacggccggcagctagcttaggatc

SEQ ID NO: 36285 - DNA, 25 bp, Mus musculus
aacggccggcaggtagcttaggatc

SEQ ID NO: 36286 - DNA, 25 bp, Mus musculus
aacggccggcagtagtacagcgctt

SEQ ID NO: 36287 - DNA, 25 bp, Mus musculus
aacggcctcgagaacactgaagtga

SEQ ID NO: 36288 - DNA, 25 bp, Mus musculus
aacggcctcgagtacactgaagtga

SEQ ID NO: 36289 - DNA, 25 bp, Mus musculus
aacggcctctccagaatggattctt

SEQ ID NO: 36290 - DNA, 25 bp, Mus musculus
aacggcctctcctgaatggattctt

SEQ ID NO: 36291 - DNA, 25 bp, Mus musculus
aacggcctgctgagggatgatctgt

SEQ ID NO: 36292 - DNA, 25 bp, Mus musculus
aacggcctgctgtgggatgatctgt

SEQ ID NO: 36293 - DNA, 25 bp, Mus musculus
aacggcctggtgcacgcaagtcgat

SEQ ID NO: 36294 - DNA, 25 bp, Mus musculus
aacggcctggtggacgcaagtcgat

SEQ ID NO: 36295 - DNA, 25 bp, Mus musculus
aacggcgaaggacaccaggcatttc

SEQ ID NO: 36296 - DNA, 25 bp, Mus musculus
aacggcgaaggagaccaggcatttc

SEQ ID NO: 36297 - DNA, 25 bp, Mus musculus
aacggcgacgcaagcatgacctgaa

SEQ ID NO: 36298 - DNA, 25 bp, Mus musculus
aacggcgacgcatgcatgacctgaa

SEQ ID NO: 36299 - DNA, 25 bp, Mus musculus
aacggcgagactacggacttgtggc

SEQ ID NO: 36300 - DNA, 25 bp, Mus musculus
aacggcgagacttcggacttgtggc

SEQ ID NO: 36301 - DNA, 25 bp, Mus musculus
aacggcgcctacacgctcgtgcagg

SEQ ID NO: 36302 - DNA, 25 bp, Mus musculus
aacggcgcctactcgctcgtgcagg

SEQ ID NO: 36303 - DNA, 25 bp, Mus musculus
aacggcgcggccaacaagaagatga

SEQ ID NO: 36304 - DNA, 25 bp, Mus musculus
aacggcgcggcctacaagaagatga

SEQ ID NO: 36305 - DNA, 25 bp, Mus musculus
aacggcgggacacaatctgctgcca

SEQ ID NO: 36306 - DNA, 25 bp, Mus musculus
aacggcgggacagaatctgctgcca

SEQ ID NO: 36307 - DNA, 25 bp, Mus musculus
aacggcgggccaatcagggatgtcc

SEQ ID NO: 36308 - DNA, 25 bp, Mus musculus
aacggcgggccattcagggatgtcc

SEQ ID NO: 36309 - DNA, 25 bp, Mus musculus
aacggcgtcaggactacggttggca

SEQ ID NO: 36310 - DNA, 25 bp, Mus musculus
aacggcgtcaggtctacggttggca

SEQ ID NO: 36311 - DNA, 25 bp, Mus musculus
aacggcgtttccaggccagcaataa

SEQ ID NO: 36312 - DNA, 25 bp, Mus musculus
aacggcgtttcctggccagcaataa

SEQ ID NO: 36313 - DNA, 25 bp, Mus musculus
aacggctacagcaaggcaggcatcc

SEQ ID NO: 36314 - DNA, 25 bp, Mus musculus
aacggctacagctaggcaggcatcc

SEQ ID NO: 36315 - DNA, 25 bp, Mus musculus
aacggctacctactggtgctgcctg

SEQ ID NO: 36316 - DNA, 25 bp, Mus musculus
aacggctacctagtggtgctgcctg

SEQ ID NO: 36317 - DNA, 25 bp, Mus musculus
aacggctacgttcagcgaaacctgt

SEQ ID NO: 36318 - DNA, 25 bp, Mus musculus
aacggctacgttgagcgaaacctgt

SEQ ID NO: 36319 - DNA, 25 bp, Mus musculus
aacggctatgcaagtttccatgtgt

SEQ ID NO: 36320 - DNA, 25 bp, Mus musculus
aacggctatgcatgtttccatgtgt

SEQ ID NO: 36321 - DNA, 25 bp, Mus musculus
aacggctcgtaacaggttgtccaat

SEQ ID NO: 36322 - DNA, 25 bp, Mus musculus
aacggctcgtaagaggttgtccaat

SEQ ID NO: 36323 - DNA, 25 bp, Mus musculus
aacggctctagtcttgatactttca

SEQ ID NO: 36324 - DNA, 25 bp, Mus musculus
aacggctctagtgttgatactttca

SEQ ID NO: 36325 - DNA, 25 bp, Mus musculus
aacggctctcggaggcccctcagat

SEQ ID NO: 36326 - DNA, 25 bp, Mus musculus
aacggctctcggtggcccctcagat

SEQ ID NO: 36327 - DNA, 25 bp, Mus musculus
aacggctgggtacaggactattgag

SEQ ID NO: 36328 - DNA, 25 bp, Mus musculus
aacggctgggtagaggactattgag

SEQ ID NO: 36329 - DNA, 25 bp, Mus musculus
aacggctggttcagagcccaaattc

SEQ ID NO: 36330 - DNA, 25 bp, Mus musculus
aacggctggttctgagcccaaattc

SEQ ID NO: 36331 - DNA, 25 bp, Mus musculus
aacggctgtgcgctgaacttcttca

SEQ ID NO: 36332 - DNA, 25 bp, Mus musculus
aacggctgtgcggtgaacttcttca

SEQ ID NO: 36333 - DNA, 25 bp, Mus musculus
aacggctgtggcatgttgagatgac

SEQ ID NO: 36334 - DNA, 25 bp, Mus musculus
aacggctgtggcttgttgagatgac

SEQ ID NO: 36335 - DNA, 25 bp, Mus musculus
aacggcttcagccacaatgggatta

SEQ ID NO: 36336 - DNA, 25 bp, Mus musculus
aacggcttcagcgacaatgggatta

SEQ ID NO: 36337 - DNA, 25 bp, Mus musculus
aacggcttcatcagcgggtggcctg

SEQ ID NO: 36338 - DNA, 25 bp, Mus musculus
aacggcttcatctgcgggtggcctg

SEQ ID NO: 36339 - DNA, 25 bp, Mus musculus
aacggcttccagataggcatgaaga

SEQ ID NO: 36340 - DNA, 25 bp, Mus musculus
aacggcttccagttaggcatgaaga

SEQ ID NO: 36341 - DNA, 25 bp, Mus musculus
aacggcttctgaagtgctccgagaa

SEQ ID NO: 36342 - DNA, 25 bp, Mus musculus
aacggcttctgatgtgctccgagaa

SEQ ID NO: 36343 - DNA, 25 bp, Mus musculus
aacggcttctgcaggtgatatgggc

SEQ ID NO: 36344 - DNA, 25 bp, Mus musculus
aacggcttctgctggtgatatgggc

SEQ ID NO: 36345 - DNA, 25 bp, Mus musculus
aacggcttgagcctttggaagctgc

SEQ ID NO: 36346 - DNA, 25 bp, Mus musculus
aacggcttgagcgtttggaagctgc

SEQ ID NO: 36347 - DNA, 25 bp, Mus musculus
aacggcttgcatcatttggtgcatc

SEQ ID NO: 36348 - DNA, 25 bp, Mus musculus
aacggcttgcatgatttggtgcatc

SEQ ID NO: 36349 - DNA, 25 bp, Mus musculus
aacggctttcgaaaactagggcgat

SEQ ID NO: 36350 - DNA, 25 bp, Mus musculus
aacggctttcgataactagggcgat

SEQ ID NO: 36351 - DNA, 25 bp, Mus musculus
aacgggaacagcctgcaagcgatat

SEQ ID NO: 36352 - DNA, 25 bp, Mus musculus
aacgggaacagcgtgcaagcgatat

SEQ ID NO: 36353 - DNA, 25 bp, Mus musculus
aacgggaaccccatggcaataatgg

SEQ ID NO: 36354 - DNA, 25 bp, Mus musculus
aacgggaaccccttggcaataatgg

SEQ ID NO: 36355 - DNA, 25 bp, Mus musculus
aacgggacatcgaacgcgaggctca

SEQ ID NO: 36356 - DNA, 25 bp, Mus musculus
aacgggacatcgtacgcgaggctca

SEQ ID NO: 36357 - DNA, 25 bp, Mus musculus
aacgggacctgcctgacgtgggtga

SEQ ID NO: 36358 - DNA, 25 bp, Mus musculus
aacgggacctgcgtgacgtgggtga

SEQ ID NO: 36359 - DNA, 25 bp, Mus musculus
aacgggactctaacttcaactcaac

SEQ ID NO: 36360 - DNA, 25 bp, Mus musculus
aacgggactctatcttcaactcaac

SEQ ID NO: 36361 - DNA, 25 bp, Mus musculus
aacgggacttctcactcattgatga

SEQ ID NO: 36362 - DNA, 25 bp, Mus musculus
aacgggacttctgactcattgatga

SEQ ID NO: 36363 - DNA, 25 bp, Mus musculus
aacgggagcaacagcagcggaagca

SEQ ID NO: 36364 - DNA, 25 bp, Mus musculus
aacgggagcaactgcagcggaagca

SEQ ID NO: 36365 - DNA, 25 bp, Mus musculus
aacgggaggcctacatggagcagtt

SEQ ID NO: 36366 - DNA, 25 bp, Mus musculus
aacgggaggccttcatggagcagtt

SEQ ID NO: 36367 - DNA, 25 bp, Mus musculus
aacgggagtatcagcttcagtacaa

SEQ ID NO: 36368 - DNA, 25 bp, Mus musculus
aacgggagtatctgcttcagtacaa

SEQ ID NO: 36369 - DNA, 25 bp, Mus musculus
aacgggagtcttattctctgaggca

SEQ ID NO: 36370 - DNA, 25 bp, Mus musculus
aacgggagtctttttctctgaggca

SEQ ID NO: 36371 - DNA, 25 bp, Mus musculus
aacgggatggaaacagctcacttat

SEQ ID NO: 36372 - DNA, 25 bp, Mus musculus
aacgggatggaatcagctcacttat

SEQ ID NO: 36373 - DNA, 25 bp, Mus musculus
aacgggatttgaactaagcgaatgc

SEQ ID NO: 36374 - DNA, 25 bp, Mus musculus
aacgggatttgatctaagcgaatgc

SEQ ID NO: 36375 - DNA, 25 bp, Mus musculus
aacgggcacgggagaagcgagcaca

SEQ ID NO: 36376 - DNA, 25 bp, Mus musculus
aacgggcacgggtgaagcgagcaca

SEQ ID NO: 36377 - DNA, 25 bp, Mus musculus
aacgggcatcagacagactcaagaa

SEQ ID NO: 36378 - DNA, 25 bp, Mus musculus
aacgggcatcagtcagactcaagaa

SEQ ID NO: 36379 - DNA, 25 bp, Mus musculus
aacgggccggccacatcttgagaga

SEQ ID NO: 36380 - DNA, 25 bp, Mus musculus
aacgggccggcctcatcttgagaga

SEQ ID NO: 36381 - DNA, 25 bp, Mus musculus
aacgggcctccaagaagcaattcaa

SEQ ID NO: 36382 - DNA, 25 bp, Mus musculus
aacgggcctccatgaagcaattcaa

SEQ ID NO: 36383 - DNA, 25 bp, Mus musculus
aacgggcctttgaagatgttactag

SEQ ID NO: 36384 - DNA, 25 bp, Mus musculus
aacgggcctttgtagatgttactag

SEQ ID NO: 36385 - DNA, 25 bp, Mus musculus
aacgggcgcttacttggaatcatca

SEQ ID NO: 36386 - DNA, 25 bp, Mus musculus
aacgggcgcttagttggaatcatca

SEQ ID NO: 36387 - DNA, 25 bp, Mus musculus
aacgggctaggcactgtatcttata

SEQ ID NO: 36388 - DNA, 25 bp, Mus musculus
aacgggctaggctctgtatcttata

SEQ ID NO: 36389 - DNA, 25 bp, Mus musculus
aacgggctgcaaaaatttctcacaa

SEQ ID NO: 36390 - DNA, 25 bp, Mus musculus
aacgggctgcaataatttctcacaa

SEQ ID NO: 36391 - DNA, 25 bp, Mus musculus
aacgggctgggcatctactgtggca

SEQ ID NO: 36392 - DNA, 25 bp, Mus musculus
aacgggctgggcttctactgtggca

SEQ ID NO: 36393 - DNA, 25 bp, Mus musculus
aacgggcttcagatgactcagtgct

SEQ ID NO: 36394 - DNA, 25 bp, Mus musculus
aacgggcttcagttgactcagtgct

SEQ ID NO: 36395 - DNA, 25 bp, Mus musculus
aacgggtatggcaaggactttgtga

SEQ ID NO: 36396 - DNA, 25 bp, Mus musculus
aacgggtatggctaggactttgtga

SEQ ID NO: 36397 - DNA, 25 bp, Mus musculus
aacgggtatgtgattgccatttgct

SEQ ID NO: 36398 - DNA, 25 bp, Mus musculus
aacgggtatgtgtttgccatttgct

SEQ ID NO: 36399 - DNA, 25 bp, Mus musculus
aacgggtccttgctggacagactgt

SEQ ID NO: 36400 - DNA, 25 bp, Mus musculus
aacgggtccttggtggacagactgt

SEQ ID NO: 36401 - DNA, 25 bp, Mus musculus
aacgggtgccagctttcagaaggcc

SEQ ID NO: 36402 - DNA, 25 bp, Mus musculus
aacgggtgccaggtttcagaaggcc

SEQ ID NO: 36403 - DNA, 25 bp, Mus musculus
aacgggtgtgtgataaactcctgat

SEQ ID NO: 36404 - DNA, 25 bp, Mus musculus
aacgggtgtgtgttaaactcctgat

SEQ ID NO: 36405 - DNA, 25 bp, Mus musculus
aacgggttcatgaggcttttgccca

SEQ ID NO: 36406 - DNA, 25 bp, Mus musculus
aacgggttcatgtggcttttgccca

SEQ ID NO: 36407 - DNA, 25 bp, Mus musculus
aacgggttcccgaagcagacagcgg

SEQ ID NO: 36408 - DNA, 25 bp, Mus musculus
aacgggttcccgtagcagacagcgg

SEQ ID NO: 36409 - DNA, 25 bp, Mus musculus
aacggtaaatgcacgcccaaggtgg

SEQ ID NO: 36410 - DNA, 25 bp, Mus musculus
aacggtaaatgctcgcccaaggtgg

SEQ ID NO: 36411 - DNA, 25 bp, Mus musculus
aacggtacagcaccaagtcctggaa

SEQ ID NO: 36412 - DNA, 25 bp, Mus musculus
aacggtacagcagcaagtcctggaa

SEQ ID NO: 36413 - DNA, 25 bp, Mus musculus
aacggtaccgcacaccattcaaact

SEQ ID NO: 36414 - DNA, 25 bp, Mus musculus
aacggtaccgcagaccattcaaact

SEQ ID NO: 36415 - DNA, 25 bp, Mus musculus
aacggtaccggtctcaggctcctcg

SEQ ID NO: 36416 - DNA, 25 bp, Mus musculus
aacggtaccggtgtcaggctcctcg

SEQ ID NO: 36417 - DNA, 25 bp, Mus musculus
aacggtagtgcgagtgcaccaccaa

SEQ ID NO: 36418 - DNA, 25 bp, Mus musculus
aacggtagtgcgtgtgcaccaccaa

SEQ ID NO: 36419 - DNA, 25 bp, Mus musculus
aacggtataggtcgcttcatatgtc

SEQ ID NO: 36420 - DNA, 25 bp, Mus musculus
aacggtataggtggcttcatatgtc

SEQ ID NO: 36421 - DNA, 25 bp, Mus musculus
aacggtatggcgactgtcccgaggc

SEQ ID NO: 36422 - DNA, 25 bp, Mus musculus
aacggtatggcgtctgtcccgaggc

SEQ ID NO: 36423 - DNA, 25 bp, Mus musculus
aacggtatgggacccgtaatgacga

SEQ ID NO: 36424 - DNA, 25 bp, Mus musculus
aacggtatgggagccgtaatgacga

SEQ ID NO: 36425 - DNA, 25 bp, Mus musculus
aacggtatgtttagaagttcgagtg

SEQ ID NO: 36426 - DNA, 25 bp, Mus musculus
aacggtatgttttgaagttcgagtg

SEQ ID NO: 36427 - DNA, 25 bp, Mus musculus
aacggtattcctaggacctgcagat

SEQ ID NO: 36428 - DNA, 25 bp, Mus musculus
aacggtattccttggacctgcagat

SEQ ID NO: 36429 - DNA, 25 bp, Mus musculus
aacggtattgtgcatttgtggcatt

SEQ ID NO: 36430 - DNA, 25 bp, Mus musculus
aacggtattgtggatttgtggcatt

SEQ ID NO: 36431 - DNA, 25 bp, Mus musculus
aacggtcaatttaaagcctgtcatg

SEQ ID NO: 36432 - DNA, 25 bp, Mus musculus
aacggtcaattttaagcctgtcatg

SEQ ID NO: 36433 - DNA, 25 bp, Mus musculus
aacggtcactacagcagatgccctt

SEQ ID NO: 36434 - DNA, 25 bp, Mus musculus
aacggtcactactgcagatgccctt

SEQ ID NO: 36435 - DNA, 25 bp, Mus musculus
aacggtccaaagaaaacatgtgcat

SEQ ID NO: 36436 - DNA, 25 bp, Mus musculus
aacggtccaaagtaaacatgtgcat

SEQ ID NO: 36437 - DNA, 25 bp, Mus musculus
aacggtccatgaattctgtcctcga

SEQ ID NO: 36438 - DNA, 25 bp, Mus musculus
aacggtccatgatttctgtcctcga

SEQ ID NO: 36439 - DNA, 25 bp, Mus musculus
aacggtccattcacgtctgttgttc

SEQ ID NO: 36440 - DNA, 25 bp, Mus musculus
aacggtccattctcgtctgttgttc

SEQ ID NO: 36441 - DNA, 25 bp, Mus musculus
aacggtcctattcaactgagtaaga

SEQ ID NO: 36442 - DNA, 25 bp, Mus musculus
aacggtcctattgaactgagtaaga

SEQ ID NO: 36443 - DNA, 25 bp, Mus musculus
aacggtcgttttctccacagatgat

SEQ ID NO: 36444 - DNA, 25 bp, Mus musculus
aacggtcgttttgtccacagatgat

SEQ ID NO: 36445 - DNA, 25 bp, Mus musculus
aacggtctagacaacaagctgcgtg

SEQ ID NO: 36446 - DNA, 25 bp, Mus musculus
aacggtctagactacaagctgcgtg

SEQ ID NO: 36447 - DNA, 25 bp, Mus musculus
aacggtctgaatatgtacagcgcgg

SEQ ID NO: 36448 - DNA, 25 bp, Mus musculus
aacggtctgaatttgtacagcgcgg

SEQ ID NO: 36449 - DNA, 25 bp, Mus musculus
aacggtctggccatccaagcatttg

SEQ ID NO: 36450 - DNA, 25 bp, Mus musculus
aacggtctggccttccaagcatttg

SEQ ID NO: 36451 - DNA, 25 bp, Mus musculus
aacggtgaatgacctgcagaacttg

SEQ ID NO: 36452 - DNA, 25 bp, Mus musculus
aacggtgaatgagctgcagaacttg

SEQ ID NO: 36453 - DNA, 25 bp, Mus musculus
aacggtgacctacacccctgggcag

SEQ ID NO: 36454 - DNA, 25 bp, Mus musculus
aacggtgacctagacccctgggcag

SEQ ID NO: 36455 - DNA, 25 bp, Mus musculus
aacggtgagtctctcttcataaaca

SEQ ID NO: 36456 - DNA, 25 bp, Mus musculus
aacggtgagtctgtcttcataaaca

SEQ ID NO: 36457 - DNA, 25 bp, Mus musculus
aacggtgatgaaatctttgtttctt

SEQ ID NO: 36458 - DNA, 25 bp, Mus musculus
aacggtgatgaattctttgtttctt

SEQ ID NO: 36459 - DNA, 25 bp, Mus musculus
aacggtgatggcatccgaatggaaa

SEQ ID NO: 36460 - DNA, 25 bp, Mus musculus
aacggtgatggcttccgaatggaaa

SEQ ID NO: 36461 - DNA, 25 bp, Mus musculus
aacggtgcattaattcagctattat

SEQ ID NO: 36462 - DNA, 25 bp, Mus musculus
aacggtgcattatttcagctattat

SEQ ID NO: 36463 - DNA, 25 bp, Mus musculus
aacggtgcattccagtacttggcat

SEQ ID NO: 36464 - DNA, 25 bp, Mus musculus
aacggtgcattcgagtacttggcat

SEQ ID NO: 36465 - DNA, 25 bp, Mus musculus
aacggtgccaaacccgccttagtga

SEQ ID NO: 36466 - DNA, 25 bp, Mus musculus
aacggtgccaaagccgccttagtga

SEQ ID NO: 36467 - DNA, 25 bp, Mus musculus
aacggtgccattaacttcacggaag

SEQ ID NO: 36468 - DNA, 25 bp, Mus musculus
aacggtgccattacgaggacctgaa

SEQ ID NO: 36469 - DNA, 25 bp, Mus musculus
aacggtgccatttacttcacggaag

SEQ ID NO: 36470 - DNA, 25 bp, Mus musculus
aacggtgccatttcgaggacctgaa

SEQ ID NO: 36471 - DNA, 25 bp, Mus musculus
aacggtgcctcaactcaaatgtgtc

SEQ ID NO: 36472 - DNA, 25 bp, Mus musculus
aacggtgcctcatctcaaatgtgtc

SEQ ID NO: 36473 - DNA, 25 bp, Mus musculus
aacggtgctggaccctgaagttcga

SEQ ID NO: 36474 - DNA, 25 bp, Mus musculus
aacggtgctggagcctgaagttcga

SEQ ID NO: 36475 - DNA, 25 bp, Mus musculus
aacggtggatcacaatagccacgtt

SEQ ID NO: 36476 - DNA, 25 bp, Mus musculus
aacggtggatcagaatagccacgtt

SEQ ID NO: 36477 - DNA, 25 bp, Mus musculus
aacggtggatttatgctaggaccca

SEQ ID NO: 36478 - DNA, 25 bp, Mus musculus
aacggtggatttttgctaggaccca

SEQ ID NO: 36479 - DNA, 25 bp, Mus musculus
aacggtggccgtcaatgtagattac

SEQ ID NO: 36480 - DNA, 25 bp, Mus musculus
aacggtggccgtgaatgtagattac

SEQ ID NO: 36481 - DNA, 25 bp, Mus musculus
aacggtgtacaacgacctatgtgtc

SEQ ID NO: 36482 - DNA, 25 bp, Mus musculus
aacggtgtacaaggacctatgtgtc

SEQ ID NO: 36483 - DNA, 25 bp, Mus musculus
aacggtgtagagcagagtttgcaaa

SEQ ID NO: 36484 - DNA, 25 bp, Mus musculus
aacggtgtagaggagagtttgcaaa

SEQ ID NO: 36485 - DNA, 25 bp, Mus musculus
aacggtgtgtctacagagctttctc

SEQ ID NO: 36486 - DNA, 25 bp, Mus musculus
aacggtgtgtcttcagagctttctc

SEQ ID NO: 36487 - DNA, 25 bp, Mus musculus
aacggtgtgtgtcacactgcgctgt

SEQ ID NO: 36488 - DNA, 25 bp, Mus musculus
aacggtgtgtgtgacactgcgctgt

SEQ ID NO: 36489 - DNA, 25 bp, Mus musculus
aacggtgtgttcactctctaaagga

SEQ ID NO: 36490 - DNA, 25 bp, Mus musculus
aacggtgtgttctctctctaaagga

SEQ ID NO: 36491 - DNA, 25 bp, Mus musculus
aacggtgttcaaatttccagcaaga

SEQ ID NO: 36492 - DNA, 25 bp, Mus musculus
aacggtgttcaattttccagcaaga

SEQ ID NO: 36493 - DNA, 25 bp, Mus musculus
aacggttagtttctttgctgctagg

SEQ ID NO: 36494 - DNA, 25 bp, Mus musculus
aacggttagtttgtttgctgctagg

SEQ ID NO: 36495 - DNA, 25 bp, Mus musculus
aacggttcagccaagtctggagcgc

SEQ ID NO: 36496 - DNA, 25 bp, Mus musculus
aacggttcagcctagtctggagcgc

SEQ ID NO: 36497 - DNA, 25 bp, Mus musculus
aacggttcaggccacatgagcaagt

SEQ ID NO: 36498 - DNA, 25 bp, Mus musculus
aacggttcaggcgacatgagcaagt

SEQ ID NO: 36499 - DNA, 25 bp, Mus musculus
aacggttcagtaagcgggtcttctc

SEQ ID NO: 36500 - DNA, 25 bp, Mus musculus
aacggttcagtatgcgggtcttctc

SEQ ID NO: 36501 - DNA, 25 bp, Mus musculus
aacggttctctcagcaaatgcttgg

SEQ ID NO: 36502 - DNA, 25 bp, Mus musculus
aacggttctctctgcaaatgcttgg

SEQ ID NO: 36503 - DNA, 25 bp, Mus musculus
aacggttgccatcccaatggaggca

SEQ ID NO: 36504 - DNA, 25 bp, Mus musculus
aacggttgccatgccaatggaggca

SEQ ID NO: 36505 - DNA, 25 bp, Mus musculus
aacggttggttcagtaacgtgactg

SEQ ID NO: 36506 - DNA, 25 bp, Mus musculus
aacggttggttctgtaacgtgactg

SEQ ID NO: 36507 - DNA, 25 bp, Mus musculus
aacggttgttctcttgaacctatag

SEQ ID NO: 36508 - DNA, 25 bp, Mus musculus
aacggttgttctgttgaacctatag

SEQ ID NO: 36509 - DNA, 25 bp, Mus musculus
aacggtttgcagacttgggtgacat

SEQ ID NO: 36510 - DNA, 25 bp, Mus musculus
aacggtttgcagtcttgggtgacat

SEQ ID NO: 36511 - DNA, 25 bp, Mus musculus
aacggttttgggaattcagactgtg

SEQ ID NO: 36512 - DNA, 25 bp, Mus musculus
aacggttttgggtattcagactgtg

SEQ ID NO: 36513 - DNA, 25 bp, Mus musculus
aacggtttttccacagtgcattctg

SEQ ID NO: 36514 - DNA, 25 bp, Mus musculus
aacggtttttcctcagtgcattctg

SEQ ID NO: 36515 - DNA, 25 bp, Mus musculus
aacgtaaatctgaacactggaagca

SEQ ID NO: 36516 - DNA, 25 bp, Mus musculus
aacgtaaatctgtacactggaagca

SEQ ID NO: 36517 - DNA, 25 bp, Mus musculus
aacgtaactggtatctgactgcggg

SEQ ID NO: 36518 - DNA, 25 bp, Mus musculus
aacgtaactggtttctgactgcggg

SEQ ID NO: 36519 - DNA, 25 bp, Mus musculus
aacgtaagtgccaaaacctctcttg

SEQ ID NO: 36520 - DNA, 25 bp, Mus musculus
aacgtaagtgcctaaacctctcttg

SEQ ID NO: 36521 - DNA, 25 bp, Mus musculus
aacgtaattttaccttcctctgaag

SEQ ID NO: 36522 - DNA, 25 bp, Mus musculus
aacgtaattttagcttcctctgaag

SEQ ID NO: 36523 - DNA, 25 bp, Mus musculus
aacgtacaataacttggacatcaca

SEQ ID NO: 36524 - DNA, 25 bp, Mus musculus
aacgtacaataagttggacatcaca

SEQ ID NO: 36525 - DNA, 25 bp, Mus musculus
aacgtaccacgacctggcgtgtaga

SEQ ID NO: 36526 - DNA, 25 bp, Mus musculus
aacgtaccacgagctggcgtgtaga

SEQ ID NO: 36527 - DNA, 25 bp, Mus musculus
aacgtactgggtcactccctcggag

SEQ ID NO: 36528 - DNA, 25 bp, Mus musculus
aacgtactgggtgactccctcggag

SEQ ID NO: 36529 - DNA, 25 bp, Mus musculus
aacgtagaaatgcacgtgctcttta

SEQ ID NO: 36530 - DNA, 25 bp, Mus musculus
aacgtagaaatggacgtgctcttta

SEQ ID NO: 36531 - DNA, 25 bp, Mus musculus
aacgtagacattagccagtgaccca

SEQ ID NO: 36532 - DNA, 25 bp, Mus musculus
aacgtagacatttgccagtgaccca

SEQ ID NO: 36533 - DNA, 25 bp, Mus musculus
aacgtagcagtacctgtctgtctgt

SEQ ID NO: 36534 - DNA, 25 bp, Mus musculus
aacgtagcagtagctgtctgtctgt

SEQ ID NO: 36535 - DNA, 25 bp, Mus musculus
aacgtagctcgaatctggtacacgc

SEQ ID NO: 36536 - DNA, 25 bp, Mus musculus
aacgtagctcgattctggtacacgc

SEQ ID NO: 36537 - DNA, 25 bp, Mus musculus
aacgtagcttagagggcacaatgct

SEQ ID NO: 36538 - DNA, 25 bp, Mus musculus
aacgtagcttagtgggcacaatgct

SEQ ID NO: 36539 - DNA, 25 bp, Mus musculus
aacgtaggccatatccgagagctct

SEQ ID NO: 36540 - DNA, 25 bp, Mus musculus
aacgtaggccatttccgagagctct

SEQ ID NO: 36541 - DNA, 25 bp, Mus musculus
aacgtaggtgctcgaaagctcccac

SEQ ID NO: 36542 - DNA, 25 bp, Mus musculus
aacgtaggtgctggaaagctcccac

SEQ ID NO: 36543 - DNA, 25 bp, Mus musculus
aacgtagtcattcattctgccggtg

SEQ ID NO: 36544 - DNA, 25 bp, Mus musculus
aacgtagtcattgattctgccggtg

SEQ ID NO: 36545 - DNA, 25 bp, Mus musculus
aacgtagtgaacagccaattgcgga

SEQ ID NO: 36546 - DNA, 25 bp, Mus musculus
aacgtagtgaactgccaattgcgga

SEQ ID NO: 36547 - DNA, 25 bp, Mus musculus
aacgtagtgtcaattgtagtagaac

SEQ ID NO: 36548 - DNA, 25 bp, Mus musculus
aacgtagtgtcatttgtagtagaac

SEQ ID NO: 36549 - DNA, 25 bp, Mus musculus
aacgtataacttcatttctcttcaa

SEQ ID NO: 36550 - DNA, 25 bp, Mus musculus
aacgtataacttgatttctcttcaa

SEQ ID NO: 36551 - DNA, 25 bp, Mus musculus
aacgtatctctcagaagttgtttca

SEQ ID NO: 36552 - DNA, 25 bp, Mus musculus
aacgtatctctctgaagttgtttca

SEQ ID NO: 36553 - DNA, 25 bp, Mus musculus
aacgtatgaagcctaaccgctggtt

SEQ ID NO: 36554 - DNA, 25 bp, Mus musculus
aacgtatgaagcgtaaccgctggtt

SEQ ID NO: 36555 - DNA, 25 bp, Mus musculus
aacgtatgcctcctggttaaagtct

SEQ ID NO: 36556 - DNA, 25 bp, Mus musculus
aacgtatgcctcgtggttaaagtct

SEQ ID NO: 36557 - DNA, 25 bp, Mus musculus
aacgtatggcttcaagttcctggct

SEQ ID NO: 36558 - DNA, 25 bp, Mus musculus
aacgtatggcttgaagttcctggct

SEQ ID NO: 36559 - DNA, 25 bp, Mus musculus
aacgtatggtagaggcacgcctggc

SEQ ID NO: 36560 - DNA, 25 bp, Mus musculus
aacgtatggtagtggcacgcctggc

SEQ ID NO: 36561 - DNA, 25 bp, Mus musculus
aacgtattcgttcatagcttaaaga

SEQ ID NO: 36562 - DNA, 25 bp, Mus musculus
aacgtattcgttgatagcttaaaga

SEQ ID NO: 36563 - DNA, 25 bp, Mus musculus
aacgtattgctacaaggcgctggct

SEQ ID NO: 36564 - DNA, 25 bp, Mus musculus
aacgtattgctagaaggcgctggct

SEQ ID NO: 36565 - DNA, 25 bp, Mus musculus
aacgtatttgctcaaggacccatct

SEQ ID NO: 36566 - DNA, 25 bp, Mus musculus
aacgtatttgctgaaggacccatct

SEQ ID NO: 36567 - DNA, 25 bp, Mus musculus
aacgtcaaaaggatgtttacagtat

SEQ ID NO: 36568 - DNA, 25 bp, Mus musculus
aacgtcaaaaggttgtttacagtat

SEQ ID NO: 36569 - DNA, 25 bp, Mus musculus
aacgtcaagggcaggtcacccctgg

SEQ ID NO: 36570 - DNA, 25 bp, Mus musculus
aacgtcaagggctggtcacccctgg

SEQ ID NO: 36571 - DNA, 25 bp, Mus musculus
aacgtcacaaggcacggccacttgt

SEQ ID NO: 36572 - DNA, 25 bp, Mus musculus
aacgtcacaaggctgcttattatca

SEQ ID NO: 36573 - DNA, 25 bp, Mus musculus
aacgtcacaagggacggccacttgt

SEQ ID NO: 36574 - DNA, 25 bp, Mus musculus
aacgtcacaagggtgcttattatca

SEQ ID NO: 36575 - DNA, 25 bp, Mus musculus
aacgtcaccgccaaactgatggccg

SEQ ID NO: 36576 - DNA, 25 bp, Mus musculus
aacgtcaccgcctaactgatggccg

SEQ ID NO: 36577 - DNA, 25 bp, Mus musculus
aacgtcaccttaacttgtttctgca

SEQ ID NO: 36578 - DNA, 25 bp, Mus musculus
aacgtcaccttatcttgtttctgca

SEQ ID NO: 36579 - DNA, 25 bp, Mus musculus
aacgtcactgctaaattgtgcatcc

SEQ ID NO: 36580 - DNA, 25 bp, Mus musculus
aacgtcactgcttaattgtgcatcc

SEQ ID NO: 36581 - DNA, 25 bp, Mus musculus
aacgtcagagcaaggctggtgagac

SEQ ID NO: 36582 - DNA, 25 bp, Mus musculus
aacgtcagagcatggctggtgagac

SEQ ID NO: 36583 - DNA, 25 bp, Mus musculus
aacgtcagagtgagttttgtcttaa

SEQ ID NO: 36584 - DNA, 25 bp, Mus musculus
aacgtcagagtgtgttttgtcttaa

SEQ ID NO: 36585 - DNA, 25 bp, Mus musculus
aacgtcagatttctgcctgtctcga

SEQ ID NO: 36586 - DNA, 25 bp, Mus musculus
aacgtcagatttgtgcctgtctcga

SEQ ID NO: 36587 - DNA, 25 bp, Mus musculus
aacgtcaggcaacactctgactctc

SEQ ID NO: 36588 - DNA, 25 bp, Mus musculus
aacgtcaggcaagactctgactctc

SEQ ID NO: 36589 - DNA, 25 bp, Mus musculus
aacgtcagtgtcaacatctcatgga

SEQ ID NO: 36590 - DNA, 25 bp, Mus musculus
aacgtcagtgtctacatctcatgga

SEQ ID NO: 36591 - DNA, 25 bp, Mus musculus
aacgtcatccttaggtaagcgtcgc

SEQ ID NO: 36592 - DNA, 25 bp, Mus musculus
aacgtcatcctttggtaagcgtcgc

SEQ ID NO: 36593 - DNA, 25 bp, Mus musculus
aacgtcattcacatttgattcctga

SEQ ID NO: 36594 - DNA, 25 bp, Mus musculus
aacgtcattcacttttgattcctga

SEQ ID NO: 36595 - DNA, 25 bp, Mus musculus
aacgtcattgaaagttgttgcatga

SEQ ID NO: 36596 - DNA, 25 bp, Mus musculus
aacgtcattgaatgttgttgcatga

SEQ ID NO: 36597 - DNA, 25 bp, Mus musculus
aacgtcattgagaccttcactgagc

SEQ ID NO: 36598 - DNA, 25 bp, Mus musculus
aacgtcattgagtccttcactgagc

SEQ ID NO: 36599 - DNA, 25 bp, Mus musculus
aacgtccacagcaactttgcagaga

SEQ ID NO: 36600 - DNA, 25 bp, Mus musculus
aacgtccacagctactttgcagaga

SEQ ID NO: 36601 - DNA, 25 bp, Mus musculus
aacgtccactcactgacacggcagg

SEQ ID NO: 36602 - DNA, 25 bp, Mus musculus
aacgtccactcagtgacacggcagg

SEQ ID NO: 36603 - DNA, 25 bp, Mus musculus
aacgtcccacagatgattcaatacc

SEQ ID NO: 36604 - DNA, 25 bp, Mus musculus
aacgtcccacagttgattcaatacc

SEQ ID NO: 36605 - DNA, 25 bp, Mus musculus
aacgtcccagatacttcaacctgtt

SEQ ID NO: 36606 - DNA, 25 bp, Mus musculus
aacgtcccagattcttcaacctgtt

SEQ ID NO: 36607 - DNA, 25 bp, Mus musculus
aacgtcccgaggctacatggtcgag

SEQ ID NO: 36608 - DNA, 25 bp, Mus musculus
aacgtcccgagggtacatggtcgag

SEQ ID NO: 36609 - DNA, 25 bp, Mus musculus
aacgtccgctgtaaatccattctta

SEQ ID NO: 36610 - DNA, 25 bp, Mus musculus
aacgtccgctgttaatccattctta

SEQ ID NO: 36611 - DNA, 25 bp, Mus musculus
aacgtcctctaaagcgtgccaggga

SEQ ID NO: 36612 - DNA, 25 bp, Mus musculus
aacgtcctctaatgcgtgccaggga

SEQ ID NO: 36613 - DNA, 25 bp, Mus musculus
aacgtcgccaaacctgaggccgaga

SEQ ID NO: 36614 - DNA, 25 bp, Mus musculus
aacgtcgccaaagctgaggccgaga

SEQ ID NO: 36615 - DNA, 25 bp, Mus musculus
aacgtcgcttggcaatcttcaaaga

SEQ ID NO: 36616 - DNA, 25 bp, Mus musculus
aacgtcgcttgggaatcttcaaaga

SEQ ID NO: 36617 - DNA, 25 bp, Mus musculus
aacgtcggcgacagaagcagatgaa

SEQ ID NO: 36618 - DNA, 25 bp, Mus musculus
aacgtcggcgactgaagcagatgaa

SEQ ID NO: 36619 - DNA, 25 bp, Mus musculus
aacgtcgggcccaggagaagattga

SEQ ID NO: 36620 - DNA, 25 bp, Mus musculus
aacgtcgggccctggagaagattga

SEQ ID NO: 36621 - DNA, 25 bp, Mus musculus
aacgtcgtaaatcctaagttcatgc

SEQ ID NO: 36622 - DNA, 25 bp, Mus musculus
aacgtcgtaaatgctaagttcatgc

SEQ ID NO: 36623 - DNA, 25 bp, Mus musculus
aacgtcgtcaacaatgtccagcaga

SEQ ID NO: 36624 - DNA, 25 bp, Mus musculus
aacgtcgtcaactatgtccagcaga

SEQ ID NO: 36625 - DNA, 25 bp, Mus musculus
aacgtctaacatataccttgcacac

SEQ ID NO: 36626 - DNA, 25 bp, Mus musculus
aacgtctaacatttaccttgcacac

SEQ ID NO: 36627 - DNA, 25 bp, Mus musculus
aacgtctaatcgctggctgcattgg

SEQ ID NO: 36628 - DNA, 25 bp, Mus musculus
aacgtctaatcggtggctgcattgg

SEQ ID NO: 36629 - DNA, 25 bp, Mus musculus
aacgtctacgcgaagaaccctgact

SEQ ID NO: 36630 - DNA, 25 bp, Mus musculus
aacgtctacgcgtagaaccctgact

SEQ ID NO: 36631 - DNA, 25 bp, Mus musculus
aacgtctacgtcagtgttgagggat

SEQ ID NO: 36632 - DNA, 25 bp, Mus musculus
aacgtctacgtctgtgttgagggat

SEQ ID NO: 36633 - DNA, 25 bp, Mus musculus
aacgtctactgcacttgctttatgt

SEQ ID NO: 36634 - DNA, 25 bp, Mus musculus
aacgtctactgctcttgctttatgt

SEQ ID NO: 36635 - DNA, 25 bp, Mus musculus
aacgtctcattgcagtgtaatacag

SEQ ID NO: 36636 - DNA, 25 bp, Mus musculus
aacgtctcattggagtgtaatacag

SEQ ID NO: 36637 - DNA, 25 bp, Mus musculus
aacgtctctgagatacctccagtgg

SEQ ID NO: 36638 - DNA, 25 bp, Mus musculus
aacgtctctgagttacctccagtgg

SEQ ID NO: 36639 - DNA, 25 bp, Mus musculus
aacgtctctggaagcactgttgctt

SEQ ID NO: 36640 - DNA, 25 bp, Mus musculus
aacgtctctggatgcactgttgctt

SEQ ID NO: 36641 - DNA, 25 bp, Mus musculus
aacgtctggactagcaagcccattt

SEQ ID NO: 36642 - DNA, 25 bp, Mus musculus
aacgtctggacttgcaagcccattt

SEQ ID NO: 36643 - DNA, 25 bp, Mus musculus
aacgtctgggttaagccctggaatg

SEQ ID NO: 36644 - DNA, 25 bp, Mus musculus
aacgtctgggtttagccctggaatg

SEQ ID NO: 36645 - DNA, 25 bp, Mus musculus
aacgtctgtaagcactgtctggaca

SEQ ID NO: 36646 - DNA, 25 bp, Mus musculus
aacgtctgtaaggactgtctggaca

SEQ ID NO: 36647 - DNA, 25 bp, Mus musculus
aacgtctgtatcatgttctgggtat

SEQ ID NO: 36648 - DNA, 25 bp, Mus musculus
aacgtctgtatcttgttctgggtat

SEQ ID NO: 36649 - DNA, 25 bp, Mus musculus
aacgtctgtccccaagagcctggac

SEQ ID NO: 36650 - DNA, 25 bp, Mus musculus
aacgtctgtcccgaagagcctggac

SEQ ID NO: 36651 - DNA, 25 bp, Mus musculus
aacgtctgtctcaggccgagtctaa

SEQ ID NO: 36652 - DNA, 25 bp, Mus musculus
aacgtctgtctctggccgagtctaa

SEQ ID NO: 36653 - DNA, 25 bp, Mus musculus
aacgtcttagtgctcaggctgtctg

SEQ ID NO: 36654 - DNA, 25 bp, Mus musculus
aacgtcttagtggtcaggctgtctg

SEQ ID NO: 36655 - DNA, 25 bp, Mus musculus
aacgtcttcttgagaactcctgagg

SEQ ID NO: 36656 - DNA, 25 bp, Mus musculus
aacgtcttcttgtgaactcctgagg

SEQ ID NO: 36657 - DNA, 25 bp, Mus musculus
aacgtctttgagaagcattgctgca

SEQ ID NO: 36658 - DNA, 25 bp, Mus musculus
aacgtctttgagtagcattgctgca

SEQ ID NO: 36659 - DNA, 25 bp, Mus musculus
aacgtgaaacaccaacttaggccat

SEQ ID NO: 36660 - DNA, 25 bp, Mus musculus
aacgtgaaacacgaacttaggccat

SEQ ID NO: 36661 - DNA, 25 bp, Mus musculus
aacgtgaaccacattgcaaatcaga

SEQ ID NO: 36662 - DNA, 25 bp, Mus musculus
aacgtgaaccactttgcaaatcaga

SEQ ID NO: 36663 - DNA, 25 bp, Mus musculus
aacgtgaatgtgctttctagcatcc

SEQ ID NO: 36664 - DNA, 25 bp, Mus musculus
aacgtgaatgtggtttctagcatcc

SEQ ID NO: 36665 - DNA, 25 bp, Mus musculus
aacgtgacataaccccttcaagttt

SEQ ID NO: 36666 - DNA, 25 bp, Mus musculus
aacgtgacataagcccttcaagttt

SEQ ID NO: 36667 - DNA, 25 bp, Mus musculus
aacgtgactaaaccgcttcctgagc

SEQ ID NO: 36668 - DNA, 25 bp, Mus musculus
aacgtgactaaagcgcttcctgagc

SEQ ID NO: 36669 - DNA, 25 bp, Mus musculus
aacgtgactggcactgagcctggca

SEQ ID NO: 36670 - DNA, 25 bp, Mus musculus
aacgtgactggctctgagcctggca

SEQ ID NO: 36671 - DNA, 25 bp, Mus musculus
aacgtgagagacatcagagacacat

SEQ ID NO: 36672 - DNA, 25 bp, Mus musculus
aacgtgagagacttcagagacacat

SEQ ID NO: 36673 - DNA, 25 bp, Mus musculus
aacgtgagccatcttgatgctcctc

SEQ ID NO: 36674 - DNA, 25 bp, Mus musculus
aacgtgagccatgttgatgctcctc

SEQ ID NO: 36675 - DNA, 25 bp, Mus musculus
aacgtgagcttgatgagggtcgcta

SEQ ID NO: 36676 - DNA, 25 bp, Mus musculus
aacgtgagcttgttgagggtcgcta

SEQ ID NO: 36677 - DNA, 25 bp, Mus musculus
aacgtgaggcagattctgccaccat

SEQ ID NO: 36678 - DNA, 25 bp, Mus musculus
aacgtgaggcagtttctgccaccat

SEQ ID NO: 36679 - DNA, 25 bp, Mus musculus
aacgtgagttccctggatccaatcc

SEQ ID NO: 36680 - DNA, 25 bp, Mus musculus
aacgtgagttccgtggatccaatcc

SEQ ID NO: 36681 - DNA, 25 bp, Mus musculus
aacgtgatctaaaagacctgggact

SEQ ID NO: 36682 - DNA, 25 bp, Mus musculus
aacgtgatctaatagacctgggact

SEQ ID NO: 36683 - DNA, 25 bp, Mus musculus
aacgtgatggagatttctgccttca

SEQ ID NO: 36684 - DNA, 25 bp, Mus musculus
aacgtgatggagttttctgccttca

SEQ ID NO: 36685 - DNA, 25 bp, Mus musculus
aacgtgattagtccagcaaagcctt

SEQ ID NO: 36686 - DNA, 25 bp, Mus musculus
aacgtgattagtgcagcaaagcctt

SEQ ID NO: 36687 - DNA, 25 bp, Mus musculus
aacgtgatttccagttgctctgtca

SEQ ID NO: 36688 - DNA, 25 bp, Mus musculus
aacgtgatttcctgttgctctgtca

SEQ ID NO: 36689 - DNA, 25 bp, Mus musculus
aacgtgatttctactaaatcatata

SEQ ID NO: 36690 - DNA, 25 bp, Mus musculus
aacgtgatttctactcggaagtgac

SEQ ID NO: 36691 - DNA, 25 bp, Mus musculus
aacgtgatttcttctaaatcatata

SEQ ID NO: 36692 - DNA, 25 bp, Mus musculus
aacgtgatttcttctcggaagtgac

SEQ ID NO: 36693 - DNA, 25 bp, Mus musculus
aacgtgcaacacactcgtgcgaagg

SEQ ID NO: 36694 - DNA, 25 bp, Mus musculus
aacgtgcaacacatagctcttctca

SEQ ID NO: 36695 - DNA, 25 bp, Mus musculus
aacgtgcaacactctcgtgcgaagg

SEQ ID NO: 36696 - DNA, 25 bp, Mus musculus
aacgtgcaacacttagctcttctca

SEQ ID NO: 36697 - DNA, 25 bp, Mus musculus
aacgtgcagaaaagtctccccaggc

SEQ ID NO: 36698 - DNA, 25 bp, Mus musculus
aacgtgcagaaatgtctccccaggc

SEQ ID NO: 36699 - DNA, 25 bp, Mus musculus
aacgtgcagcccctgttgagatgac

SEQ ID NO: 36700 - DNA, 25 bp, Mus musculus
aacgtgcagcccgtgttgagatgac

SEQ ID NO: 36701 - DNA, 25 bp, Mus musculus
aacgtgcaggacatagtgcttctcc

SEQ ID NO: 36702 - DNA, 25 bp, Mus musculus
aacgtgcaggacttagtgcttctcc

SEQ ID NO: 36703 - DNA, 25 bp, Mus musculus
aacgtgcagtcaaagcctggccttc

SEQ ID NO: 36704 - DNA, 25 bp, Mus musculus
aacgtgcagtcatagcctggccttc

SEQ ID NO: 36705 - DNA, 25 bp, Mus musculus
aacgtgcatatgaagcctgggttcc

SEQ ID NO: 36706 - DNA, 25 bp, Mus musculus
aacgtgcatatgaccatggtccatc

SEQ ID NO: 36707 - DNA, 25 bp, Mus musculus
aacgtgcatatgtagcctgggttcc

SEQ ID NO: 36708 - DNA, 25 bp, Mus musculus
aacgtgcatatgtccatggtccatc

SEQ ID NO: 36709 - DNA, 25 bp, Mus musculus
aacgtgcatgccctggtctttgtct

SEQ ID NO: 36710 - DNA, 25 bp, Mus musculus
aacgtgcatgccgtggtctttgtct

SEQ ID NO: 36711 - DNA, 25 bp, Mus musculus
aacgtgcccgatctaacataattgt

SEQ ID NO: 36712 - DNA, 25 bp, Mus musculus
aacgtgcccgatgtaacataattgt

SEQ ID NO: 36713 - DNA, 25 bp, Mus musculus
aacgtgctagataagagtccaccat

SEQ ID NO: 36714 - DNA, 25 bp, Mus musculus
aacgtgctagattagagtccaccat

SEQ ID NO: 36715 - DNA, 25 bp, Mus musculus
aacgtgctcatcaacctgaaggaca

SEQ ID NO: 36716 - DNA, 25 bp, Mus musculus
aacgtgctcatctacctgaaggaca

SEQ ID NO: 36717 - DNA, 25 bp, Mus musculus
aacgtgctctggcatgtctagctat

SEQ ID NO: 36718 - DNA, 25 bp, Mus musculus
aacgtgctctgggatgtctagctat

SEQ ID NO: 36719 - DNA, 25 bp, Mus musculus
aacgtgctgaagatccgaaggcgaa

SEQ ID NO: 36720 - DNA, 25 bp, Mus musculus
aacgtgctgaagttccgaaggcgaa

SEQ ID NO: 36721 - DNA, 25 bp, Mus musculus
aacgtgctgatacatcctgaccacc

SEQ ID NO: 36722 - DNA, 25 bp, Mus musculus
aacgtgctgatagatcctgaccacc

SEQ ID NO: 36723 - DNA, 25 bp, Mus musculus
aacgtgctggaaatcatcttgggtc

SEQ ID NO: 36724 - DNA, 25 bp, Mus musculus
aacgtgctggaattcatcttgggtc

SEQ ID NO: 36725 - DNA, 25 bp, Mus musculus
aacgtgcttattcaaaactgtacag

SEQ ID NO: 36726 - DNA, 25 bp, Mus musculus
aacgtgcttattgaaaactgtacag

SEQ ID NO: 36727 - DNA, 25 bp, Mus musculus
aacgtgcttcccagcggtggcgcct

SEQ ID NO: 36728 - DNA, 25 bp, Mus musculus
aacgtgcttccctgcggtggcgcct

SEQ ID NO: 36729 - DNA, 25 bp, Mus musculus
aacgtgcttgggagtgtgacttgcc

SEQ ID NO: 36730 - DNA, 25 bp, Mus musculus
aacgtgcttgggtgtgtgacttgcc

SEQ ID NO: 36731 - DNA, 25 bp, Mus musculus
aacgtggaagttcccttgtgcctaa

SEQ ID NO: 36732 - DNA, 25 bp, Mus musculus
aacgtggaagttgccttgtgcctaa

SEQ ID NO: 36733 - DNA, 25 bp, Mus musculus
aacgtggaattgaggttcttgccca

SEQ ID NO: 36734 - DNA, 25 bp, Mus musculus
aacgtggaattgtggttcttgccca

SEQ ID NO: 36735 - DNA, 25 bp, Mus musculus
aacgtggacaagcaaagattaagac

SEQ ID NO: 36736 - DNA, 25 bp, Mus musculus
aacgtggacaaggaaagattaagac

SEQ ID NO: 36737 - DNA, 25 bp, Mus musculus
aacgtggacacccagggcaacatct

SEQ ID NO: 36738 - DNA, 25 bp, Mus musculus
aacgtggacaccgagggcaacatct

SEQ ID NO: 36739 - DNA, 25 bp, Mus musculus
aacgtggacggcatgacagccctgc

SEQ ID NO: 36740 - DNA, 25 bp, Mus musculus
aacgtggacggcttgacagccctgc

SEQ ID NO: 36741 - DNA, 25 bp, Mus musculus
aacgtggagaggagcgcctcctact

SEQ ID NO: 36742 - DNA, 25 bp, Mus musculus
aacgtggagaggtgcgcctcctact

SEQ ID NO: 36743 - DNA, 25 bp, Mus musculus
aacgtggagctcactgcttcagggc

SEQ ID NO: 36744 - DNA, 25 bp, Mus musculus
aacgtggagctctctgcttcagggc

SEQ ID NO: 36745 - DNA, 25 bp, Mus musculus
aacgtggagttgatgccctaaaggt

SEQ ID NO: 36746 - DNA, 25 bp, Mus musculus
aacgtggagttgttgccctaaaggt

SEQ ID NO: 36747 - DNA, 25 bp, Mus musculus
aacgtggatatgatttttctagtga

SEQ ID NO: 36748 - DNA, 25 bp, Mus musculus
aacgtggatatgttttttctagtga

SEQ ID NO: 36749 - DNA, 25 bp, Mus musculus
aacgtggcacagatccttatgcata

SEQ ID NO: 36750 - DNA, 25 bp, Mus musculus
aacgtggcacagttccttatgcata

SEQ ID NO: 36751 - DNA, 25 bp, Mus musculus
aacgtggcagccattggagtcagct

SEQ ID NO: 36752 - DNA, 25 bp, Mus musculus
aacgtggcagcctttggagtcagct

SEQ ID NO: 36753 - DNA, 25 bp, Mus musculus
aacgtggcatcgatgccctaagtta

SEQ ID NO: 36754 - DNA, 25 bp, Mus musculus
aacgtggcatcgttgccctaagtta

SEQ ID NO: 36755 - DNA, 25 bp, Mus musculus
aacgtggccgagcttgataggacca

SEQ ID NO: 36756 - DNA, 25 bp, Mus musculus
aacgtggccgaggttgataggacca

SEQ ID NO: 36757 - DNA, 25 bp, Mus musculus
aacgtggctatgagcaatggagaca

SEQ ID NO: 36758 - DNA, 25 bp, Mus musculus
aacgtggctatgtgcaatggagaca

SEQ ID NO: 36759 - DNA, 25 bp, Mus musculus
aacgtggctgtcattaagtgcctca

SEQ ID NO: 36760 - DNA, 25 bp, Mus musculus
aacgtggctgtctttaagtgcctca

SEQ ID NO: 36761 - DNA, 25 bp, Mus musculus
aacgtgggaatcatctacctgctta

SEQ ID NO: 36762 - DNA, 25 bp, Mus musculus
aacgtgggaatcttctacctgctta

SEQ ID NO: 36763 - DNA, 25 bp, Mus musculus
aacgtgggcactctggtgcagcata

SEQ ID NO: 36764 - DNA, 25 bp, Mus musculus
aacgtgggcactgtggtgcagcata

SEQ ID NO: 36765 - DNA, 25 bp, Mus musculus
aacgtgggccagctatagacagtga

SEQ ID NO: 36766 - DNA, 25 bp, Mus musculus
aacgtgggccaggtatagacagtga

SEQ ID NO: 36767 - DNA, 25 bp, Mus musculus
aacgtgggcccactggatctgcaga

SEQ ID NO: 36768 - DNA, 25 bp, Mus musculus
aacgtgggcccagtggatctgcaga

SEQ ID NO: 36769 - DNA, 25 bp, Mus musculus
aacgtgggccccaaatactcagcat

SEQ ID NO: 36770 - DNA, 25 bp, Mus musculus
aacgtgggcccctaatactcagcat

SEQ ID NO: 36771 - DNA, 25 bp, Mus musculus
aacgtgggtggtacttactgatctt

SEQ ID NO: 36772 - DNA, 25 bp, Mus musculus
aacgtgggtggttcttactgatctt

SEQ ID NO: 36773 - DNA, 25 bp, Mus musculus
aacgtgggttcaaaatcacctgaag

SEQ ID NO: 36774 - DNA, 25 bp, Mus musculus
aacgtgggttcataatcacctgaag

SEQ ID NO: 36775 - DNA, 25 bp, Mus musculus
aacgtggtattccacatgcctgtgt

SEQ ID NO: 36776 - DNA, 25 bp, Mus musculus
aacgtggtattcgacatgcctgtgt

SEQ ID NO: 36777 - DNA, 25 bp, Mus musculus
aacgtggtccttacattaggttctg

SEQ ID NO: 36778 - DNA, 25 bp, Mus musculus
aacgtggtcctttcattaggttctg

SEQ ID NO: 36779 - DNA, 25 bp, Mus musculus
aacgtggtctccctaaagctcaggt

SEQ ID NO: 36780 - DNA, 25 bp, Mus musculus
aacgtggtctccgtaaagctcaggt

SEQ ID NO: 36781 - DNA, 25 bp, Mus musculus
aacgtggttctgcacaagcccggca

SEQ ID NO: 36782 - DNA, 25 bp, Mus musculus
aacgtggttctggacaagcccggca

SEQ ID NO: 36783 - DNA, 25 bp, Mus musculus
aacgtggttcttcgagtagatctaa

SEQ ID NO: 36784 - DNA, 25 bp, Mus musculus
aacgtggttcttggagtagatctaa

SEQ ID NO: 36785 - DNA, 25 bp, Mus musculus
aacgtggtttccatcttcaagtcct

SEQ ID NO: 36786 - DNA, 25 bp, Mus musculus
aacgtggtttccattttgtgcctgt

SEQ ID NO: 36787 - DNA, 25 bp, Mus musculus
aacgtggtttccttcttcaagtcct

SEQ ID NO: 36788 - DNA, 25 bp, Mus musculus
aacgtggtttcctttttgtgcctgt

SEQ ID NO: 36789 - DNA, 25 bp, Mus musculus
aacgtgtaatttatggctatgatgt

SEQ ID NO: 36790 - DNA, 25 bp, Mus musculus
aacgtgtaatttttggctatgatgt

SEQ ID NO: 36791 - DNA, 25 bp, Mus musculus
aacgtgtaccagctacctaaggagg

SEQ ID NO: 36792 - DNA, 25 bp, Mus musculus
aacgtgtaccaggtacctaaggagg

SEQ ID NO: 36793 - DNA, 25 bp, Mus musculus
aacgtgtactgtcactcggttgtgt

SEQ ID NO: 36794 - DNA, 25 bp, Mus musculus
aacgtgtactgtgactcggttgtgt

SEQ ID NO: 36795 - DNA, 25 bp, Mus musculus
aacgtgtatatcctgtgggagagta

SEQ ID NO: 36796 - DNA, 25 bp, Mus musculus
aacgtgtatatcgtgtgggagagta

SEQ ID NO: 36797 - DNA, 25 bp, Mus musculus
aacgtgtcacctaaagggcttgtgc

SEQ ID NO: 36798 - DNA, 25 bp, Mus musculus
aacgtgtcaccttaagggcttgtgc

SEQ ID NO: 36799 - DNA, 25 bp, Mus musculus
aacgtgtcagcccattcctggaaga

SEQ ID NO: 36800 - DNA, 25 bp, Mus musculus
aacgtgtcagccgattcctggaaga

SEQ ID NO: 36801 - DNA, 25 bp, Mus musculus
aacgtgtcatcgaagacctctcagg

SEQ ID NO: 36802 - DNA, 25 bp, Mus musculus
aacgtgtcatcgtagacctctcagg

SEQ ID NO: 36803 - DNA, 25 bp, Mus musculus
aacgtgtccataatcaacagccctg

SEQ ID NO: 36804 - DNA, 25 bp, Mus musculus
aacgtgtccatattcaacagccctg

SEQ ID NO: 36805 - DNA, 25 bp, Mus musculus
aacgtgtccggaaaaacttcagcaa

SEQ ID NO: 36806 - DNA, 25 bp, Mus musculus
aacgtgtccggataaacttcagcaa

SEQ ID NO: 36807 - DNA, 25 bp, Mus musculus
aacgtgtctactactctgcttggat

SEQ ID NO: 36808 - DNA, 25 bp, Mus musculus
aacgtgtctacttctctgcttggat

SEQ ID NO: 36809 - DNA, 25 bp, Mus musculus
aacgtgtgaagccatcgggaagccc

SEQ ID NO: 36810 - DNA, 25 bp, Mus musculus
aacgtgtgaagcgatcgggaagccc

SEQ ID NO: 36811 - DNA, 25 bp, Mus musculus
aacgtgtgcatgctttcggtttcac

SEQ ID NO: 36812 - DNA, 25 bp, Mus musculus
aacgtgtgcatggtttcggtttcac

SEQ ID NO: 36813 - DNA, 25 bp, Mus musculus
aacgtgtggccaatattccaggtga

SEQ ID NO: 36814 - DNA, 25 bp, Mus musculus
aacgtgtggccattattccaggtga

SEQ ID NO: 36815 - DNA, 25 bp, Mus musculus
aacgtgtgtcagatccaaatgccca

SEQ ID NO: 36816 - DNA, 25 bp, Mus musculus
aacgtgtgtcagttccaaatgccca

SEQ ID NO: 36817 - DNA, 25 bp, Mus musculus
aacgtgttcaccacagccgagggac

SEQ ID NO: 36818 - DNA, 25 bp, Mus musculus
aacgtgttcacctcagccgagggac

SEQ ID NO: 36819 - DNA, 25 bp, Mus musculus
aacgtgttccatctgcatacagcct

SEQ ID NO: 36820 - DNA, 25 bp, Mus musculus
aacgtgttccatgtgcatacagcct

SEQ ID NO: 36821 - DNA, 25 bp, Mus musculus
aacgtgttctccctgtgccaagtag

SEQ ID NO: 36822 - DNA, 25 bp, Mus musculus
aacgtgttctccgtgtgccaagtag

SEQ ID NO: 36823 - DNA, 25 bp, Mus musculus
aacgtgttgactcggtggtttctat

SEQ ID NO: 36824 - DNA, 25 bp, Mus musculus
aacgtgttgactgggtggtttctat

SEQ ID NO: 36825 - DNA, 25 bp, Mus musculus
aacgtgttgcctagttttacagaag

SEQ ID NO: 36826 - DNA, 25 bp, Mus musculus
aacgtgttgccttgttttacagaag

SEQ ID NO: 36827 - DNA, 25 bp, Mus musculus
aacgttaatactactgcatcaggtg

SEQ ID NO: 36828 - DNA, 25 bp, Mus musculus
aacgttaatacttctgcatcaggtg

SEQ ID NO: 36829 - DNA, 25 bp, Mus musculus
aacgttacattgatagtggcaggat

SEQ ID NO: 36830 - DNA, 25 bp, Mus musculus
aacgttacattgttagtggcaggat

SEQ ID NO: 36831 - DNA, 25 bp, Mus musculus
aacgttaccctgagtgtgagagcct

SEQ ID NO: 36832 - DNA, 25 bp, Mus musculus
aacgttaccctgtgtgtgagagcct

SEQ ID NO: 36833 - DNA, 25 bp, Mus musculus
aacgttactgtgatttagtctgact

SEQ ID NO: 36834 - DNA, 25 bp, Mus musculus
aacgttactgtgttttagtctgact

SEQ ID NO: 36835 - DNA, 25 bp, Mus musculus
aacgttacttttcgaatctgtggtg

SEQ ID NO: 36836 - DNA, 25 bp, Mus musculus
aacgttacttttggaatctgtggtg

SEQ ID NO: 36837 - DNA, 25 bp, Mus musculus
aacgttagtgtcagctgtggatgag

SEQ ID NO: 36838 - DNA, 25 bp, Mus musculus
aacgttagtgtctgctgtggatgag

SEQ ID NO: 36839 - DNA, 25 bp, Mus musculus
aacgttatcagcatgttctgcgcac

SEQ ID NO: 36840 - DNA, 25 bp, Mus musculus
aacgttatcagcttgttctgcgcac

SEQ ID NO: 36841 - DNA, 25 bp, Mus musculus
aacgttatccaactgctgcacataa

SEQ ID NO: 36842 - DNA, 25 bp, Mus musculus
aacgttatccaagtgctgcacataa

SEQ ID NO: 36843 - DNA, 25 bp, Mus musculus
aacgttcacataatcttgtctgagt

SEQ ID NO: 36844 - DNA, 25 bp, Mus musculus
aacgttcacatattcttgtctgagt

SEQ ID NO: 36845 - DNA, 25 bp, Mus musculus
aacgttcagagaccctgacctcgga

SEQ ID NO: 36846 - DNA, 25 bp, Mus musculus
aacgttcagagagcctgacctcgga

SEQ ID NO: 36847 - DNA, 25 bp, Mus musculus
aacgttcaggtgagtgcttttggaa

SEQ ID NO: 36848 - DNA, 25 bp, Mus musculus
aacgttcaggtgtgtgcttttggaa

SEQ ID NO: 36849 - DNA, 25 bp, Mus musculus
aacgttcagtatagccatgggacca

SEQ ID NO: 36850 - DNA, 25 bp, Mus musculus
aacgttcagtattgccatgggacca

SEQ ID NO: 36851 - DNA, 25 bp, Mus musculus
aacgttccaccaaaagcctacattg

SEQ ID NO: 36852 - DNA, 25 bp, Mus musculus
aacgttccaccataagcctacattg

SEQ ID NO: 36853 - DNA, 25 bp, Mus musculus
aacgttccagcaaaaggtcttcact

SEQ ID NO: 36854 - DNA, 25 bp, Mus musculus
aacgttccagcataaggtcttcact

SEQ ID NO: 36855 - DNA, 25 bp, Mus musculus
aacgttccctgactgcttactagga

SEQ ID NO: 36856 - DNA, 25 bp, Mus musculus
aacgttccctgagtgcttactagga

SEQ ID NO: 36857 - DNA, 25 bp, Mus musculus
aacgttcgtagcagtgtggtggaca

SEQ ID NO: 36858 - DNA, 25 bp, Mus musculus
aacgttcgtagctgtgtggtggaca

SEQ ID NO: 36859 - DNA, 25 bp, Mus musculus
aacgttctacataatacccagcctt

SEQ ID NO: 36860 - DNA, 25 bp, Mus musculus
aacgttctacattatacccagcctt

SEQ ID NO: 36861 - DNA, 25 bp, Mus musculus
aacgttctcatccttgtggactagt

SEQ ID NO: 36862 - DNA, 25 bp, Mus musculus
aacgttctcatcgttgtggactagt

SEQ ID NO: 36863 - DNA, 25 bp, Mus musculus
aacgttctgtgacaaatcggcgctc

SEQ ID NO: 36864 - DNA, 25 bp, Mus musculus
aacgttctgtgagaaatcggcgctc

SEQ ID NO: 36865 - DNA, 25 bp, Mus musculus
aacgttctgtggaaagttacaatat

SEQ ID NO: 36866 - DNA, 25 bp, Mus musculus
aacgttctgtggtaagttacaatat

SEQ ID NO: 36867 - DNA, 25 bp, Mus musculus
aacgttgaaagtcttgttccttcat

SEQ ID NO: 36868 - DNA, 25 bp, Mus musculus
aacgttgaaagtgttgttccttcat

SEQ ID NO: 36869 - DNA, 25 bp, Mus musculus
aacgttgacagccaacacggccaaa

SEQ ID NO: 36870 - DNA, 25 bp, Mus musculus
aacgttgacagcgaacacggccaaa

SEQ ID NO: 36871 - DNA, 25 bp, Mus musculus
aacgttgagtggcacacggagcacc

SEQ ID NO: 36872 - DNA, 25 bp, Mus musculus
aacgttgagtgggacacggagcacc

SEQ ID NO: 36873 - DNA, 25 bp, Mus musculus
aacgttgagttgaagctgccccgag

SEQ ID NO: 36874 - DNA, 25 bp, Mus musculus
aacgttgagttgtagctgccccgag

SEQ ID NO: 36875 - DNA, 25 bp, Mus musculus
aacgttgccaagattcctggtatca

SEQ ID NO: 36876 - DNA, 25 bp, Mus musculus
aacgttgccaagtttcctggtatca

SEQ ID NO: 36877 - DNA, 25 bp, Mus musculus
aacgttgccaatattgtatatatct

SEQ ID NO: 36878 - DNA, 25 bp, Mus musculus
aacgttgccaattttgtatatatct

SEQ ID NO: 36879 - DNA, 25 bp, Mus musculus
aacgttgccatcagagaggctcctg

SEQ ID NO: 36880 - DNA, 25 bp, Mus musculus
aacgttgccatctgagaggctcctg

SEQ ID NO: 36881 - DNA, 25 bp, Mus musculus
aacgttgccgcccaacaatttggcg

SEQ ID NO: 36882 - DNA, 25 bp, Mus musculus
aacgttgccgccgaacaatttggcg

SEQ ID NO: 36883 - DNA, 25 bp, Mus musculus
aacgttgccttgaagctgattctca

SEQ ID NO: 36884 - DNA, 25 bp, Mus musculus
aacgttgccttgtagctgattctca

SEQ ID NO: 36885 - DNA, 25 bp, Mus musculus
aacgttgcgctgagtggtagatgaa

SEQ ID NO: 36886 - DNA, 25 bp, Mus musculus
aacgttgcgctgtgtggtagatgaa

SEQ ID NO: 36887 - DNA, 25 bp, Mus musculus
aacgttgcgttgcatgaccggcagc

SEQ ID NO: 36888 - DNA, 25 bp, Mus musculus
aacgttgcgttggatgaccggcagc

SEQ ID NO: 36889 - DNA, 25 bp, Mus musculus
aacgttgctggtccaacagaatccc

SEQ ID NO: 36890 - DNA, 25 bp, Mus musculus
aacgttgctggtgcaacagaatccc

SEQ ID NO: 36891 - DNA, 25 bp, Mus musculus
aacgttgcttgcacagttgctaaga

SEQ ID NO: 36892 - DNA, 25 bp, Mus musculus
aacgttgcttgctcagttgctaaga

SEQ ID NO: 36893 - DNA, 25 bp, Mus musculus
aacgttggtaatatgatcacagcac

SEQ ID NO: 36894 - DNA, 25 bp, Mus musculus
aacgttggtaatttgatcacagcac

SEQ ID NO: 36895 - DNA, 25 bp, Mus musculus
aacgttggtgctactgcttggtgga

SEQ ID NO: 36896 - DNA, 25 bp, Mus musculus
aacgttggtgcttctgcttggtgga

SEQ ID NO: 36897 - DNA, 25 bp, Mus musculus
aacgttgtcaacctgacacttgtgg

SEQ ID NO: 36898 - DNA, 25 bp, Mus musculus
aacgttgtcaacgtgacacttgtgg

SEQ ID NO: 36899 - DNA, 25 bp, Mus musculus
aacgttgtgggacagctatcaggaa

SEQ ID NO: 36900 - DNA, 25 bp, Mus musculus
aacgttgtgggagagctatcaggaa

SEQ ID NO: 36901 - DNA, 25 bp, Mus musculus
aacgttgttgggacaaggcgatgcc

SEQ ID NO: 36902 - DNA, 25 bp, Mus musculus
aacgttgttgggtcaaggcgatgcc

SEQ ID NO: 36903 - DNA, 25 bp, Mus musculus
aacgttgttttgctgaggctgacta

SEQ ID NO: 36904 - DNA, 25 bp, Mus musculus
aacgttgttttggtgaggctgacta

SEQ ID NO: 36905 - DNA, 25 bp, Mus musculus
aacgtttcacttaaggttggcactg

SEQ ID NO: 36906 - DNA, 25 bp, Mus musculus
aacgtttcactttaggttggcactg

SEQ ID NO: 36907 - DNA, 25 bp, Mus musculus
aacgtttcaggtacccagggcagca

SEQ ID NO: 36908 - DNA, 25 bp, Mus musculus
aacgtttcaggttcccagggcagca

SEQ ID NO: 36909 - DNA, 25 bp, Mus musculus
aacgtttcccttctacagttgtatg

SEQ ID NO: 36910 - DNA, 25 bp, Mus musculus
aacgtttcccttgtacagttgtatg

SEQ ID NO: 36911 - DNA, 25 bp, Mus musculus
aacgtttcgtggagatgactgcaga

SEQ ID NO: 36912 - DNA, 25 bp, Mus musculus
aacgtttcgtggtgatgactgcaga

SEQ ID NO: 36913 - DNA, 25 bp, Mus musculus
aacgtttcttcaaaatcatccccag

SEQ ID NO: 36914 - DNA, 25 bp, Mus musculus
aacgtttcttcataatcatccccag

SEQ ID NO: 36915 - DNA, 25 bp, Mus musculus
aacgtttggagtaggctggccacct

SEQ ID NO: 36916 - DNA, 25 bp, Mus musculus
aacgtttggagttggctggccacct

SEQ ID NO: 36917 - DNA, 25 bp, Mus musculus
aacgtttgtcgcatttccgttgtga

SEQ ID NO: 36918 - DNA, 25 bp, Mus musculus
aacgtttgtcgcttttccgttgtga

SEQ ID NO: 36919 - DNA, 25 bp, Mus musculus
aacgtttgtctcattttgcggtact

SEQ ID NO: 36920 - DNA, 25 bp, Mus musculus
aacgtttgtctctttttgcggtact

SEQ ID NO: 36921 - DNA, 25 bp, Mus musculus
aacgtttgtttccttggctatgcac

SEQ ID NO: 36922 - DNA, 25 bp, Mus musculus
aacgtttgtttcgttggctatgcac

SEQ ID NO: 36923 - DNA, 25 bp, Mus musculus
aacgttttacccagaaacacagctg

SEQ ID NO: 36924 - DNA, 25 bp, Mus musculus
aacgttttaccctgaaacacagctg

SEQ ID NO: 36925 - DNA, 25 bp, Mus musculus
aacgttttccaacagtgatcacaca

SEQ ID NO: 36926 - DNA, 25 bp, Mus musculus
aacgttttccaagagtgatcacaca

SEQ ID NO: 36927 - DNA, 25 bp, Mus musculus
aacgttttgacactagttgactaca

SEQ ID NO: 36928 - DNA, 25 bp, Mus musculus
aacgttttgacagtagttgactaca

SEQ ID NO: 36929 - DNA, 25 bp, Mus musculus
aactaaaatagtactacacatggaa

SEQ ID NO: 36930 - DNA, 25 bp, Mus musculus
aactaaaatagttctacacatggaa

SEQ ID NO: 36931 - DNA, 25 bp, Mus musculus
aactaaaatcatcttgcctggtggc

SEQ ID NO: 36932 - DNA, 25 bp, Mus musculus
aactaaaatcatgttgcctggtggc

SEQ ID NO: 36933 - DNA, 25 bp, Mus musculus
aactaaaattcaacagtgactcttc

SEQ ID NO: 36934 - DNA, 25 bp, Mus musculus
aactaaaattcatcagtgactcttc

SEQ ID NO: 36935 - DNA, 25 bp, Mus musculus
aactaaaattccaatcccagctctc

SEQ ID NO: 36936 - DNA, 25 bp, Mus musculus
aactaaaattcctatcccagctctc

SEQ ID NO: 36937 - DNA, 25 bp, Mus musculus
aactaaacctttacagcaacaactg

SEQ ID NO: 36938 - DNA, 25 bp, Mus musculus
aactaaaccttttcagcaacaactg

SEQ ID NO: 36939 - DNA, 25 bp, Mus musculus
aactaaacgcggcatccagcagtct

SEQ ID NO: 36940 - DNA, 25 bp, Mus musculus
aactaaacgcgggatccagcagtct

SEQ ID NO: 36941 - DNA, 25 bp, Mus musculus
aactaaactacacccttccgtgaga

SEQ ID NO: 36942 - DNA, 25 bp, Mus musculus
aactaaactacagccttccgtgaga

SEQ ID NO: 36943 - DNA, 25 bp, Mus musculus
aactaaagacctcacagtagcctgt

SEQ ID NO: 36944 - DNA, 25 bp, Mus musculus
aactaaagacctgacagtagcctgt

SEQ ID NO: 36945 - DNA, 25 bp, Mus musculus
aactaaagatggactgatcgtcccc

SEQ ID NO: 36946 - DNA, 25 bp, Mus musculus
aactaaagatggtctgatcgtcccc

SEQ ID NO: 36947 - DNA, 25 bp, Mus musculus
aactaaagcacaagctctccctgag

SEQ ID NO: 36948 - DNA, 25 bp, Mus musculus
aactaaagcacatgctctccctgag

SEQ ID NO: 36949 - DNA, 25 bp, Mus musculus
aactaaagcttcacagaaaccttga

SEQ ID NO: 36950 - DNA, 25 bp, Mus musculus
aactaaagcttctcagaaaccttga

SEQ ID NO: 36951 - DNA, 25 bp, Mus musculus
aactaaatgaccacagtgcatccct

SEQ ID NO: 36952 - DNA, 25 bp, Mus musculus
aactaaatgacctcagtgcatccct

SEQ ID NO: 36953 - DNA, 25 bp, Mus musculus
aactaaattcttctctcttaccctg

SEQ ID NO: 36954 - DNA, 25 bp, Mus musculus
aactaaattcttgtctcttaccctg

SEQ ID NO: 36955 - DNA, 25 bp, Mus musculus
aactaaatttatcacttgaccaaat

SEQ ID NO: 36956 - DNA, 25 bp, Mus musculus
aactaaatttatgacttgaccaaat

SEQ ID NO: 36957 - DNA, 25 bp, Mus musculus
aactaacaacaaacacctggtattt

SEQ ID NO: 36958 - DNA, 25 bp, Mus musculus
aactaacaacaatcacctggtattt

SEQ ID NO: 36959 - DNA, 25 bp, Mus musculus
aactaacaacatctttccatcgctt

SEQ ID NO: 36960 - DNA, 25 bp, Mus musculus
aactaacaacatgtttccatcgctt

SEQ ID NO: 36961 - DNA, 25 bp, Mus musculus
aactaacaactgacctactaggtga

SEQ ID NO: 36962 - DNA, 25 bp, Mus musculus
aactaacaactgtcctactaggtga

SEQ ID NO: 36963 - DNA, 25 bp, Mus musculus
aactaacacatccacatacatactc

SEQ ID NO: 36964 - DNA, 25 bp, Mus musculus
aactaacacatcgacatacatactc

SEQ ID NO: 36965 - DNA, 25 bp, Mus musculus
aactaacactgcatccttggacgaa

SEQ ID NO: 36966 - DNA, 25 bp, Mus musculus
aactaacactgcttccttggacgaa

SEQ ID NO: 36967 - DNA, 25 bp, Mus musculus
aactaaccaccaagaacctcttctg

SEQ ID NO: 36968 - DNA, 25 bp, Mus musculus
aactaaccaccatgaacctcttctg

SEQ ID NO: 36969 - DNA, 25 bp, Mus musculus
aactaaccagtacaccattgtctct

SEQ ID NO: 36970 - DNA, 25 bp, Mus musculus
aactaaccagtagaccattgtctct

SEQ ID NO: 36971 - DNA, 25 bp, Mus musculus
aactaaccattgactgcaaccttgc

SEQ ID NO: 36972 - DNA, 25 bp, Mus musculus
aactaaccattgtctgcaaccttgc

SEQ ID NO: 36973 - DNA, 25 bp, Mus musculus
aactaaccatttcatgagtgcaagg

SEQ ID NO: 36974 - DNA, 25 bp, Mus musculus
aactaaccatttgatgagtgcaagg

SEQ ID NO: 36975 - DNA, 25 bp, Mus musculus
aactaaccgacaacagtgtcacaga

SEQ ID NO: 36976 - DNA, 25 bp, Mus musculus
aactaaccgacatcagtgtcacaga

SEQ ID NO: 36977 - DNA, 25 bp, Mus musculus
aactaacctctaatccttgggattg

SEQ ID NO: 36978 - DNA, 25 bp, Mus musculus
aactaacctctattccttgggattg

SEQ ID NO: 36979 - DNA, 25 bp, Mus musculus
aactaacctgaaacactcagcctgc

SEQ ID NO: 36980 - DNA, 25 bp, Mus musculus
aactaacctgaatcactcagcctgc

SEQ ID NO: 36981 - DNA, 25 bp, Mus musculus
aactaacctgctatgtccaggtcac

SEQ ID NO: 36982 - DNA, 25 bp, Mus musculus
aactaacctgctttgtccaggtcac

SEQ ID NO: 36983 - DNA, 25 bp, Mus musculus
aactaacgtgtcatcactaaagcag

SEQ ID NO: 36984 - DNA, 25 bp, Mus musculus
aactaacgtgtcttcactaaagcag

SEQ ID NO: 36985 - DNA, 25 bp, Mus musculus
aactaactcccacagtcactttgag

SEQ ID NO: 36986 - DNA, 25 bp, Mus musculus
aactaactcccagagtcactttgag

SEQ ID NO: 36987 - DNA, 25 bp, Mus musculus
aactaactcccgattagagactgca

SEQ ID NO: 36988 - DNA, 25 bp, Mus musculus
aactaactcccgtttagagactgca

SEQ ID NO: 36989 - DNA, 25 bp, Mus musculus
aactaactctcacgaagttcctcat

SEQ ID NO: 36990 - DNA, 25 bp, Mus musculus
aactaactctcaggaagttcctcat

SEQ ID NO: 36991 - DNA, 25 bp, Mus musculus
aactaactcttcacagttggcatag

SEQ ID NO: 36992 - DNA, 25 bp, Mus musculus
aactaactcttctcagttggcatag

SEQ ID NO: 36993 - DNA, 25 bp, Mus musculus
aactaactgaggcacaatggacttg

SEQ ID NO: 36994 - DNA, 25 bp, Mus musculus
aactaactgagggacaatggacttg

SEQ ID NO: 36995 - DNA, 25 bp, Mus musculus
aactaactgcaactcctgttggttg

SEQ ID NO: 36996 - DNA, 25 bp, Mus musculus
aactaactgcaagtcctgttggttg

SEQ ID NO: 36997 - DNA, 25 bp, Mus musculus
aactaactgcctagcataccgcgtc

SEQ ID NO: 36998 - DNA, 25 bp, Mus musculus
aactaactgccttgcataccgcgtc

SEQ ID NO: 36999 - DNA, 25 bp, Mus musculus
aactaactgcttcttgtggtcatcc

SEQ ID NO: 37000 - DNA, 25 bp, Mus musculus
aactaactgcttgttgtggtcatcc

SEQ ID NO: 37001 - DNA, 25 bp, Mus musculus
aactaactgtacagtgttctcaatg

SEQ ID NO: 37002 - DNA, 25 bp, Mus musculus
aactaactgtacatctcagcctttg

SEQ ID NO: 37003 - DNA, 25 bp, Mus musculus
aactaactgtactgtgttctcaatg

SEQ ID NO: 37004 - DNA, 25 bp, Mus musculus
aactaactgtacttctcagcctttg

SEQ ID NO: 37005 - DNA, 25 bp, Mus musculus
aactaactgtccctctgtggctggg

SEQ ID NO: 37006 - DNA, 25 bp, Mus musculus
aactaactgtccgtctgtggctggg

SEQ ID NO: 37007 - DNA, 25 bp, Mus musculus
aactaacttagccacatctgtgaat

SEQ ID NO: 37008 - DNA, 25 bp, Mus musculus
aactaacttagcgacatctgtgaat

SEQ ID NO: 37009 - DNA, 25 bp, Mus musculus
aactaacttctgcaacaatggttct

SEQ ID NO: 37010 - DNA, 25 bp, Mus musculus
aactaacttctggaacaatggttct

SEQ ID NO: 37011 - DNA, 25 bp, Mus musculus
aactaacttggtagaacagctggcc

SEQ ID NO: 37012 - DNA, 25 bp, Mus musculus
aactaacttggttgaacagctggcc

SEQ ID NO: 37013 - DNA, 25 bp, Mus musculus
aactaacttgtgctgttcccagatg

SEQ ID NO: 37014 - DNA, 25 bp, Mus musculus
aactaacttgtggtgttcccagatg

SEQ ID NO: 37015 - DNA, 25 bp, Mus musculus
aactaactttacattgatactcatg

SEQ ID NO: 37016 - DNA, 25 bp, Mus musculus
aactaactttactttgatactcatg

SEQ ID NO: 37017 - DNA, 25 bp, Mus musculus
aactaagaattgcatgccccatgac

SEQ ID NO: 37018 - DNA, 25 bp, Mus musculus
aactaagaattggatgccccatgac

SEQ ID NO: 37019 - DNA, 25 bp, Mus musculus
aactaagacacaagggcatctcagt

SEQ ID NO: 37020 - DNA, 25 bp, Mus musculus
aactaagacacatgggcatctcagt

SEQ ID NO: 37021 - DNA, 25 bp, Mus musculus
aactaagacaggctcttctccagaa

SEQ ID NO: 37022 - DNA, 25 bp, Mus musculus
aactaagacagggtcttctccagaa

SEQ ID NO: 37023 - DNA, 25 bp, Mus musculus
aactaagacatgaagccgtggtaca

SEQ ID NO: 37024 - DNA, 25 bp, Mus musculus
aactaagacatgtagccgtggtaca

SEQ ID NO: 37025 - DNA, 25 bp, Mus musculus
aactaagactccagtcatggatgta

SEQ ID NO: 37026 - DNA, 25 bp, Mus musculus
aactaagactcctgtcatggatgta

SEQ ID NO: 37027 - DNA, 25 bp, Mus musculus
aactaagagatgattatgtcgtaca

SEQ ID NO: 37028 - DNA, 25 bp, Mus musculus
aactaagagatgtttatgtcgtaca

SEQ ID NO: 37029 - DNA, 25 bp, Mus musculus
aactaagataaaactcctctctggc

SEQ ID NO: 37030 - DNA, 25 bp, Mus musculus
aactaagataaatctcctctctggc

SEQ ID NO: 37031 - DNA, 25 bp, Mus musculus
aactaagcaactaggtgagaccttg

SEQ ID NO: 37032 - DNA, 25 bp, Mus musculus
aactaagcaacttggtgagaccttg

SEQ ID NO: 37033 - DNA, 25 bp, Mus musculus
aactaagcagaaatgggagcccgtg

SEQ ID NO: 37034 - DNA, 25 bp, Mus musculus
aactaagcagaattgggagcccgtg

SEQ ID NO: 37035 - DNA, 25 bp, Mus musculus
aactaagcccataaacacgtttgat

SEQ ID NO: 37036 - DNA, 25 bp, Mus musculus
aactaagcccattaacacgtttgat

SEQ ID NO: 37037 - DNA, 25 bp, Mus musculus
aactaagcctggatcttcttctgat

SEQ ID NO: 37038 - DNA, 25 bp, Mus musculus
aactaagcctggttcttcttctgat

SEQ ID NO: 37039 - DNA, 25 bp, Mus musculus
aactaagctattacagtccccagtg

SEQ ID NO: 37040 - DNA, 25 bp, Mus musculus
aactaagctatttcagtccccagtg

SEQ ID NO: 37041 - DNA, 25 bp, Mus musculus
aactaagctccaagcactgttgctg

SEQ ID NO: 37042 - DNA, 25 bp, Mus musculus
aactaagctccatgcactgttgctg

SEQ ID NO: 37043 - DNA, 25 bp, Mus musculus
aactaagctgctcaccaaactctgc

SEQ ID NO: 37044 - DNA, 25 bp, Mus musculus
aactaagctgctgaccaaactctgc

SEQ ID NO: 37045 - DNA, 25 bp, Mus musculus
aactaagcttccagcaagatcttgt

SEQ ID NO: 37046 - DNA, 25 bp, Mus musculus
aactaagcttcctgcaagatcttgt

SEQ ID NO: 37047 - DNA, 25 bp, Mus musculus
aactaaggaagtatcagctgctcca

SEQ ID NO: 37048 - DNA, 25 bp, Mus musculus
aactaaggaagtttcagctgctcca

SEQ ID NO: 37049 - DNA, 25 bp, Mus musculus
aactaaggagtgagtctgcaggcag

SEQ ID NO: 37050 - DNA, 25 bp, Mus musculus
aactaaggagtgtgtctgcaggcag

SEQ ID NO: 37051 - DNA, 25 bp, Mus musculus
aactaaggcaggacccctcagagat

SEQ ID NO: 37052 - DNA, 25 bp, Mus musculus
aactaaggcaggtcccctcagagat

SEQ ID NO: 37053 - DNA, 25 bp, Mus musculus
aactaaggctacacagtgtgacctt

SEQ ID NO: 37054 - DNA, 25 bp, Mus musculus
aactaaggctactcagtgtgacctt

SEQ ID NO: 37055 - DNA, 25 bp, Mus musculus
aactaaggtctgagtcgccttcttg

SEQ ID NO: 37056 - DNA, 25 bp, Mus musculus
aactaaggtctgtgtcgccttcttg

SEQ ID NO: 37057 - DNA, 25 bp, Mus musculus
aactaagtacagagtgcctgctccc

SEQ ID NO: 37058 - DNA, 25 bp, Mus musculus
aactaagtacagtgtgcctgctccc

SEQ ID NO: 37059 - DNA, 25 bp, Mus musculus
aactaagtatgtacagcctggctgt

SEQ ID NO: 37060 - DNA, 25 bp, Mus musculus
aactaagtatgttcagcctggctgt

SEQ ID NO: 37061 - DNA, 25 bp, Mus musculus
aactaagtcaacagtgtctcagaac

SEQ ID NO: 37062 - DNA, 25 bp, Mus musculus
aactaagtcaactgtgtctcagaac

SEQ ID NO: 37063 - DNA, 25 bp, Mus musculus
aactaagtcccaccaggttgacaag

SEQ ID NO: 37064 - DNA, 25 bp, Mus musculus
aactaagtcccagcaggttgacaag

SEQ ID NO: 37065 - DNA, 25 bp, Mus musculus
aactaagtgcttccagatcctttcg

SEQ ID NO: 37066 - DNA, 25 bp, Mus musculus
aactaagtgcttgcagatcctttcg

SEQ ID NO: 37067 - DNA, 25 bp, Mus musculus
aactaagtggcacacaggcatttct

SEQ ID NO: 37068 - DNA, 25 bp, Mus musculus
aactaagtggcagacaggcatttct

SEQ ID NO: 37069 - DNA, 25 bp, Mus musculus
aactaagtgtggattggcttcatac

SEQ ID NO: 37070 - DNA, 25 bp, Mus musculus
aactaagtgtggtttggcttcatac

SEQ ID NO: 37071 - DNA, 25 bp, Mus musculus
aactaagtgttgactatgatgtttt

SEQ ID NO: 37072 - DNA, 25 bp, Mus musculus
aactaagtgttgtctatgatgtttt

SEQ ID NO: 37073 - DNA, 25 bp, Mus musculus
aactaagttgccattccttgaatga

SEQ ID NO: 37074 - DNA, 25 bp, Mus musculus
aactaagttgcctttccttgaatga

SEQ ID NO: 37075 - DNA, 25 bp, Mus musculus
aactaagtttttagtgctcttgcaa

SEQ ID NO: 37076 - DNA, 25 bp, Mus musculus
aactaagttttttgtgctcttgcaa

SEQ ID NO: 37077 - DNA, 25 bp, Mus musculus
aactaataacagcatgtccccagat

SEQ ID NO: 37078 - DNA, 25 bp, Mus musculus
aactaataacaggatgtccccagat

SEQ ID NO: 37079 - DNA, 25 bp, Mus musculus
aactaataccgccagagctgtgcat

SEQ ID NO: 37080 - DNA, 25 bp, Mus musculus
aactaataccgcgagagctgtgcat

SEQ ID NO: 37081 - DNA, 25 bp, Mus musculus
aactaatagggacccattcactaac

SEQ ID NO: 37082 - DNA, 25 bp, Mus musculus
aactaatagggagccattcactaac

SEQ ID NO: 37083 - DNA, 25 bp, Mus musculus
aactaatatttcacaagctgggcat

SEQ ID NO: 37084 - DNA, 25 bp, Mus musculus
aactaatatttctcaagctgggcat

SEQ ID NO: 37085 - DNA, 25 bp, Mus musculus
aactaatcaatgctgaggtggctaa

SEQ ID NO: 37086 - DNA, 25 bp, Mus musculus
aactaatcaatggtgaggtggctaa

SEQ ID NO: 37087 - DNA, 25 bp, Mus musculus
aactaatcaggcatttgagccagga

SEQ ID NO: 37088 - DNA, 25 bp, Mus musculus
aactaatcaggcttttgagccagga

SEQ ID NO: 37089 - DNA, 25 bp, Mus musculus
aactaatccaataaaagccgccttg

SEQ ID NO: 37090 - DNA, 25 bp, Mus musculus
aactaatccaattaaagccgccttg

SEQ ID NO: 37091 - DNA, 25 bp, Mus musculus
aactaatccattccactcagtattc

SEQ ID NO: 37092 - DNA, 25 bp, Mus musculus
aactaatccattgcactcagtattc

SEQ ID NO: 37093 - DNA, 25 bp, Mus musculus
aactaatcctatcttgcttttgtat

SEQ ID NO: 37094 - DNA, 25 bp, Mus musculus
aactaatcctatgttgcttttgtat

SEQ ID NO: 37095 - DNA, 25 bp, Mus musculus
aactaatgaaccatattcggtctgt

SEQ ID NO: 37096 - DNA, 25 bp, Mus musculus
aactaatgaaccttattcggtctgt

SEQ ID NO: 37097 - DNA, 25 bp, Mus musculus
aactaatgagtaactgctgcagcag

SEQ ID NO: 37098 - DNA, 25 bp, Mus musculus
aactaatgagtatctgctgcagcag

SEQ ID NO: 37099 - DNA, 25 bp, Mus musculus
aactaatgcgttaactagcctcaaa

SEQ ID NO: 37100 - DNA, 25 bp, Mus musculus
aactaatgcgtttactagcctcaaa

SEQ ID NO: 37101 - DNA, 25 bp, Mus musculus
aactaatggatcacttacccagaaa

SEQ ID NO: 37102 - DNA, 25 bp, Mus musculus
aactaatggatctcttacccagaaa

SEQ ID NO: 37103 - DNA, 25 bp, Mus musculus
aactaattaccgactgtacgcctat

SEQ ID NO: 37104 - DNA, 25 bp, Mus musculus
aactaattaccgtctgtacgcctat

SEQ ID NO: 37105 - DNA, 25 bp, Mus musculus
aactaattggtgagttccatgcaga

SEQ ID NO: 37106 - DNA, 25 bp, Mus musculus
aactaattggtgtgttccatgcaga

SEQ ID NO: 37107 - DNA, 25 bp, Mus musculus
aactaatttattatctcctggcccg

SEQ ID NO: 37108 - DNA, 25 bp, Mus musculus
aactaatttattttctcctggcccg

SEQ ID NO: 37109 - DNA, 25 bp, Mus musculus
aactaatttgttagacattccatgt

SEQ ID NO: 37110 - DNA, 25 bp, Mus musculus
aactaatttgtttgacattccatgt

SEQ ID NO: 37111 - DNA, 25 bp, Mus musculus
aactacaaacttcactctacactat

SEQ ID NO: 37112 - DNA, 25 bp, Mus musculus
aactacaaacttgactctacactat

SEQ ID NO: 37113 - DNA, 25 bp, Mus musculus
aactacaaagcacagagatcccata

SEQ ID NO: 37114 - DNA, 25 bp, Mus musculus
aactacaaagcagagagatcccata

SEQ ID NO: 37115 - DNA, 25 bp, Mus musculus
aactacaaagggaacgagccagcaa

SEQ ID NO: 37116 - DNA, 25 bp, Mus musculus
aactacaaagggtacgagccagcaa

SEQ ID NO: 37117 - DNA, 25 bp, Mus musculus
aactacaacctgatctaccctccag

SEQ ID NO: 37118 - DNA, 25 bp, Mus musculus
aactacaacctgctgctgctagaaa

SEQ ID NO: 37119 - DNA, 25 bp, Mus musculus
aactacaacctggtgctgctagaaa

SEQ ID NO: 37120 - DNA, 25 bp, Mus musculus
aactacaacctgttctaccctccag

SEQ ID NO: 37121 - DNA, 25 bp, Mus musculus
aactacaacgtaaatctaagggaga

SEQ ID NO: 37122 - DNA, 25 bp, Mus musculus
aactacaacgtatatctaagggaga

SEQ ID NO: 37123 - DNA, 25 bp, Mus musculus
aactacaatcatctcaggaaaaggg

SEQ ID NO: 37124 - DNA, 25 bp, Mus musculus
aactacaatcatgtcaggaaaaggg

SEQ ID NO: 37125 - DNA, 25 bp, Mus musculus
aactacaatggccacacgtgtctgc

SEQ ID NO: 37126 - DNA, 25 bp, Mus musculus
aactacaatggcgacacgtgtctgc

SEQ ID NO: 37127 - DNA, 25 bp, Mus musculus
aactacacacatatgctatgtcact

SEQ ID NO: 37128 - DNA, 25 bp, Mus musculus
aactacacacatttgctatgtcact

SEQ ID NO: 37129 - DNA, 25 bp, Mus musculus
aactacacaggacattcttcgggct

SEQ ID NO: 37130 - DNA, 25 bp, Mus musculus
aactacacaggagattcttcgggct

SEQ ID NO: 37131 - DNA, 25 bp, Mus musculus
aactacaccgttcaggcgacagaca

SEQ ID NO: 37132 - DNA, 25 bp, Mus musculus
aactacaccgttgaggcgacagaca

SEQ ID NO: 37133 - DNA, 25 bp, Mus musculus
aactacacctgcagcacctgaggca

SEQ ID NO: 37134 - DNA, 25 bp, Mus musculus
aactacacctgctgcacctgaggca

SEQ ID NO: 37135 - DNA, 25 bp, Mus musculus
aactacactcaccatgttttcatga

SEQ ID NO: 37136 - DNA, 25 bp, Mus musculus
aactacactcacgatgttttcatga

SEQ ID NO: 37137 - DNA, 25 bp, Mus musculus
aactacactcttcttttaatttgca

SEQ ID NO: 37138 - DNA, 25 bp, Mus musculus
aactacactcttgttttaatttgca

SEQ ID NO: 37139 - DNA, 25 bp, Mus musculus
aactacactgtgacttcaacatctc

SEQ ID NO: 37140 - DNA, 25 bp, Mus musculus
aactacactgtgtcttcaacatctc

SEQ ID NO: 37141 - DNA, 25 bp, Mus musculus
aactacacttatcaggtgggctcct

SEQ ID NO: 37142 - DNA, 25 bp, Mus musculus
aactacacttatgaggtgggctcct

SEQ ID NO: 37143 - DNA, 25 bp, Mus musculus
aactacagaatacctgagggccagg

SEQ ID NO: 37144 - DNA, 25 bp, Mus musculus
aactacagaatagctgagggccagg

SEQ ID NO: 37145 - DNA, 25 bp, Mus musculus
aactacagaggtcctggatgctacc

SEQ ID NO: 37146 - DNA, 25 bp, Mus musculus
aactacagaggtgctggatgctacc

SEQ ID NO: 37147 - DNA, 25 bp, Mus musculus
aactacagagtaagacggtggctat

SEQ ID NO: 37148 - DNA, 25 bp, Mus musculus
aactacagagtactgatgccctcgt

SEQ ID NO: 37149 - DNA, 25 bp, Mus musculus
aactacagagtagtgatgccctcgt

SEQ ID NO: 37150 - DNA, 25 bp, Mus musculus
aactacagagtatgacggtggctat

SEQ ID NO: 37151 - DNA, 25 bp, Mus musculus
aactacagagtcacggattgcattt

SEQ ID NO: 37152 - DNA, 25 bp, Mus musculus
aactacagagtctcggattgcattt

SEQ ID NO: 37153 - DNA, 25 bp, Mus musculus
aactacagatccagaggtgttagct

SEQ ID NO: 37154 - DNA, 25 bp, Mus musculus
aactacagatcctgaggtgttagct

SEQ ID NO: 37155 - DNA, 25 bp, Mus musculus
aactacagattgacatggtcagcaa

SEQ ID NO: 37156 - DNA, 25 bp, Mus musculus
aactacagattgtcatggtcagcaa

SEQ ID NO: 37157 - DNA, 25 bp, Mus musculus
aactacagctgcaaggtttctgaga

SEQ ID NO: 37158 - DNA, 25 bp, Mus musculus
aactacagctgctaggtttctgaga

SEQ ID NO: 37159 - DNA, 25 bp, Mus musculus
aactacaggcaactattgacagctg

SEQ ID NO: 37160 - DNA, 25 bp, Mus musculus
aactacaggcaagtattgacagctg

SEQ ID NO: 37161 - DNA, 25 bp, Mus musculus
aactacaggccactatcataattga

SEQ ID NO: 37162 - DNA, 25 bp, Mus musculus
aactacaggccagtatcataattga

SEQ ID NO: 37163 - DNA, 25 bp, Mus musculus
aactacaggttgaagaattggattc

SEQ ID NO: 37164 - DNA, 25 bp, Mus musculus
aactacaggttgtagaattggattc

SEQ ID NO: 37165 - DNA, 25 bp, Mus musculus
aactacagtatgctgtggcatatac

SEQ ID NO: 37166 - DNA, 25 bp, Mus musculus
aactacagtatggtgtggcatatac

SEQ ID NO: 37167 - DNA, 25 bp, Mus musculus
aactacagttatcagagccccgtct

SEQ ID NO: 37168 - DNA, 25 bp, Mus musculus
aactacagttatgagagccccgtct

SEQ ID NO: 37169 - DNA, 25 bp, Mus musculus
aactacagttggagtaataacacaa

SEQ ID NO: 37170 - DNA, 25 bp, Mus musculus
aactacagttggtgtaataacacaa

SEQ ID NO: 37171 - DNA, 25 bp, Mus musculus
aactacagtttgactcagaggaatc

SEQ ID NO: 37172 - DNA, 25 bp, Mus musculus
aactacagtttgtctcagaggaatc

SEQ ID NO: 37173 - DNA, 25 bp, Mus musculus
aactacatactgacacctgggtttt

SEQ ID NO: 37174 - DNA, 25 bp, Mus musculus
aactacatactgtcacctgggtttt

SEQ ID NO: 37175 - DNA, 25 bp, Mus musculus
aactacatagtcaagtgtttggagc

SEQ ID NO: 37176 - DNA, 25 bp, Mus musculus
aactacatagtctagtgtttggagc

SEQ ID NO: 37177 - DNA, 25 bp, Mus musculus
aactacatccccagggattatctcc

SEQ ID NO: 37178 - DNA, 25 bp, Mus musculus
aactacatcccctgggattatctcc

SEQ ID NO: 37179 - DNA, 25 bp, Mus musculus
aactacatccgtctggaggagctac

SEQ ID NO: 37180 - DNA, 25 bp, Mus musculus
aactacatccgtgtggaggagctac

SEQ ID NO: 37181 - DNA, 25 bp, Mus musculus
aactacatcctacaggactccttag

SEQ ID NO: 37182 - DNA, 25 bp, Mus musculus
aactacatcctagaggactccttag

SEQ ID NO: 37183 - DNA, 25 bp, Mus musculus
aactacatcgtgctgactgggtact

SEQ ID NO: 37184 - DNA, 25 bp, Mus musculus
aactacatcgtggtgactgggtact

SEQ ID NO: 37185 - DNA, 25 bp, Mus musculus
aactacatctggcaaatttctcgcc

SEQ ID NO: 37186 - DNA, 25 bp, Mus musculus
aactacatctgggaaatttctcgcc

SEQ ID NO: 37187 - DNA, 25 bp, Mus musculus
aactacatctttccttgtgacaaca

SEQ ID NO: 37188 - DNA, 25 bp, Mus musculus
aactacatctttgcttgtgacaaca

SEQ ID NO: 37189 - DNA, 25 bp, Mus musculus
aactacatgactaccgtcatgtcac

SEQ ID NO: 37190 - DNA, 25 bp, Mus musculus
aactacatgacttccgtcatgtcac

SEQ ID NO: 37191 - DNA, 25 bp, Mus musculus
aactacatgcaacttgtctgaccct

SEQ ID NO: 37192 - DNA, 25 bp, Mus musculus
aactacatgcaagttgtctgaccct

SEQ ID NO: 37193 - DNA, 25 bp, Mus musculus
aactacatggagatcctcgaggtcc

SEQ ID NO: 37194 - DNA, 25 bp, Mus musculus
aactacatggagttcctcgaggtcc

SEQ ID NO: 37195 - DNA, 25 bp, Mus musculus
aactacatgtgcattataaggccaa

SEQ ID NO: 37196 - DNA, 25 bp, Mus musculus
aactacatgtgctttataaggccaa

SEQ ID NO: 37197 - DNA, 25 bp, Mus musculus
aactacattcctccagtgttttaag

SEQ ID NO: 37198 - DNA, 25 bp, Mus musculus
aactacattcctgcagtgttttaag

SEQ ID NO: 37199 - DNA, 25 bp, Mus musculus
aactacattcttcctttgatttcat

SEQ ID NO: 37200 - DNA, 25 bp, Mus musculus
aactacattcttgctttgatttcat

SEQ ID NO: 37201 - DNA, 25 bp, Mus musculus
aactacatttcaagctgtggttgaa

SEQ ID NO: 37202 - DNA, 25 bp, Mus musculus
aactacatttcatgctgtggttgaa

SEQ ID NO: 37203 - DNA, 25 bp, Mus musculus
aactacatttttaagggcacaccat

SEQ ID NO: 37204 - DNA, 25 bp, Mus musculus
aactacattttttagggcacaccat

SEQ ID NO: 37205 - DNA, 25 bp, Mus musculus
aactaccaaccaatgcctaagcaga

SEQ ID NO: 37206 - DNA, 25 bp, Mus musculus
aactaccaaccattgcctaagcaga

SEQ ID NO: 37207 - DNA, 25 bp, Mus musculus
aactaccaactgaacttctgttttg

SEQ ID NO: 37208 - DNA, 25 bp, Mus musculus
aactaccaactgtacttctgttttg

SEQ ID NO: 37209 - DNA, 25 bp, Mus musculus
aactaccaatgcagagtttgcccag

SEQ ID NO: 37210 - DNA, 25 bp, Mus musculus
aactaccaatgctgagtttgcccag

SEQ ID NO: 37211 - DNA, 25 bp, Mus musculus
aactaccaatggaggtgctacttac

SEQ ID NO: 37212 - DNA, 25 bp, Mus musculus
aactaccaatggtggtgctacttac

SEQ ID NO: 37213 - DNA, 25 bp, Mus musculus
aactaccagaggatgtggacccaac

SEQ ID NO: 37214 - DNA, 25 bp, Mus musculus
aactaccagaggttgtggacccaac

SEQ ID NO: 37215 - DNA, 25 bp, Mus musculus
aactaccagattaaccagcggacat

SEQ ID NO: 37216 - DNA, 25 bp, Mus musculus
aactaccagatttaccagcggacat

SEQ ID NO: 37217 - DNA, 25 bp, Mus musculus
aactaccagctaattacttcagatg

SEQ ID NO: 37218 - DNA, 25 bp, Mus musculus
aactaccagctatttacttcagatg

SEQ ID NO: 37219 - DNA, 25 bp, Mus musculus
aactaccataggcagtcacccagaa

SEQ ID NO: 37220 - DNA, 25 bp, Mus musculus
aactaccatagggagtcacccagaa

SEQ ID NO: 37221 - DNA, 25 bp, Mus musculus
aactacccaagaacaattctgtaat

SEQ ID NO: 37222 - DNA, 25 bp, Mus musculus
aactacccaagatcaattctgtaat

SEQ ID NO: 37223 - DNA, 25 bp, Mus musculus
aactaccctatgctctcagggacaa

SEQ ID NO: 37224 - DNA, 25 bp, Mus musculus
aactaccctatggtctcagggacaa

SEQ ID NO: 37225 - DNA, 25 bp, Mus musculus
aactaccctctgcttgcataggtaa

SEQ ID NO: 37226 - DNA, 25 bp, Mus musculus
aactaccctctggttgcataggtaa

SEQ ID NO: 37227 - DNA, 25 bp, Mus musculus
aactaccgataaaattctccctact

SEQ ID NO: 37228 - DNA, 25 bp, Mus musculus
aactaccgataatattctccctact

SEQ ID NO: 37229 - DNA, 25 bp, Mus musculus
aactaccgatatcctactgctcgta

SEQ ID NO: 37230 - DNA, 25 bp, Mus musculus
aactaccgatatgctactgctcgta

SEQ ID NO: 37231 - DNA, 25 bp, Mus musculus
aactaccggctcaaggaatatgaaa

SEQ ID NO: 37232 - DNA, 25 bp, Mus musculus
aactaccggctctaggaatatgaaa

SEQ ID NO: 37233 - DNA, 25 bp, Mus musculus
aactaccgggtactcagactcaatg

SEQ ID NO: 37234 - DNA, 25 bp, Mus musculus
aactaccgggtagtcagactcaatg

SEQ ID NO: 37235 - DNA, 25 bp, Mus musculus
aactacctcatcagcaattcgttgg

SEQ ID NO: 37236 - DNA, 25 bp, Mus musculus
aactacctcatctgcaattcgttgg

SEQ ID NO: 37237 - DNA, 25 bp, Mus musculus
aactacctcatgagaaattggctgt

SEQ ID NO: 37238 - DNA, 25 bp, Mus musculus
aactacctcatgtgaaattggctgt

SEQ ID NO: 37239 - DNA, 25 bp, Mus musculus
aactacctgaggaacgtggctttag

SEQ ID NO: 37240 - DNA, 25 bp, Mus musculus
aactacctgaggtacgtggctttag

SEQ ID NO: 37241 - DNA, 25 bp, Mus musculus
aactacctgatcacattgtttctct

SEQ ID NO: 37242 - DNA, 25 bp, Mus musculus
aactacctgatctcattgtttctct

SEQ ID NO: 37243 - DNA, 25 bp, Mus musculus
aactacctgattcgtttgctgctaa

SEQ ID NO: 37244 - DNA, 25 bp, Mus musculus
aactacctgattggtttgctgctaa

SEQ ID NO: 37245 - DNA, 25 bp, Mus musculus
aactacctgcagcaagccggccatg

SEQ ID NO: 37246 - DNA, 25 bp, Mus musculus
aactacctgcaggaagccggccatg

SEQ ID NO: 37247 - DNA, 25 bp, Mus musculus
aactacctggctccctgtaataagg

SEQ ID NO: 37248 - DNA, 25 bp, Mus musculus
aactacctggctgcctgtaataagg

SEQ ID NO: 37249 - DNA, 25 bp, Mus musculus
aactacctgggtaactaaacatgca

SEQ ID NO: 37250 - DNA, 25 bp, Mus musculus
aactacctgggttactaaacatgca

SEQ ID NO: 37251 - DNA, 25 bp, Mus musculus
aactacctgtaactcttgcttcatc

SEQ ID NO: 37252 - DNA, 25 bp, Mus musculus
aactacctgtaagtcttgcttcatc

SEQ ID NO: 37253 - DNA, 25 bp, Mus musculus
aactacctgttgagaccatgtttca

SEQ ID NO: 37254 - DNA, 25 bp, Mus musculus
aactacctgttgtgaccatgtttca

SEQ ID NO: 37255 - DNA, 25 bp, Mus musculus
aactaccttagcaacacaatcaaac

SEQ ID NO: 37256 - DNA, 25 bp, Mus musculus
aactaccttagctacacaatcaaac

SEQ ID NO: 37257 - DNA, 25 bp, Mus musculus
aactaccttgtgcatatctctgtat

SEQ ID NO: 37258 - DNA, 25 bp, Mus musculus
aactaccttgtggatatctctgtat

SEQ ID NO: 37259 - DNA, 25 bp, Mus musculus
aactaccttttaatgcagctgcgcg

SEQ ID NO: 37260 - DNA, 25 bp, Mus musculus
aactaccttttattgcagctgcgcg

SEQ ID NO: 37261 - DNA, 25 bp, Mus musculus
aactacgaacatcgtgcatttgctc

SEQ ID NO: 37262 - DNA, 25 bp, Mus musculus
aactacgaacatggtgcatttgctc

SEQ ID NO: 37263 - DNA, 25 bp, Mus musculus
aactacgaaggcagagggtctccgg

SEQ ID NO: 37264 - DNA, 25 bp, Mus musculus
aactacgaaggctgagggtctccgg

SEQ ID NO: 37265 - DNA, 25 bp, Mus musculus
aactacgactatatcctcagcacag

SEQ ID NO: 37266 - DNA, 25 bp, Mus musculus
aactacgactatttcctcagcacag

SEQ ID NO: 37267 - DNA, 25 bp, Mus musculus
aactacgagatgagtaagcggccat

SEQ ID NO: 37268 - DNA, 25 bp, Mus musculus
aactacgagatgtgtaagcggccat

SEQ ID NO: 37269 - DNA, 25 bp, Mus musculus
aactacgagattcttggcctttcta

SEQ ID NO: 37270 - DNA, 25 bp, Mus musculus
aactacgagattgttggcctttcta

SEQ ID NO: 37271 - DNA, 25 bp, Mus musculus
aactacgagcacctggatatccaaa

SEQ ID NO: 37272 - DNA, 25 bp, Mus musculus
aactacgagcacgtggatatccaaa

SEQ ID NO: 37273 - DNA, 25 bp, Mus musculus
aactacgcttcaattagattcagaa

SEQ ID NO: 37274 - DNA, 25 bp, Mus musculus
aactacgcttcatttagattcagaa

SEQ ID NO: 37275 - DNA, 25 bp, Mus musculus
aactacgcttccagtgtattactaa

SEQ ID NO: 37276 - DNA, 25 bp, Mus musculus
aactacgcttcctgtgtattactaa

SEQ ID NO: 37277 - DNA, 25 bp, Mus musculus
aactacggacacagggtggtgcacc

SEQ ID NO: 37278 - DNA, 25 bp, Mus musculus
aactacggacactgggtggtgcacc

SEQ ID NO: 37279 - DNA, 25 bp, Mus musculus
aactacggagagctggctaactggt

SEQ ID NO: 37280 - DNA, 25 bp, Mus musculus
aactacggagaggtggctaactggt

SEQ ID NO: 37281 - DNA, 25 bp, Mus musculus
aactacggagtgctggttagaccaa

SEQ ID NO: 37282 - DNA, 25 bp, Mus musculus
aactacggagtggtggttagaccaa

SEQ ID NO: 37283 - DNA, 25 bp, Mus musculus
aactacggcagtacagatgacagat

SEQ ID NO: 37284 - DNA, 25 bp, Mus musculus
aactacggcagttcagatgacagat

SEQ ID NO: 37285 - DNA, 25 bp, Mus musculus
aactacggccgcatgggccatggct

SEQ ID NO: 37286 - DNA, 25 bp, Mus musculus
aactacggccgcttgggccatggct

SEQ ID NO: 37287 - DNA, 25 bp, Mus musculus
aactacggccttagggctcttcaag

SEQ ID NO: 37288 - DNA, 25 bp, Mus musculus
aactacggcctttgggctcttcaag

SEQ ID NO: 37289 - DNA, 25 bp, Mus musculus
aactacggtgaccaaggcaatgctt

SEQ ID NO: 37290 - DNA, 25 bp, Mus musculus
aactacggtgacgaaggcaatgctt

SEQ ID NO: 37291 - DNA, 25 bp, Mus musculus
aactacgtaggactggtggacacct

SEQ ID NO: 37292 - DNA, 25 bp, Mus musculus
aactacgtaggagtggtggacacct

SEQ ID NO: 37293 - DNA, 25 bp, Mus musculus
aactacgtcggtctattagtgccag

SEQ ID NO: 37294 - DNA, 25 bp, Mus musculus
aactacgtcggtgtattagtgccag

SEQ ID NO: 37295 - DNA, 25 bp, Mus musculus
aactacgtcttcatctgcttcagga

SEQ ID NO: 37296 - DNA, 25 bp, Mus musculus
aactacgtcttcttctgcttcagga

SEQ ID NO: 37297 - DNA, 25 bp, Mus musculus
aactacgtgaaaccggacatggcag

SEQ ID NO: 37298 - DNA, 25 bp, Mus musculus
aactacgtgaaagcggacatggcag

SEQ ID NO: 37299 - DNA, 25 bp, Mus musculus
aactacgtgactcccattgaagact

SEQ ID NO: 37300 - DNA, 25 bp, Mus musculus
aactacgtgactgccattgaagact

SEQ ID NO: 37301 - DNA, 25 bp, Mus musculus
aactacgtgcggcatgatgcggttt

SEQ ID NO: 37302 - DNA, 25 bp, Mus musculus
aactacgtgcgggatgatgcggttt

SEQ ID NO: 37303 - DNA, 25 bp, Mus musculus
aactacgtggagatcactcgcatcc

SEQ ID NO: 37304 - DNA, 25 bp, Mus musculus
aactacgtggagttcactcgcatcc

SEQ ID NO: 37305 - DNA, 25 bp, Mus musculus
aactacgttctcagggattgctggg

SEQ ID NO: 37306 - DNA, 25 bp, Mus musculus
aactacgttctctgggattgctggg

SEQ ID NO: 37307 - DNA, 25 bp, Mus musculus
aactactaactcaagatggtacagt

SEQ ID NO: 37308 - DNA, 25 bp, Mus musculus
aactactaactctagatggtacagt

SEQ ID NO: 37309 - DNA, 25 bp, Mus musculus
aactactacaacagctgagatcaca

SEQ ID NO: 37310 - DNA, 25 bp, Mus musculus
aactactacaactgctgagatcaca

SEQ ID NO: 37311 - DNA, 25 bp, Mus musculus
aactactactaaaaattctctttga

SEQ ID NO: 37312 - DNA, 25 bp, Mus musculus
aactactactaataattctctttga

SEQ ID NO: 37313 - DNA, 25 bp, Mus musculus
aactactagatcactgcttcagctg

SEQ ID NO: 37314 - DNA, 25 bp, Mus musculus
aactactagatctctgcttcagctg

SEQ ID NO: 37315 - DNA, 25 bp, Mus musculus
aactactcacacatgtagccagcgt

SEQ ID NO: 37316 - DNA, 25 bp, Mus musculus
aactactcacacttgtagccagcgt

SEQ ID NO: 37317 - DNA, 25 bp, Mus musculus
aactactcactcagcttcatatgac

SEQ ID NO: 37318 - DNA, 25 bp, Mus musculus
aactactcactctgcttcatatgac

SEQ ID NO: 37319 - DNA, 25 bp, Mus musculus
aactactcatatcgaagtggactga

SEQ ID NO: 37320 - DNA, 25 bp, Mus musculus
aactactcatatggaagtggactga

SEQ ID NO: 37321 - DNA, 25 bp, Mus musculus
aactactccagtctcttgtactgac

SEQ ID NO: 37322 - DNA, 25 bp, Mus musculus
aactactccagtgtcttgtactgac

SEQ ID NO: 37323 - DNA, 25 bp, Mus musculus
aactactcccagaacttttactatg

SEQ ID NO: 37324 - DNA, 25 bp, Mus musculus
aactactcccagtacttttactatg

SEQ ID NO: 37325 - DNA, 25 bp, Mus musculus
aactactctcaaagctgtacccaag

SEQ ID NO: 37326 - DNA, 25 bp, Mus musculus
aactactctcaatgctgtacccaag

SEQ ID NO: 37327 - DNA, 25 bp, Mus musculus
aactactctcttctctgatgtgctt

SEQ ID NO: 37328 - DNA, 25 bp, Mus musculus
aactactctcttgtctgatgtgctt

SEQ ID NO: 37329 - DNA, 25 bp, Mus musculus
aactactctgtgatcctgcagtgga

SEQ ID NO: 37330 - DNA, 25 bp, Mus musculus
aactactctgtgttcctgcagtgga

SEQ ID NO: 37331 - DNA, 25 bp, Mus musculus
aactactgatgacttgacttaaaaa

SEQ ID NO: 37332 - DNA, 25 bp, Mus musculus
aactactgatgagttgacttaaaaa

SEQ ID NO: 37333 - DNA, 25 bp, Mus musculus
aactactgattaatttgacacacat

SEQ ID NO: 37334 - DNA, 25 bp, Mus musculus
aactactgattattttgacacacat

SEQ ID NO: 37335 - DNA, 25 bp, Mus musculus
aactactgcaggaccagcttttcca

SEQ ID NO: 37336 - DNA, 25 bp, Mus musculus
aactactgcaggtccagcttttcca

SEQ ID NO: 37337 - DNA, 25 bp, Mus musculus
aactactgcggacttgacccggaag

SEQ ID NO: 37338 - DNA, 25 bp, Mus musculus
aactactgcggagttgacccggaag

SEQ ID NO: 37339 - DNA, 25 bp, Mus musculus
aactactggccacttacaagttcct

SEQ ID NO: 37340 - DNA, 25 bp, Mus musculus
aactactggccagttacaagttcct

SEQ ID NO: 37341 - DNA, 25 bp, Mus musculus
aactactggcccatgaaagactttt

SEQ ID NO: 37342 - DNA, 25 bp, Mus musculus
aactactggcccttgaaagactttt

SEQ ID NO: 37343 - DNA, 25 bp, Mus musculus
aactactggcctattttaatggtgg

SEQ ID NO: 37344 - DNA, 25 bp, Mus musculus
aactactggccttttttaatggtgg

SEQ ID NO: 37345 - DNA, 25 bp, Mus musculus
aactactgggttcagatattttcta

SEQ ID NO: 37346 - DNA, 25 bp, Mus musculus
aactactgggttgagatattttcta

SEQ ID NO: 37347 - DNA, 25 bp, Mus musculus
aactactgtaatagtggaccccact

SEQ ID NO: 37348 - DNA, 25 bp, Mus musculus
aactactgtaattgtggaccccact

SEQ ID NO: 37349 - DNA, 25 bp, Mus musculus
aactactgttctaccaattaaggat

SEQ ID NO: 37350 - DNA, 25 bp, Mus musculus
aactactgttcttccaattaaggat

SEQ ID NO: 37351 - DNA, 25 bp, Mus musculus
aactacttcaagagtatgggagact

SEQ ID NO: 37352 - DNA, 25 bp, Mus musculus
aactacttcaagtgtatgggagact

SEQ ID NO: 37353 - DNA, 25 bp, Mus musculus
aactacttcgccattgccgagaacg

SEQ ID NO: 37354 - DNA, 25 bp, Mus musculus
aactacttcgcctttgccgagaacg

SEQ ID NO: 37355 - DNA, 25 bp, Mus musculus
aactacttctctaacattgttgact

SEQ ID NO: 37356 - DNA, 25 bp, Mus musculus
aactacttctcttacattgttgact

SEQ ID NO: 37357 - DNA, 25 bp, Mus musculus
aactacttgctcagtgttattgtga

SEQ ID NO: 37358 - DNA, 25 bp, Mus musculus
aactacttgctctgtgttattgtga

SEQ ID NO: 37359 - DNA, 25 bp, Mus musculus
aactacttgcttagttccggactgg

SEQ ID NO: 37360 - DNA, 25 bp, Mus musculus
aactacttgctttgttccggactgg

SEQ ID NO: 37361 - DNA, 25 bp, Mus musculus
aactacttggatctggcattctgca

SEQ ID NO: 37362 - DNA, 25 bp, Mus musculus
aactacttggatgtggcattctgca

SEQ ID NO: 37363 - DNA, 25 bp, Mus musculus
aactacttggtacctgtatttaata

SEQ ID NO: 37364 - DNA, 25 bp, Mus musculus
aactacttggtagctgtatttaata

SEQ ID NO: 37365 - DNA, 25 bp, Mus musculus
aactacttgtatctccacttgatta

SEQ ID NO: 37366 - DNA, 25 bp, Mus musculus
aactacttgtatgtccacttgatta

SEQ ID NO: 37367 - DNA, 25 bp, Mus musculus
aactacttgtcaatgcagaatttgg

SEQ ID NO: 37368 - DNA, 25 bp, Mus musculus
aactacttgtcattgcagaatttgg

SEQ ID NO: 37369 - DNA, 25 bp, Mus musculus
aactactttctaccatctcagcagc

SEQ ID NO: 37370 - DNA, 25 bp, Mus musculus
aactactttctagcatctcagcagc

SEQ ID NO: 37371 - DNA, 25 bp, Mus musculus
aactactttgaaacttcaagtcact

SEQ ID NO: 37372 - DNA, 25 bp, Mus musculus
aactactttgaatcttcaagtcact

SEQ ID NO: 37373 - DNA, 25 bp, Mus musculus
aactactttgcacaagtcgactgca

SEQ ID NO: 37374 - DNA, 25 bp, Mus musculus
aactactttgcacgacagaccaatg

SEQ ID NO: 37375 - DNA, 25 bp, Mus musculus
aactactttgcagaagtcgactgca

SEQ ID NO: 37376 - DNA, 25 bp, Mus musculus
aactactttgcaggacagaccaatg

SEQ ID NO: 37377 - DNA, 25 bp, Mus musculus
aactactttggtcgcctgggctacg

SEQ ID NO: 37378 - DNA, 25 bp, Mus musculus
aactactttggtggcctgggctacg

SEQ ID NO: 37379 - DNA, 25 bp, Mus musculus
aactagaagaaaatgttcagccaat

SEQ ID NO: 37380 - DNA, 25 bp, Mus musculus
aactagaagaaattgttcagccaat

SEQ ID NO: 37381 - DNA, 25 bp, Mus musculus
aactagaagggtctgcatcttgcta

SEQ ID NO: 37382 - DNA, 25 bp, Mus musculus
aactagaagggtgtgcatcttgcta

SEQ ID NO: 37383 - DNA, 25 bp, Mus musculus
aactagaagtgtatcatgcttgcct

SEQ ID NO: 37384 - DNA, 25 bp, Mus musculus
aactagaagtgtttcatgcttgcct

SEQ ID NO: 37385 - DNA, 25 bp, Mus musculus
aactagaatagccttgaacacagaa

SEQ ID NO: 37386 - DNA, 25 bp, Mus musculus
aactagaatagcgttgaacacagaa

SEQ ID NO: 37387 - DNA, 25 bp, Mus musculus
aactagaatgagagcctcggccgtg

SEQ ID NO: 37388 - DNA, 25 bp, Mus musculus
aactagaatgagtgcctcggccgtg

SEQ ID NO: 37389 - DNA, 25 bp, Mus musculus
aactagaatgctcgattcttttctt

SEQ ID NO: 37390 - DNA, 25 bp, Mus musculus
aactagaatgctggattcttttctt

SEQ ID NO: 37391 - DNA, 25 bp, Mus musculus
aactagacatctcttgttatcacta

SEQ ID NO: 37392 - DNA, 25 bp, Mus musculus
aactagacatctgttgttatcacta

SEQ ID NO: 37393 - DNA, 25 bp, Mus musculus
aactagacatgacgcttctccatct

SEQ ID NO: 37394 - DNA, 25 bp, Mus musculus
aactagacatgaggcttctccatct

SEQ ID NO: 37395 - DNA, 25 bp, Mus musculus
aactagacatttcatggtaactgcc

SEQ ID NO: 37396 - DNA, 25 bp, Mus musculus
aactagacatttgatggtaactgcc

SEQ ID NO: 37397 - DNA, 25 bp, Mus musculus
aactagactgcccttgaattcatat

SEQ ID NO: 37398 - DNA, 25 bp, Mus musculus
aactagactgccgttgaattcatat

SEQ ID NO: 37399 - DNA, 25 bp, Mus musculus
aactagagactcagacacggaggct

SEQ ID NO: 37400 - DNA, 25 bp, Mus musculus
aactagagactctgacacggaggct

SEQ ID NO: 37401 - DNA, 25 bp, Mus musculus
aactagagattgcaacgaccatggg

SEQ ID NO: 37402 - DNA, 25 bp, Mus musculus
aactagagattggaacgaccatggg

SEQ ID NO: 37403 - DNA, 25 bp, Mus musculus
aactagagcgatcgccagtggtgca

SEQ ID NO: 37404 - DNA, 25 bp, Mus musculus
aactagagcgatggccagtggtgca

SEQ ID NO: 37405 - DNA, 25 bp, Mus musculus
aactagagggttatattggctgatt

SEQ ID NO: 37406 - DNA, 25 bp, Mus musculus
aactagagggttttattggctgatt

SEQ ID NO: 37407 - DNA, 25 bp, Mus musculus
aactagagtggaatgcaggatgctg

SEQ ID NO: 37408 - DNA, 25 bp, Mus musculus
aactagagtggattgcaggatgctg

SEQ ID NO: 37409 - DNA, 25 bp, Mus musculus
aactagatccttagtcatggacttg

SEQ ID NO: 37410 - DNA, 25 bp, Mus musculus
aactagatcctttgtcatggacttg

SEQ ID NO: 37411 - DNA, 25 bp, Mus musculus
aactagatgaggctgtcacagggct

SEQ ID NO: 37412 - DNA, 25 bp, Mus musculus
aactagatgagggtgtcacagggct

SEQ ID NO: 37413 - DNA, 25 bp, Mus musculus
aactagatgtagatggcctcctctt

SEQ ID NO: 37414 - DNA, 25 bp, Mus musculus
aactagatgtagttggcctcctctt

SEQ ID NO: 37415 - DNA, 25 bp, Mus musculus
aactagattaacctcccgtgacact

SEQ ID NO: 37416 - DNA, 25 bp, Mus musculus
aactagattaacgtcccgtgacact

SEQ ID NO: 37417 - DNA, 25 bp, Mus musculus
aactagattggccagtgggcaagcc

SEQ ID NO: 37418 - DNA, 25 bp, Mus musculus
aactagattggcgagtgggcaagcc

SEQ ID NO: 37419 - DNA, 25 bp, Mus musculus
aactagatttacagcttcatttttt

SEQ ID NO: 37420 - DNA, 25 bp, Mus musculus
aactagatttactgcttcatttttt

SEQ ID NO: 37421 - DNA, 25 bp, Mus musculus
aactagatttgtacagaaccagaga

SEQ ID NO: 37422 - DNA, 25 bp, Mus musculus
aactagatttgttcagaaccagaga

SEQ ID NO: 37423 - DNA, 25 bp, Mus musculus
aactagcaatggaggtggcctctca

SEQ ID NO: 37424 - DNA, 25 bp, Mus musculus
aactagcaatggtggtggcctctca

SEQ ID NO: 37425 - DNA, 25 bp, Mus musculus
aactagcagaccaaggcatctacaa

SEQ ID NO: 37426 - DNA, 25 bp, Mus musculus
aactagcagacctaggcatctacaa

SEQ ID NO: 37427 - DNA, 25 bp, Mus musculus
aactagcagttacaagtgagcttgt

SEQ ID NO: 37428 - DNA, 25 bp, Mus musculus
aactagcagttagaagtgagcttgt

SEQ ID NO: 37429 - DNA, 25 bp, Mus musculus
aactagcatatcatgaaactggtat

SEQ ID NO: 37430 - DNA, 25 bp, Mus musculus
aactagcatatcttgaaactggtat

SEQ ID NO: 37431 - DNA, 25 bp, Mus musculus
aactagcatgtgaaagctgactatg

SEQ ID NO: 37432 - DNA, 25 bp, Mus musculus
aactagcatgtgtaagctgactatg

SEQ ID NO: 37433 - DNA, 25 bp, Mus musculus
aactagccacataacttttccaaat

SEQ ID NO: 37434 - DNA, 25 bp, Mus musculus
aactagccacattacttttccaaat

SEQ ID NO: 37435 - DNA, 25 bp, Mus musculus
aactagccagtacagagcctgaacc

SEQ ID NO: 37436 - DNA, 25 bp, Mus musculus
aactagccagtagagagcctgaacc

SEQ ID NO: 37437 - DNA, 25 bp, Mus musculus
aactagccagtgactattggcagtg

SEQ ID NO: 37438 - DNA, 25 bp, Mus musculus
aactagccagtgtctattggcagtg

SEQ ID NO: 37439 - DNA, 25 bp, Mus musculus
aactagcccatgaaggttctgatta

SEQ ID NO: 37440 - DNA, 25 bp, Mus musculus
aactagcccatgtaggttctgatta

SEQ ID NO: 37441 - DNA, 25 bp, Mus musculus
aactagcccgacatcttttcaaaat

SEQ ID NO: 37442 - DNA, 25 bp, Mus musculus
aactagcccgacttcttttcaaaat

SEQ ID NO: 37443 - DNA, 25 bp, Mus musculus
aactagcccttgcactatctttctt

SEQ ID NO: 37444 - DNA, 25 bp, Mus musculus
aactagcccttggactatctttctt

SEQ ID NO: 37445 - DNA, 25 bp, Mus musculus
aactagcctagccaaggatcactga

SEQ ID NO: 37446 - DNA, 25 bp, Mus musculus
aactagcctagcgaaggatcactga

SEQ ID NO: 37447 - DNA, 25 bp, Mus musculus
aactagcctcacctcagcatgatct

SEQ ID NO: 37448 - DNA, 25 bp, Mus musculus
aactagcctcacgtcagcatgatct

SEQ ID NO: 37449 - DNA, 25 bp, Mus musculus
aactagcctcttccagtggctggaa

SEQ ID NO: 37450 - DNA, 25 bp, Mus musculus
aactagcctcttgcagtggctggaa

SEQ ID NO: 37451 - DNA, 25 bp, Mus musculus
aactagcctggcatgtggtagctgc

SEQ ID NO: 37452 - DNA, 25 bp, Mus musculus
aactagcctggcttgtggtagctgc

SEQ ID NO: 37453 - DNA, 25 bp, Mus musculus
aactagcgccacacaggaaaccctg

SEQ ID NO: 37454 - DNA, 25 bp, Mus musculus
aactagcgccactcaggaaaccctg

SEQ ID NO: 37455 - DNA, 25 bp, Mus musculus
aactagctccttaggttagctcttc

SEQ ID NO: 37456 - DNA, 25 bp, Mus musculus
aactagctcctttggttagctcttc

SEQ ID NO: 37457 - DNA, 25 bp, Mus musculus
aactagctcttacctttccaaactg

SEQ ID NO: 37458 - DNA, 25 bp, Mus musculus
aactagctcttagctttccaaactg

SEQ ID NO: 37459 - DNA, 25 bp, Mus musculus
aactagctgaacagatgtttcaggg

SEQ ID NO: 37460 - DNA, 25 bp, Mus musculus
aactagctgaactgatgtttcaggg

SEQ ID NO: 37461 - DNA, 25 bp, Mus musculus
aactagctttacatgagagaacaga

SEQ ID NO: 37462 - DNA, 25 bp, Mus musculus
aactagctttacttgagagaacaga

SEQ ID NO: 37463 - DNA, 25 bp, Mus musculus
aactaggaggaacaacactggcttc

SEQ ID NO: 37464 - DNA, 25 bp, Mus musculus
aactaggaggaagaacactggcttc

SEQ ID NO: 37465 - DNA, 25 bp, Mus musculus
aactaggaggtacgcctggtgtctc

SEQ ID NO: 37466 - DNA, 25 bp, Mus musculus
aactaggaggtaggcctggtgtctc

SEQ ID NO: 37467 - DNA, 25 bp, Mus musculus
aactaggagtgtctttagggctgcc

SEQ ID NO: 37468 - DNA, 25 bp, Mus musculus
aactaggagtgtgtttagggctgcc

SEQ ID NO: 37469 - DNA, 25 bp, Mus musculus
aactaggatcagagtgccgtaggat

SEQ ID NO: 37470 - DNA, 25 bp, Mus musculus
aactaggatcagtgtgccgtaggat

SEQ ID NO: 37471 - DNA, 25 bp, Mus musculus
aactaggatcctcatgcttataagt

SEQ ID NO: 37472 - DNA, 25 bp, Mus musculus
aactaggatcctgatgcttataagt

SEQ ID NO: 37473 - DNA, 25 bp, Mus musculus
aactaggcactgattggaacaaaga

SEQ ID NO: 37474 - DNA, 25 bp, Mus musculus
aactaggcactgtttggaacaaaga

SEQ ID NO: 37475 - DNA, 25 bp, Mus musculus
aactaggcagcaaacgtgatcatgt

SEQ ID NO: 37476 - DNA, 25 bp, Mus musculus
aactaggcagcaatactccgtgttt

SEQ ID NO: 37477 - DNA, 25 bp, Mus musculus
aactaggcagcatacgtgatcatgt

SEQ ID NO: 37478 - DNA, 25 bp, Mus musculus
aactaggcagcattactccgtgttt

SEQ ID NO: 37479 - DNA, 25 bp, Mus musculus
aactaggccctaagcacaactgaca

SEQ ID NO: 37480 - DNA, 25 bp, Mus musculus
aactaggccctatgcacaactgaca

SEQ ID NO: 37481 - DNA, 25 bp, Mus musculus
aactaggccctcatgtgctcggcat

SEQ ID NO: 37482 - DNA, 25 bp, Mus musculus
aactaggccctcttgtgctcggcat

SEQ ID NO: 37483 - DNA, 25 bp, Mus musculus
aactaggcctggaggtatacgctgt

SEQ ID NO: 37484 - DNA, 25 bp, Mus musculus
aactaggcctggtggtatacgctgt

SEQ ID NO: 37485 - DNA, 25 bp, Mus musculus
aactaggccttcagtgagagcagca

SEQ ID NO: 37486 - DNA, 25 bp, Mus musculus
aactaggccttctgtgagagcagca

SEQ ID NO: 37487 - DNA, 25 bp, Mus musculus
aactaggccttgaaggacccagaga

SEQ ID NO: 37488 - DNA, 25 bp, Mus musculus
aactaggccttgtaggacccagaga

SEQ ID NO: 37489 - DNA, 25 bp, Mus musculus
aactaggctattatgtgttcaaact

SEQ ID NO: 37490 - DNA, 25 bp, Mus musculus
aactaggctattttgtgttcaaact

SEQ ID NO: 37491 - DNA, 25 bp, Mus musculus
aactagggattgcagccaaggcttt

SEQ ID NO: 37492 - DNA, 25 bp, Mus musculus
aactagggattggagccaaggcttt

SEQ ID NO: 37493 - DNA, 25 bp, Mus musculus
aactagggatttactggtatttgat

SEQ ID NO: 37494 - DNA, 25 bp, Mus musculus
aactagggattttctggtatttgat

SEQ ID NO: 37495 - DNA, 25 bp, Mus musculus
aactagggccaactggagaggctta

SEQ ID NO: 37496 - DNA, 25 bp, Mus musculus
aactagggccaagtggagaggctta

SEQ ID NO: 37497 - DNA, 25 bp, Mus musculus
aactagggctccatctttgcttcaa

SEQ ID NO: 37498 - DNA, 25 bp, Mus musculus
aactagggctccttctttgcttcaa

SEQ ID NO: 37499 - DNA, 25 bp, Mus musculus
aactagggtttgatggcaccaggca

SEQ ID NO: 37500 - DNA, 25 bp, Mus musculus
aactagggtttgttggcaccaggca

SEQ ID NO: 37501 - DNA, 25 bp, Mus musculus
aactaggtatccatgtgaccgctga

SEQ ID NO: 37502 - DNA, 25 bp, Mus musculus
aactaggtatccttgtgaccgctga

SEQ ID NO: 37503 - DNA, 25 bp, Mus musculus
aactaggtttgtatcgtggtcaatt

SEQ ID NO: 37504 - DNA, 25 bp, Mus musculus
aactaggtttgtttcgtggtcaatt

SEQ ID NO: 37505 - DNA, 25 bp, Mus musculus
aactagtagcgaacagccaggctcc

SEQ ID NO: 37506 - DNA, 25 bp, Mus musculus
aactagtagcgatcagccaggctcc

SEQ ID NO: 37507 - DNA, 25 bp, Mus musculus
aactagtccattaggcatctggaaa

SEQ ID NO: 37508 - DNA, 25 bp, Mus musculus
aactagtccatttggcatctggaaa

SEQ ID NO: 37509 - DNA, 25 bp, Mus musculus
aactagtcccgacatttctagctcc

SEQ ID NO: 37510 - DNA, 25 bp, Mus musculus
aactagtcccgagatttctagctcc

SEQ ID NO: 37511 - DNA, 25 bp, Mus musculus
aactagtcctagagcctcactgtgg

SEQ ID NO: 37512 - DNA, 25 bp, Mus musculus
aactagtcctagagtctgtaagtga

SEQ ID NO: 37513 - DNA, 25 bp, Mus musculus
aactagtcctagtgcctcactgtgg

SEQ ID NO: 37514 - DNA, 25 bp, Mus musculus
aactagtcctagtgtctgtaagtga

SEQ ID NO: 37515 - DNA, 25 bp, Mus musculus
aactagtctgttagtcctgttctaa

SEQ ID NO: 37516 - DNA, 25 bp, Mus musculus
aactagtctgtttgtcctgttctaa

SEQ ID NO: 37517 - DNA, 25 bp, Mus musculus
aactagtcttaactcatgtgatctg

SEQ ID NO: 37518 - DNA, 25 bp, Mus musculus
aactagtcttaagtcatgtgatctg

SEQ ID NO: 37519 - DNA, 25 bp, Mus musculus
aactagtcttctacagggacagagc

SEQ ID NO: 37520 - DNA, 25 bp, Mus musculus
aactagtcttcttcagggacagagc

SEQ ID NO: 37521 - DNA, 25 bp, Mus musculus
aactagtgctcacattcaaactact

SEQ ID NO: 37522 - DNA, 25 bp, Mus musculus
aactagtgctcagattcaaactact

SEQ ID NO: 37523 - DNA, 25 bp, Mus musculus
aactagtgcttcaatttgtatctaa

SEQ ID NO: 37524 - DNA, 25 bp, Mus musculus
aactagtgcttctatttgtatctaa

SEQ ID NO: 37525 - DNA, 25 bp, Mus musculus
aactagtgttctcagactccattca

SEQ ID NO: 37526 - DNA, 25 bp, Mus musculus
aactagtgttctgagactccattca

SEQ ID NO: 37527 - DNA, 25 bp, Mus musculus
aactagttacggaggcttcagagca

SEQ ID NO: 37528 - DNA, 25 bp, Mus musculus
aactagttacggtggcttcagagca

SEQ ID NO: 37529 - DNA, 25 bp, Mus musculus
aactagttatcaattgcaattctta

SEQ ID NO: 37530 - DNA, 25 bp, Mus musculus
aactagttatcatttgcaattctta

SEQ ID NO: 37531 - DNA, 25 bp, Mus musculus
aactagttccatacagtgtgctgat

SEQ ID NO: 37532 - DNA, 25 bp, Mus musculus
aactagttccattcagtgtgctgat

SEQ ID NO: 37533 - DNA, 25 bp, Mus musculus
aactagttgagacagctcggagcct

SEQ ID NO: 37534 - DNA, 25 bp, Mus musculus
aactagttgagagagctcggagcct

SEQ ID NO: 37535 - DNA, 25 bp, Mus musculus
aactagttgctgagggttctacccg

SEQ ID NO: 37536 - DNA, 25 bp, Mus musculus
aactagttgctgtgggttctacccg

SEQ ID NO: 37537 - DNA, 25 bp, Mus musculus
aactagttgtgtactgcagtctata

SEQ ID NO: 37538 - DNA, 25 bp, Mus musculus
aactagttgtgttctgcagtctata

SEQ ID NO: 37539 - DNA, 25 bp, Mus musculus
aactataacctccattgccaaactc

SEQ ID NO: 37540 - DNA, 25 bp, Mus musculus
aactataacctcgattgccaaactc

SEQ ID NO: 37541 - DNA, 25 bp, Mus musculus
aactataactgaattctgcttaaca

SEQ ID NO: 37542 - DNA, 25 bp, Mus musculus
aactataactgatttctgcttaaca

SEQ ID NO: 37543 - DNA, 25 bp, Mus musculus
aactataaggaaacccatcttcaat

SEQ ID NO: 37544 - DNA, 25 bp, Mus musculus
aactataaggaatcccatcttcaat

SEQ ID NO: 37545 - DNA, 25 bp, Mus musculus
aactatacaaagctcagccctcagg

SEQ ID NO: 37546 - DNA, 25 bp, Mus musculus
aactatacaaaggtcagccctcagg

SEQ ID NO: 37547 - DNA, 25 bp, Mus musculus
aactatacattgatgctggagagct

SEQ ID NO: 37548 - DNA, 25 bp, Mus musculus
aactatacattgttgctggagagct

SEQ ID NO: 37549 - DNA, 25 bp, Mus musculus
aactatagaatcactctgggccctg

SEQ ID NO: 37550 - DNA, 25 bp, Mus musculus
aactatagaatctctctgggccctg

SEQ ID NO: 37551 - DNA, 25 bp, Mus musculus
aactatagacctctggccctggagg

SEQ ID NO: 37552 - DNA, 25 bp, Mus musculus
aactatagacctgtggccctggagg

SEQ ID NO: 37553 - DNA, 25 bp, Mus musculus
aactatagagtgctgccgactgcgt

SEQ ID NO: 37554 - DNA, 25 bp, Mus musculus
aactatagagtggtgccgactgcgt

SEQ ID NO: 37555 - DNA, 25 bp, Mus musculus
aactatagctgtatatggcatacct

SEQ ID NO: 37556 - DNA, 25 bp, Mus musculus
aactatagctgtttatggcatacct

SEQ ID NO: 37557 - DNA, 25 bp, Mus musculus
aactatagtcacagctgctttcaat

SEQ ID NO: 37558 - DNA, 25 bp, Mus musculus
aactatagtcactgctgctttcaat

SEQ ID NO: 37559 - DNA, 25 bp, Mus musculus
aactatagtgaaaaagatctggcca

SEQ ID NO: 37560 - DNA, 25 bp, Mus musculus
aactatagtgaataagatctggcca

SEQ ID NO: 37561 - DNA, 25 bp, Mus musculus
aactatagttccatgcctactacat

SEQ ID NO: 37562 - DNA, 25 bp, Mus musculus
aactatagttccttgcctactacat

SEQ ID NO: 37563 - DNA, 25 bp, Mus musculus
aactatatacttacttccttctctg

SEQ ID NO: 37564 - DNA, 25 bp, Mus musculus
aactatatactttcttccttctctg

SEQ ID NO: 37565 - DNA, 25 bp, Mus musculus
aactatatcaagacgctgaccgcca

SEQ ID NO: 37566 - DNA, 25 bp, Mus musculus
aactatatcaagtcgctgaccgcca

SEQ ID NO: 37567 - DNA, 25 bp, Mus musculus
aactatatcattctatttccaggag

SEQ ID NO: 37568 - DNA, 25 bp, Mus musculus
aactatatcattgtatttccaggag

SEQ ID NO: 37569 - DNA, 25 bp, Mus musculus
aactatatggctaccagtagctttt

SEQ ID NO: 37570 - DNA, 25 bp, Mus musculus
aactatatggcttccagtagctttt

SEQ ID NO: 37571 - DNA, 25 bp, Mus musculus
aactatattagtcggccaagtacag

SEQ ID NO: 37572 - DNA, 25 bp, Mus musculus
aactatattagtgggccaagtacag

SEQ ID NO: 37573 - DNA, 25 bp, Mus musculus
aactatattattctgctgcaagtat

SEQ ID NO: 37574 - DNA, 25 bp, Mus musculus
aactatattattgtgctgcaagtat

SEQ ID NO: 37575 - DNA, 25 bp, Mus musculus
aactatattgtcctagttggcctag

SEQ ID NO: 37576 - DNA, 25 bp, Mus musculus
aactatattgtcgtagttggcctag

SEQ ID NO: 37577 - DNA, 25 bp, Mus musculus
aactatcaaaagagtgctcttctaa

SEQ ID NO: 37578 - DNA, 25 bp, Mus musculus
aactatcaaaagtgtgctcttctaa

SEQ ID NO: 37579 - DNA, 25 bp, Mus musculus
aactatcagtgcaagtgaactgtga

SEQ ID NO: 37580 - DNA, 25 bp, Mus musculus
aactatcagtgctagtgaactgtga

SEQ ID NO: 37581 - DNA, 25 bp, Mus musculus
aactatccaggcataccgagtcata

SEQ ID NO: 37582 - DNA, 25 bp, Mus musculus
aactatccaggcttaccgagtcata

SEQ ID NO: 37583 - DNA, 25 bp, Mus musculus
aactatccagtgagtcttctgtgac

SEQ ID NO: 37584 - DNA, 25 bp, Mus musculus
aactatccagtgtgtcttctgtgac

SEQ ID NO: 37585 - DNA, 25 bp, Mus musculus
aactatcctatgatatgttcctaga

SEQ ID NO: 37586 - DNA, 25 bp, Mus musculus
aactatcctatgttatgttcctaga

SEQ ID NO: 37587 - DNA, 25 bp, Mus musculus
aactatcgtaataatctgctgcctg

SEQ ID NO: 37588 - DNA, 25 bp, Mus musculus
aactatcgtaattatctgctgcctg

SEQ ID NO: 37589 - DNA, 25 bp, Mus musculus
aactatcgttcaatggctcaaccac

SEQ ID NO: 37590 - DNA, 25 bp, Mus musculus
aactatcgttcattggctcaaccac

SEQ ID NO: 37591 - DNA, 25 bp, Mus musculus
aactatctaatcattttcgacaaca

SEQ ID NO: 37592 - DNA, 25 bp, Mus musculus
aactatctaatctttttcgacaaca

SEQ ID NO: 37593 - DNA, 25 bp, Mus musculus
aactatctcaacatttgcatcttgg

SEQ ID NO: 37594 - DNA, 25 bp, Mus musculus
aactatctcaacttttgcatcttgg

SEQ ID NO: 37595 - DNA, 25 bp, Mus musculus
aactatctctacaaggtcgctcaag

SEQ ID NO: 37596 - DNA, 25 bp, Mus musculus
aactatctctactaggtcgctcaag

SEQ ID NO: 37597 - DNA, 25 bp, Mus musculus
aactatctgataagccaggcctctg

SEQ ID NO: 37598 - DNA, 25 bp, Mus musculus
aactatctgatatgccaggcctctg

SEQ ID NO: 37599 - DNA, 25 bp, Mus musculus
aactatcttgccacatttgatttgc

SEQ ID NO: 37600 - DNA, 25 bp, Mus musculus
aactatcttgcctcatttgatttgc

SEQ ID NO: 37601 - DNA, 25 bp, Mus musculus
aactatgaagtacctcccacctgtg

SEQ ID NO: 37602 - DNA, 25 bp, Mus musculus
aactatgaagtagctcccacctgtg

SEQ ID NO: 37603 - DNA, 25 bp, Mus musculus
aactatgaagtgagtgtctgtagca

SEQ ID NO: 37604 - DNA, 25 bp, Mus musculus
aactatgaagtgtgtgtctgtagca

SEQ ID NO: 37605 - DNA, 25 bp, Mus musculus
aactatgacatgaaggatgtcctct

SEQ ID NO: 37606 - DNA, 25 bp, Mus musculus
aactatgacatgtaggatgtcctct

SEQ ID NO: 37607 - DNA, 25 bp, Mus musculus
aactatgacggtcagtgactggtat

SEQ ID NO: 37608 - DNA, 25 bp, Mus musculus
aactatgacggtgagtgactggtat

SEQ ID NO: 37609 - DNA, 25 bp, Mus musculus
aactatgactccctgaggctgcagc

SEQ ID NO: 37610 - DNA, 25 bp, Mus musculus
aactatgactccgtgaggctgcagc

SEQ ID NO: 37611 - DNA, 25 bp, Mus musculus
aactatgactgtcactcttccaaaa

SEQ ID NO: 37612 - DNA, 25 bp, Mus musculus
aactatgactgtgactcttccaaaa

SEQ ID NO: 37613 - DNA, 25 bp, Mus musculus
aactatgagagtacctgtcctccga

SEQ ID NO: 37614 - DNA, 25 bp, Mus musculus
aactatgagagtatcccacgggtct

SEQ ID NO: 37615 - DNA, 25 bp, Mus musculus
aactatgagagttcctgtcctccga

SEQ ID NO: 37616 - DNA, 25 bp, Mus musculus
aactatgagagtttcccacgggtct

SEQ ID NO: 37617 - DNA, 25 bp, Mus musculus
aactatgagctcaaccttggtcaga

SEQ ID NO: 37618 - DNA, 25 bp, Mus musculus
aactatgagctctaccttggtcaga

SEQ ID NO: 37619 - DNA, 25 bp, Mus musculus
aactatgaggccctggaacaaaagg

SEQ ID NO: 37620 - DNA, 25 bp, Mus musculus
aactatgaggccgtggaacaaaagg

SEQ ID NO: 37621 - DNA, 25 bp, Mus musculus
aactatgatgtgagcgcgcgtgttt

SEQ ID NO: 37622 - DNA, 25 bp, Mus musculus
aactatgatgtgtgcgcgcgtgttt

SEQ ID NO: 37623 - DNA, 25 bp, Mus musculus
aactatgattctagctccaattgaa

SEQ ID NO: 37624 - DNA, 25 bp, Mus musculus
aactatgattcttgctccaattgaa

SEQ ID NO: 37625 - DNA, 25 bp, Mus musculus
aactatgcaatgatcaggagatggc

SEQ ID NO: 37626 - DNA, 25 bp, Mus musculus
aactatgcaatgttcaggagatggc

SEQ ID NO: 37627 - DNA, 25 bp, Mus musculus
aactatgcagttcctaattgcctag

SEQ ID NO: 37628 - DNA, 25 bp, Mus musculus
aactatgcagttgctaattgcctag

SEQ ID NO: 37629 - DNA, 25 bp, Mus musculus
aactatgccaacaatatacactgct

SEQ ID NO: 37630 - DNA, 25 bp, Mus musculus
aactatgccaactatatacactgct

SEQ ID NO: 37631 - DNA, 25 bp, Mus musculus
aactatgccacacacgatgacatcg

SEQ ID NO: 37632 - DNA, 25 bp, Mus musculus
aactatgccacagacgatgacatcg

SEQ ID NO: 37633 - DNA, 25 bp, Mus musculus
aactatgccttacagtttcatctgc

SEQ ID NO: 37634 - DNA, 25 bp, Mus musculus
aactatgccttagagtttcatctgc

SEQ ID NO: 37635 - DNA, 25 bp, Mus musculus
aactatgcgttaaattgtcttgcaa

SEQ ID NO: 37636 - DNA, 25 bp, Mus musculus
aactatgcgttatattgtcttgcaa

SEQ ID NO: 37637 - DNA, 25 bp, Mus musculus
aactatgctggcagatgacacgtta

SEQ ID NO: 37638 - DNA, 25 bp, Mus musculus
aactatgctggctgatgacacgtta

SEQ ID NO: 37639 - DNA, 25 bp, Mus musculus
aactatgctgtgctgatgtccatgc

SEQ ID NO: 37640 - DNA, 25 bp, Mus musculus
aactatgctgtggtgatgtccatgc

SEQ ID NO: 37641 - DNA, 25 bp, Mus musculus
aactatgctgttcacgattggccca

SEQ ID NO: 37642 - DNA, 25 bp, Mus musculus
aactatgctgttgacgattggccca

SEQ ID NO: 37643 - DNA, 25 bp, Mus musculus
aactatggaagtcgctcttatttct

SEQ ID NO: 37644 - DNA, 25 bp, Mus musculus
aactatggaagtggctcttatttct

SEQ ID NO: 37645 - DNA, 25 bp, Mus musculus
aactatggacgtaaagctggtctct

SEQ ID NO: 37646 - DNA, 25 bp, Mus musculus
aactatggacgttaagctggtctct

SEQ ID NO: 37647 - DNA, 25 bp, Mus musculus
aactatggagctcgtgactactgta

SEQ ID NO: 37648 - DNA, 25 bp, Mus musculus
aactatggagctggtgactactgta

SEQ ID NO: 37649 - DNA, 25 bp, Mus musculus
aactatggagtcctctactgacatt

SEQ ID NO: 37650 - DNA, 25 bp, Mus musculus
aactatggagtcgtctactgacatt

SEQ ID NO: 37651 - DNA, 25 bp, Mus musculus
aactatggccccaagctaagtggcc

SEQ ID NO: 37652 - DNA, 25 bp, Mus musculus
aactatggcccctagctaagtggcc

SEQ ID NO: 37653 - DNA, 25 bp, Mus musculus
aactatggcgtcatctggttcaagg

SEQ ID NO: 37654 - DNA, 25 bp, Mus musculus
aactatggcgtcttctggttcaagg

SEQ ID NO: 37655 - DNA, 25 bp, Mus musculus
aactatgggacacccgctagtcatc

SEQ ID NO: 37656 - DNA, 25 bp, Mus musculus
aactatgggacagccgctagtcatc

SEQ ID NO: 37657 - DNA, 25 bp, Mus musculus
aactatggtctaatctgggtttgta

SEQ ID NO: 37658 - DNA, 25 bp, Mus musculus
aactatggtctattctgggtttgta

SEQ ID NO: 37659 - DNA, 25 bp, Mus musculus
aactatggtctgcactagatagcca

SEQ ID NO: 37660 - DNA, 25 bp, Mus musculus
aactatggtctggactagatagcca

SEQ ID NO: 37661 - DNA, 25 bp, Mus musculus
aactatggtgcacgttcccaactct

SEQ ID NO: 37662 - DNA, 25 bp, Mus musculus
aactatggtgcaggttcccaactct

SEQ ID NO: 37663 - DNA, 25 bp, Mus musculus
aactatggttctacgatcactggat

SEQ ID NO: 37664 - DNA, 25 bp, Mus musculus
aactatggttcttcgatcactggat

SEQ ID NO: 37665 - DNA, 25 bp, Mus musculus
aactatgtacccatcttcaaggaga

SEQ ID NO: 37666 - DNA, 25 bp, Mus musculus
aactatgtacccttcttcaaggaga

SEQ ID NO: 37667 - DNA, 25 bp, Mus musculus
aactatgtagagaaactttgatctg

SEQ ID NO: 37668 - DNA, 25 bp, Mus musculus
aactatgtagagtaactttgatctg

SEQ ID NO: 37669 - DNA, 25 bp, Mus musculus
aactatgtagataagggtgacccca

SEQ ID NO: 37670 - DNA, 25 bp, Mus musculus
aactatgtagattagggtgacccca

SEQ ID NO: 37671 - DNA, 25 bp, Mus musculus
aactatgtcccaatgtctggtggcg

SEQ ID NO: 37672 - DNA, 25 bp, Mus musculus
aactatgtcccattgtctggtggcg

SEQ ID NO: 37673 - DNA, 25 bp, Mus musculus
aactatgtctacaggtttctgcctg

SEQ ID NO: 37674 - DNA, 25 bp, Mus musculus
aactatgtctactggtttctgcctg

SEQ ID NO: 37675 - DNA, 25 bp, Mus musculus
aactatgtctatcaccatggtgcca

SEQ ID NO: 37676 - DNA, 25 bp, Mus musculus
aactatgtctatgaccatggtgcca

SEQ ID NO: 37677 - DNA, 25 bp, Mus musculus
aactatgtctgaatctatgcctata

SEQ ID NO: 37678 - DNA, 25 bp, Mus musculus
aactatgtctgattctatgcctata

SEQ ID NO: 37679 - DNA, 25 bp, Mus musculus
aactatgtcttgactgtaacagcat

SEQ ID NO: 37680 - DNA, 25 bp, Mus musculus
aactatgtcttgtctgtaacagcat

SEQ ID NO: 37681 - DNA, 25 bp, Mus musculus
aactatgtgcacagcgatctggcgc

SEQ ID NO: 37682 - DNA, 25 bp, Mus musculus
aactatgtgcactgcgatctggcgc

SEQ ID NO: 37683 - DNA, 25 bp, Mus musculus
aactatgtgcccagccctatggcag

SEQ ID NO: 37684 - DNA, 25 bp, Mus musculus
aactatgtgccctgccctatggcag

SEQ ID NO: 37685 - DNA, 25 bp, Mus musculus
aactatgtgggcatttcggaaatcc

SEQ ID NO: 37686 - DNA, 25 bp, Mus musculus
aactatgtgggcttttcggaaatcc

SEQ ID NO: 37687 - DNA, 25 bp, Mus musculus
aactatgtgggtctctctgagtctg

SEQ ID NO: 37688 - DNA, 25 bp, Mus musculus
aactatgtgggtgtctctgagtctg

SEQ ID NO: 37689 - DNA, 25 bp, Mus musculus
aactatgtggtccacctgggcaaca

SEQ ID NO: 37690 - DNA, 25 bp, Mus musculus
aactatgtggtcgacctgggcaaca

SEQ ID NO: 37691 - DNA, 25 bp, Mus musculus
aactatgtgttgctttttttcactt

SEQ ID NO: 37692 - DNA, 25 bp, Mus musculus
aactatgtgttggtttttttcactt

SEQ ID NO: 37693 - DNA, 25 bp, Mus musculus
aactatgttaacatgtacctggttt

SEQ ID NO: 37694 - DNA, 25 bp, Mus musculus
aactatgttaacttgtacctggttt

SEQ ID NO: 37695 - DNA, 25 bp, Mus musculus
aactattaacctaccagtctctgtg

SEQ ID NO: 37696 - DNA, 25 bp, Mus musculus
aactattaaccttccagtctctgtg

SEQ ID NO: 37697 - DNA, 25 bp, Mus musculus
aactattaactacggccgagacgat

SEQ ID NO: 37698 - DNA, 25 bp, Mus musculus
aactattaactagggccgagacgat

SEQ ID NO: 37699 - DNA, 25 bp, Mus musculus
aactattactgtatagcaatggcac

SEQ ID NO: 37700 - DNA, 25 bp, Mus musculus
aactattactgtttagcaatggcac

SEQ ID NO: 37701 - DNA, 25 bp, Mus musculus
aactattagcatatggcctggcagg

SEQ ID NO: 37702 - DNA, 25 bp, Mus musculus
aactattagcatttggcctggcagg

SEQ ID NO: 37703 - DNA, 25 bp, Mus musculus
aactattagtgtcacccaggtcacc

SEQ ID NO: 37704 - DNA, 25 bp, Mus musculus
aactattagtgtgacccaggtcacc

SEQ ID NO: 37705 - DNA, 25 bp, Mus musculus
aactattatgtgctcgatgctttgt

SEQ ID NO: 37706 - DNA, 25 bp, Mus musculus
aactattatgtggtcgatgctttgt

SEQ ID NO: 37707 - DNA, 25 bp, Mus musculus
aactattcacaaaggactccttcct

SEQ ID NO: 37708 - DNA, 25 bp, Mus musculus
aactattcacaatggactccttcct

SEQ ID NO: 37709 - DNA, 25 bp, Mus musculus
aactattcagaaaacccttccatgg

SEQ ID NO: 37710 - DNA, 25 bp, Mus musculus
aactattcagaaccattgcatacag

SEQ ID NO: 37711 - DNA, 25 bp, Mus musculus
aactattcagaagcattgcatacag

SEQ ID NO: 37712 - DNA, 25 bp, Mus musculus
aactattcagaatacccttccatgg

SEQ ID NO: 37713 - DNA, 25 bp, Mus musculus
aactattcccagagtatagtgttca

SEQ ID NO: 37714 - DNA, 25 bp, Mus musculus
aactattcccagtgtatagtgttca

SEQ ID NO: 37715 - DNA, 25 bp, Mus musculus
aactattcccggatattgctgtctc

SEQ ID NO: 37716 - DNA, 25 bp, Mus musculus
aactattcccggttattgctgtctc

SEQ ID NO: 37717 - DNA, 25 bp, Mus musculus
aactattcctttatccagatcactg

SEQ ID NO: 37718 - DNA, 25 bp, Mus musculus
aactattcctttttccagatcactg

SEQ ID NO: 37719 - DNA, 25 bp, Mus musculus
aactattgaatacagaaatccagct

SEQ ID NO: 37720 - DNA, 25 bp, Mus musculus
aactattgaatagagaaatccagct

SEQ ID NO: 37721 - DNA, 25 bp, Mus musculus
aactattgagagaggccttgcctgc

SEQ ID NO: 37722 - DNA, 25 bp, Mus musculus
aactattgagagtggccttgcctgc

SEQ ID NO: 37723 - DNA, 25 bp, Mus musculus
aactattgagcacaatagctgtttc

SEQ ID NO: 37724 - DNA, 25 bp, Mus musculus
aactattgagcagaatagctgtttc

SEQ ID NO: 37725 - DNA, 25 bp, Mus musculus
aactattgctccagcactgtgcttg

SEQ ID NO: 37726 - DNA, 25 bp, Mus musculus
aactattgctcctgcactgtgcttg

SEQ ID NO: 37727 - DNA, 25 bp, Mus musculus
aactattgcttcattgccatacctg

SEQ ID NO: 37728 - DNA, 25 bp, Mus musculus
aactattgcttctttgccatacctg

SEQ ID NO: 37729 - DNA, 25 bp, Mus musculus
aactattgtaggctccctcgccaaa

SEQ ID NO: 37730 - DNA, 25 bp, Mus musculus
aactattgtagggtccctcgccaaa

SEQ ID NO: 37731 - DNA, 25 bp, Mus musculus
aactattgtctaaatgcccatggaa

SEQ ID NO: 37732 - DNA, 25 bp, Mus musculus
aactattgtctatatgcccatggaa

SEQ ID NO: 37733 - DNA, 25 bp, Mus musculus
aactattgttgccatctttccatct

SEQ ID NO: 37734 - DNA, 25 bp, Mus musculus
aactattgttgcgatctttccatct

SEQ ID NO: 37735 - DNA, 25 bp, Mus musculus
aactattgtttgacctgatgcccat

SEQ ID NO: 37736 - DNA, 25 bp, Mus musculus
aactattgtttgtcctgatgcccat

SEQ ID NO: 37737 - DNA, 25 bp, Mus musculus
aactatttaacaaacagcgaccaat

SEQ ID NO: 37738 - DNA, 25 bp, Mus musculus
aactatttaacatacagcgaccaat

SEQ ID NO: 37739 - DNA, 25 bp, Mus musculus
aactatttactgcagatatttcaat

SEQ ID NO: 37740 - DNA, 25 bp, Mus musculus
aactatttactggagatatttcaat

SEQ ID NO: 37741 - DNA, 25 bp, Mus musculus
aactatttccagagacttctgtaaa

SEQ ID NO: 37742 - DNA, 25 bp, Mus musculus
aactatttccagtgacttctgtaaa

SEQ ID NO: 37743 - DNA, 25 bp, Mus musculus
aactatttccatatctcagaggttt

SEQ ID NO: 37744 - DNA, 25 bp, Mus musculus
aactatttccatcattagcctcacc

SEQ ID NO: 37745 - DNA, 25 bp, Mus musculus
aactatttccatctgttgaaacggc

SEQ ID NO: 37746 - DNA, 25 bp, Mus musculus
aactatttccatgattagcctcacc

SEQ ID NO: 37747 - DNA, 25 bp, Mus musculus
aactatttccatgtgttgaaacggc

SEQ ID NO: 37748 - DNA, 25 bp, Mus musculus
aactatttccatttctcagaggttt

SEQ ID NO: 37749 - DNA, 25 bp, Mus musculus
aactatttctcactacttgtcagtg

SEQ ID NO: 37750 - DNA, 25 bp, Mus musculus
aactatttctcagtacttgtcagtg

SEQ ID NO: 37751 - DNA, 25 bp, Mus musculus
aactatttgaagaatgcacatttga

SEQ ID NO: 37752 - DNA, 25 bp, Mus musculus
aactatttgaagtatgcacatttga

SEQ ID NO: 37753 - DNA, 25 bp, Mus musculus
aactatttgacgatgacgattcagg

SEQ ID NO: 37754 - DNA, 25 bp, Mus musculus
aactatttgacgttgacgattcagg

SEQ ID NO: 37755 - DNA, 25 bp, Mus musculus
aactatttgcagcttgctggcttgc

SEQ ID NO: 37756 - DNA, 25 bp, Mus musculus
aactatttgcaggttgctggcttgc

SEQ ID NO: 37757 - DNA, 25 bp, Mus musculus
aactatttgcatccttctgattaaa

SEQ ID NO: 37758 - DNA, 25 bp, Mus musculus
aactatttgcatgcttctgattaaa

SEQ ID NO: 37759 - DNA, 25 bp, Mus musculus
aactatttgcttctcattgtaacac

SEQ ID NO: 37760 - DNA, 25 bp, Mus musculus
aactatttgcttgtcattgtaacac

SEQ ID NO: 37761 - DNA, 25 bp, Mus musculus
aactatttgtacactattgttactg

SEQ ID NO: 37762 - DNA, 25 bp, Mus musculus
aactatttgtactctattgttactg

SEQ ID NO: 37763 - DNA, 25 bp, Mus musculus
aactattttcaaatgcctctgggat

SEQ ID NO: 37764 - DNA, 25 bp, Mus musculus
aactattttcaattgcctctgggat

SEQ ID NO: 37765 - DNA, 25 bp, Mus musculus
aactattttcatccctctggaataa

SEQ ID NO: 37766 - DNA, 25 bp, Mus musculus
aactattttcatgcctctggaataa

SEQ ID NO: 37767 - DNA, 25 bp, Mus musculus
aactattttcttaggaatcactgaa

SEQ ID NO: 37768 - DNA, 25 bp, Mus musculus
aactattttctttggaatcactgaa

SEQ ID NO: 37769 - DNA, 25 bp, Mus musculus
aactcaaacatgaagcctagggcta

SEQ ID NO: 37770 - DNA, 25 bp, Mus musculus
aactcaaacatgataactctgtact

SEQ ID NO: 37771 - DNA, 25 bp, Mus musculus
aactcaaacatgtagcctagggcta

SEQ ID NO: 37772 - DNA, 25 bp, Mus musculus
aactcaaacatgttaactctgtact

SEQ ID NO: 37773 - DNA, 25 bp, Mus musculus
aactcaaagcaaatcacccatctct

SEQ ID NO: 37774 - DNA, 25 bp, Mus musculus
aactcaaagcaattcacccatctct

SEQ ID NO: 37775 - DNA, 25 bp, Mus musculus
aactcaaagcgaatctcctacctga

SEQ ID NO: 37776 - DNA, 25 bp, Mus musculus
aactcaaagcgattctcctacctga

SEQ ID NO: 37777 - DNA, 25 bp, Mus musculus
aactcaaaggtcatgtgttaaaact

SEQ ID NO: 37778 - DNA, 25 bp, Mus musculus
aactcaaaggtcttgtgttaaaact

SEQ ID NO: 37779 - DNA, 25 bp, Mus musculus
aactcaaagtcgagattcagccgta

SEQ ID NO: 37780 - DNA, 25 bp, Mus musculus
aactcaaagtcgtgattcagccgta

SEQ ID NO: 37781 - DNA, 25 bp, Mus musculus
aactcaaagtgacccaggttctcaa

SEQ ID NO: 37782 - DNA, 25 bp, Mus musculus
aactcaaagtgagccaggttctcaa

SEQ ID NO: 37783 - DNA, 25 bp, Mus musculus
aactcaaatcctacactgagctcaa

SEQ ID NO: 37784 - DNA, 25 bp, Mus musculus
aactcaaatccttcactgagctcaa

SEQ ID NO: 37785 - DNA, 25 bp, Mus musculus
aactcaaatgccacattctaccaaa

SEQ ID NO: 37786 - DNA, 25 bp, Mus musculus
aactcaaatgcctcattctaccaaa

SEQ ID NO: 37787 - DNA, 25 bp, Mus musculus
aactcaacagccaaggatgcccagg

SEQ ID NO: 37788 - DNA, 25 bp, Mus musculus
aactcaacagcctaggatgcccagg

SEQ ID NO: 37789 - DNA, 25 bp, Mus musculus
aactcaaccctgaccagaagcttaa

SEQ ID NO: 37790 - DNA, 25 bp, Mus musculus
aactcaaccctgtccagaagcttaa

SEQ ID NO: 37791 - DNA, 25 bp, Mus musculus
aactcaacgcgcaagggatggacca

SEQ ID NO: 37792 - DNA, 25 bp, Mus musculus
aactcaacgcgctagggatggacca

SEQ ID NO: 37793 - DNA, 25 bp, Mus musculus
aactcaacggcactgctttagtaaa

SEQ ID NO: 37794 - DNA, 25 bp, Mus musculus
aactcaacggcagtgctttagtaaa

SEQ ID NO: 37795 - DNA, 25 bp, Mus musculus
aactcaactgtgactctcgatcagc

SEQ ID NO: 37796 - DNA, 25 bp, Mus musculus
aactcaactgtgtctctcgatcagc

SEQ ID NO: 37797 - DNA, 25 bp, Mus musculus
aactcaacttgtacgtctttgtaga

SEQ ID NO: 37798 - DNA, 25 bp, Mus musculus
aactcaacttgttcgtctttgtaga

SEQ ID NO: 37799 - DNA, 25 bp, Mus musculus
aactcaagaaaacgctactccaagg

SEQ ID NO: 37800 - DNA, 25 bp, Mus musculus
aactcaagaaaaggctactccaagg

SEQ ID NO: 37801 - DNA, 25 bp, Mus musculus
aactcaagacacagacgcactagct

SEQ ID NO: 37802 - DNA, 25 bp, Mus musculus
aactcaagacactgacgcactagct

SEQ ID NO: 37803 - DNA, 25 bp, Mus musculus
aactcaagatatccacttggtgtct

SEQ ID NO: 37804 - DNA, 25 bp, Mus musculus
aactcaagatatgcacttggtgtct

SEQ ID NO: 37805 - DNA, 25 bp, Mus musculus
aactcaaggcacacgtgttcggata

SEQ ID NO: 37806 - DNA, 25 bp, Mus musculus
aactcaaggcacagggctctctttc

SEQ ID NO: 37807 - DNA, 25 bp, Mus musculus
aactcaaggcactcgtgttcggata

SEQ ID NO: 37808 - DNA, 25 bp, Mus musculus
aactcaaggcactgggctctctttc

SEQ ID NO: 37809 - DNA, 25 bp, Mus musculus
aactcaagtgttcagctgtctcata

SEQ ID NO: 37810 - DNA, 25 bp, Mus musculus
aactcaagtgttgagctgtctcata

SEQ ID NO: 37811 - DNA, 25 bp, Mus musculus
aactcaagttctcggtggcaagcta

SEQ ID NO: 37812 - DNA, 25 bp, Mus musculus
aactcaagttctgggtggcaagcta

SEQ ID NO: 37813 - DNA, 25 bp, Mus musculus
aactcaatcatcctcacatactggc

SEQ ID NO: 37814 - DNA, 25 bp, Mus musculus
aactcaatcatcgtcacatactggc

SEQ ID NO: 37815 - DNA, 25 bp, Mus musculus
aactcaatctgccaatatctctcaa

SEQ ID NO: 37816 - DNA, 25 bp, Mus musculus
aactcaatctgcgaatatctctcaa

SEQ ID NO: 37817 - DNA, 25 bp, Mus musculus
aactcaattccccactggatgtcat

SEQ ID NO: 37818 - DNA, 25 bp, Mus musculus
aactcaattcccgactggatgtcat

SEQ ID NO: 37819 - DNA, 25 bp, Mus musculus
aactcaattctgagtgcctggtgaa

SEQ ID NO: 37820 - DNA, 25 bp, Mus musculus
aactcaattctgtgtgcctggtgaa

SEQ ID NO: 37821 - DNA, 25 bp, Mus musculus
aactcaattggcctgtctactataa

SEQ ID NO: 37822 - DNA, 25 bp, Mus musculus
aactcaattggcgtgtctactataa

SEQ ID NO: 37823 - DNA, 25 bp, Mus musculus
aactcacaactgattaggcaggatc

SEQ ID NO: 37824 - DNA, 25 bp, Mus musculus
aactcacaactgtttaggcaggatc

SEQ ID NO: 37825 - DNA, 25 bp, Mus musculus
aactcacaattaagttggtgccatc

SEQ ID NO: 37826 - DNA, 25 bp, Mus musculus
aactcacaattatgttggtgccatc

SEQ ID NO: 37827 - DNA, 25 bp, Mus musculus
aactcacacagacgtacacttaata

SEQ ID NO: 37828 - DNA, 25 bp, Mus musculus
aactcacacagaggtacacttaata

SEQ ID NO: 37829 - DNA, 25 bp, Mus musculus
aactcacacatcattaaaccttcat

SEQ ID NO: 37830 - DNA, 25 bp, Mus musculus
aactcacacatctttaaaccttcat

SEQ ID NO: 37831 - DNA, 25 bp, Mus musculus
aactcacaccttcgctttctttgaa

SEQ ID NO: 37832 - DNA, 25 bp, Mus musculus
aactcacaccttggctttctttgaa

SEQ ID NO: 37833 - DNA, 25 bp, Mus musculus
aactcacactttatgctctgatttt

SEQ ID NO: 37834 - DNA, 25 bp, Mus musculus
aactcacactttttgctctgatttt

SEQ ID NO: 37835 - DNA, 25 bp, Mus musculus
aactcacagacaattgcttccatct

SEQ ID NO: 37836 - DNA, 25 bp, Mus musculus
aactcacagacatttgcttccatct

SEQ ID NO: 37837 - DNA, 25 bp, Mus musculus
aactcacagagtacaaggtacctgc

SEQ ID NO: 37838 - DNA, 25 bp, Mus musculus
aactcacagagttcaaggtacctgc

SEQ ID NO: 37839 - DNA, 25 bp, Mus musculus
aactcacagatcaggatggctgcct

SEQ ID NO: 37840 - DNA, 25 bp, Mus musculus
aactcacagatctggatggctgcct

SEQ ID NO: 37841 - DNA, 25 bp, Mus musculus
aactcacagattctctttgcctctc

SEQ ID NO: 37842 - DNA, 25 bp, Mus musculus
aactcacagattgtctttgcctctc

SEQ ID NO: 37843 - DNA, 25 bp, Mus musculus
aactcacaggctacatcctaactga

SEQ ID NO: 37844 - DNA, 25 bp, Mus musculus
aactcacaggcttcatcctaactga

SEQ ID NO: 37845 - DNA, 25 bp, Mus musculus
aactcacagggcctcgtgggcatca

SEQ ID NO: 37846 - DNA, 25 bp, Mus musculus
aactcacagggcgtcgtgggcatca

SEQ ID NO: 37847 - DNA, 25 bp, Mus musculus
aactcacagtgacagtgccgccttg

SEQ ID NO: 37848 - DNA, 25 bp, Mus musculus
aactcacagtgagagtgccgccttg

SEQ ID NO: 37849 - DNA, 25 bp, Mus musculus
aactcacatcacctcattcctgatt

SEQ ID NO: 37850 - DNA, 25 bp, Mus musculus
aactcacatcacgtcattcctgatt

SEQ ID NO: 37851 - DNA, 25 bp, Mus musculus
aactcacatgcccagagctgtcaga

SEQ ID NO: 37852 - DNA, 25 bp, Mus musculus
aactcacatgccgagagctgtcaga

SEQ ID NO: 37853 - DNA, 25 bp, Mus musculus
aactcacatgtgaagatccaatgct

SEQ ID NO: 37854 - DNA, 25 bp, Mus musculus
aactcacatgtgtagatccaatgct

SEQ ID NO: 37855 - DNA, 25 bp, Mus musculus
aactcacattcacctgaagctttaa

SEQ ID NO: 37856 - DNA, 25 bp, Mus musculus
aactcacattcagctgaagctttaa

SEQ ID NO: 37857 - DNA, 25 bp, Mus musculus
aactcacattccacagttcagaaat

SEQ ID NO: 37858 - DNA, 25 bp, Mus musculus
aactcacattcctcagttcagaaat

SEQ ID NO: 37859 - DNA, 25 bp, Mus musculus
aactcaccaagacggccaggttctg

SEQ ID NO: 37860 - DNA, 25 bp, Mus musculus
aactcaccaagagggccaggttctg

SEQ ID NO: 37861 - DNA, 25 bp, Mus musculus
aactcaccacttcatgccataggag

SEQ ID NO: 37862 - DNA, 25 bp, Mus musculus
aactcaccacttgatgccataggag

SEQ ID NO: 37863 - DNA, 25 bp, Mus musculus
aactcaccatttaatttctgtcgcc

SEQ ID NO: 37864 - DNA, 25 bp, Mus musculus
aactcaccatttcatgtacccagag

SEQ ID NO: 37865 - DNA, 25 bp, Mus musculus
aactcaccatttgatgtacccagag

SEQ ID NO: 37866 - DNA, 25 bp, Mus musculus
aactcaccattttatttctgtcgcc

SEQ ID NO: 37867 - DNA, 25 bp, Mus musculus
aactcacccagtatgctaagtaatg

SEQ ID NO: 37868 - DNA, 25 bp, Mus musculus
aactcacccagtttgctaagtaatg

SEQ ID NO: 37869 - DNA, 25 bp, Mus musculus
aactcacccgtcactgagagtggga

SEQ ID NO: 37870 - DNA, 25 bp, Mus musculus
aactcacccgtctctgagagtggga

SEQ ID NO: 37871 - DNA, 25 bp, Mus musculus
aactcacctagtctggatagacagg

SEQ ID NO: 37872 - DNA, 25 bp, Mus musculus
aactcacctagtgtggatagacagg

SEQ ID NO: 37873 - DNA, 25 bp, Mus musculus
aactcacctgtgaatgggcaaggtt

SEQ ID NO: 37874 - DNA, 25 bp, Mus musculus
aactcacctgtgtatgggcaaggtt

SEQ ID NO: 37875 - DNA, 25 bp, Mus musculus
aactcaccttagatatatgttgaat

SEQ ID NO: 37876 - DNA, 25 bp, Mus musculus
aactcaccttagttatatgttgaat

SEQ ID NO: 37877 - DNA, 25 bp, Mus musculus
aactcaccttgcagcctagaaattc

SEQ ID NO: 37878 - DNA, 25 bp, Mus musculus
aactcaccttgctgcctagaaattc

SEQ ID NO: 37879 - DNA, 25 bp, Mus musculus
aactcacgcagactactttgagcct

SEQ ID NO: 37880 - DNA, 25 bp, Mus musculus
aactcacgcagagtactttgagcct

SEQ ID NO: 37881 - DNA, 25 bp, Mus musculus
aactcacgccggctgcaggctgatg

SEQ ID NO: 37882 - DNA, 25 bp, Mus musculus
aactcacgccgggtgcaggctgatg

SEQ ID NO: 37883 - DNA, 25 bp, Mus musculus
aactcacgtcatcggtattggcaac

SEQ ID NO: 37884 - DNA, 25 bp, Mus musculus
aactcacgtcatgggtattggcaac

SEQ ID NO: 37885 - DNA, 25 bp, Mus musculus
aactcacgtgcaaagctgaaagcgc

SEQ ID NO: 37886 - DNA, 25 bp, Mus musculus
aactcacgtgcatagctgaaagcgc

SEQ ID NO: 37887 - DNA, 25 bp, Mus musculus
aactcacgttagcactgccttgacg

SEQ ID NO: 37888 - DNA, 25 bp, Mus musculus
aactcacgttaggactgccttgacg

SEQ ID NO: 37889 - DNA, 25 bp, Mus musculus
aactcactaactcaacctggtttgt

SEQ ID NO: 37890 - DNA, 25 bp, Mus musculus
aactcactaactgaacctggtttgt

SEQ ID NO: 37891 - DNA, 25 bp, Mus musculus
aactcactacagaatcaataaacca

SEQ ID NO: 37892 - DNA, 25 bp, Mus musculus
aactcactacagtatcaataaacca

SEQ ID NO: 37893 - DNA, 25 bp, Mus musculus
aactcactacataccactgatgtgc

SEQ ID NO: 37894 - DNA, 25 bp, Mus musculus
aactcactacattccactgatgtgc

SEQ ID NO: 37895 - DNA, 25 bp, Mus musculus
aactcactattcacctgcctgtggt

SEQ ID NO: 37896 - DNA, 25 bp, Mus musculus
aactcactattctcctgcctgtggt

SEQ ID NO: 37897 - DNA, 25 bp, Mus musculus
aactcactcagaacccttttttaat

SEQ ID NO: 37898 - DNA, 25 bp, Mus musculus
aactcactcagatcccttttttaat

SEQ ID NO: 37899 - DNA, 25 bp, Mus musculus
aactcactccctcctttgtaaggat

SEQ ID NO: 37900 - DNA, 25 bp, Mus musculus
aactcactccctgctttgtaaggat

SEQ ID NO: 37901 - DNA, 25 bp, Mus musculus
aactcactctttcatactggcgtaa

SEQ ID NO: 37902 - DNA, 25 bp, Mus musculus
aactcactctttgatactggcgtaa

SEQ ID NO: 37903 - DNA, 25 bp, Mus musculus
aactcactgaatctcacaccaacat

SEQ ID NO: 37904 - DNA, 25 bp, Mus musculus
aactcactgaatgtcacaccaacat

SEQ ID NO: 37905 - DNA, 25 bp, Mus musculus
aactcactgagaatgctgtcagtca

SEQ ID NO: 37906 - DNA, 25 bp, Mus musculus
aactcactgagattgctgtcagtca

SEQ ID NO: 37907 - DNA, 25 bp, Mus musculus
aactcactgagcaccggaagtgtat

SEQ ID NO: 37908 - DNA, 25 bp, Mus musculus
aactcactgagctccggaagtgtat

SEQ ID NO: 37909 - DNA, 25 bp, Mus musculus
aactcactgcccaagaggcatgcag

SEQ ID NO: 37910 - DNA, 25 bp, Mus musculus
aactcactgccctagaggcatgcag

SEQ ID NO: 37911 - DNA, 25 bp, Mus musculus
aactcactgggcattgtggctcaca

SEQ ID NO: 37912 - DNA, 25 bp, Mus musculus
aactcactgggctttgtggctcaca

SEQ ID NO: 37913 - DNA, 25 bp, Mus musculus
aactcactggtgactttcagggtaa

SEQ ID NO: 37914 - DNA, 25 bp, Mus musculus
aactcactggtgtctttcagggtaa

SEQ ID NO: 37915 - DNA, 25 bp, Mus musculus
aactcactgttcaatgggtgtttcc

SEQ ID NO: 37916 - DNA, 25 bp, Mus musculus
aactcactgttctatgggtgtttcc

SEQ ID NO: 37917 - DNA, 25 bp, Mus musculus
aactcactgttgatgaagattctgg

SEQ ID NO: 37918 - DNA, 25 bp, Mus musculus
aactcactgttgttgaagattctgg

SEQ ID NO: 37919 - DNA, 25 bp, Mus musculus
aactcacttaggattttgctcctct

SEQ ID NO: 37920 - DNA, 25 bp, Mus musculus
aactcacttaggtttttgctcctct

SEQ ID NO: 37921 - DNA, 25 bp, Mus musculus
aactcacttcccagcaatggtaagg

SEQ ID NO: 37922 - DNA, 25 bp, Mus musculus
aactcacttccctgcaatggtaagg

SEQ ID NO: 37923 - DNA, 25 bp, Mus musculus
aactcacttcctctttagaaatgaa

SEQ ID NO: 37924 - DNA, 25 bp, Mus musculus
aactcacttcctgtttagaaatgaa

SEQ ID NO: 37925 - DNA, 25 bp, Mus musculus
aactcacttgccatggcaatctctg

SEQ ID NO: 37926 - DNA, 25 bp, Mus musculus
aactcacttgccttggcaatctctg

SEQ ID NO: 37927 - DNA, 25 bp, Mus musculus
aactcacttggaagtatatctgaat

SEQ ID NO: 37928 - DNA, 25 bp, Mus musculus
aactcacttggatgtatatctgaat

SEQ ID NO: 37929 - DNA, 25 bp, Mus musculus
aactcactttacaggccgatatcat

SEQ ID NO: 37930 - DNA, 25 bp, Mus musculus
aactcactttactggccgatatcat

SEQ ID NO: 37931 - DNA, 25 bp, Mus musculus
aactcactttgacacgacctgtgat

SEQ ID NO: 37932 - DNA, 25 bp, Mus musculus
aactcactttgagacgacctgtgat

SEQ ID NO: 37933 - DNA, 25 bp, Mus musculus
aactcactttgtagctgaagaaaac

SEQ ID NO: 37934 - DNA, 25 bp, Mus musculus
aactcactttgttgctgaagaaaac

SEQ ID NO: 37935 - DNA, 25 bp, Mus musculus
aactcacttttacgagctgtggcag

SEQ ID NO: 37936 - DNA, 25 bp, Mus musculus
aactcacttttaggagctgtggcag

SEQ ID NO: 37937 - DNA, 25 bp, Mus musculus
aactcagaaattcaaccggcctctg

SEQ ID NO: 37938 - DNA, 25 bp, Mus musculus
aactcagaaattgaaccggcctctg

SEQ ID NO: 37939 - DNA, 25 bp, Mus musculus
aactcagaacacagtgaacggtagg

SEQ ID NO: 37940 - DNA, 25 bp, Mus musculus
aactcagaacactgtgaacggtagg

SEQ ID NO: 37941 - DNA, 25 bp, Mus musculus
aactcagaacagcagctgcctcttg

SEQ ID NO: 37942 - DNA, 25 bp, Mus musculus
aactcagaacaggagctgcctcttg

SEQ ID NO: 37943 - DNA, 25 bp, Mus musculus
aactcagacacgatacatattctaa

SEQ ID NO: 37944 - DNA, 25 bp, Mus musculus
aactcagacacgttacatattctaa

SEQ ID NO: 37945 - DNA, 25 bp, Mus musculus
aactcagacaggattatggcttcat

SEQ ID NO: 37946 - DNA, 25 bp, Mus musculus
aactcagacaggtttatggcttcat

SEQ ID NO: 37947 - DNA, 25 bp, Mus musculus
aactcagacccaacatcaagcaaaa

SEQ ID NO: 37948 - DNA, 25 bp, Mus musculus
aactcagacccatcatcaagcaaaa

SEQ ID NO: 37949 - DNA, 25 bp, Mus musculus
aactcagaccctattgtaaagcaga

SEQ ID NO: 37950 - DNA, 25 bp, Mus musculus
aactcagacccttttgtaaagcaga

SEQ ID NO: 37951 - DNA, 25 bp, Mus musculus
aactcagacgatattgaccctgctt

SEQ ID NO: 37952 - DNA, 25 bp, Mus musculus
aactcagacgattttgaccctgctt

SEQ ID NO: 37953 - DNA, 25 bp, Mus musculus
aactcagacgccagtaagcagacta

SEQ ID NO: 37954 - DNA, 25 bp, Mus musculus
aactcagacgcctgtaagcagacta

SEQ ID NO: 37955 - DNA, 25 bp, Mus musculus
aactcagacgctaggcctctgatga

SEQ ID NO: 37956 - DNA, 25 bp, Mus musculus
aactcagacgcttggcctctgatga

SEQ ID NO: 37957 - DNA, 25 bp, Mus musculus
aactcagagaatcctacctgactgc

SEQ ID NO: 37958 - DNA, 25 bp, Mus musculus
aactcagagaatgctacctgactgc

SEQ ID NO: 37959 - DNA, 25 bp, Mus musculus
aactcagagagcagcgggcggcggc

SEQ ID NO: 37960 - DNA, 25 bp, Mus musculus
aactcagagagctgcgggcggcggc

SEQ ID NO: 37961 - DNA, 25 bp, Mus musculus
aactcagagatacacgtacacttac

SEQ ID NO: 37962 - DNA, 25 bp, Mus musculus
aactcagagatagacgtacacttac

SEQ ID NO: 37963 - DNA, 25 bp, Mus musculus
aactcagagctactgacagccctgg

SEQ ID NO: 37964 - DNA, 25 bp, Mus musculus
aactcagagctagtgacagccctgg

SEQ ID NO: 37965 - DNA, 25 bp, Mus musculus
aactcagaggtcctgggagccacaa

SEQ ID NO: 37966 - DNA, 25 bp, Mus musculus
aactcagaggtcgtgggagccacaa

SEQ ID NO: 37967 - DNA, 25 bp, Mus musculus
aactcagagttcagtttggttctgt

SEQ ID NO: 37968 - DNA, 25 bp, Mus musculus
aactcagagttctgtttggttctgt

SEQ ID NO: 37969 - DNA, 25 bp, Mus musculus
aactcagatcagcaggcggcagcta

SEQ ID NO: 37970 - DNA, 25 bp, Mus musculus
aactcagatcaggaggcggcagcta

SEQ ID NO: 37971 - DNA, 25 bp, Mus musculus
aactcagatcatagggtggcaattc

SEQ ID NO: 37972 - DNA, 25 bp, Mus musculus
aactcagatcattgggtggcaattc

SEQ ID NO: 37973 - DNA, 25 bp, Mus musculus
aactcagatgcacaccttaggtcca

SEQ ID NO: 37974 - DNA, 25 bp, Mus musculus
aactcagatgcagaccttaggtcca

SEQ ID NO: 37975 - DNA, 25 bp, Mus musculus
aactcagatgtgcttctcgccagtg

SEQ ID NO: 37976 - DNA, 25 bp, Mus musculus
aactcagatgtggttctcgccagtg

SEQ ID NO: 37977 - DNA, 25 bp, Mus musculus
aactcagattcacactcagcttcag

SEQ ID NO: 37978 - DNA, 25 bp, Mus musculus
aactcagattcagactcagcttcag

SEQ ID NO: 37979 - DNA, 25 bp, Mus musculus
aactcagattggactggcagtggca

SEQ ID NO: 37980 - DNA, 25 bp, Mus musculus
aactcagattggtctggcagtggca

SEQ ID NO: 37981 - DNA, 25 bp, Mus musculus
aactcagatttccaggcttagcaac

SEQ ID NO: 37982 - DNA, 25 bp, Mus musculus
aactcagatttcgaggcttagcaac

SEQ ID NO: 37983 - DNA, 25 bp, Mus musculus
aactcagcaaaactacctgtgttct

SEQ ID NO: 37984 - DNA, 25 bp, Mus musculus
aactcagcaaaagtacctgtgttct

SEQ ID NO: 37985 - DNA, 25 bp, Mus musculus
aactcagcactgcacttttctataa

SEQ ID NO: 37986 - DNA, 25 bp, Mus musculus
aactcagcactggacttttctataa

SEQ ID NO: 37987 - DNA, 25 bp, Mus musculus
aactcagcagaaaaacactctttgt

SEQ ID NO: 37988 - DNA, 25 bp, Mus musculus
aactcagcagaataacactctttgt

SEQ ID NO: 37989 - DNA, 25 bp, Mus musculus
aactcagcagctacaggatgcttca

SEQ ID NO: 37990 - DNA, 25 bp, Mus musculus
aactcagcagctccatcaatgtgga

SEQ ID NO: 37991 - DNA, 25 bp, Mus musculus
aactcagcagctgcatcaatgtgga

SEQ ID NO: 37992 - DNA, 25 bp, Mus musculus
aactcagcagcttcaggatgcttca

SEQ ID NO: 37993 - DNA, 25 bp, Mus musculus
aactcagcatagatcctgtcaggaa

SEQ ID NO: 37994 - DNA, 25 bp, Mus musculus
aactcagcatagttcctgtcaggaa

SEQ ID NO: 37995 - DNA, 25 bp, Mus musculus
aactcagcatgtaggcagtcctatc

SEQ ID NO: 37996 - DNA, 25 bp, Mus musculus
aactcagcatgttggcagtcctatc

SEQ ID NO: 37997 - DNA, 25 bp, Mus musculus
aactcagcattgcataccctcagta

SEQ ID NO: 37998 - DNA, 25 bp, Mus musculus
aactcagcattggataccctcagta

SEQ ID NO: 37999 - DNA, 25 bp, Mus musculus
aactcagccaacaattagcctagtc

SEQ ID NO: 38000 - DNA, 25 bp, Mus musculus
aactcagccaacagtaacgtcatca

SEQ ID NO: 38001 - DNA, 25 bp, Mus musculus
aactcagccaactattagcctagtc

SEQ ID NO: 38002 - DNA, 25 bp, Mus musculus
aactcagccaactgtaacgtcatca

SEQ ID NO: 38003 - DNA, 25 bp, Mus musculus
aactcagccactcacgaatgcatgg

SEQ ID NO: 38004 - DNA, 25 bp, Mus musculus
aactcagccactgacgaatgcatgg

SEQ ID NO: 38005 - DNA, 25 bp, Mus musculus
aactcagccagtaatgtgaacgcag

SEQ ID NO: 38006 - DNA, 25 bp, Mus musculus
aactcagccagtatccatatatgtg

SEQ ID NO: 38007 - DNA, 25 bp, Mus musculus
aactcagccagttatgtgaacgcag

SEQ ID NO: 38008 - DNA, 25 bp, Mus musculus
aactcagccagtttccatatatgtg

SEQ ID NO: 38009 - DNA, 25 bp, Mus musculus
aactcagcgtggactctacagattc

SEQ ID NO: 38010 - DNA, 25 bp, Mus musculus
aactcagcgtggtctctacagattc

SEQ ID NO: 38011 - DNA, 25 bp, Mus musculus
aactcagctaaacccagccttgaag

SEQ ID NO: 38012 - DNA, 25 bp, Mus musculus
aactcagctaaagccagccttgaag

SEQ ID NO: 38013 - DNA, 25 bp, Mus musculus
aactcagctccaaatccctgtgaag

SEQ ID NO: 38014 - DNA, 25 bp, Mus musculus
aactcagctccatatccctgtgaag

SEQ ID NO: 38015 - DNA, 25 bp, Mus musculus
aactcagctgagcaggacacccaag

SEQ ID NO: 38016 - DNA, 25 bp, Mus musculus
aactcagctgaggaggacacccaag

SEQ ID NO: 38017 - DNA, 25 bp, Mus musculus
aactcagctgcactcctgaaacttg

SEQ ID NO: 38018 - DNA, 25 bp, Mus musculus
aactcagctgcagtcctgaaacttg

SEQ ID NO: 38019 - DNA, 25 bp, Mus musculus
aactcagctttcaatccaggatatc

SEQ ID NO: 38020 - DNA, 25 bp, Mus musculus
aactcagctttctatccaggatatc

SEQ ID NO: 38021 - DNA, 25 bp, Mus musculus
aactcaggaccacctgcccgaggag

SEQ ID NO: 38022 - DNA, 25 bp, Mus musculus
aactcaggaccagctgcccgaggag

SEQ ID NO: 38023 - DNA, 25 bp, Mus musculus
aactcaggacccatgtctcaggtga

SEQ ID NO: 38024 - DNA, 25 bp, Mus musculus
aactcaggacccttgtctcaggtga

SEQ ID NO: 38025 - DNA, 25 bp, Mus musculus
aactcaggacggcttgtcccaggct

SEQ ID NO: 38026 - DNA, 25 bp, Mus musculus
aactcaggacgggttgtcccaggct

SEQ ID NO: 38027 - DNA, 25 bp, Mus musculus
aactcaggcaaaccatgtcttcaaa

SEQ ID NO: 38028 - DNA, 25 bp, Mus musculus
aactcaggcaaagcatgtcttcaaa

SEQ ID NO: 38029 - DNA, 25 bp, Mus musculus
aactcaggcagtacatcgtcctcat

SEQ ID NO: 38030 - DNA, 25 bp, Mus musculus
aactcaggcagtattctttcacaaa

SEQ ID NO: 38031 - DNA, 25 bp, Mus musculus
aactcaggcagttcatcgtcctcat

SEQ ID NO: 38032 - DNA, 25 bp, Mus musculus
aactcaggcagttttctttcacaaa

SEQ ID NO: 38033 - DNA, 25 bp, Mus musculus
aactcaggctttcgcattgacagac

SEQ ID NO: 38034 - DNA, 25 bp, Mus musculus
aactcaggctttggcattgacagac

SEQ ID NO: 38035 - DNA, 25 bp, Mus musculus
aactcagggtcaaggctctgactga

SEQ ID NO: 38036 - DNA, 25 bp, Mus musculus
aactcagggtcatggctctgactga

SEQ ID NO: 38037 - DNA, 25 bp, Mus musculus
aactcagggtttccaggcttcgtgg

SEQ ID NO: 38038 - DNA, 25 bp, Mus musculus
aactcagggtttgcaggcttcgtgg

SEQ ID NO: 38039 - DNA, 25 bp, Mus musculus
aactcaggtcctaagacttggcaaa

SEQ ID NO: 38040 - DNA, 25 bp, Mus musculus
aactcaggtccttagacttggcaaa

SEQ ID NO: 38041 - DNA, 25 bp, Mus musculus
aactcaggtctaataatccaccgtg

SEQ ID NO: 38042 - DNA, 25 bp, Mus musculus
aactcaggtctattaatccaccgtg

SEQ ID NO: 38043 - DNA, 25 bp, Mus musculus
aactcaggtctccaaacttctactt

SEQ ID NO: 38044 - DNA, 25 bp, Mus musculus
aactcaggtctcgaaacttctactt

SEQ ID NO: 38045 - DNA, 25 bp, Mus musculus
aactcaggtgaacctggatcccact

SEQ ID NO: 38046 - DNA, 25 bp, Mus musculus
aactcaggtgaagctggatcccact

SEQ ID NO: 38047 - DNA, 25 bp, Mus musculus
aactcaggttttactgcagttgccc

SEQ ID NO: 38048 - DNA, 25 bp, Mus musculus
aactcaggtttttctgcagttgccc

SEQ ID NO: 38049 - DNA, 25 bp, Mus musculus
aactcagtaagaaggttctgcccat

SEQ ID NO: 38050 - DNA, 25 bp, Mus musculus
aactcagtaagatggttctgcccat

SEQ ID NO: 38051 - DNA, 25 bp, Mus musculus
aactcagtacccacctggtcgtggg

SEQ ID NO: 38052 - DNA, 25 bp, Mus musculus
aactcagtaccctcctggtcgtggg

SEQ ID NO: 38053 - DNA, 25 bp, Mus musculus
aactcagtactgatggaccccaaaa

SEQ ID NO: 38054 - DNA, 25 bp, Mus musculus
aactcagtactgttggaccccaaaa

SEQ ID NO: 38055 - DNA, 25 bp, Mus musculus
aactcagtatccaaagacatgacag

SEQ ID NO: 38056 - DNA, 25 bp, Mus musculus
aactcagtatcctaagacatgacag

SEQ ID NO: 38057 - DNA, 25 bp, Mus musculus
aactcagtatctcagtctgccttga

SEQ ID NO: 38058 - DNA, 25 bp, Mus musculus
aactcagtatctgagtctgccttga

SEQ ID NO: 38059 - DNA, 25 bp, Mus musculus
aactcagtcgtcctaataacctggg

SEQ ID NO: 38060 - DNA, 25 bp, Mus musculus
aactcagtcgtcgtaataacctggg

SEQ ID NO: 38061 - DNA, 25 bp, Mus musculus
aactcagtctcccagcgagctgtag

SEQ ID NO: 38062 - DNA, 25 bp, Mus musculus
aactcagtctccgagcgagctgtag

SEQ ID NO: 38063 - DNA, 25 bp, Mus musculus
aactcagtctgactgtgctaagaca

SEQ ID NO: 38064 - DNA, 25 bp, Mus musculus
aactcagtctgagtgtgctaagaca

SEQ ID NO: 38065 - DNA, 25 bp, Mus musculus
aactcagtctttcaccaactgggat

SEQ ID NO: 38066 - DNA, 25 bp, Mus musculus
aactcagtctttgaccaactgggat

SEQ ID NO: 38067 - DNA, 25 bp, Mus musculus
aactcagtgaggagttcttctccct

SEQ ID NO: 38068 - DNA, 25 bp, Mus musculus
aactcagtgaggtgttcttctccct

SEQ ID NO: 38069 - DNA, 25 bp, Mus musculus
aactcagtgattaccttgcttgtgc

SEQ ID NO: 38070 - DNA, 25 bp, Mus musculus
aactcagtgatttccttgcttgtgc

SEQ ID NO: 38071 - DNA, 25 bp, Mus musculus
aactcagtgcagcagccacggtttc

SEQ ID NO: 38072 - DNA, 25 bp, Mus musculus
aactcagtgcaggagccacggtttc

SEQ ID NO: 38073 - DNA, 25 bp, Mus musculus
aactcagtgctaatcatgttcttct

SEQ ID NO: 38074 - DNA, 25 bp, Mus musculus
aactcagtgctattcatgttcttct

SEQ ID NO: 38075 - DNA, 25 bp, Mus musculus
aactcagtggaaagctttatctggt

SEQ ID NO: 38076 - DNA, 25 bp, Mus musculus
aactcagtggaatgctttatctggt

SEQ ID NO: 38077 - DNA, 25 bp, Mus musculus
aactcagtggatatattctcttggt

SEQ ID NO: 38078 - DNA, 25 bp, Mus musculus
aactcagtggatctactctccggag

SEQ ID NO: 38079 - DNA, 25 bp, Mus musculus
aactcagtggatgtactctccggag

SEQ ID NO: 38080 - DNA, 25 bp, Mus musculus
aactcagtggatttattctcttggt

SEQ ID NO: 38081 - DNA, 25 bp, Mus musculus
aactcagtggcactgtacttcctag

SEQ ID NO: 38082 - DNA, 25 bp, Mus musculus
aactcagtggcagtgtacttcctag

SEQ ID NO: 38083 - DNA, 25 bp, Mus musculus
aactcagtgggcacacaaaggacct

SEQ ID NO: 38084 - DNA, 25 bp, Mus musculus
aactcagtgggctcacaaaggacct

SEQ ID NO: 38085 - DNA, 25 bp, Mus musculus
aactcagtgtgtagcattctcctgg

SEQ ID NO: 38086 - DNA, 25 bp, Mus musculus
aactcagtgtgttgcattctcctgg

SEQ ID NO: 38087 - DNA, 25 bp, Mus musculus
aactcagtgtttccttctatgtcag

SEQ ID NO: 38088 - DNA, 25 bp, Mus musculus
aactcagtgtttgcttctatgtcag

SEQ ID NO: 38089 - DNA, 25 bp, Mus musculus
aactcagttatcaattgggcaggaa

SEQ ID NO: 38090 - DNA, 25 bp, Mus musculus
aactcagttatctattgggcaggaa

SEQ ID NO: 38091 - DNA, 25 bp, Mus musculus
aactcagttctcagactttgtgggc

SEQ ID NO: 38092 - DNA, 25 bp, Mus musculus
aactcagttctctgactttgtgggc

SEQ ID NO: 38093 - DNA, 25 bp, Mus musculus
aactcagttctgaatgcttgcaagg

SEQ ID NO: 38094 - DNA, 25 bp, Mus musculus
aactcagttctgtatgcttgcaagg

SEQ ID NO: 38095 - DNA, 25 bp, Mus musculus
aactcagttgacagaaatgcctgcc

SEQ ID NO: 38096 - DNA, 25 bp, Mus musculus
aactcagttgactgaaatgcctgcc

SEQ ID NO: 38097 - DNA, 25 bp, Mus musculus
aactcagttggcatgatgacctcat

SEQ ID NO: 38098 - DNA, 25 bp, Mus musculus
aactcagttggcttgatgacctcat

SEQ ID NO: 38099 - DNA, 25 bp, Mus musculus
aactcagtttgaaccaattaagcac

SEQ ID NO: 38100 - DNA, 25 bp, Mus musculus
aactcagtttgatccaattaagcac

SEQ ID NO: 38101 - DNA, 25 bp, Mus musculus
aactcagtttggctgcctcgggaga

SEQ ID NO: 38102 - DNA, 25 bp, Mus musculus
aactcagtttgggtgcctcgggaga

SEQ ID NO: 38103 - DNA, 25 bp, Mus musculus
aactcagtttgtcgtatagaatctc

SEQ ID NO: 38104 - DNA, 25 bp, Mus musculus
aactcagtttgtggtatagaatctc

SEQ ID NO: 38105 - DNA, 25 bp, Mus musculus
aactcagtttttagcttctgccagg

SEQ ID NO: 38106 - DNA, 25 bp, Mus musculus
aactcagttttttgcttctgccagg

SEQ ID NO: 38107 - DNA, 25 bp, Mus musculus
aactcataacttatgactgtacaga

SEQ ID NO: 38108 - DNA, 25 bp, Mus musculus
aactcataacttttgactgtacaga

SEQ ID NO: 38109 - DNA, 25 bp, Mus musculus
aactcatacacccagatgcagacac

SEQ ID NO: 38110 - DNA, 25 bp, Mus musculus
aactcatacaccgagatgcagacac

SEQ ID NO: 38111 - DNA, 25 bp, Mus musculus
aactcatacaggagactgccccttt

SEQ ID NO: 38112 - DNA, 25 bp, Mus musculus
aactcatacaggtgactgccccttt

SEQ ID NO: 38113 - DNA, 25 bp, Mus musculus
aactcatatgttcgacctttcccca

SEQ ID NO: 38114 - DNA, 25 bp, Mus musculus
aactcatatgttggacctttcccca

SEQ ID NO: 38115 - DNA, 25 bp, Mus musculus
aactcatattggagaagcaccctat

SEQ ID NO: 38116 - DNA, 25 bp, Mus musculus
aactcatattggatgttctgcaaac

SEQ ID NO: 38117 - DNA, 25 bp, Mus musculus
aactcatattggtgaagcaccctat

SEQ ID NO: 38118 - DNA, 25 bp, Mus musculus
aactcatattggttgttctgcaaac

SEQ ID NO: 38119 - DNA, 25 bp, Mus musculus
aactcatcaggccagcagtttctct

SEQ ID NO: 38120 - DNA, 25 bp, Mus musculus
aactcatcaggcgagcagtttctct

SEQ ID NO: 38121 - DNA, 25 bp, Mus musculus
aactcatcaggtatatcctatggga

SEQ ID NO: 38122 - DNA, 25 bp, Mus musculus
aactcatcaggtttatcctatggga

SEQ ID NO: 38123 - DNA, 25 bp, Mus musculus
aactcatcatcacgccgttaacttc

SEQ ID NO: 38124 - DNA, 25 bp, Mus musculus
aactcatcatcaggccgttaacttc

SEQ ID NO: 38125 - DNA, 25 bp, Mus musculus
aactcatccggcatgttagccttaa

SEQ ID NO: 38126 - DNA, 25 bp, Mus musculus
aactcatccggcttgttagccttaa

SEQ ID NO: 38127 - DNA, 25 bp, Mus musculus
aactcatccgtgacagccttgtaaa

SEQ ID NO: 38128 - DNA, 25 bp, Mus musculus
aactcatccgtgtcagccttgtaaa

SEQ ID NO: 38129 - DNA, 25 bp, Mus musculus
aactcatcctttctgttgctgatct

SEQ ID NO: 38130 - DNA, 25 bp, Mus musculus
aactcatcctttgtgttgctgatct

SEQ ID NO: 38131 - DNA, 25 bp, Mus musculus
aactcatctgacataatatgcattt

SEQ ID NO: 38132 - DNA, 25 bp, Mus musculus
aactcatctgacttaatatgcattt

SEQ ID NO: 38133 - DNA, 25 bp, Mus musculus
aactcatctgcacctgcggacactt

SEQ ID NO: 38134 - DNA, 25 bp, Mus musculus
aactcatctgcagctgcggacactt

SEQ ID NO: 38135 - DNA, 25 bp, Mus musculus
aactcatctgggattcttctcaact

SEQ ID NO: 38136 - DNA, 25 bp, Mus musculus
aactcatctgggtttcttctcaact

SEQ ID NO: 38137 - DNA, 25 bp, Mus musculus
aactcatgaaggactgtaaactaca

SEQ ID NO: 38138 - DNA, 25 bp, Mus musculus
aactcatgaaggtctgtaaactaca

SEQ ID NO: 38139 - DNA, 25 bp, Mus musculus
aactcatgacctaacctaatgctaa

SEQ ID NO: 38140 - DNA, 25 bp, Mus musculus
aactcatgaccttacctaatgctaa

SEQ ID NO: 38141 - DNA, 25 bp, Mus musculus
aactcatgagaacggataccgttca

SEQ ID NO: 38142 - DNA, 25 bp, Mus musculus
aactcatgagaagggataccgttca

SEQ ID NO: 38143 - DNA, 25 bp, Mus musculus
aactcatgagtacgtctgtgcattt

SEQ ID NO: 38144 - DNA, 25 bp, Mus musculus
aactcatgagtaggtctgtgcattt

SEQ ID NO: 38145 - DNA, 25 bp, Mus musculus
aactcatgattcctgaaagctatgc

SEQ ID NO: 38146 - DNA, 25 bp, Mus musculus
aactcatgattcgtgaaagctatgc

SEQ ID NO: 38147 - DNA, 25 bp, Mus musculus
aactcatgcagtccaatcattaggg

SEQ ID NO: 38148 - DNA, 25 bp, Mus musculus
aactcatgcagtgcaatcattaggg

SEQ ID NO: 38149 - DNA, 25 bp, Mus musculus
aactcatgcattactgaattacagt

SEQ ID NO: 38150 - DNA, 25 bp, Mus musculus
aactcatgcatttctgaattacagt

SEQ ID NO: 38151 - DNA, 25 bp, Mus musculus
aactcatggcgaccccaggcctggg

SEQ ID NO: 38152 - DNA, 25 bp, Mus musculus
aactcatggcgagcccaggcctggg

SEQ ID NO: 38153 - DNA, 25 bp, Mus musculus
aactcatgggcccaggcaccaagtt

SEQ ID NO: 38154 - DNA, 25 bp, Mus musculus
aactcatgggccgaggcaccaagtt

SEQ ID NO: 38155 - DNA, 25 bp, Mus musculus
aactcatgggtacaagctcactttt

SEQ ID NO: 38156 - DNA, 25 bp, Mus musculus
aactcatgggtagaagctcactttt

SEQ ID NO: 38157 - DNA, 25 bp, Mus musculus
aactcatggtatcgcctttacaagg

SEQ ID NO: 38158 - DNA, 25 bp, Mus musculus
aactcatggtatggcctttacaagg

SEQ ID NO: 38159 - DNA, 25 bp, Mus musculus
aactcattaatgctcgagcgcctcg

SEQ ID NO: 38160 - DNA, 25 bp, Mus musculus
aactcattaatggtcgagcgcctcg

SEQ ID NO: 38161 - DNA, 25 bp, Mus musculus
aactcattatccataatcagtcatt

SEQ ID NO: 38162 - DNA, 25 bp, Mus musculus
aactcattatccttaatcagtcatt

SEQ ID NO: 38163 - DNA, 25 bp, Mus musculus
aactcattcacaagacttcccaggc

SEQ ID NO: 38164 - DNA, 25 bp, Mus musculus
aactcattcacatgacttcccaggc

SEQ ID NO: 38165 - DNA, 25 bp, Mus musculus
aactcattcaggagatagaaaccat

SEQ ID NO: 38166 - DNA, 25 bp, Mus musculus
aactcattcaggtgatagaaaccat

SEQ ID NO: 38167 - DNA, 25 bp, Mus musculus
aactcattccaaacgtgtccattga

SEQ ID NO: 38168 - DNA, 25 bp, Mus musculus
aactcattccaatcgtgtccattga

SEQ ID NO: 38169 - DNA, 25 bp, Mus musculus
aactcattcccaaagcccggagatg

SEQ ID NO: 38170 - DNA, 25 bp, Mus musculus
aactcattcccatagcccggagatg

SEQ ID NO: 38171 - DNA, 25 bp, Mus musculus
aactcattcccgaatatgtcctagg

SEQ ID NO: 38172 - DNA, 25 bp, Mus musculus
aactcattcccgtatatgtcctagg

SEQ ID NO: 38173 - DNA, 25 bp, Mus musculus
aactcattctgtagcgggtagagaa

SEQ ID NO: 38174 - DNA, 25 bp, Mus musculus
aactcattctgttgcgggtagagaa

SEQ ID NO: 38175 - DNA, 25 bp, Mus musculus
aactcattgaagaacgccggagcca

SEQ ID NO: 38176 - DNA, 25 bp, Mus musculus
aactcattgaagtacgccggagcca

SEQ ID NO: 38177 - DNA, 25 bp, Mus musculus
aactcattgatgctgctatatggct

SEQ ID NO: 38178 - DNA, 25 bp, Mus musculus
aactcattgatggtgctatatggct

SEQ ID NO: 38179 - DNA, 25 bp, Mus musculus
aactcattgcttatggcagctctgt

SEQ ID NO: 38180 - DNA, 25 bp, Mus musculus
aactcattgcttttggcagctctgt

SEQ ID NO: 38181 - DNA, 25 bp, Mus musculus
aactcattggccattcagcttagct

SEQ ID NO: 38182 - DNA, 25 bp, Mus musculus
aactcattggcctttcagcttagct

SEQ ID NO: 38183 - DNA, 25 bp, Mus musculus
aactcatttagtaacctatcgaaca

SEQ ID NO: 38184 - DNA, 25 bp, Mus musculus
aactcatttagttacctatcgaaca

SEQ ID NO: 38185 - DNA, 25 bp, Mus musculus
aactcatttcatacctaatacagcc

SEQ ID NO: 38186 - DNA, 25 bp, Mus musculus
aactcatttcattcctaatacagcc

SEQ ID NO: 38187 - DNA, 25 bp, Mus musculus
aactcatttctgattgggcacaaag

SEQ ID NO: 38188 - DNA, 25 bp, Mus musculus
aactcatttctgtttgggcacaaag

SEQ ID NO: 38189 - DNA, 25 bp, Mus musculus
aactcatttcttactgatctttaaa

SEQ ID NO: 38190 - DNA, 25 bp, Mus musculus
aactcatttctttctgatctttaaa

SEQ ID NO: 38191 - DNA, 25 bp, Mus musculus
aactcatttgcaatccatggatcaa

SEQ ID NO: 38192 - DNA, 25 bp, Mus musculus
aactcatttgcattccatggatcaa

SEQ ID NO: 38193 - DNA, 25 bp, Mus musculus
aactcatttgtgatagaaacttgaa

SEQ ID NO: 38194 - DNA, 25 bp, Mus musculus
aactcatttgtgattgaatcaatgc

SEQ ID NO: 38195 - DNA, 25 bp, Mus musculus
aactcatttgtgttagaaacttgaa

SEQ ID NO: 38196 - DNA, 25 bp, Mus musculus
aactcatttgtgtttgaatcaatgc

SEQ ID NO: 38197 - DNA, 25 bp, Mus musculus
aactcattttagctttggctatcat

SEQ ID NO: 38198 - DNA, 25 bp, Mus musculus
aactcattttaggtttggctatcat

SEQ ID NO: 38199 - DNA, 25 bp, Mus musculus
aactccaaactcctcctaattaatg

SEQ ID NO: 38200 - DNA, 25 bp, Mus musculus
aactccaaactcgtcctaattaatg

SEQ ID NO: 38201 - DNA, 25 bp, Mus musculus
aactccaaagagcttctgttaaatg

SEQ ID NO: 38202 - DNA, 25 bp, Mus musculus
aactccaaagaggttctgttaaatg

SEQ ID NO: 38203 - DNA, 25 bp, Mus musculus
aactccaaagcccatagtccattct

SEQ ID NO: 38204 - DNA, 25 bp, Mus musculus
aactccaaagccgatagtccattct

SEQ ID NO: 38205 - DNA, 25 bp, Mus musculus
aactccaactccagctttggttcaa

SEQ ID NO: 38206 - DNA, 25 bp, Mus musculus
aactccaactcctgctttggttcaa

SEQ ID NO: 38207 - DNA, 25 bp, Mus musculus
aactccaagaatatcaccaaccaag

SEQ ID NO: 38208 - DNA, 25 bp, Mus musculus
aactccaagaatttcaccaaccaag

SEQ ID NO: 38209 - DNA, 25 bp, Mus musculus
aactccaagccccagcagattaaaa

SEQ ID NO: 38210 - DNA, 25 bp, Mus musculus
aactccaagcccgagcagattaaaa

SEQ ID NO: 38211 - DNA, 25 bp, Mus musculus
aactccaagcctattgactatctga

SEQ ID NO: 38212 - DNA, 25 bp, Mus musculus
aactccaagccttttgactatctga

SEQ ID NO: 38213 - DNA, 25 bp, Mus musculus
aactccaatcaacatgtttgcctaa

SEQ ID NO: 38214 - DNA, 25 bp, Mus musculus
aactccaatcaagatgtttgcctaa

SEQ ID NO: 38215 - DNA, 25 bp, Mus musculus
aactccaattctaggattctttagt

SEQ ID NO: 38216 - DNA, 25 bp, Mus musculus
aactccaattctctacaaatgaaaa

SEQ ID NO: 38217 - DNA, 25 bp, Mus musculus
aactccaattctgtacaaatgaaaa

SEQ ID NO: 38218 - DNA, 25 bp, Mus musculus
aactccaattcttggattctttagt

SEQ ID NO: 38219 - DNA, 25 bp, Mus musculus
aactccacagacactcacgaggtta

SEQ ID NO: 38220 - DNA, 25 bp, Mus musculus
aactccacagactctcacgaggtta

SEQ ID NO: 38221 - DNA, 25 bp, Mus musculus
aactccacagagcacctgggacggg

SEQ ID NO: 38222 - DNA, 25 bp, Mus musculus
aactccacagaggacctgggacggg

SEQ ID NO: 38223 - DNA, 25 bp, Mus musculus
aactccacagtcattaaagccactc

SEQ ID NO: 38224 - DNA, 25 bp, Mus musculus
aactccacagtctttaaagccactc

SEQ ID NO: 38225 - DNA, 25 bp, Mus musculus
aactccaccactagttgattttctc

SEQ ID NO: 38226 - DNA, 25 bp, Mus musculus
aactccaccacttgttgattttctc

SEQ ID NO: 38227 - DNA, 25 bp, Mus musculus
aactccacctccacctgtaggcaga

SEQ ID NO: 38228 - DNA, 25 bp, Mus musculus
aactccacctcctcctgtaggcaga

SEQ ID NO: 38229 - DNA, 25 bp, Mus musculus
aactccaccttcaatcaggttgtgc

SEQ ID NO: 38230 - DNA, 25 bp, Mus musculus
aactccaccttctatcaggttgtgc

SEQ ID NO: 38231 - DNA, 25 bp, Mus musculus
aactccacctttcaagaccagtact

SEQ ID NO: 38232 - DNA, 25 bp, Mus musculus
aactccacctttgaagaccagtact

SEQ ID NO: 38233 - DNA, 25 bp, Mus musculus
aactccacgtgcagggtctgttgca

SEQ ID NO: 38234 - DNA, 25 bp, Mus musculus
aactccacgtgctgggtctgttgca

SEQ ID NO: 38235 - DNA, 25 bp, Mus musculus
aactccactgtcattgaactcaaag

SEQ ID NO: 38236 - DNA, 25 bp, Mus musculus
aactccactgtctttgaactcaaag

SEQ ID NO: 38237 - DNA, 25 bp, Mus musculus
aactccacttgcaagggatcagaca

SEQ ID NO: 38238 - DNA, 25 bp, Mus musculus
aactccacttgctagggatcagaca

SEQ ID NO: 38239 - DNA, 25 bp, Mus musculus
aactccagaaagatttatttcagtg

SEQ ID NO: 38240 - DNA, 25 bp, Mus musculus
aactccagaaagttttatttcagtg

SEQ ID NO: 38241 - DNA, 25 bp, Mus musculus
aactccagacaacatttctcagtga

SEQ ID NO: 38242 - DNA, 25 bp, Mus musculus
aactccagacaagatttctcagtga

SEQ ID NO: 38243 - DNA, 25 bp, Mus musculus
aactccagacatactactcccaggg

SEQ ID NO: 38244 - DNA, 25 bp, Mus musculus
aactccagacattctactcccaggg

SEQ ID NO: 38245 - DNA, 25 bp, Mus musculus
aactccagagcacaagtatccttag

SEQ ID NO: 38246 - DNA, 25 bp, Mus musculus
aactccagagcagaagtatccttag

SEQ ID NO: 38247 - DNA, 25 bp, Mus musculus
aactccagaggcagtgctggttcct

SEQ ID NO: 38248 - DNA, 25 bp, Mus musculus
aactccagaggctgtgctggttcct

SEQ ID NO: 38249 - DNA, 25 bp, Mus musculus
aactccagatcaacactctttgggc

SEQ ID NO: 38250 - DNA, 25 bp, Mus musculus
aactccagatcatcactctttgggc

SEQ ID NO: 38251 - DNA, 25 bp, Mus musculus
aactccagccacagtttgtgtttga

SEQ ID NO: 38252 - DNA, 25 bp, Mus musculus
aactccagccactgtttgtgtttga

SEQ ID NO: 38253 - DNA, 25 bp, Mus musculus
aactccagcctgagtatatacaata

SEQ ID NO: 38254 - DNA, 25 bp, Mus musculus
aactccagcctgtgtatatacaata

SEQ ID NO: 38255 - DNA, 25 bp, Mus musculus
aactccagccttcagatgacgacaa

SEQ ID NO: 38256 - DNA, 25 bp, Mus musculus
aactccagccttgagatgacgacaa

SEQ ID NO: 38257 - DNA, 25 bp, Mus musculus
aactccagcgagctcagaaaccctt

SEQ ID NO: 38258 - DNA, 25 bp, Mus musculus
aactccagcgaggtcagaaaccctt

SEQ ID NO: 38259 - DNA, 25 bp, Mus musculus
aactccagctacaggtgatccagac

SEQ ID NO: 38260 - DNA, 25 bp, Mus musculus
aactccagctactggtgatccagac

SEQ ID NO: 38261 - DNA, 25 bp, Mus musculus
aactccagcttcagagactggcagt

SEQ ID NO: 38262 - DNA, 25 bp, Mus musculus
aactccagcttctgagactggcagt

SEQ ID NO: 38263 - DNA, 25 bp, Mus musculus
aactccaggactcagacactgcctg

SEQ ID NO: 38264 - DNA, 25 bp, Mus musculus
aactccaggactgagacactgcctg

SEQ ID NO: 38265 - DNA, 25 bp, Mus musculus
aactccagggtgaggttgatcctac

SEQ ID NO: 38266 - DNA, 25 bp, Mus musculus
aactccagggtgtggttgatcctac

SEQ ID NO: 38267 - DNA, 25 bp, Mus musculus
aactccaggtgtcagccttgctaaa

SEQ ID NO: 38268 - DNA, 25 bp, Mus musculus
aactccaggtgtgagccttgctaaa

SEQ ID NO: 38269 - DNA, 25 bp, Mus musculus
aactccagtcttcttttttgccgca

SEQ ID NO: 38270 - DNA, 25 bp, Mus musculus
aactccagtcttgttttttgccgca

SEQ ID NO: 38271 - DNA, 25 bp, Mus musculus
aactccagtgacatcccgaaatgca

SEQ ID NO: 38272 - DNA, 25 bp, Mus musculus
aactccagtgacttcccgaaatgca

SEQ ID NO: 38273 - DNA, 25 bp, Mus musculus
aactccagtggaattcgaggctact

SEQ ID NO: 38274 - DNA, 25 bp, Mus musculus
aactccagtggatttcgaggctact

SEQ ID NO: 38275 - DNA, 25 bp, Mus musculus
aactccagtgtgagctctgactctt

SEQ ID NO: 38276 - DNA, 25 bp, Mus musculus
aactccagtgtgtgctctgactctt

SEQ ID NO: 38277 - DNA, 25 bp, Mus musculus
aactccagttccaaatgatatagta

SEQ ID NO: 38278 - DNA, 25 bp, Mus musculus
aactccagttccaagagagccgttg

SEQ ID NO: 38279 - DNA, 25 bp, Mus musculus
aactccagttcctaatgatatagta

SEQ ID NO: 38280 - DNA, 25 bp, Mus musculus
aactccagttcctagagagccgttg

SEQ ID NO: 38281 - DNA, 25 bp, Mus musculus
aactccagttctaataggatttgag

SEQ ID NO: 38282 - DNA, 25 bp, Mus musculus
aactccagttcttataggatttgag

SEQ ID NO: 38283 - DNA, 25 bp, Mus musculus
aactccatagagatgccgaagcgta

SEQ ID NO: 38284 - DNA, 25 bp, Mus musculus
aactccatagagttgccgaagcgta

SEQ ID NO: 38285 - DNA, 25 bp, Mus musculus
aactccatagtgatctgacatccag

SEQ ID NO: 38286 - DNA, 25 bp, Mus musculus
aactccatagtgttctgacatccag

SEQ ID NO: 38287 - DNA, 25 bp, Mus musculus
aactccatatctagggcattcagtg

SEQ ID NO: 38288 - DNA, 25 bp, Mus musculus
aactccatatcttgggcattcagtg

SEQ ID NO: 38289 - DNA, 25 bp, Mus musculus
aactccatattcaagttttctctga

SEQ ID NO: 38290 - DNA, 25 bp, Mus musculus
aactccatattctagttttctctga

SEQ ID NO: 38291 - DNA, 25 bp, Mus musculus
aactccatcactagtaattatggtg

SEQ ID NO: 38292 - DNA, 25 bp, Mus musculus
aactccatcacttgtaattatggtg

SEQ ID NO: 38293 - DNA, 25 bp, Mus musculus
aactccatcaggaattgtggcatca

SEQ ID NO: 38294 - DNA, 25 bp, Mus musculus
aactccatcaggtattgtggcatca

SEQ ID NO: 38295 - DNA, 25 bp, Mus musculus
aactccatgctgattgacaccagag

SEQ ID NO: 38296 - DNA, 25 bp, Mus musculus
aactccatgctgtttgacaccagag

SEQ ID NO: 38297 - DNA, 25 bp, Mus musculus
aactccatgggaagaaagctacaca

SEQ ID NO: 38298 - DNA, 25 bp, Mus musculus
aactccatgggatgaaagctacaca

SEQ ID NO: 38299 - DNA, 25 bp, Mus musculus
aactccatgggcatgtccaacagcc

SEQ ID NO: 38300 - DNA, 25 bp, Mus musculus
aactccatgggcttgtccaacagcc

SEQ ID NO: 38301 - DNA, 25 bp, Mus musculus
aactccattaaaattatgtccattt

SEQ ID NO: 38302 - DNA, 25 bp, Mus musculus
aactccattaaatttatgtccattt

SEQ ID NO: 38303 - DNA, 25 bp, Mus musculus
aactccattctgcatacatctaatg

SEQ ID NO: 38304 - DNA, 25 bp, Mus musculus
aactccattctggatacatctaatg

SEQ ID NO: 38305 - DNA, 25 bp, Mus musculus
aactccattcttactcttcattttt

SEQ ID NO: 38306 - DNA, 25 bp, Mus musculus
aactccattctttctcttcattttt

SEQ ID NO: 38307 - DNA, 25 bp, Mus musculus
aactccattttcagtaggtcaccgt

SEQ ID NO: 38308 - DNA, 25 bp, Mus musculus
aactccattttctgtaggtcaccgt

SEQ ID NO: 38309 - DNA, 25 bp, Mus musculus
aactcccaacagacaccgcgagaga

SEQ ID NO: 38310 - DNA, 25 bp, Mus musculus
aactcccaacagtcaccgcgagaga

SEQ ID NO: 38311 - DNA, 25 bp, Mus musculus
aactcccaagaaagccttaatgccc

SEQ ID NO: 38312 - DNA, 25 bp, Mus musculus
aactcccaagaatgccttaatgccc

SEQ ID NO: 38313 - DNA, 25 bp, Mus musculus
aactcccacaagacattgctctgta

SEQ ID NO: 38314 - DNA, 25 bp, Mus musculus
aactcccacaagtcattgctctgta

SEQ ID NO: 38315 - DNA, 25 bp, Mus musculus
aactcccacaggcaaagaatcccag

SEQ ID NO: 38316 - DNA, 25 bp, Mus musculus
aactcccacagggaaagaatcccag

SEQ ID NO: 38317 - DNA, 25 bp, Mus musculus
aactcccagagtaccatgctccatt

SEQ ID NO: 38318 - DNA, 25 bp, Mus musculus
aactcccagagtcaaccaataatat

SEQ ID NO: 38319 - DNA, 25 bp, Mus musculus
aactcccagagtgaaccaataatat

SEQ ID NO: 38320 - DNA, 25 bp, Mus musculus
aactcccagagttccatgctccatt

SEQ ID NO: 38321 - DNA, 25 bp, Mus musculus
aactcccaggaaatgcagttgtgaa

SEQ ID NO: 38322 - DNA, 25 bp, Mus musculus
aactcccaggaattgcagttgtgaa

SEQ ID NO: 38323 - DNA, 25 bp, Mus musculus
aactcccatctgagtgtccttgttc

SEQ ID NO: 38324 - DNA, 25 bp, Mus musculus
aactcccatctgtgtgtccttgttc

SEQ ID NO: 38325 - DNA, 25 bp, Mus musculus
aactcccatcttcatgtgcatcaca

SEQ ID NO: 38326 - DNA, 25 bp, Mus musculus
aactcccatcttgatgtgcatcaca

SEQ ID NO: 38327 - DNA, 25 bp, Mus musculus
aactcccatgccatgttcatctcat

SEQ ID NO: 38328 - DNA, 25 bp, Mus musculus
aactcccatgccttgttcatctcat

SEQ ID NO: 38329 - DNA, 25 bp, Mus musculus
aactccccaggcacaacctccatgt

SEQ ID NO: 38330 - DNA, 25 bp, Mus musculus
aactccccaggctcaacctccatgt

SEQ ID NO: 38331 - DNA, 25 bp, Mus musculus
aactccccgtgtattgttgatatag

SEQ ID NO: 38332 - DNA, 25 bp, Mus musculus
aactccccgtgttttgttgatatag

SEQ ID NO: 38333 - DNA, 25 bp, Mus musculus
aactcccctcttaacaaagctgagg

SEQ ID NO: 38334 - DNA, 25 bp, Mus musculus
aactcccctctttacaaagctgagg

SEQ ID NO: 38335 - DNA, 25 bp, Mus musculus
aactcccgcataattcaaccgtata

SEQ ID NO: 38336 - DNA, 25 bp, Mus musculus
aactcccgcatatttcaaccgtata

SEQ ID NO: 38337 - DNA, 25 bp, Mus musculus
aactcccgtttacagactgcagcac

SEQ ID NO: 38338 - DNA, 25 bp, Mus musculus
aactcccgtttagagactgcagcac

SEQ ID NO: 38339 - DNA, 25 bp, Mus musculus
aactccctaataattgcttcctaag

SEQ ID NO: 38340 - DNA, 25 bp, Mus musculus
aactccctaatatttgcttcctaag

SEQ ID NO: 38341 - DNA, 25 bp, Mus musculus
aactccctacctcattctgtagttg

SEQ ID NO: 38342 - DNA, 25 bp, Mus musculus
aactccctacctgattctgtagttg

SEQ ID NO: 38343 - DNA, 25 bp, Mus musculus
aactccctatgtagctgaactccag

SEQ ID NO: 38344 - DNA, 25 bp, Mus musculus
aactccctatgtatagatacaagag

SEQ ID NO: 38345 - DNA, 25 bp, Mus musculus
aactccctatgttgctgaactccag

SEQ ID NO: 38346 - DNA, 25 bp, Mus musculus
aactccctatgtttagatacaagag

SEQ ID NO: 38347 - DNA, 25 bp, Mus musculus
aactccctcaaaagctcttttgtgt

SEQ ID NO: 38348 - DNA, 25 bp, Mus musculus
aactccctcaaatgctcttttgtgt

SEQ ID NO: 38349 - DNA, 25 bp, Mus musculus
aactccctcagtctcttatgtgcag

SEQ ID NO: 38350 - DNA, 25 bp, Mus musculus
aactccctcagtgtcttatgtgcag

SEQ ID NO: 38351 - DNA, 25 bp, Mus musculus
aactccctcatcagtcctgtgtgta

SEQ ID NO: 38352 - DNA, 25 bp, Mus musculus
aactccctcatctgtcctgtgtgta

SEQ ID NO: 38353 - DNA, 25 bp, Mus musculus
aactccctccatcgcagaagtacta

SEQ ID NO: 38354 - DNA, 25 bp, Mus musculus
aactccctccatggcagaagtacta

SEQ ID NO: 38355 - DNA, 25 bp, Mus musculus
aactccctcgtgcttttgagatgtt

SEQ ID NO: 38356 - DNA, 25 bp, Mus musculus
aactccctcgtggttttgagatgtt

SEQ ID NO: 38357 - DNA, 25 bp, Mus musculus
aactccctctaccttgtaattgatg

SEQ ID NO: 38358 - DNA, 25 bp, Mus musculus
aactccctctacgttgtaattgatg

SEQ ID NO: 38359 - DNA, 25 bp, Mus musculus
aactccctgtacaactaggcagaag

SEQ ID NO: 38360 - DNA, 25 bp, Mus musculus
aactccctgtactactaggcagaag

SEQ ID NO: 38361 - DNA, 25 bp, Mus musculus
aactccctgtgcagccaaggatgat

SEQ ID NO: 38362 - DNA, 25 bp, Mus musculus
aactccctgtgctgccaaggatgat

SEQ ID NO: 38363 - DNA, 25 bp, Mus musculus
aactcccttagcaagtgccctgtgg

SEQ ID NO: 38364 - DNA, 25 bp, Mus musculus
aactcccttagctagtgccctgtgg

SEQ ID NO: 38365 - DNA, 25 bp, Mus musculus
aactcccttgcccaatactggtggg

SEQ ID NO: 38366 - DNA, 25 bp, Mus musculus
aactcccttgccgaatactggtggg

SEQ ID NO: 38367 - DNA, 25 bp, Mus musculus
aactccgaagaaaatatgaatccac

SEQ ID NO: 38368 - DNA, 25 bp, Mus musculus
aactccgaagaatatatgaatccac

SEQ ID NO: 38369 - DNA, 25 bp, Mus musculus
aactccgaattgcactgcactgtgg

SEQ ID NO: 38370 - DNA, 25 bp, Mus musculus
aactccgaattggactgcactgtgg

SEQ ID NO: 38371 - DNA, 25 bp, Mus musculus
aactccgagactcaactaccatttg

SEQ ID NO: 38372 - DNA, 25 bp, Mus musculus
aactccgagactgaactaccatttg

SEQ ID NO: 38373 - DNA, 25 bp, Mus musculus
aactccgagatgaatttccaaccag

SEQ ID NO: 38374 - DNA, 25 bp, Mus musculus
aactccgagatgtatttccaaccag

SEQ ID NO: 38375 - DNA, 25 bp, Mus musculus
aactccgcagttaagaatacttcct

SEQ ID NO: 38376 - DNA, 25 bp, Mus musculus
aactccgcagtttagaatacttcct

SEQ ID NO: 38377 - DNA, 25 bp, Mus musculus
aactccgccctgatatactttttga

SEQ ID NO: 38378 - DNA, 25 bp, Mus musculus
aactccgccctgttatactttttga

SEQ ID NO: 38379 - DNA, 25 bp, Mus musculus
aactccgctgagctgctccggagga

SEQ ID NO: 38380 - DNA, 25 bp, Mus musculus
aactccgctgaggtgctccggagga

SEQ ID NO: 38381 - DNA, 25 bp, Mus musculus
aactccgcttttcacgtattcaggg

SEQ ID NO: 38382 - DNA, 25 bp, Mus musculus
aactccgcttttgacgtattcaggg

SEQ ID NO: 38383 - DNA, 25 bp, Mus musculus
aactccggaaaaagcagcagaggct

SEQ ID NO: 38384 - DNA, 25 bp, Mus musculus
aactccggaaaatgcagcagaggct

SEQ ID NO: 38385 - DNA, 25 bp, Mus musculus
aactccgggcttccattagacgcag

SEQ ID NO: 38386 - DNA, 25 bp, Mus musculus
aactccgggcttgcattagacgcag

SEQ ID NO: 38387 - DNA, 25 bp, Mus musculus
aactccggtgcacgaattccaaaat

SEQ ID NO: 38388 - DNA, 25 bp, Mus musculus
aactccggtgcaggaattccaaaat

SEQ ID NO: 38389 - DNA, 25 bp, Mus musculus
aactccggtgttcattacagctagc

SEQ ID NO: 38390 - DNA, 25 bp, Mus musculus
aactccggtgttgattacagctagc

SEQ ID NO: 38391 - DNA, 25 bp, Mus musculus
aactccgtagctcatttggtaataa

SEQ ID NO: 38392 - DNA, 25 bp, Mus musculus
aactccgtagctgatttggtaataa

SEQ ID NO: 38393 - DNA, 25 bp, Mus musculus
aactccgtggaacccggatggtcca

SEQ ID NO: 38394 - DNA, 25 bp, Mus musculus
aactccgtggaagccggatggtcca

SEQ ID NO: 38395 - DNA, 25 bp, Mus musculus
aactccgtgtcgaccagctaaagta

SEQ ID NO: 38396 - DNA, 25 bp, Mus musculus
aactccgtgtcgtccagctaaagta

SEQ ID NO: 38397 - DNA, 25 bp, Mus musculus
aactccgttagtagatcttcaagac

SEQ ID NO: 38398 - DNA, 25 bp, Mus musculus
aactccgttagttgatcttcaagac

SEQ ID NO: 38399 - DNA, 25 bp, Mus musculus
aactccgttcatacataaaccacac

SEQ ID NO: 38400 - DNA, 25 bp, Mus musculus
aactccgttcattcataaaccacac

SEQ ID NO: 38401 - DNA, 25 bp, Mus musculus
aactcctaagacaccgccatgaaag

SEQ ID NO: 38402 - DNA, 25 bp, Mus musculus
aactcctaagactccgccatgaaag

SEQ ID NO: 38403 - DNA, 25 bp, Mus musculus
aactcctaatccaaaccattatatg

SEQ ID NO: 38404 - DNA, 25 bp, Mus musculus
aactcctaatcctaaccattatatg

SEQ ID NO: 38405 - DNA, 25 bp, Mus musculus
aactcctaatgaaaacctgtgacta

SEQ ID NO: 38406 - DNA, 25 bp, Mus musculus
aactcctaatgataacctgtgacta

SEQ ID NO: 38407 - DNA, 25 bp, Mus musculus
aactcctaatttagcactgtccctt

SEQ ID NO: 38408 - DNA, 25 bp, Mus musculus
aactcctaattttgcactgtccctt

SEQ ID NO: 38409 - DNA, 25 bp, Mus musculus
aactcctacagcaagtggttctcca

SEQ ID NO: 38410 - DNA, 25 bp, Mus musculus
aactcctacagctagtggttctcca

SEQ ID NO: 38411 - DNA, 25 bp, Mus musculus
aactcctacataaggtgcacactct

SEQ ID NO: 38412 - DNA, 25 bp, Mus musculus
aactcctacatatggtgcacactct

SEQ ID NO: 38413 - DNA, 25 bp, Mus musculus
aactcctactggctagtcctaaagt

SEQ ID NO: 38414 - DNA, 25 bp, Mus musculus
aactcctactgggtagtcctaaagt

SEQ ID NO: 38415 - DNA, 25 bp, Mus musculus
aactcctagaacaggctctggcatg

SEQ ID NO: 38416 - DNA, 25 bp, Mus musculus
aactcctagaactggctctggcatg

SEQ ID NO: 38417 - DNA, 25 bp, Mus musculus
aactcctagagtagtgctttgccct

SEQ ID NO: 38418 - DNA, 25 bp, Mus musculus
aactcctagagttgtgctttgccct

SEQ ID NO: 38419 - DNA, 25 bp, Mus musculus
aactcctaggtccacatggttgatg

SEQ ID NO: 38420 - DNA, 25 bp, Mus musculus
aactcctaggtcgacatggttgatg

SEQ ID NO: 38421 - DNA, 25 bp, Mus musculus
aactcctagtttacctgtggccaat

SEQ ID NO: 38422 - DNA, 25 bp, Mus musculus
aactcctagttttcctgtggccaat

SEQ ID NO: 38423 - DNA, 25 bp, Mus musculus
aactcctataatcgcaacacttggg

SEQ ID NO: 38424 - DNA, 25 bp, Mus musculus
aactcctataatggcaacacttggg

SEQ ID NO: 38425 - DNA, 25 bp, Mus musculus
aactcctatcatctagctagccctt

SEQ ID NO: 38426 - DNA, 25 bp, Mus musculus
aactcctatcatgtagctagccctt

SEQ ID NO: 38427 - DNA, 25 bp, Mus musculus
aactcctatgagatcagctgtctct

SEQ ID NO: 38428 - DNA, 25 bp, Mus musculus
aactcctatgagttcagctgtctct

SEQ ID NO: 38429 - DNA, 25 bp, Mus musculus
aactcctatttgaagacaaggcatt

SEQ ID NO: 38430 - DNA, 25 bp, Mus musculus
aactcctatttgtagacaaggcatt

SEQ ID NO: 38431 - DNA, 25 bp, Mus musculus
aactcctcaagcctacatgtgtcta

SEQ ID NO: 38432 - DNA, 25 bp, Mus musculus
aactcctcaagcgtacatgtgtcta

SEQ ID NO: 38433 - DNA, 25 bp, Mus musculus
aactcctcaatccagcctggcggta

SEQ ID NO: 38434 - DNA, 25 bp, Mus musculus
aactcctcaatcgagcctggcggta

SEQ ID NO: 38435 - DNA, 25 bp, Mus musculus
aactcctcagatatctctagcacaa

SEQ ID NO: 38436 - DNA, 25 bp, Mus musculus
aactcctcagatttctctagcacaa

SEQ ID NO: 38437 - DNA, 25 bp, Mus musculus
aactcctcagctattgtcagacttt

SEQ ID NO: 38438 - DNA, 25 bp, Mus musculus
aactcctcagcttttgtcagacttt

SEQ ID NO: 38439 - DNA, 25 bp, Mus musculus
aactcctcagtgatccccatcgata

SEQ ID NO: 38440 - DNA, 25 bp, Mus musculus
aactcctcagtgttccccatcgata

SEQ ID NO: 38441 - DNA, 25 bp, Mus musculus
aactcctccaatcaagggctaagaa

SEQ ID NO: 38442 - DNA, 25 bp, Mus musculus
aactcctccaatgaagggctaagaa

SEQ ID NO: 38443 - DNA, 25 bp, Mus musculus
aactcctcccttcggattatcttgt

SEQ ID NO: 38444 - DNA, 25 bp, Mus musculus
aactcctcccttgggattatcttgt

SEQ ID NO: 38445 - DNA, 25 bp, Mus musculus
aactcctccggccttgcagttttgg

SEQ ID NO: 38446 - DNA, 25 bp, Mus musculus
aactcctccggcgttgcagttttgg

SEQ ID NO: 38447 - DNA, 25 bp, Mus musculus
aactcctcctcgatagaaaccgtgt

SEQ ID NO: 38448 - DNA, 25 bp, Mus musculus
aactcctcctcgttagaaaccgtgt

SEQ ID NO: 38449 - DNA, 25 bp, Mus musculus
aactcctcgaacacagggcttgaaa

SEQ ID NO: 38450 - DNA, 25 bp, Mus musculus
aactcctcgaactcagggcttgaaa

SEQ ID NO: 38451 - DNA, 25 bp, Mus musculus
aactcctcgagaactccttgaatgg

SEQ ID NO: 38452 - DNA, 25 bp, Mus musculus
aactcctcgagatctccttgaatgg

SEQ ID NO: 38453 - DNA, 25 bp, Mus musculus
aactcctcgaggaccatgcgtagag

SEQ ID NO: 38454 - DNA, 25 bp, Mus musculus
aactcctcgaggtccatgcgtagag

SEQ ID NO: 38455 - DNA, 25 bp, Mus musculus
aactcctcggagaacgtgcctgagt

SEQ ID NO: 38456 - DNA, 25 bp, Mus musculus
aactcctcggagtacgtgcctgagt

SEQ ID NO: 38457 - DNA, 25 bp, Mus musculus
aactcctcgggcacggactatggcg

SEQ ID NO: 38458 - DNA, 25 bp, Mus musculus
aactcctcgggctcggactatggcg

SEQ ID NO: 38459 - DNA, 25 bp, Mus musculus
aactcctctggacactctgtttaaa

SEQ ID NO: 38460 - DNA, 25 bp, Mus musculus
aactcctctggagactctgtttaaa

SEQ ID NO: 38461 - DNA, 25 bp, Mus musculus
aactcctcttacagtagggccatga

SEQ ID NO: 38462 - DNA, 25 bp, Mus musculus
aactcctcttactgtagggccatga

SEQ ID NO: 38463 - DNA, 25 bp, Mus musculus
aactcctcttccaataaggctgtct

SEQ ID NO: 38464 - DNA, 25 bp, Mus musculus
aactcctcttcctataaggctgtct

SEQ ID NO: 38465 - DNA, 25 bp, Mus musculus
aactcctgaaggctgctgagagcat

SEQ ID NO: 38466 - DNA, 25 bp, Mus musculus
aactcctgaagggtgctgagagcat

SEQ ID NO: 38467 - DNA, 25 bp, Mus musculus
aactcctgccacaagagcttgtgga

SEQ ID NO: 38468 - DNA, 25 bp, Mus musculus
aactcctgccactagagcttgtgga

SEQ ID NO: 38469 - DNA, 25 bp, Mus musculus
aactcctgcgacattcactttgaaa

SEQ ID NO: 38470 - DNA, 25 bp, Mus musculus
aactcctgcgactttcactttgaaa

SEQ ID NO: 38471 - DNA, 25 bp, Mus musculus
aactcctgcggaagttcagaaacta

SEQ ID NO: 38472 - DNA, 25 bp, Mus musculus
aactcctgcggatgttcagaaacta

SEQ ID NO: 38473 - DNA, 25 bp, Mus musculus
aactcctgcgggacagtcgagcttc

SEQ ID NO: 38474 - DNA, 25 bp, Mus musculus
aactcctgcgggtcagtcgagcttc

SEQ ID NO: 38475 - DNA, 25 bp, Mus musculus
aactcctgcgtgagcgcgcacagag

SEQ ID NO: 38476 - DNA, 25 bp, Mus musculus
aactcctgcgtgtgcgcgcacagag

SEQ ID NO: 38477 - DNA, 25 bp, Mus musculus
aactcctgctcaagagcaccttgat

SEQ ID NO: 38478 - DNA, 25 bp, Mus musculus
aactcctgctcatgagcaccttgat

SEQ ID NO: 38479 - DNA, 25 bp, Mus musculus
aactcctggaagaccttaggtggat

SEQ ID NO: 38480 - DNA, 25 bp, Mus musculus
aactcctggaagtccttaggtggat

SEQ ID NO: 38481 - DNA, 25 bp, Mus musculus
aactcctggacaatgacagttcctc

SEQ ID NO: 38482 - DNA, 25 bp, Mus musculus
aactcctggacattgacagttcctc

SEQ ID NO: 38483 - DNA, 25 bp, Mus musculus
aactcctggatacctatgctgatgc

SEQ ID NO: 38484 - DNA, 25 bp, Mus musculus
aactcctggatagctatgctgatgc

SEQ ID NO: 38485 - DNA, 25 bp, Mus musculus
aactcctggctcaattagggtccta

SEQ ID NO: 38486 - DNA, 25 bp, Mus musculus
aactcctggctctattagggtccta

SEQ ID NO: 38487 - DNA, 25 bp, Mus musculus
aactcctgggagcatttgcagttgc

SEQ ID NO: 38488 - DNA, 25 bp, Mus musculus
aactcctgggaggatttgcagttgc

SEQ ID NO: 38489 - DNA, 25 bp, Mus musculus
aactcctgggcaagcatctgaatga

SEQ ID NO: 38490 - DNA, 25 bp, Mus musculus
aactcctgggcatgcatctgaatga

SEQ ID NO: 38491 - DNA, 25 bp, Mus musculus
aactcctgtaacattacctaagcag

SEQ ID NO: 38492 - DNA, 25 bp, Mus musculus
aactcctgtaactttacctaagcag

SEQ ID NO: 38493 - DNA, 25 bp, Mus musculus
aactcctgtaagaaagaggtccaca

SEQ ID NO: 38494 - DNA, 25 bp, Mus musculus
aactcctgtaagtaagaggtccaca

SEQ ID NO: 38495 - DNA, 25 bp, Mus musculus
aactcctgtattctttcctactttg

SEQ ID NO: 38496 - DNA, 25 bp, Mus musculus
aactcctgtattgtttcctactttg

SEQ ID NO: 38497 - DNA, 25 bp, Mus musculus
aactcctgtggcataccatttatgg

SEQ ID NO: 38498 - DNA, 25 bp, Mus musculus
aactcctgtggcttaccatttatgg

SEQ ID NO: 38499 - DNA, 25 bp, Mus musculus
aactcctgttcccacaacaacatga

SEQ ID NO: 38500 - DNA, 25 bp, Mus musculus
aactcctgttccgacaacaacatga

SEQ ID NO: 38501 - DNA, 25 bp, Mus musculus
aactcctgttttctgactatggcca

SEQ ID NO: 38502 - DNA, 25 bp, Mus musculus
aactcctgttttgtgactatggcca

SEQ ID NO: 38503 - DNA, 25 bp, Mus musculus
aactccttaacccatgaactagctg

SEQ ID NO: 38504 - DNA, 25 bp, Mus musculus
aactccttaaccgatgaactagctg

SEQ ID NO: 38505 - DNA, 25 bp, Mus musculus
aactccttagatacgtttctattga

SEQ ID NO: 38506 - DNA, 25 bp, Mus musculus
aactccttagattcgtttctattga

SEQ ID NO: 38507 - DNA, 25 bp, Mus musculus
aactccttagtacacctacatgcta

SEQ ID NO: 38508 - DNA, 25 bp, Mus musculus
aactccttagtagacctacatgcta

SEQ ID NO: 38509 - DNA, 25 bp, Mus musculus
aactccttatgtctcagatttgtga

SEQ ID NO: 38510 - DNA, 25 bp, Mus musculus
aactccttatgtgtcagatttgtga

SEQ ID NO: 38511 - DNA, 25 bp, Mus musculus
aactccttcaccctgcgtaatgaca

SEQ ID NO: 38512 - DNA, 25 bp, Mus musculus
aactccttcaccgtgcgtaatgaca

SEQ ID NO: 38513 - DNA, 25 bp, Mus musculus
aactccttcgtcaggattgcagact

SEQ ID NO: 38514 - DNA, 25 bp, Mus musculus
aactccttcgtctggattgcagact

SEQ ID NO: 38515 - DNA, 25 bp, Mus musculus
aactccttctagcatgtgattcctg

SEQ ID NO: 38516 - DNA, 25 bp, Mus musculus
aactccttctaggatgtgattcctg

SEQ ID NO: 38517 - DNA, 25 bp, Mus musculus
aactccttgaggaatgtccagcaga

SEQ ID NO: 38518 - DNA, 25 bp, Mus musculus
aactccttgaggtatgtccagcaga

SEQ ID NO: 38519 - DNA, 25 bp, Mus musculus
aactccttgagtattaaatgcttct

SEQ ID NO: 38520 - DNA, 25 bp, Mus musculus
aactccttgagttttaaatgcttct

SEQ ID NO: 38521 - DNA, 25 bp, Mus musculus
aactccttgtgaaggaatcctccca

SEQ ID NO: 38522 - DNA, 25 bp, Mus musculus
aactccttgtgatggaatcctccca

SEQ ID NO: 38523 - DNA, 25 bp, Mus musculus
aactcctttagcagtattcttcctt

SEQ ID NO: 38524 - DNA, 25 bp, Mus musculus
aactcctttagctgtattcttcctt

SEQ ID NO: 38525 - DNA, 25 bp, Mus musculus
aactcctttatcagggaccctgtgt

SEQ ID NO: 38526 - DNA, 25 bp, Mus musculus
aactcctttatctgggaccctgtgt

SEQ ID NO: 38527 - DNA, 25 bp, Mus musculus
aactcctttcagagccgctggatga

SEQ ID NO: 38528 - DNA, 25 bp, Mus musculus
aactcctttcagtgccgctggatga

SEQ ID NO: 38529 - DNA, 25 bp, Mus musculus
aactcctttgtaagaactgtgccaa

SEQ ID NO: 38530 - DNA, 25 bp, Mus musculus
aactcctttgtacgctagaacctgg

SEQ ID NO: 38531 - DNA, 25 bp, Mus musculus
aactcctttgtaggctagaacctgg

SEQ ID NO: 38532 - DNA, 25 bp, Mus musculus
aactcctttgtatgaactgtgccaa

SEQ ID NO: 38533 - DNA, 25 bp, Mus musculus
aactcgaaaccgatatatctgccag

SEQ ID NO: 38534 - DNA, 25 bp, Mus musculus
aactcgaaaccgttatatctgccag

SEQ ID NO: 38535 - DNA, 25 bp, Mus musculus
aactcgaccactcctttacatttat

SEQ ID NO: 38536 - DNA, 25 bp, Mus musculus
aactcgaccactgctttacatttat

SEQ ID NO: 38537 - DNA, 25 bp, Mus musculus
aactcgaggttgaataacagaagga

SEQ ID NO: 38538 - DNA, 25 bp, Mus musculus
aactcgaggttgtataacagaagga

SEQ ID NO: 38539 - DNA, 25 bp, Mus musculus
aactcgagtgttcagtggctcccga

SEQ ID NO: 38540 - DNA, 25 bp, Mus musculus
aactcgagtgttgagtggctcccga

SEQ ID NO: 38541 - DNA, 25 bp, Mus musculus
aactcgatagttaagcttcaggcct

SEQ ID NO: 38542 - DNA, 25 bp, Mus musculus
aactcgatagtttagcttcaggcct

SEQ ID NO: 38543 - DNA, 25 bp, Mus musculus
aactcgatgaaaccgcttgcctaag

SEQ ID NO: 38544 - DNA, 25 bp, Mus musculus
aactcgatgaaagcgcttgcctaag

SEQ ID NO: 38545 - DNA, 25 bp, Mus musculus
aactcgatgatcagtagcccaggct

SEQ ID NO: 38546 - DNA, 25 bp, Mus musculus
aactcgatgatctgtagcccaggct

SEQ ID NO: 38547 - DNA, 25 bp, Mus musculus
aactcgcaagagatgtccttccttg

SEQ ID NO: 38548 - DNA, 25 bp, Mus musculus
aactcgcaagagttgtccttccttg

SEQ ID NO: 38549 - DNA, 25 bp, Mus musculus
aactcgcattgcagaggagtccgca

SEQ ID NO: 38550 - DNA, 25 bp, Mus musculus
aactcgcattgctgaggagtccgca

SEQ ID NO: 38551 - DNA, 25 bp, Mus musculus
aactcgcgcgctctaaggttggtac

SEQ ID NO: 38552 - DNA, 25 bp, Mus musculus
aactcgcgcgctgtaaggttggtac

SEQ ID NO: 38553 - DNA, 25 bp, Mus musculus
aactcgcggtagatggagcccgcca

SEQ ID NO: 38554 - DNA, 25 bp, Mus musculus
aactcgcggtagttggagcccgcca

SEQ ID NO: 38555 - DNA, 25 bp, Mus musculus
aactcgcgttgaaagcttgcatccc

SEQ ID NO: 38556 - DNA, 25 bp, Mus musculus
aactcgcgttgatagcttgcatccc

SEQ ID NO: 38557 - DNA, 25 bp, Mus musculus
aactcgctcaagctgtcatgtacgg

SEQ ID NO: 38558 - DNA, 25 bp, Mus musculus
aactcgctcaaggtgtcatgtacgg

SEQ ID NO: 38559 - DNA, 25 bp, Mus musculus
aactcgctcactcctaaaatatttg

SEQ ID NO: 38560 - DNA, 25 bp, Mus musculus
aactcgctcactgctaaaatatttg

SEQ ID NO: 38561 - DNA, 25 bp, Mus musculus
aactcgctgtttcttctcttttcag

SEQ ID NO: 38562 - DNA, 25 bp, Mus musculus
aactcgctgtttgttctcttttcag

SEQ ID NO: 38563 - DNA, 25 bp, Mus musculus
aactcgctttgtacagccttgggag

SEQ ID NO: 38564 - DNA, 25 bp, Mus musculus
aactcgctttgttcagccttgggag

SEQ ID NO: 38565 - DNA, 25 bp, Mus musculus
aactcggagagacccttgatgtttt

SEQ ID NO: 38566 - DNA, 25 bp, Mus musculus
aactcggagagagccttgatgtttt

SEQ ID NO: 38567 - DNA, 25 bp, Mus musculus
aactcggagagcattcacatacaga

SEQ ID NO: 38568 - DNA, 25 bp, Mus musculus
aactcggagagctttcacatacaga

SEQ ID NO: 38569 - DNA, 25 bp, Mus musculus
aactcggagatgagcacgtccttgt

SEQ ID NO: 38570 - DNA, 25 bp, Mus musculus
aactcggagatgtgcacgtccttgt

SEQ ID NO: 38571 - DNA, 25 bp, Mus musculus
aactcggagttgatgcagatcagac

SEQ ID NO: 38572 - DNA, 25 bp, Mus musculus
aactcggagttgttgcagatcagac

SEQ ID NO: 38573 - DNA, 25 bp, Mus musculus
aactcggatactaaataggacctgg

SEQ ID NO: 38574 - DNA, 25 bp, Mus musculus
aactcggatactcaggaatagggca

SEQ ID NO: 38575 - DNA, 25 bp, Mus musculus
aactcggatactgaggaatagggca

SEQ ID NO: 38576 - DNA, 25 bp, Mus musculus
aactcggatacttaataggacctgg

SEQ ID NO: 38577 - DNA, 25 bp, Mus musculus
aactcggatatactcggtgctacca

SEQ ID NO: 38578 - DNA, 25 bp, Mus musculus
aactcggatatagtcggtgctacca

SEQ ID NO: 38579 - DNA, 25 bp, Mus musculus
aactcggatcagacgtgactcggct

SEQ ID NO: 38580 - DNA, 25 bp, Mus musculus
aactcggatcagtcgtgactcggct

SEQ ID NO: 38581 - DNA, 25 bp, Mus musculus
aactcggcacatacgggaccaatat

SEQ ID NO: 38582 - DNA, 25 bp, Mus musculus
aactcggcacattcgggaccaatat

SEQ ID NO: 38583 - DNA, 25 bp, Mus musculus
aactcggcatccaggtccttttggg

SEQ ID NO: 38584 - DNA, 25 bp, Mus musculus
aactcggcatcctggtccttttggg

SEQ ID NO: 38585 - DNA, 25 bp, Mus musculus
aactcggccacacagagtgcggaca

SEQ ID NO: 38586 - DNA, 25 bp, Mus musculus
aactcggccacagagagtgcggaca

SEQ ID NO: 38587 - DNA, 25 bp, Mus musculus
aactcggctcagaaccaggttcagt

SEQ ID NO: 38588 - DNA, 25 bp, Mus musculus
aactcggctcagtaccaggttcagt

SEQ ID NO: 38589 - DNA, 25 bp, Mus musculus
aactcggctgtaataatcacgcgat

SEQ ID NO: 38590 - DNA, 25 bp, Mus musculus
aactcggctgtattaatcacgcgat

SEQ ID NO: 38591 - DNA, 25 bp, Mus musculus
aactcggctgtgatgggctttgaac

SEQ ID NO: 38592 - DNA, 25 bp, Mus musculus
aactcggctgtgttgggctttgaac

SEQ ID NO: 38593 - DNA, 25 bp, Mus musculus
aactcgggacctctgaaagaagcag

SEQ ID NO: 38594 - DNA, 25 bp, Mus musculus
aactcgggacctgtgaaagaagcag

SEQ ID NO: 38595 - DNA, 25 bp, Mus musculus
aactcgggagcgcatagccagagcc

SEQ ID NO: 38596 - DNA, 25 bp, Mus musculus
aactcgggagcggatagccagagcc

SEQ ID NO: 38597 - DNA, 25 bp, Mus musculus
aactcgggtagacagagagaccaac

SEQ ID NO: 38598 - DNA, 25 bp, Mus musculus
aactcgggtagagagagagaccaac

SEQ ID NO: 38599 - DNA, 25 bp, Mus musculus
aactcgggtgccaccggaaacaatg

SEQ ID NO: 38600 - DNA, 25 bp, Mus musculus
aactcgggtgcctccggaaacaatg

SEQ ID NO: 38601 - DNA, 25 bp, Mus musculus
aactcgggtggaatcgtggcgcact

SEQ ID NO: 38602 - DNA, 25 bp, Mus musculus
aactcgggtggattcgtggcgcact

SEQ ID NO: 38603 - DNA, 25 bp, Mus musculus
aactcggtagtgaaatctttcagat

SEQ ID NO: 38604 - DNA, 25 bp, Mus musculus
aactcggtagtgtaatctttcagat

SEQ ID NO: 38605 - DNA, 25 bp, Mus musculus
aactcggtatttcatggtgtggcaa

SEQ ID NO: 38606 - DNA, 25 bp, Mus musculus
aactcggtatttgatggtgtggcaa

SEQ ID NO: 38607 - DNA, 25 bp, Mus musculus
aactcggtggagaaacctgtgtcct

SEQ ID NO: 38608 - DNA, 25 bp, Mus musculus
aactcggtggagtaacctgtgtcct

SEQ ID NO: 38609 - DNA, 25 bp, Mus musculus
aactcggtgttacggctctcgcacg

SEQ ID NO: 38610 - DNA, 25 bp, Mus musculus
aactcggtgttagggctctcgcacg

SEQ ID NO: 38611 - DNA, 25 bp, Mus musculus
aactcggtgttgcagatcctctacc

SEQ ID NO: 38612 - DNA, 25 bp, Mus musculus
aactcggtgttggagatcctctacc

SEQ ID NO: 38613 - DNA, 25 bp, Mus musculus
aactcggtgtttcgacgccggcacg

SEQ ID NO: 38614 - DNA, 25 bp, Mus musculus
aactcggtgtttggacgccggcacg

SEQ ID NO: 38615 - DNA, 25 bp, Mus musculus
aactcgtaattactactttaatgat

SEQ ID NO: 38616 - DNA, 25 bp, Mus musculus
aactcgtaattagtactttaatgat

SEQ ID NO: 38617 - DNA, 25 bp, Mus musculus
aactcgtagccgagtgtatgaacca

SEQ ID NO: 38618 - DNA, 25 bp, Mus musculus
aactcgtagccgtgtgtatgaacca

SEQ ID NO: 38619 - DNA, 25 bp, Mus musculus
aactcgtccgacacttctatgatgt

SEQ ID NO: 38620 - DNA, 25 bp, Mus musculus
aactcgtccgactcttctatgatgt

SEQ ID NO: 38621 - DNA, 25 bp, Mus musculus
aactcgtctcttctagggctaggat

SEQ ID NO: 38622 - DNA, 25 bp, Mus musculus
aactcgtctcttgtagggctaggat

SEQ ID NO: 38623 - DNA, 25 bp, Mus musculus
aactcgtctgtccagggcttcggtg

SEQ ID NO: 38624 - DNA, 25 bp, Mus musculus
aactcgtctgtcgagggcttcggtg

SEQ ID NO: 38625 - DNA, 25 bp, Mus musculus
aactcgtgccttagcataatgtacc

SEQ ID NO: 38626 - DNA, 25 bp, Mus musculus
aactcgtgcctttgcataatgtacc

SEQ ID NO: 38627 - DNA, 25 bp, Mus musculus
aactcgtgtcccatttgcccaggga

SEQ ID NO: 38628 - DNA, 25 bp, Mus musculus
aactcgtgtcccttttgcccaggga

SEQ ID NO: 38629 - DNA, 25 bp, Mus musculus
aactcgtgtgtgacactaggcagcc

SEQ ID NO: 38630 - DNA, 25 bp, Mus musculus
aactcgtgtgtgtcactaggcagcc

SEQ ID NO: 38631 - DNA, 25 bp, Mus musculus
aactctaaccgcagtgtctcgggcg

SEQ ID NO: 38632 - DNA, 25 bp, Mus musculus
aactctaaccgctgtgtctcgggcg

SEQ ID NO: 38633 - DNA, 25 bp, Mus musculus
aactctaacgtgcacggagacgcca

SEQ ID NO: 38634 - DNA, 25 bp, Mus musculus
aactctaacgtggacggagacgcca

SEQ ID NO: 38635 - DNA, 25 bp, Mus musculus
aactctaactgaattactgtgcaca

SEQ ID NO: 38636 - DNA, 25 bp, Mus musculus
aactctaactgatttactgtgcaca

SEQ ID NO: 38637 - DNA, 25 bp, Mus musculus
aactctaagagaccatcagaaaatt

SEQ ID NO: 38638 - DNA, 25 bp, Mus musculus
aactctaagagagcatcagaaaatt

SEQ ID NO: 38639 - DNA, 25 bp, Mus musculus
aactctaagggtcaaaaatgctcaa

SEQ ID NO: 38640 - DNA, 25 bp, Mus musculus
aactctaagggtgaaaaatgctcaa

SEQ ID NO: 38641 - DNA, 25 bp, Mus musculus
aactctaatatgctctgtgtgtgtg

SEQ ID NO: 38642 - DNA, 25 bp, Mus musculus
aactctaatatggtctgtgtgtgtg

SEQ ID NO: 38643 - DNA, 25 bp, Mus musculus
aactctaatgatatggccatgaggc

SEQ ID NO: 38644 - DNA, 25 bp, Mus musculus
aactctaatgatttggccatgaggc

SEQ ID NO: 38645 - DNA, 25 bp, Mus musculus
aactctaattagctcattcctaagg

SEQ ID NO: 38646 - DNA, 25 bp, Mus musculus
aactctaattaggtcattcctaagg

SEQ ID NO: 38647 - DNA, 25 bp, Mus musculus
aactctacacagagcaaagctcaga

SEQ ID NO: 38648 - DNA, 25 bp, Mus musculus
aactctacacagtgcaaagctcaga

SEQ ID NO: 38649 - DNA, 25 bp, Mus musculus
aactctacaccaagcggcgcggagg

SEQ ID NO: 38650 - DNA, 25 bp, Mus musculus
aactctacaccatgcggcgcggagg

SEQ ID NO: 38651 - DNA, 25 bp, Mus musculus
aactctacagcgatctttttaccag

SEQ ID NO: 38652 - DNA, 25 bp, Mus musculus
aactctacagcgttctttttaccag

SEQ ID NO: 38653 - DNA, 25 bp, Mus musculus
aactctacatctcatagaaggctaa

SEQ ID NO: 38654 - DNA, 25 bp, Mus musculus
aactctacatctgatagaaggctaa

SEQ ID NO: 38655 - DNA, 25 bp, Mus musculus
aactctacatgcaacctacttgtgg

SEQ ID NO: 38656 - DNA, 25 bp, Mus musculus
aactctacatgctacctacttgtgg

SEQ ID NO: 38657 - DNA, 25 bp, Mus musculus
aactctaccaaactggccaatctgg

SEQ ID NO: 38658 - DNA, 25 bp, Mus musculus
aactctaccaaagtggccaatctgg

SEQ ID NO: 38659 - DNA, 25 bp, Mus musculus
aactctaccgacattaggctggcaa

SEQ ID NO: 38660 - DNA, 25 bp, Mus musculus
aactctaccgactttaggctggcaa

SEQ ID NO: 38661 - DNA, 25 bp, Mus musculus
aactctaccggcctctgagtctatt

SEQ ID NO: 38662 - DNA, 25 bp, Mus musculus
aactctaccggcgtctgagtctatt

SEQ ID NO: 38663 - DNA, 25 bp, Mus musculus
aactctacgaagaccactacgatgt

SEQ ID NO: 38664 - DNA, 25 bp, Mus musculus
aactctacgaagtccactacgatgt

SEQ ID NO: 38665 - DNA, 25 bp, Mus musculus
aactctacttcacatcacagctgtg

SEQ ID NO: 38666 - DNA, 25 bp, Mus musculus
aactctacttcagatcacagctgtg

SEQ ID NO: 38667 - DNA, 25 bp, Mus musculus
aactctactttgctttaggcttaca

SEQ ID NO: 38668 - DNA, 25 bp, Mus musculus
aactctactttggtttaggcttaca

SEQ ID NO: 38669 - DNA, 25 bp, Mus musculus
aactctagactaatatcccatccat

SEQ ID NO: 38670 - DNA, 25 bp, Mus musculus
aactctagactattatcccatccat

SEQ ID NO: 38671 - DNA, 25 bp, Mus musculus
aactctagactgctggttttcagaa

SEQ ID NO: 38672 - DNA, 25 bp, Mus musculus
aactctagactggtggttttcagaa

SEQ ID NO: 38673 - DNA, 25 bp, Mus musculus
aactctagcacaaagtggcctcagg

SEQ ID NO: 38674 - DNA, 25 bp, Mus musculus
aactctagcacatagtggcctcagg

SEQ ID NO: 38675 - DNA, 25 bp, Mus musculus
aactctagctgtagtcttttctctt

SEQ ID NO: 38676 - DNA, 25 bp, Mus musculus
aactctagctgttgtcttttctctt

SEQ ID NO: 38677 - DNA, 25 bp, Mus musculus
aactctagcttgactttttggagca

SEQ ID NO: 38678 - DNA, 25 bp, Mus musculus
aactctagcttgtctttttggagca

SEQ ID NO: 38679 - DNA, 25 bp, Mus musculus
aactctagctttaactatttttgtg

SEQ ID NO: 38680 - DNA, 25 bp, Mus musculus
aactctagcttttactatttttgtg

SEQ ID NO: 38681 - DNA, 25 bp, Mus musculus
aactctaggcgcaaactgtagagag

SEQ ID NO: 38682 - DNA, 25 bp, Mus musculus
aactctaggcgctaactgtagagag

SEQ ID NO: 38683 - DNA, 25 bp, Mus musculus
aactctagggttatggtctgagaca

SEQ ID NO: 38684 - DNA, 25 bp, Mus musculus
aactctagggttttggtctgagaca

SEQ ID NO: 38685 - DNA, 25 bp, Mus musculus
aactctagtcccagggagcctggta

SEQ ID NO: 38686 - DNA, 25 bp, Mus musculus
aactctagtccctgggagcctggta

SEQ ID NO: 38687 - DNA, 25 bp, Mus musculus
aactctagtgctaaagtgacattac

SEQ ID NO: 38688 - DNA, 25 bp, Mus musculus
aactctagtgcttaagtgacattac

SEQ ID NO: 38689 - DNA, 25 bp, Mus musculus
aactctagtttcacctagcccagct

SEQ ID NO: 38690 - DNA, 25 bp, Mus musculus
aactctagtttctcctagcccagct

SEQ ID NO: 38691 - DNA, 25 bp, Mus musculus
aactctagttttctgtcccagtggt

SEQ ID NO: 38692 - DNA, 25 bp, Mus musculus
aactctagttttgtgtcccagtggt

SEQ ID NO: 38693 - DNA, 25 bp, Mus musculus
aactctatatgaagcttcctttccc

SEQ ID NO: 38694 - DNA, 25 bp, Mus musculus
aactctatatgatgcttcctttccc

SEQ ID NO: 38695 - DNA, 25 bp, Mus musculus
aactctatcacgaggaaggcaccgt

SEQ ID NO: 38696 - DNA, 25 bp, Mus musculus
aactctatcacgtggaaggcaccgt

SEQ ID NO: 38697 - DNA, 25 bp, Mus musculus
aactctatcagcaactcacttgggt

SEQ ID NO: 38698 - DNA, 25 bp, Mus musculus
aactctatcagctactcacttgggt

SEQ ID NO: 38699 - DNA, 25 bp, Mus musculus
aactctatccacacaaaaatctcac

SEQ ID NO: 38700 - DNA, 25 bp, Mus musculus
aactctatccactcaaaaatctcac

SEQ ID NO: 38701 - DNA, 25 bp, Mus musculus
aactctatgacaacgatgtggccaa

SEQ ID NO: 38702 - DNA, 25 bp, Mus musculus
aactctatgacatcgatgtggccaa

SEQ ID NO: 38703 - DNA, 25 bp, Mus musculus
aactctatggaactggaggccctcc

SEQ ID NO: 38704 - DNA, 25 bp, Mus musculus
aactctatggaagtggaggccctcc

SEQ ID NO: 38705 - DNA, 25 bp, Mus musculus
aactctatggagctcaccgctggga

SEQ ID NO: 38706 - DNA, 25 bp, Mus musculus
aactctatggaggtcaccgctggga

SEQ ID NO: 38707 - DNA, 25 bp, Mus musculus
aactctatggctcccgcacatgcat

SEQ ID NO: 38708 - DNA, 25 bp, Mus musculus
aactctatggctgccgcacatgcat

SEQ ID NO: 38709 - DNA, 25 bp, Mus musculus
aactctatgggaacctcagtgctgc

SEQ ID NO: 38710 - DNA, 25 bp, Mus musculus
aactctatgggatcctcagtgctgc

SEQ ID NO: 38711 - DNA, 25 bp, Mus musculus
aactctatgtagaacctgcaagtca

SEQ ID NO: 38712 - DNA, 25 bp, Mus musculus
aactctatgtagtacctgcaagtca

SEQ ID NO: 38713 - DNA, 25 bp, Mus musculus
aactctattacactggtccgttcaa

SEQ ID NO: 38714 - DNA, 25 bp, Mus musculus
aactctattacagtggtccgttcaa

SEQ ID NO: 38715 - DNA, 25 bp, Mus musculus
aactctattactatatgtgttgcaa

SEQ ID NO: 38716 - DNA, 25 bp, Mus musculus
aactctattactttatgtgttgcaa

SEQ ID NO: 38717 - DNA, 25 bp, Mus musculus
aactctattccaagaaaccctaggg

SEQ ID NO: 38718 - DNA, 25 bp, Mus musculus
aactctattccatgaaaccctaggg

SEQ ID NO: 38719 - DNA, 25 bp, Mus musculus
aactctattgccaaagggatgcttt

SEQ ID NO: 38720 - DNA, 25 bp, Mus musculus
aactctattgcctaagggatgcttt

SEQ ID NO: 38721 - DNA, 25 bp, Mus musculus
aactctatttgaactactgtccctc

SEQ ID NO: 38722 - DNA, 25 bp, Mus musculus
aactctatttgatctactgtccctc

SEQ ID NO: 38723 - DNA, 25 bp, Mus musculus
aactctcaaagtattatcctggttg

SEQ ID NO: 38724 - DNA, 25 bp, Mus musculus
aactctcaaagttttatcctggttg

SEQ ID NO: 38725 - DNA, 25 bp, Mus musculus
aactctcaacaaatgactccataca

SEQ ID NO: 38726 - DNA, 25 bp, Mus musculus
aactctcaacaattgactccataca

SEQ ID NO: 38727 - DNA, 25 bp, Mus musculus
aactctcacaagcttctctaaggcc

SEQ ID NO: 38728 - DNA, 25 bp, Mus musculus
aactctcacaaggttctctaaggcc

SEQ ID NO: 38729 - DNA, 25 bp, Mus musculus
aactctcaccttagtggttcttgga

SEQ ID NO: 38730 - DNA, 25 bp, Mus musculus
aactctcacctttgtggttcttgga

SEQ ID NO: 38731 - DNA, 25 bp, Mus musculus
aactctcacggcctgatgattgtcc

SEQ ID NO: 38732 - DNA, 25 bp, Mus musculus
aactctcacggcgtgatgattgtcc

SEQ ID NO: 38733 - DNA, 25 bp, Mus musculus
aactctcacttcatccagagcgagg

SEQ ID NO: 38734 - DNA, 25 bp, Mus musculus
aactctcacttcttccagagcgagg

SEQ ID NO: 38735 - DNA, 25 bp, Mus musculus
aactctcactttacaagggaacttg

SEQ ID NO: 38736 - DNA, 25 bp, Mus musculus
aactctcacttttcaagggaacttg

SEQ ID NO: 38737 - DNA, 25 bp, Mus musculus
aactctcagacgcatcgcaagaatt

SEQ ID NO: 38738 - DNA, 25 bp, Mus musculus
aactctcagacggatcgcaagaatt

SEQ ID NO: 38739 - DNA, 25 bp, Mus musculus
aactctcagactattcgaacacgtg

SEQ ID NO: 38740 - DNA, 25 bp, Mus musculus
aactctcagacttttcgaacacgtg

SEQ ID NO: 38741 - DNA, 25 bp, Mus musculus
aactctcagatgctgcatcttcgga

SEQ ID NO: 38742 - DNA, 25 bp, Mus musculus
aactctcagatggtgcatcttcgga

SEQ ID NO: 38743 - DNA, 25 bp, Mus musculus
aactctcagccgcatgcagggccag

SEQ ID NO: 38744 - DNA, 25 bp, Mus musculus
aactctcagccggatgcagggccag

SEQ ID NO: 38745 - DNA, 25 bp, Mus musculus
aactctcagctacctatctatctag

SEQ ID NO: 38746 - DNA, 25 bp, Mus musculus
aactctcagctagctatctatctag

SEQ ID NO: 38747 - DNA, 25 bp, Mus musculus
aactctcagggcaaacatggtgtag

SEQ ID NO: 38748 - DNA, 25 bp, Mus musculus
aactctcagggcaacatgagcgcgt

SEQ ID NO: 38749 - DNA, 25 bp, Mus musculus
aactctcagggctaacatggtgtag

SEQ ID NO: 38750 - DNA, 25 bp, Mus musculus
aactctcagggctacatgagcgcgt

SEQ ID NO: 38751 - DNA, 25 bp, Mus musculus
aactctcaggtgaagatggtggtac

SEQ ID NO: 38752 - DNA, 25 bp, Mus musculus
aactctcaggtgtagatggtggtac

SEQ ID NO: 38753 - DNA, 25 bp, Mus musculus
aactctcagtgccatgtgatttagc

SEQ ID NO: 38754 - DNA, 25 bp, Mus musculus
aactctcagtgcgatgtgatttagc

SEQ ID NO: 38755 - DNA, 25 bp, Mus musculus
aactctcatgtcagactatcaagcc

SEQ ID NO: 38756 - DNA, 25 bp, Mus musculus
aactctcatgtctgactatcaagcc

SEQ ID NO: 38757 - DNA, 25 bp, Mus musculus
aactctccaacacaagtcacatctt

SEQ ID NO: 38758 - DNA, 25 bp, Mus musculus
aactctccaacagaagtcacatctt

SEQ ID NO: 38759 - DNA, 25 bp, Mus musculus
aactctccacttacatgcctgttga

SEQ ID NO: 38760 - DNA, 25 bp, Mus musculus
aactctccactttcatgcctgttga

SEQ ID NO: 38761 - DNA, 25 bp, Mus musculus
aactctccctggagcaccgagattc

SEQ ID NO: 38762 - DNA, 25 bp, Mus musculus
aactctccctggtgcaccgagattc

SEQ ID NO: 38763 - DNA, 25 bp, Mus musculus
aactctcctcaaaacgtggtactga

SEQ ID NO: 38764 - DNA, 25 bp, Mus musculus
aactctcctcaatacgtggtactga

SEQ ID NO: 38765 - DNA, 25 bp, Mus musculus
aactctcctcggcttgatacaacta

SEQ ID NO: 38766 - DNA, 25 bp, Mus musculus
aactctcctcgggttgatacaacta

SEQ ID NO: 38767 - DNA, 25 bp, Mus musculus
aactctcctctcacagtgatggcag

SEQ ID NO: 38768 - DNA, 25 bp, Mus musculus
aactctcctctcacattttccctta

SEQ ID NO: 38769 - DNA, 25 bp, Mus musculus
aactctcctctctcagtgatggcag

SEQ ID NO: 38770 - DNA, 25 bp, Mus musculus
aactctcctctctcattttccctta

SEQ ID NO: 38771 - DNA, 25 bp, Mus musculus
aactctcctggaacggaaaccaagt

SEQ ID NO: 38772 - DNA, 25 bp, Mus musculus
aactctcctggatcggaaaccaagt

SEQ ID NO: 38773 - DNA, 25 bp, Mus musculus
aactctcctggcatctgagacttta

SEQ ID NO: 38774 - DNA, 25 bp, Mus musculus
aactctcctggcttctgagacttta

SEQ ID NO: 38775 - DNA, 25 bp, Mus musculus
aactctcctggtcataaacagccgg

SEQ ID NO: 38776 - DNA, 25 bp, Mus musculus
aactctcctggtgataaacagccgg

SEQ ID NO: 38777 - DNA, 25 bp, Mus musculus
aactctcctgtgctaatctcagagg

SEQ ID NO: 38778 - DNA, 25 bp, Mus musculus
aactctcctgtggtaatctcagagg

SEQ ID NO: 38779 - DNA, 25 bp, Mus musculus
aactctcctttgaaactgagccttc

SEQ ID NO: 38780 - DNA, 25 bp, Mus musculus
aactctcctttgattgctgtaactt

SEQ ID NO: 38781 - DNA, 25 bp, Mus musculus
aactctcctttgtaactgagccttc

SEQ ID NO: 38782 - DNA, 25 bp, Mus musculus
aactctcctttgtttgctgtaactt

SEQ ID NO: 38783 - DNA, 25 bp, Mus musculus
aactctcggcgaaattctcaaagga

SEQ ID NO: 38784 - DNA, 25 bp, Mus musculus
aactctcggcgatattctcaaagga

SEQ ID NO: 38785 - DNA, 25 bp, Mus musculus
aactctctactcatactgcgcagta

SEQ ID NO: 38786 - DNA, 25 bp, Mus musculus
aactctctactcttactgcgcagta

SEQ ID NO: 38787 - DNA, 25 bp, Mus musculus
aactctctagcaacattgccacagg

SEQ ID NO: 38788 - DNA, 25 bp, Mus musculus
aactctctagcatcattgccacagg

SEQ ID NO: 38789 - DNA, 25 bp, Mus musculus
aactctctagctcttttcaaagcag

SEQ ID NO: 38790 - DNA, 25 bp, Mus musculus
aactctctagctgttttcaaagcag

SEQ ID NO: 38791 - DNA, 25 bp, Mus musculus
aactctctagttctctcttaatgga

SEQ ID NO: 38792 - DNA, 25 bp, Mus musculus
aactctctagttgtctcttaatgga

SEQ ID NO: 38793 - DNA, 25 bp, Mus musculus
aactctctcatcactaggacaaagc

SEQ ID NO: 38794 - DNA, 25 bp, Mus musculus
aactctctcatctctaggacaaagc

SEQ ID NO: 38795 - DNA, 25 bp, Mus musculus
aactctctccacaacatctaaaatt

SEQ ID NO: 38796 - DNA, 25 bp, Mus musculus
aactctctccactacatctaaaatt

SEQ ID NO: 38797 - DNA, 25 bp, Mus musculus
aactctctccagctctgaggaggtc

SEQ ID NO: 38798 - DNA, 25 bp, Mus musculus
aactctctccaggtctgaggaggtc

SEQ ID NO: 38799 - DNA, 25 bp, Mus musculus
aactctctcctgcaaagtctgtgct

SEQ ID NO: 38800 - DNA, 25 bp, Mus musculus
aactctctcctggaaagtctgtgct

SEQ ID NO: 38801 - DNA, 25 bp, Mus musculus
aactctctctagcaaaaatgcccaa

SEQ ID NO: 38802 - DNA, 25 bp, Mus musculus
aactctctctaggaaaaatgcccaa

SEQ ID NO: 38803 - DNA, 25 bp, Mus musculus
aactctctctatccactgcagtaag

SEQ ID NO: 38804 - DNA, 25 bp, Mus musculus
aactctctctatgcactgcagtaag

SEQ ID NO: 38805 - DNA, 25 bp, Mus musculus
aactctctctttcgctttttagcgc

SEQ ID NO: 38806 - DNA, 25 bp, Mus musculus
aactctctctttggctttttagcgc

SEQ ID NO: 38807 - DNA, 25 bp, Mus musculus
aactctctgactcattgttctctta

SEQ ID NO: 38808 - DNA, 25 bp, Mus musculus
aactctctgactgattgttctctta

SEQ ID NO: 38809 - DNA, 25 bp, Mus musculus
aactctctgcggagacgtgctggag

SEQ ID NO: 38810 - DNA, 25 bp, Mus musculus
aactctctgcggtgacgtgctggag

SEQ ID NO: 38811 - DNA, 25 bp, Mus musculus
aactctctggtactagtttctccga

SEQ ID NO: 38812 - DNA, 25 bp, Mus musculus
aactctctggtagtagtttctccga

SEQ ID NO: 38813 - DNA, 25 bp, Mus musculus
aactctctggtcaagttgacgggct

SEQ ID NO: 38814 - DNA, 25 bp, Mus musculus
aactctctggtctagttgacgggct

SEQ ID NO: 38815 - DNA, 25 bp, Mus musculus
aactctctgtacctctaagtctgtg

SEQ ID NO: 38816 - DNA, 25 bp, Mus musculus
aactctctgtacgtctaagtctgtg

SEQ ID NO: 38817 - DNA, 25 bp, Mus musculus
aactctcttaatattcttaggatca

SEQ ID NO: 38818 - DNA, 25 bp, Mus musculus
aactctcttaattttcttaggatca

SEQ ID NO: 38819 - DNA, 25 bp, Mus musculus
aactctcttatcaacgcagttcttg

SEQ ID NO: 38820 - DNA, 25 bp, Mus musculus
aactctcttatctacgcagttcttg

SEQ ID NO: 38821 - DNA, 25 bp, Mus musculus
aactctcttctcaagatttctcgtg

SEQ ID NO: 38822 - DNA, 25 bp, Mus musculus
aactctcttctctagatttctcgtg

SEQ ID NO: 38823 - DNA, 25 bp, Mus musculus
aactctctttcaaggtccctgcagg

SEQ ID NO: 38824 - DNA, 25 bp, Mus musculus
aactctctttcatggtccctgcagg

SEQ ID NO: 38825 - DNA, 25 bp, Mus musculus
aactctctttgcaggaaaaactcct

SEQ ID NO: 38826 - DNA, 25 bp, Mus musculus
aactctctttgctggaaaaactcct

SEQ ID NO: 38827 - DNA, 25 bp, Mus musculus
aactctcttttcactatttggacca

SEQ ID NO: 38828 - DNA, 25 bp, Mus musculus
aactctcttttctctatttggacca

SEQ ID NO: 38829 - DNA, 25 bp, Mus musculus
aactctgaaaccagtgactgtatct

SEQ ID NO: 38830 - DNA, 25 bp, Mus musculus
aactctgaaacctgtgactgtatct

SEQ ID NO: 38831 - DNA, 25 bp, Mus musculus
aactctgaaatccaagctgccctac

SEQ ID NO: 38832 - DNA, 25 bp, Mus musculus
aactctgaaatcgaagctgccctac

SEQ ID NO: 38833 - DNA, 25 bp, Mus musculus
aactctgaacgtctgaagtcttaga

SEQ ID NO: 38834 - DNA, 25 bp, Mus musculus
aactctgaacgtgtgaagtcttaga

SEQ ID NO: 38835 - DNA, 25 bp, Mus musculus
aactctgaacttaaggaatctgcat

SEQ ID NO: 38836 - DNA, 25 bp, Mus musculus
aactctgaacttcgagattttgcta

SEQ ID NO: 38837 - DNA, 25 bp, Mus musculus
aactctgaacttggagattttgcta

SEQ ID NO: 38838 - DNA, 25 bp, Mus musculus
aactctgaactttaggaatctgcat

SEQ ID NO: 38839 - DNA, 25 bp, Mus musculus
aactctgaagtaattctgagcgtca

SEQ ID NO: 38840 - DNA, 25 bp, Mus musculus
aactctgaagtatttctgagcgtca

SEQ ID NO: 38841 - DNA, 25 bp, Mus musculus
aactctgaatccaagaggtggcaaa

SEQ ID NO: 38842 - DNA, 25 bp, Mus musculus
aactctgaatcctagaggtggcaaa

SEQ ID NO: 38843 - DNA, 25 bp, Mus musculus
aactctgacccactaacttccaagt

SEQ ID NO: 38844 - DNA, 25 bp, Mus musculus
aactctgacccagtaacttccaagt

SEQ ID NO: 38845 - DNA, 25 bp, Mus musculus
aactctgactgtactctttggaatt

SEQ ID NO: 38846 - DNA, 25 bp, Mus musculus
aactctgactgttctctttggaatt

SEQ ID NO: 38847 - DNA, 25 bp, Mus musculus
aactctgacttccttacctctcaga

SEQ ID NO: 38848 - DNA, 25 bp, Mus musculus
aactctgacttcgttacctctcaga

SEQ ID NO: 38849 - DNA, 25 bp, Mus musculus
aactctgagaagacttcccaggcct

SEQ ID NO: 38850 - DNA, 25 bp, Mus musculus
aactctgagaagtcttcccaggcct

SEQ ID NO: 38851 - DNA, 25 bp, Mus musculus
aactctgagagcaggagtcttcctc

SEQ ID NO: 38852 - DNA, 25 bp, Mus musculus
aactctgagagctggagtcttcctc

SEQ ID NO: 38853 - DNA, 25 bp, Mus musculus
aactctgagatcaccaagcgcttgg

SEQ ID NO: 38854 - DNA, 25 bp, Mus musculus
aactctgagatctccaagcgcttgg

SEQ ID NO: 38855 - DNA, 25 bp, Mus musculus
aactctgagccgattccttttgtga

SEQ ID NO: 38856 - DNA, 25 bp, Mus musculus
aactctgagccgtttccttttgtga

SEQ ID NO: 38857 - DNA, 25 bp, Mus musculus
aactctgagctacggcatttgcctg

SEQ ID NO: 38858 - DNA, 25 bp, Mus musculus
aactctgagctagggcatttgcctg

SEQ ID NO: 38859 - DNA, 25 bp, Mus musculus
aactctgaggatacacagcagctgg

SEQ ID NO: 38860 - DNA, 25 bp, Mus musculus
aactctgaggattcacagcagctgg

SEQ ID NO: 38861 - DNA, 25 bp, Mus musculus
aactctgaggtaaccctgtagctgt

SEQ ID NO: 38862 - DNA, 25 bp, Mus musculus
aactctgaggtatccctgtagctgt

SEQ ID NO: 38863 - DNA, 25 bp, Mus musculus
aactctgatacacttcttcagtaca

SEQ ID NO: 38864 - DNA, 25 bp, Mus musculus
aactctgatacagttcttcagtaca

SEQ ID NO: 38865 - DNA, 25 bp, Mus musculus
aactctgatcgtaattaagtgcact

SEQ ID NO: 38866 - DNA, 25 bp, Mus musculus
aactctgatcgttattaagtgcact

SEQ ID NO: 38867 - DNA, 25 bp, Mus musculus
aactctgatgacaaaagccaagtgc

SEQ ID NO: 38868 - DNA, 25 bp, Mus musculus
aactctgatgactaaagccaagtgc

SEQ ID NO: 38869 - DNA, 25 bp, Mus musculus
aactctgattaaccccaatatttgt

SEQ ID NO: 38870 - DNA, 25 bp, Mus musculus
aactctgattaagcccaatatttgt

SEQ ID NO: 38871 - DNA, 25 bp, Mus musculus
aactctgattccagattgagacatc

SEQ ID NO: 38872 - DNA, 25 bp, Mus musculus
aactctgattcctgattgagacatc

SEQ ID NO: 38873 - DNA, 25 bp, Mus musculus
aactctgattttaaccagctctagg

SEQ ID NO: 38874 - DNA, 25 bp, Mus musculus
aactctgatttttaccagctctagg

SEQ ID NO: 38875 - DNA, 25 bp, Mus musculus
aactctgcaagaccgccgtgaaggt

SEQ ID NO: 38876 - DNA, 25 bp, Mus musculus
aactctgcaagagcgccgtgaaggt

SEQ ID NO: 38877 - DNA, 25 bp, Mus musculus
aactctgcaatccacttgatggaag

SEQ ID NO: 38878 - DNA, 25 bp, Mus musculus
aactctgcaatcgacttgatggaag

SEQ ID NO: 38879 - DNA, 25 bp, Mus musculus
aactctgcacttacaagctctgcgt

SEQ ID NO: 38880 - DNA, 25 bp, Mus musculus
aactctgcactttcaagctctgcgt

SEQ ID NO: 38881 - DNA, 25 bp, Mus musculus
aactctgcagggatgtgccacagtt

SEQ ID NO: 38882 - DNA, 25 bp, Mus musculus
aactctgcagggttgtgccacagtt

SEQ ID NO: 38883 - DNA, 25 bp, Mus musculus
aactctgcagttctcacaacaacat

SEQ ID NO: 38884 - DNA, 25 bp, Mus musculus
aactctgcagttgtcacaacaacat

SEQ ID NO: 38885 - DNA, 25 bp, Mus musculus
aactctgcatcaccttcaacaagga

SEQ ID NO: 38886 - DNA, 25 bp, Mus musculus
aactctgcatcagcttcaacaagga

SEQ ID NO: 38887 - DNA, 25 bp, Mus musculus
aactctgcatggcttctcagaactt

SEQ ID NO: 38888 - DNA, 25 bp, Mus musculus
aactctgcatgggttctcagaactt

SEQ ID NO: 38889 - DNA, 25 bp, Mus musculus
aactctgcccagaggaaagcatgtg

SEQ ID NO: 38890 - DNA, 25 bp, Mus musculus
aactctgcccagcttggcttggtga

SEQ ID NO: 38891 - DNA, 25 bp, Mus musculus
aactctgcccaggttggcttggtga

SEQ ID NO: 38892 - DNA, 25 bp, Mus musculus
aactctgcccagtggaaagcatgtg

SEQ ID NO: 38893 - DNA, 25 bp, Mus musculus
aactctgccgccacaaaataaagta

SEQ ID NO: 38894 - DNA, 25 bp, Mus musculus
aactctgccgcctcaaaataaagta

SEQ ID NO: 38895 - DNA, 25 bp, Mus musculus
aactctgctaaaagtaggcaggcct

SEQ ID NO: 38896 - DNA, 25 bp, Mus musculus
aactctgctaaatgtaggcaggcct

SEQ ID NO: 38897 - DNA, 25 bp, Mus musculus
aactctgctcctaacgtttgaagtg

SEQ ID NO: 38898 - DNA, 25 bp, Mus musculus
aactctgctccttacgtttgaagtg

SEQ ID NO: 38899 - DNA, 25 bp, Mus musculus
aactctgctgaactgttgctgaaaa

SEQ ID NO: 38900 - DNA, 25 bp, Mus musculus
aactctgctgaagtgttgctgaaaa

SEQ ID NO: 38901 - DNA, 25 bp, Mus musculus
aactctgctgctaccttggttgtgt

SEQ ID NO: 38902 - DNA, 25 bp, Mus musculus
aactctgctgcttccttggttgtgt

SEQ ID NO: 38903 - DNA, 25 bp, Mus musculus
aactctgcttgtcacaggttcaggc

SEQ ID NO: 38904 - DNA, 25 bp, Mus musculus
aactctgcttgtgacaggttcaggc

SEQ ID NO: 38905 - DNA, 25 bp, Mus musculus
aactctgcttttagttaggccattg

SEQ ID NO: 38906 - DNA, 25 bp, Mus musculus
aactctgctttttgttaggccattg

SEQ ID NO: 38907 - DNA, 25 bp, Mus musculus
aactctggaaggaattggtgcctgt

SEQ ID NO: 38908 - DNA, 25 bp, Mus musculus
aactctggaaggtattggtgcctgt

SEQ ID NO: 38909 - DNA, 25 bp, Mus musculus
aactctggacggctaccaagcatag

SEQ ID NO: 38910 - DNA, 25 bp, Mus musculus
aactctggacgggtaccaagcatag

SEQ ID NO: 38911 - DNA, 25 bp, Mus musculus
aactctggagctagcatggacttca

SEQ ID NO: 38912 - DNA, 25 bp, Mus musculus
aactctggagctattgccagcctgt

SEQ ID NO: 38913 - DNA, 25 bp, Mus musculus
aactctggagcttgcatggacttca

SEQ ID NO: 38914 - DNA, 25 bp, Mus musculus
aactctggagcttttgccagcctgt

SEQ ID NO: 38915 - DNA, 25 bp, Mus musculus
aactctggaggcaccatcgccttca

SEQ ID NO: 38916 - DNA, 25 bp, Mus musculus
aactctggaggctccatcgccttca

SEQ ID NO: 38917 - DNA, 25 bp, Mus musculus
aactctggagtgacttcaaagatca

SEQ ID NO: 38918 - DNA, 25 bp, Mus musculus
aactctggagtgtcttcaaagatca

SEQ ID NO: 38919 - DNA, 25 bp, Mus musculus
aactctggagttacagaaccactgg

SEQ ID NO: 38920 - DNA, 25 bp, Mus musculus
aactctggagtttcagaaccactgg

SEQ ID NO: 38921 - DNA, 25 bp, Mus musculus
aactctggattgaatctggtggcat

SEQ ID NO: 38922 - DNA, 25 bp, Mus musculus
aactctggattgtatctggtggcat

SEQ ID NO: 38923 - DNA, 25 bp, Mus musculus
aactctggcagtattgggagcgatc

SEQ ID NO: 38924 - DNA, 25 bp, Mus musculus
aactctggcagttttgggagcgatc

SEQ ID NO: 38925 - DNA, 25 bp, Mus musculus
aactctggccaacatcttggagctg

SEQ ID NO: 38926 - DNA, 25 bp, Mus musculus
aactctggccaagatcttggagctg

SEQ ID NO: 38927 - DNA, 25 bp, Mus musculus
aactctggcctcattcaagggcccg

SEQ ID NO: 38928 - DNA, 25 bp, Mus musculus
aactctggcctctttcaagggcccg

SEQ ID NO: 38929 - DNA, 25 bp, Mus musculus
aactctggcgcgcaggctcttgaat

SEQ ID NO: 38930 - DNA, 25 bp, Mus musculus
aactctggcgcggaggctcttgaat

SEQ ID NO: 38931 - DNA, 25 bp, Mus musculus
aactctggctgtccttaattatgac

SEQ ID NO: 38932 - DNA, 25 bp, Mus musculus
aactctggctgtgcttaattatgac

SEQ ID NO: 38933 - DNA, 25 bp, Mus musculus
aactctggctttcccgcatgggtag

SEQ ID NO: 38934 - DNA, 25 bp, Mus musculus
aactctggctttcctcctaggagat

SEQ ID NO: 38935 - DNA, 25 bp, Mus musculus
aactctggctttgccgcatgggtag

SEQ ID NO: 38936 - DNA, 25 bp, Mus musculus
aactctggctttgctcctaggagat

SEQ ID NO: 38937 - DNA, 25 bp, Mus musculus
aactctgggataagcctagctgcca

SEQ ID NO: 38938 - DNA, 25 bp, Mus musculus
aactctgggatatgcctagctgcca

SEQ ID NO: 38939 - DNA, 25 bp, Mus musculus
aactctgggctgcttcaagtttcct

SEQ ID NO: 38940 - DNA, 25 bp, Mus musculus
aactctgggctggttcaagtttcct

SEQ ID NO: 38941 - DNA, 25 bp, Mus musculus
aactctggtatcctgtggtctgaag

SEQ ID NO: 38942 - DNA, 25 bp, Mus musculus
aactctggtatcgtgtggtctgaag

SEQ ID NO: 38943 - DNA, 25 bp, Mus musculus
aactctggtattaactgcattagtc

SEQ ID NO: 38944 - DNA, 25 bp, Mus musculus
aactctggtatttactgcattagtc

SEQ ID NO: 38945 - DNA, 25 bp, Mus musculus
aactctggtcttctgggaatgcagc

SEQ ID NO: 38946 - DNA, 25 bp, Mus musculus
aactctggtcttgtgggaatgcagc

SEQ ID NO: 38947 - DNA, 25 bp, Mus musculus
aactctggtgctacatgccatgaac

SEQ ID NO: 38948 - DNA, 25 bp, Mus musculus
aactctggtgcttcatgccatgaac

SEQ ID NO: 38949 - DNA, 25 bp, Mus musculus
aactctgtacagaaggtaccggcct

SEQ ID NO: 38950 - DNA, 25 bp, Mus musculus
aactctgtacagtaggtaccggcct

SEQ ID NO: 38951 - DNA, 25 bp, Mus musculus
aactctgtagctatcctgctatgaa

SEQ ID NO: 38952 - DNA, 25 bp, Mus musculus
aactctgtagctttcctgctatgaa

SEQ ID NO: 38953 - DNA, 25 bp, Mus musculus
aactctgtagtccactagcaccgtg

SEQ ID NO: 38954 - DNA, 25 bp, Mus musculus
aactctgtagtcgactagcaccgtg

SEQ ID NO: 38955 - DNA, 25 bp, Mus musculus
aactctgtagttctcctgtgtcatg

SEQ ID NO: 38956 - DNA, 25 bp, Mus musculus
aactctgtagttgtcctgtgtcatg

SEQ ID NO: 38957 - DNA, 25 bp, Mus musculus
aactctgtatgaaagtgaggtacgg

SEQ ID NO: 38958 - DNA, 25 bp, Mus musculus
aactctgtatgatagtgaggtacgg

SEQ ID NO: 38959 - DNA, 25 bp, Mus musculus
aactctgtatgtctgctgtggtgca

SEQ ID NO: 38960 - DNA, 25 bp, Mus musculus
aactctgtatgtgtgctgtggtgca

SEQ ID NO: 38961 - DNA, 25 bp, Mus musculus
aactctgtattcaaaattcctgcac

SEQ ID NO: 38962 - DNA, 25 bp, Mus musculus
aactctgtattctaaattcctgcac

SEQ ID NO: 38963 - DNA, 25 bp, Mus musculus
aactctgtattgatcctaaagacgg

SEQ ID NO: 38964 - DNA, 25 bp, Mus musculus
aactctgtattgttcctaaagacgg

SEQ ID NO: 38965 - DNA, 25 bp, Mus musculus
aactctgtcagaagacatcgtggat

SEQ ID NO: 38966 - DNA, 25 bp, Mus musculus
aactctgtcagaattgtcgaagcaa

SEQ ID NO: 38967 - DNA, 25 bp, Mus musculus
aactctgtcagatgacatcgtggat

SEQ ID NO: 38968 - DNA, 25 bp, Mus musculus
aactctgtcagatttgtcgaagcaa

SEQ ID NO: 38969 - DNA, 25 bp, Mus musculus
aactctgtcatcagaagtctgggtt

SEQ ID NO: 38970 - DNA, 25 bp, Mus musculus
aactctgtcatctgaagtctgggtt

SEQ ID NO: 38971 - DNA, 25 bp, Mus musculus
aactctgtcattaatcgcttcaacg

SEQ ID NO: 38972 - DNA, 25 bp, Mus musculus
aactctgtcatttatcgcttcaacg

SEQ ID NO: 38973 - DNA, 25 bp, Mus musculus
aactctgtccggcactgatgtatag

SEQ ID NO: 38974 - DNA, 25 bp, Mus musculus
aactctgtccgggactgatgtatag

SEQ ID NO: 38975 - DNA, 25 bp, Mus musculus
aactctgtccttcctgtgatgatca

SEQ ID NO: 38976 - DNA, 25 bp, Mus musculus
aactctgtccttgctgtgatgatca

SEQ ID NO: 38977 - DNA, 25 bp, Mus musculus
aactctgtcggtcttgtctcccaga

SEQ ID NO: 38978 - DNA, 25 bp, Mus musculus
aactctgtcggtgttgtctcccaga

SEQ ID NO: 38979 - DNA, 25 bp, Mus musculus
aactctgtctaacttggaagggtct

SEQ ID NO: 38980 - DNA, 25 bp, Mus musculus
aactctgtctaagttggaagggtct

SEQ ID NO: 38981 - DNA, 25 bp, Mus musculus
aactctgtgctaacagatcttcatt

SEQ ID NO: 38982 - DNA, 25 bp, Mus musculus
aactctgtgctatcagatcttcatt

SEQ ID NO: 38983 - DNA, 25 bp, Mus musculus
aactctgtggacatggacatggaca

SEQ ID NO: 38984 - DNA, 25 bp, Mus musculus
aactctgtggacttggacatggaca

SEQ ID NO: 38985 - DNA, 25 bp, Mus musculus
aactctgtggatatgcctggtctag

SEQ ID NO: 38986 - DNA, 25 bp, Mus musculus
aactctgtggatttgcctggtctag

SEQ ID NO: 38987 - DNA, 25 bp, Mus musculus
aactctgtgggtattgtgctccgac

SEQ ID NO: 38988 - DNA, 25 bp, Mus musculus
aactctgtgggttttgtgctccgac

SEQ ID NO: 38989 - DNA, 25 bp, Mus musculus
aactctgtggtcaacgggcagcttt

SEQ ID NO: 38990 - DNA, 25 bp, Mus musculus
aactctgtggtctacgggcagcttt

SEQ ID NO: 38991 - DNA, 25 bp, Mus musculus
aactctgtgtgaccccgataacatt

SEQ ID NO: 38992 - DNA, 25 bp, Mus musculus
aactctgtgtgagcccgataacatt

SEQ ID NO: 38993 - DNA, 25 bp, Mus musculus
aactctgttagaaactcttgcgtgt

SEQ ID NO: 38994 - DNA, 25 bp, Mus musculus
aactctgttagatactcttgcgtgt

SEQ ID NO: 38995 - DNA, 25 bp, Mus musculus
aactctgttcctcacaagtctgtga

SEQ ID NO: 38996 - DNA, 25 bp, Mus musculus
aactctgttcctgacaagtctgtga

SEQ ID NO: 38997 - DNA, 25 bp, Mus musculus
aactctgttctaccatcctcaatgt

SEQ ID NO: 38998 - DNA, 25 bp, Mus musculus
aactctgttctagcatcctcaatgt

SEQ ID NO: 38999 - DNA, 25 bp, Mus musculus
aactctgtttaacttcccagcacac

SEQ ID NO: 39000 - DNA, 25 bp, Mus musculus
aactctgtttaagttcccagcacac

SEQ ID NO: 39001 - DNA, 25 bp, Mus musculus
aactctgtttgtcaaaggtctgtct

SEQ ID NO: 39002 - DNA, 25 bp, Mus musculus
aactctgtttgtgaaaggtctgtct

SEQ ID NO: 39003 - DNA, 25 bp, Mus musculus
aactctgttttcctgggacagacaa

SEQ ID NO: 39004 - DNA, 25 bp, Mus musculus
aactctgttttcgtgggacagacaa

SEQ ID NO: 39005 - DNA, 25 bp, Mus musculus
aactctgtttttacatagtgcctct

SEQ ID NO: 39006 - DNA, 25 bp, Mus musculus
aactctgtttttctccacaggatgg

SEQ ID NO: 39007 - DNA, 25 bp, Mus musculus
aactctgtttttgtccacaggatgg

SEQ ID NO: 39008 - DNA, 25 bp, Mus musculus
aactctgttttttcatagtgcctct

SEQ ID NO: 39009 - DNA, 25 bp, Mus musculus
aactcttaaaacatgcctactcctg

SEQ ID NO: 39010 - DNA, 25 bp, Mus musculus
aactcttaaaacttgcctactcctg

SEQ ID NO: 39011 - DNA, 25 bp, Mus musculus
aactcttaaccgatgaactctccag

SEQ ID NO: 39012 - DNA, 25 bp, Mus musculus
aactcttaaccgttgaactctccag

SEQ ID NO: 39013 - DNA, 25 bp, Mus musculus
aactcttacaccctgctgtgtgagc

SEQ ID NO: 39014 - DNA, 25 bp, Mus musculus
aactcttacaccgtgctgtgtgagc

SEQ ID NO: 39015 - DNA, 25 bp, Mus musculus
aactcttaccctatgtgtgcatcac

SEQ ID NO: 39016 - DNA, 25 bp, Mus musculus
aactcttaccctttgtgtgcatcac

SEQ ID NO: 39017 - DNA, 25 bp, Mus musculus
aactcttagactcttggttcaccag

SEQ ID NO: 39018 - DNA, 25 bp, Mus musculus
aactcttagactgttggttcaccag

SEQ ID NO: 39019 - DNA, 25 bp, Mus musculus
aactcttagagacatgaacctgcct

SEQ ID NO: 39020 - DNA, 25 bp, Mus musculus
aactcttagagagatgaacctgcct

SEQ ID NO: 39021 - DNA, 25 bp, Mus musculus
aactcttagctcatctagcaccaag

SEQ ID NO: 39022 - DNA, 25 bp, Mus musculus
aactcttagctcttctagcaccaag

SEQ ID NO: 39023 - DNA, 25 bp, Mus musculus
aactcttatagcagggacaggtccc

SEQ ID NO: 39024 - DNA, 25 bp, Mus musculus
aactcttatagctgggacaggtccc

SEQ ID NO: 39025 - DNA, 25 bp, Mus musculus
aactcttatgatatatcctcctaca

SEQ ID NO: 39026 - DNA, 25 bp, Mus musculus
aactcttatgatttatcctcctaca

SEQ ID NO: 39027 - DNA, 25 bp, Mus musculus
aactcttatgtcctgctttgtgcct

SEQ ID NO: 39028 - DNA, 25 bp, Mus musculus
aactcttatgtcgtgctttgtgcct

SEQ ID NO: 39029 - DNA, 25 bp, Mus musculus
aactcttcacagaggctctgacatg

SEQ ID NO: 39030 - DNA, 25 bp, Mus musculus
aactcttcacagtggctctgacatg

SEQ ID NO: 39031 - DNA, 25 bp, Mus musculus
aactcttcagagacctcaaacagtg

SEQ ID NO: 39032 - DNA, 25 bp, Mus musculus
aactcttcagagtcctcaaacagtg

SEQ ID NO: 39033 - DNA, 25 bp, Mus musculus
aactcttcatctctgtaatgctacc

SEQ ID NO: 39034 - DNA, 25 bp, Mus musculus
aactcttcatctgtgtaatgctacc

SEQ ID NO: 39035 - DNA, 25 bp, Mus musculus
aactcttcattcacaaagtttggga

SEQ ID NO: 39036 - DNA, 25 bp, Mus musculus
aactcttcattcacctaaggtgggc

SEQ ID NO: 39037 - DNA, 25 bp, Mus musculus
aactcttcattctcaaagtttggga

SEQ ID NO: 39038 - DNA, 25 bp, Mus musculus
aactcttcattctcctaaggtgggc

SEQ ID NO: 39039 - DNA, 25 bp, Mus musculus
aactcttccaaacatgctctcaggc

SEQ ID NO: 39040 - DNA, 25 bp, Mus musculus
aactcttccaaagatgctctcaggc

SEQ ID NO: 39041 - DNA, 25 bp, Mus musculus
aactcttccaggattcttggactcc

SEQ ID NO: 39042 - DNA, 25 bp, Mus musculus
aactcttccaggtttcttggactcc

SEQ ID NO: 39043 - DNA, 25 bp, Mus musculus
aactcttcctaaatatagctgcgaa

SEQ ID NO: 39044 - DNA, 25 bp, Mus musculus
aactcttcctaattatagctgcgaa

SEQ ID NO: 39045 - DNA, 25 bp, Mus musculus
aactcttccttcaataagttgactg

SEQ ID NO: 39046 - DNA, 25 bp, Mus musculus
aactcttccttctataagttgactg

SEQ ID NO: 39047 - DNA, 25 bp, Mus musculus
aactcttctataatacctcttaatt

SEQ ID NO: 39048 - DNA, 25 bp, Mus musculus
aactcttctatattacctcttaatt

SEQ ID NO: 39049 - DNA, 25 bp, Mus musculus
aactcttctcttattctatggtaat

SEQ ID NO: 39050 - DNA, 25 bp, Mus musculus
aactcttctctttttctatggtaat

SEQ ID NO: 39051 - DNA, 25 bp, Mus musculus
aactcttctggccaatttaccatta

SEQ ID NO: 39052 - DNA, 25 bp, Mus musculus
aactcttctggcgaatttaccatta

SEQ ID NO: 39053 - DNA, 25 bp, Mus musculus
aactcttgaagacgctggaccccag

SEQ ID NO: 39054 - DNA, 25 bp, Mus musculus
aactcttgaagaggctggaccccag

SEQ ID NO: 39055 - DNA, 25 bp, Mus musculus
aactcttgagcacttaagtaattga

SEQ ID NO: 39056 - DNA, 25 bp, Mus musculus
aactcttgagcagttaagtaattga

SEQ ID NO: 39057 - DNA, 25 bp, Mus musculus
aactcttgaggtagcacatgccgtt

SEQ ID NO: 39058 - DNA, 25 bp, Mus musculus
aactcttgaggttgcacatgccgtt

SEQ ID NO: 39059 - DNA, 25 bp, Mus musculus
aactcttgagttaaagcttaggcta

SEQ ID NO: 39060 - DNA, 25 bp, Mus musculus
aactcttgagttctgctttgatggg

SEQ ID NO: 39061 - DNA, 25 bp, Mus musculus
aactcttgagttgtgctttgatggg

SEQ ID NO: 39062 - DNA, 25 bp, Mus musculus
aactcttgagtttaagcttaggcta

SEQ ID NO: 39063 - DNA, 25 bp, Mus musculus
aactcttgatatacgttaccacgca

SEQ ID NO: 39064 - DNA, 25 bp, Mus musculus
aactcttgatattcgttaccacgca

SEQ ID NO: 39065 - DNA, 25 bp, Mus musculus
aactcttgccctaggtttacatatg

SEQ ID NO: 39066 - DNA, 25 bp, Mus musculus
aactcttgcccttggtttacatatg

SEQ ID NO: 39067 - DNA, 25 bp, Mus musculus
aactcttgcttcatgctgcttcagt

SEQ ID NO: 39068 - DNA, 25 bp, Mus musculus
aactcttgcttcttgctgcttcagt

SEQ ID NO: 39069 - DNA, 25 bp, Mus musculus
aactcttggaatagtcatctgatca

SEQ ID NO: 39070 - DNA, 25 bp, Mus musculus
aactcttggaattgtcatctgatca

SEQ ID NO: 39071 - DNA, 25 bp, Mus musculus
aactcttggattcatctgattactg

SEQ ID NO: 39072 - DNA, 25 bp, Mus musculus
aactcttggattgatctgattactg

SEQ ID NO: 39073 - DNA, 25 bp, Mus musculus
aactcttggctgcttactgtcacac

SEQ ID NO: 39074 - DNA, 25 bp, Mus musculus
aactcttggctggttactgtcacac

SEQ ID NO: 39075 - DNA, 25 bp, Mus musculus
aactcttgggacagtttcctgtggc

SEQ ID NO: 39076 - DNA, 25 bp, Mus musculus
aactcttgggactgtttcctgtggc

SEQ ID NO: 39077 - DNA, 25 bp, Mus musculus
aactcttggtccctgttggtgaagc

SEQ ID NO: 39078 - DNA, 25 bp, Mus musculus
aactcttggtccgtgttggtgaagc

SEQ ID NO: 39079 - DNA, 25 bp, Mus musculus
aactcttggtgtcttggatacccac

SEQ ID NO: 39080 - DNA, 25 bp, Mus musculus
aactcttggtgtgttggatacccac

SEQ ID NO: 39081 - DNA, 25 bp, Mus musculus
aactcttgtcctatgctaacagccg

SEQ ID NO: 39082 - DNA, 25 bp, Mus musculus
aactcttgtcctttgctaacagccg

SEQ ID NO: 39083 - DNA, 25 bp, Mus musculus
aactcttgttgacacattatggcaa

SEQ ID NO: 39084 - DNA, 25 bp, Mus musculus
aactcttgttgagacattatggcaa

SEQ ID NO: 39085 - DNA, 25 bp, Mus musculus
aactctttaaacattctcaggtcca

SEQ ID NO: 39086 - DNA, 25 bp, Mus musculus
aactctttaaactttctcaggtcca

SEQ ID NO: 39087 - DNA, 25 bp, Mus musculus
aactctttacctagcctgtatttat

SEQ ID NO: 39088 - DNA, 25 bp, Mus musculus
aactctttaccttgcctgtatttat

SEQ ID NO: 39089 - DNA, 25 bp, Mus musculus
aactctttagaaactgaccttcagc

SEQ ID NO: 39090 - DNA, 25 bp, Mus musculus
aactctttagaatctgaccttcagc

SEQ ID NO: 39091 - DNA, 25 bp, Mus musculus
aactctttagttcttttactgtgtg

SEQ ID NO: 39092 - DNA, 25 bp, Mus musculus
aactctttagttgttttactgtgtg

SEQ ID NO: 39093 - DNA, 25 bp, Mus musculus
aactctttatgtctcagcttacctg

SEQ ID NO: 39094 - DNA, 25 bp, Mus musculus
aactctttatgtgtcagcttacctg

SEQ ID NO: 39095 - DNA, 25 bp, Mus musculus
aactctttatttaccgatctcttga

SEQ ID NO: 39096 - DNA, 25 bp, Mus musculus
aactctttattttccgatctcttga

SEQ ID NO: 39097 - DNA, 25 bp, Mus musculus
aactctttcaacacaactgtgtcta

SEQ ID NO: 39098 - DNA, 25 bp, Mus musculus
aactctttcaactcaactgtgtcta

SEQ ID NO: 39099 - DNA, 25 bp, Mus musculus
aactctttccacacatgtacactag

SEQ ID NO: 39100 - DNA, 25 bp, Mus musculus
aactctttccactcatgtacactag

SEQ ID NO: 39101 - DNA, 25 bp, Mus musculus
aactctttcccaacaggacttcgag

SEQ ID NO: 39102 - DNA, 25 bp, Mus musculus
aactctttcccatcaggacttcgag

SEQ ID NO: 39103 - DNA, 25 bp, Mus musculus
aactctttctaacatcacctcgcgt

SEQ ID NO: 39104 - DNA, 25 bp, Mus musculus
aactctttctaagatcacctcgcgt

SEQ ID NO: 39105 - DNA, 25 bp, Mus musculus
aactctttctatacgtgaaacactg

SEQ ID NO: 39106 - DNA, 25 bp, Mus musculus
aactctttctattcgtgaaacactg

SEQ ID NO: 39107 - DNA, 25 bp, Mus musculus
aactctttctgtaagcagcaaggga

SEQ ID NO: 39108 - DNA, 25 bp, Mus musculus
aactctttctgttagcagcaaggga

SEQ ID NO: 39109 - DNA, 25 bp, Mus musculus
aactctttcttgacatctctggaga

SEQ ID NO: 39110 - DNA, 25 bp, Mus musculus
aactctttcttgtcatctctggaga

SEQ ID NO: 39111 - DNA, 25 bp, Mus musculus
aactctttgccccatgaagtgtcaa

SEQ ID NO: 39112 - DNA, 25 bp, Mus musculus
aactctttgcccgatgaagtgtcaa

SEQ ID NO: 39113 - DNA, 25 bp, Mus musculus
aactctttgggcatctcgtctggat

SEQ ID NO: 39114 - DNA, 25 bp, Mus musculus
aactctttgggcttctcgtctggat

SEQ ID NO: 39115 - DNA, 25 bp, Mus musculus
aactctttgtatcatgtgttggtac

SEQ ID NO: 39116 - DNA, 25 bp, Mus musculus
aactctttgtatgatgtgttggtac

SEQ ID NO: 39117 - DNA, 25 bp, Mus musculus
aactctttgttgagcccggtggaat

SEQ ID NO: 39118 - DNA, 25 bp, Mus musculus
aactctttgttgtgcccggtggaat

SEQ ID NO: 39119 - DNA, 25 bp, Mus musculus
aactcttttacactgttccagctga

SEQ ID NO: 39120 - DNA, 25 bp, Mus musculus
aactcttttacagtgttccagctga

SEQ ID NO: 39121 - DNA, 25 bp, Mus musculus
aactcttttcgaaacctggttgata

SEQ ID NO: 39122 - DNA, 25 bp, Mus musculus
aactcttttcgatacctggttgata

SEQ ID NO: 39123 - DNA, 25 bp, Mus musculus
aactcttttcggattcacttctggg

SEQ ID NO: 39124 - DNA, 25 bp, Mus musculus
aactcttttcggtttcacttctggg

SEQ ID NO: 39125 - DNA, 25 bp, Mus musculus
aactcttttgagagtttcatggaca

SEQ ID NO: 39126 - DNA, 25 bp, Mus musculus
aactcttttgagtgtttcatggaca

SEQ ID NO: 39127 - DNA, 25 bp, Mus musculus
aactcttttgtacagcacttggcta

SEQ ID NO: 39128 - DNA, 25 bp, Mus musculus
aactcttttgtagagcacttggcta

SEQ ID NO: 39129 - DNA, 25 bp, Mus musculus
aactctttttcactctaaaatgctg

SEQ ID NO: 39130 - DNA, 25 bp, Mus musculus
aactctttttcagtctaaaatgctg

SEQ ID NO: 39131 - DNA, 25 bp, Mus musculus
aactgaaaactaaaccatacttgat

SEQ ID NO: 39132 - DNA, 25 bp, Mus musculus
aactgaaaactataccatacttgat

SEQ ID NO: 39133 - DNA, 25 bp, Mus musculus
aactgaaaataaccgcagtgcctac

SEQ ID NO: 39134 - DNA, 25 bp, Mus musculus
aactgaaaataagcgcagtgcctac

SEQ ID NO: 39135 - DNA, 25 bp, Mus musculus
aactgaaaatcaatagactgctaag

SEQ ID NO: 39136 - DNA, 25 bp, Mus musculus
aactgaaaatcattagactgctaag

SEQ ID NO: 39137 - DNA, 25 bp, Mus musculus
aactgaaaccagctcctctgtacga

SEQ ID NO: 39138 - DNA, 25 bp, Mus musculus
aactgaaaccaggtcctctgtacga

SEQ ID NO: 39139 - DNA, 25 bp, Mus musculus
aactgaaacgccagcgagcggctgc

SEQ ID NO: 39140 - DNA, 25 bp, Mus musculus
aactgaaacgcctgcgagcggctgc

SEQ ID NO: 39141 - DNA, 25 bp, Mus musculus
aactgaaacgtcacaaggcacggcc

SEQ ID NO: 39142 - DNA, 25 bp, Mus musculus
aactgaaacgtctcaaggcacggcc

SEQ ID NO: 39143 - DNA, 25 bp, Mus musculus
aactgaaagcacagaaggcctccac

SEQ ID NO: 39144 - DNA, 25 bp, Mus musculus
aactgaaagcactgaaggcctccac

SEQ ID NO: 39145 - DNA, 25 bp, Mus musculus
aactgaaagtgcattcctccatccg

SEQ ID NO: 39146 - DNA, 25 bp, Mus musculus
aactgaaagtgctttcctccatccg

SEQ ID NO: 39147 - DNA, 25 bp, Mus musculus
aactgaaagttgcttgtcttccctg

SEQ ID NO: 39148 - DNA, 25 bp, Mus musculus
aactgaaagttggttgtcttccctg

SEQ ID NO: 39149 - DNA, 25 bp, Mus musculus
aactgaaatctacctcccgagaaat

SEQ ID NO: 39150 - DNA, 25 bp, Mus musculus
aactgaaatctagctcccgagaaat

SEQ ID NO: 39151 - DNA, 25 bp, Mus musculus
aactgaaatctcacttggccatggg

SEQ ID NO: 39152 - DNA, 25 bp, Mus musculus
aactgaaatctctcttggccatggg

SEQ ID NO: 39153 - DNA, 25 bp, Mus musculus
aactgaaatgtcacaacccgtcact

SEQ ID NO: 39154 - DNA, 25 bp, Mus musculus
aactgaaatgtctcaacccgtcact

SEQ ID NO: 39155 - DNA, 25 bp, Mus musculus
aactgaaattctaaagtgccctact

SEQ ID NO: 39156 - DNA, 25 bp, Mus musculus
aactgaaattcttaagtgccctact

SEQ ID NO: 39157 - DNA, 25 bp, Mus musculus
aactgaaatttccatgggcaatggt

SEQ ID NO: 39158 - DNA, 25 bp, Mus musculus
aactgaaatttcgatgggcaatggt

SEQ ID NO: 39159 - DNA, 25 bp, Mus musculus
aactgaacacccaggagcgtatgaa

SEQ ID NO: 39160 - DNA, 25 bp, Mus musculus
aactgaacaccctggagcgtatgaa

SEQ ID NO: 39161 - DNA, 25 bp, Mus musculus
aactgaacagccacgatttttaaga

SEQ ID NO: 39162 - DNA, 25 bp, Mus musculus
aactgaacagcctcgatttttaaga

SEQ ID NO: 39163 - DNA, 25 bp, Mus musculus
aactgaacatgtagctgtatcctaa

SEQ ID NO: 39164 - DNA, 25 bp, Mus musculus
aactgaacatgttgctgtatcctaa

SEQ ID NO: 39165 - DNA, 25 bp, Mus musculus
aactgaacctcacaccgtctcctct

SEQ ID NO: 39166 - DNA, 25 bp, Mus musculus
aactgaacctcagaccgtctcctct

SEQ ID NO: 39167 - DNA, 25 bp, Mus musculus
aactgaacgggtatggactgagcaa

SEQ ID NO: 39168 - DNA, 25 bp, Mus musculus
aactgaacgggtttggactgagcaa

SEQ ID NO: 39169 - DNA, 25 bp, Mus musculus
aactgaactcagcaagggtgatatt

SEQ ID NO: 39170 - DNA, 25 bp, Mus musculus
aactgaactcaggaagggtgatatt

SEQ ID NO: 39171 - DNA, 25 bp, Mus musculus
aactgaactcggagcacgtcgggtt

SEQ ID NO: 39172 - DNA, 25 bp, Mus musculus
aactgaactcggtgcacgtcgggtt

SEQ ID NO: 39173 - DNA, 25 bp, Mus musculus
aactgaactctaattgccacacaaa

SEQ ID NO: 39174 - DNA, 25 bp, Mus musculus
aactgaactctatttgccacacaaa

SEQ ID NO: 39175 - DNA, 25 bp, Mus musculus
aactgaacttcaatgctcctgataa

SEQ ID NO: 39176 - DNA, 25 bp, Mus musculus
aactgaacttcattgctcctgataa

SEQ ID NO: 39177 - DNA, 25 bp, Mus musculus
aactgaagaaacaccctccagatag

SEQ ID NO: 39178 - DNA, 25 bp, Mus musculus
aactgaagaaactccctccagatag

SEQ ID NO: 39179 - DNA, 25 bp, Mus musculus
aactgaagactgaggcagggtctaa

SEQ ID NO: 39180 - DNA, 25 bp, Mus musculus
aactgaagactgtggcagggtctaa

SEQ ID NO: 39181 - DNA, 25 bp, Mus musculus
aactgaagaggtcctttcccctgat

SEQ ID NO: 39182 - DNA, 25 bp, Mus musculus
aactgaagaggtgctttcccctgat

SEQ ID NO: 39183 - DNA, 25 bp, Mus musculus
aactgaagagtgcaccgcaaatgac

SEQ ID NO: 39184 - DNA, 25 bp, Mus musculus
aactgaagagtggaccgcaaatgac

SEQ ID NO: 39185 - DNA, 25 bp, Mus musculus
aactgaagagttcaccccgccagtc

SEQ ID NO: 39186 - DNA, 25 bp, Mus musculus
aactgaagagttgaccccgccagtc

SEQ ID NO: 39187 - DNA, 25 bp, Mus musculus
aactgaagattcctcctgactttcc

SEQ ID NO: 39188 - DNA, 25 bp, Mus musculus
aactgaagattcgtcctgactttcc

SEQ ID NO: 39189 - DNA, 25 bp, Mus musculus
aactgaagcagcattttgtgcctcc

SEQ ID NO: 39190 - DNA, 25 bp, Mus musculus
aactgaagcagctttttgtgcctcc

SEQ ID NO: 39191 - DNA, 25 bp, Mus musculus
aactgaaggcacaaaatctaaaatc

SEQ ID NO: 39192 - DNA, 25 bp, Mus musculus
aactgaaggcactaaatctaaaatc

SEQ ID NO: 39193 - DNA, 25 bp, Mus musculus
aactgaaggccaccatgggttccac

SEQ ID NO: 39194 - DNA, 25 bp, Mus musculus
aactgaaggccagcatgggttccac

SEQ ID NO: 39195 - DNA, 25 bp, Mus musculus
aactgaagggcgaggtgaaactgca

SEQ ID NO: 39196 - DNA, 25 bp, Mus musculus
aactgaagggcgtggtgaaactgca

SEQ ID NO: 39197 - DNA, 25 bp, Mus musculus
aactgaagtattacgacaagctaaa

SEQ ID NO: 39198 - DNA, 25 bp, Mus musculus
aactgaagtatttcgacaagctaaa

SEQ ID NO: 39199 - DNA, 25 bp, Mus musculus
aactgaagtcaaaccgtcttccaat

SEQ ID NO: 39200 - DNA, 25 bp, Mus musculus
aactgaagtcaatccgtcttccaat

SEQ ID NO: 39201 - DNA, 25 bp, Mus musculus
aactgaagtgtcctctttccaatag

SEQ ID NO: 39202 - DNA, 25 bp, Mus musculus
aactgaagtgtcgtctttccaatag

SEQ ID NO: 39203 - DNA, 25 bp, Mus musculus
aactgaataaggcatttagatccaa

SEQ ID NO: 39204 - DNA, 25 bp, Mus musculus
aactgaataagggatttagatccaa

SEQ ID NO: 39205 - DNA, 25 bp, Mus musculus
aactgaatacatctggccctacctc

SEQ ID NO: 39206 - DNA, 25 bp, Mus musculus
aactgaatacatgtggccctacctc

SEQ ID NO: 39207 - DNA, 25 bp, Mus musculus
aactgaatatacacagattttttaa

SEQ ID NO: 39208 - DNA, 25 bp, Mus musculus
aactgaatatactcagattttttaa

SEQ ID NO: 39209 - DNA, 25 bp, Mus musculus
aactgaatcagccttaacaattatt

SEQ ID NO: 39210 - DNA, 25 bp, Mus musculus
aactgaatcagcgttaacaattatt

SEQ ID NO: 39211 - DNA, 25 bp, Mus musculus
aactgaatctaaactgtgctttttt

SEQ ID NO: 39212 - DNA, 25 bp, Mus musculus
aactgaatctaatctgtgctttttt

SEQ ID NO: 39213 - DNA, 25 bp, Mus musculus
aactgaatcttaaatcaatcactgg

SEQ ID NO: 39214 - DNA, 25 bp, Mus musculus
aactgaatcttatatcaatcactgg

SEQ ID NO: 39215 - DNA, 25 bp, Mus musculus
aactgaatgatgcttatatcccttg

SEQ ID NO: 39216 - DNA, 25 bp, Mus musculus
aactgaatgatggttatatcccttg

SEQ ID NO: 39217 - DNA, 25 bp, Mus musculus
aactgaatgattaactgatgcaacc

SEQ ID NO: 39218 - DNA, 25 bp, Mus musculus
aactgaatgatttactgatgcaacc

SEQ ID NO: 39219 - DNA, 25 bp, Mus musculus
aactgaatgcacaactcttcacaga

SEQ ID NO: 39220 - DNA, 25 bp, Mus musculus
aactgaatgcactactcttcacaga

SEQ ID NO: 39221 - DNA, 25 bp, Mus musculus
aactgaatgggcctagtctgcataa

SEQ ID NO: 39222 - DNA, 25 bp, Mus musculus
aactgaatgggcgtagtctgcataa

SEQ ID NO: 39223 - DNA, 25 bp, Mus musculus
aactgaatggtcaggatctggaact

SEQ ID NO: 39224 - DNA, 25 bp, Mus musculus
aactgaatggtctggatctggaact

SEQ ID NO: 39225 - DNA, 25 bp, Mus musculus
aactgaatgtttcctatcaaaagaa

SEQ ID NO: 39226 - DNA, 25 bp, Mus musculus
aactgaatgtttgctatcaaaagaa

SEQ ID NO: 39227 - DNA, 25 bp, Mus musculus
aactgaattagcatgttccaaacta

SEQ ID NO: 39228 - DNA, 25 bp, Mus musculus
aactgaattagcttgttccaaacta

SEQ ID NO: 39229 - DNA, 25 bp, Mus musculus
aactgaatttatatggctacactaa

SEQ ID NO: 39230 - DNA, 25 bp, Mus musculus
aactgaatttatttggctacactaa

SEQ ID NO: 39231 - DNA, 25 bp, Mus musculus
aactgacaacacctacctttcaggg

SEQ ID NO: 39232 - DNA, 25 bp, Mus musculus
aactgacaacacgtacctttcaggg

SEQ ID NO: 39233 - DNA, 25 bp, Mus musculus
aactgacaatgcctgattctgtccc

SEQ ID NO: 39234 - DNA, 25 bp, Mus musculus
aactgacaatgcgtgattctgtccc

SEQ ID NO: 39235 - DNA, 25 bp, Mus musculus
aactgacacacaactacatacctac

SEQ ID NO: 39236 - DNA, 25 bp, Mus musculus
aactgacacacatctacatacctac

SEQ ID NO: 39237 - DNA, 25 bp, Mus musculus
aactgacaccctcgttggcaagtta

SEQ ID NO: 39238 - DNA, 25 bp, Mus musculus
aactgacaccctggttggcaagtta

SEQ ID NO: 39239 - DNA, 25 bp, Mus musculus
aactgacactgaaattagaccgaaa

SEQ ID NO: 39240 - DNA, 25 bp, Mus musculus
aactgacactgatattagaccgaaa

SEQ ID NO: 39241 - DNA, 25 bp, Mus musculus
aactgacactgtaacaaggccatga

SEQ ID NO: 39242 - DNA, 25 bp, Mus musculus
aactgacactgttacaaggccatga

SEQ ID NO: 39243 - DNA, 25 bp, Mus musculus
aactgacagcacaattgaggtggac

SEQ ID NO: 39244 - DNA, 25 bp, Mus musculus
aactgacagcactattgaggtggac

SEQ ID NO: 39245 - DNA, 25 bp, Mus musculus
aactgacagcttcctcaagtgatcc

SEQ ID NO: 39246 - DNA, 25 bp, Mus musculus
aactgacagcttgctcaagtgatcc

SEQ ID NO: 39247 - DNA, 25 bp, Mus musculus
aactgacaggacatcgggctgctgg

SEQ ID NO: 39248 - DNA, 25 bp, Mus musculus
aactgacaggacttcgggctgctgg

SEQ ID NO: 39249 - DNA, 25 bp, Mus musculus
aactgacagtagctaggacattact

SEQ ID NO: 39250 - DNA, 25 bp, Mus musculus
aactgacagtaggtaggacattact

SEQ ID NO: 39251 - DNA, 25 bp, Mus musculus
aactgacagtttaaattctacccat

SEQ ID NO: 39252 - DNA, 25 bp, Mus musculus
aactgacagttttaattctacccat

SEQ ID NO: 39253 - DNA, 25 bp, Mus musculus
aactgacatggtctccgtacgaggt

SEQ ID NO: 39254 - DNA, 25 bp, Mus musculus
aactgacatggtgtccgtacgaggt

SEQ ID NO: 39255 - DNA, 25 bp, Mus musculus
aactgacattagacctattcctgat

SEQ ID NO: 39256 - DNA, 25 bp, Mus musculus
aactgacattagtcctattcctgat

SEQ ID NO: 39257 - DNA, 25 bp, Mus musculus
aactgacattccctgattgactgag

SEQ ID NO: 39258 - DNA, 25 bp, Mus musculus
aactgacattccgtgattgactgag

SEQ ID NO: 39259 - DNA, 25 bp, Mus musculus
aactgacattttcctactctcgaaa

SEQ ID NO: 39260 - DNA, 25 bp, Mus musculus
aactgacattttgctactctcgaaa

SEQ ID NO: 39261 - DNA, 25 bp, Mus musculus
aactgaccaagtacctacagagccg

SEQ ID NO: 39262 - DNA, 25 bp, Mus musculus
aactgaccaagttcctacagagccg

SEQ ID NO: 39263 - DNA, 25 bp, Mus musculus
aactgaccaatcatggcaagacagg

SEQ ID NO: 39264 - DNA, 25 bp, Mus musculus
aactgaccaatcttggcaagacagg

SEQ ID NO: 39265 - DNA, 25 bp, Mus musculus
aactgaccagagaccctagatcttt

SEQ ID NO: 39266 - DNA, 25 bp, Mus musculus
aactgaccagagtccctagatcttt

SEQ ID NO: 39267 - DNA, 25 bp, Mus musculus
aactgaccagctaactctgggcatc

SEQ ID NO: 39268 - DNA, 25 bp, Mus musculus
aactgaccagcttactctgggcatc

SEQ ID NO: 39269 - DNA, 25 bp, Mus musculus
aactgaccatttatcacatagtact

SEQ ID NO: 39270 - DNA, 25 bp, Mus musculus
aactgaccatttttcacatagtact

SEQ ID NO: 39271 - DNA, 25 bp, Mus musculus
aactgaccctagaagctaccaggtg

SEQ ID NO: 39272 - DNA, 25 bp, Mus musculus
aactgaccctagtagctaccaggtg

SEQ ID NO: 39273 - DNA, 25 bp, Mus musculus
aactgaccctatacttttggccaag

SEQ ID NO: 39274 - DNA, 25 bp, Mus musculus
aactgaccctattcttttggccaag

SEQ ID NO: 39275 - DNA, 25 bp, Mus musculus
aactgaccctgtcaaatcctcctcc

SEQ ID NO: 39276 - DNA, 25 bp, Mus musculus
aactgaccctgtgaaatcctcctcc

SEQ ID NO: 39277 - DNA, 25 bp, Mus musculus
aactgaccgcacagagcagtggtat

SEQ ID NO: 39278 - DNA, 25 bp, Mus musculus
aactgaccgcactgagcagtggtat

SEQ ID NO: 39279 - DNA, 25 bp, Mus musculus
aactgacctaacaagcagctttgat

SEQ ID NO: 39280 - DNA, 25 bp, Mus musculus
aactgacctaactagcagctttgat

SEQ ID NO: 39281 - DNA, 25 bp, Mus musculus
aactgacctcatacctgttgcctca

SEQ ID NO: 39282 - DNA, 25 bp, Mus musculus
aactgacctcattcctgttgcctca

SEQ ID NO: 39283 - DNA, 25 bp, Mus musculus
aactgacctgccagataagtctaga

SEQ ID NO: 39284 - DNA, 25 bp, Mus musculus
aactgacctgcctgataagtctaga

SEQ ID NO: 39285 - DNA, 25 bp, Mus musculus
aactgacctgcgctggagctgctct

SEQ ID NO: 39286 - DNA, 25 bp, Mus musculus
aactgacctgcggtggagctgctct

SEQ ID NO: 39287 - DNA, 25 bp, Mus musculus
aactgaccttataatctgcacgtaa

SEQ ID NO: 39288 - DNA, 25 bp, Mus musculus
aactgaccttattatctgcacgtaa

SEQ ID NO: 39289 - DNA, 25 bp, Mus musculus
aactgacgaggactgctcaagccct

SEQ ID NO: 39290 - DNA, 25 bp, Mus musculus
aactgacgaggagtgctcaagccct

SEQ ID NO: 39291 - DNA, 25 bp, Mus musculus
aactgacggatgatcagtacctgtt

SEQ ID NO: 39292 - DNA, 25 bp, Mus musculus
aactgacggatgttcagtacctgtt

SEQ ID NO: 39293 - DNA, 25 bp, Mus musculus
aactgacggccgacgacgggcagcc

SEQ ID NO: 39294 - DNA, 25 bp, Mus musculus
aactgacggccgtcgacgggcagcc

SEQ ID NO: 39295 - DNA, 25 bp, Mus musculus
aactgacgtcttagcatgtctaaga

SEQ ID NO: 39296 - DNA, 25 bp, Mus musculus
aactgacgtctttgcatgtctaaga

SEQ ID NO: 39297 - DNA, 25 bp, Mus musculus
aactgacgtggcatgttaaggtctg

SEQ ID NO: 39298 - DNA, 25 bp, Mus musculus
aactgacgtggcttgttaaggtctg

SEQ ID NO: 39299 - DNA, 25 bp, Mus musculus
aactgactcacgagatggcgaccat

SEQ ID NO: 39300 - DNA, 25 bp, Mus musculus
aactgactcacgtgatggcgaccat

SEQ ID NO: 39301 - DNA, 25 bp, Mus musculus
aactgactcagacaacttctccatt

SEQ ID NO: 39302 - DNA, 25 bp, Mus musculus
aactgactcagagaacttctccatt

SEQ ID NO: 39303 - DNA, 25 bp, Mus musculus
aactgactcatactgctgtgtataa

SEQ ID NO: 39304 - DNA, 25 bp, Mus musculus
aactgactcatagtgctgtgtataa

SEQ ID NO: 39305 - DNA, 25 bp, Mus musculus
aactgactcattcctcggaatgtca

SEQ ID NO: 39306 - DNA, 25 bp, Mus musculus
aactgactcattgctcggaatgtca

SEQ ID NO: 39307 - DNA, 25 bp, Mus musculus
aactgactccagaccacaactaatg

SEQ ID NO: 39308 - DNA, 25 bp, Mus musculus
aactgactccagtccacaactaatg

SEQ ID NO: 39309 - DNA, 25 bp, Mus musculus
aactgactcgagctgatcctgagca

SEQ ID NO: 39310 - DNA, 25 bp, Mus musculus
aactgactcgaggtgatcctgagca

SEQ ID NO: 39311 - DNA, 25 bp, Mus musculus
aactgactctagacctcactgattt

SEQ ID NO: 39312 - DNA, 25 bp, Mus musculus
aactgactctagtcctcactgattt

SEQ ID NO: 39313 - DNA, 25 bp, Mus musculus
aactgactgcccatgtaatgaacgt

SEQ ID NO: 39314 - DNA, 25 bp, Mus musculus
aactgactgcccttgtaatgaacgt

SEQ ID NO: 39315 - DNA, 25 bp, Mus musculus
aactgactgggacgattccctggga

SEQ ID NO: 39316 - DNA, 25 bp, Mus musculus
aactgactgggaggattccctggga

SEQ ID NO: 39317 - DNA, 25 bp, Mus musculus
aactgactgggtatgtacaattcta

SEQ ID NO: 39318 - DNA, 25 bp, Mus musculus
aactgactgggtttgtacaattcta

SEQ ID NO: 39319 - DNA, 25 bp, Mus musculus
aactgactgtgtagtgctcagcacc

SEQ ID NO: 39320 - DNA, 25 bp, Mus musculus
aactgactgtgttgtgctcagcacc

SEQ ID NO: 39321 - DNA, 25 bp, Mus musculus
aactgacttccaagcggttggctga

SEQ ID NO: 39322 - DNA, 25 bp, Mus musculus
aactgacttccatgcggttggctga

SEQ ID NO: 39323 - DNA, 25 bp, Mus musculus
aactgacttttgaactatttacagg

SEQ ID NO: 39324 - DNA, 25 bp, Mus musculus
aactgacttttgtactatttacagg

SEQ ID NO: 39325 - DNA, 25 bp, Mus musculus
aactgagaaacaatcctgatagatg

SEQ ID NO: 39326 - DNA, 25 bp, Mus musculus
aactgagaaacaatctgcccctgga

SEQ ID NO: 39327 - DNA, 25 bp, Mus musculus
aactgagaaacattcctgatagatg

SEQ ID NO: 39328 - DNA, 25 bp, Mus musculus
aactgagaaacattctgcccctgga

SEQ ID NO: 39329 - DNA, 25 bp, Mus musculus
aactgagaaactagcgagacttcct

SEQ ID NO: 39330 - DNA, 25 bp, Mus musculus
aactgagaaacttgcgagacttcct

SEQ ID NO: 39331 - DNA, 25 bp, Mus musculus
aactgagaaatcaggacctcccttg

SEQ ID NO: 39332 - DNA, 25 bp, Mus musculus
aactgagaaatctggacctcccttg

SEQ ID NO: 39333 - DNA, 25 bp, Mus musculus
aactgagaacaaccctccatcagat

SEQ ID NO: 39334 - DNA, 25 bp, Mus musculus
aactgagaacaagcctccatcagat

SEQ ID NO: 39335 - DNA, 25 bp, Mus musculus
aactgagaacttcggcaacaggttt

SEQ ID NO: 39336 - DNA, 25 bp, Mus musculus
aactgagaacttgggcaacaggttt

SEQ ID NO: 39337 - DNA, 25 bp, Mus musculus
aactgagaagtacctggatcttatg

SEQ ID NO: 39338 - DNA, 25 bp, Mus musculus
aactgagaagtagctggatcttatg

SEQ ID NO: 39339 - DNA, 25 bp, Mus musculus
aactgagacagtaggctatgtgaat

SEQ ID NO: 39340 - DNA, 25 bp, Mus musculus
aactgagacagtcatgcagccgcat

SEQ ID NO: 39341 - DNA, 25 bp, Mus musculus
aactgagacagtcccatgctggcct

SEQ ID NO: 39342 - DNA, 25 bp, Mus musculus
aactgagacagtgatgcagccgcat

SEQ ID NO: 39343 - DNA, 25 bp, Mus musculus
aactgagacagtgccatgctggcct

SEQ ID NO: 39344 - DNA, 25 bp, Mus musculus
aactgagacagttggctatgtgaat

SEQ ID NO: 39345 - DNA, 25 bp, Mus musculus
aactgagaccaaagcccttccactt

SEQ ID NO: 39346 - DNA, 25 bp, Mus musculus
aactgagaccaatgcccttccactt

SEQ ID NO: 39347 - DNA, 25 bp, Mus musculus
aactgagactctacactaacggctg

SEQ ID NO: 39348 - DNA, 25 bp, Mus musculus
aactgagactcttcactaacggctg

SEQ ID NO: 39349 - DNA, 25 bp, Mus musculus
aactgagagcttaattgctgatttt

SEQ ID NO: 39350 - DNA, 25 bp, Mus musculus
aactgagagctttattgctgatttt

SEQ ID NO: 39351 - DNA, 25 bp, Mus musculus
aactgagaggaaaaaagccatttac

SEQ ID NO: 39352 - DNA, 25 bp, Mus musculus
aactgagaggaataaagccatttac

SEQ ID NO: 39353 - DNA, 25 bp, Mus musculus
aactgagatctgacaacatagaggg

SEQ ID NO: 39354 - DNA, 25 bp, Mus musculus
aactgagatctgtcaacatagaggg

SEQ ID NO: 39355 - DNA, 25 bp, Mus musculus
aactgagatggcacgcagggcatgc

SEQ ID NO: 39356 - DNA, 25 bp, Mus musculus
aactgagatggctcgcagggcatgc

SEQ ID NO: 39357 - DNA, 25 bp, Mus musculus
aactgagcaagcacgtggaccagaa

SEQ ID NO: 39358 - DNA, 25 bp, Mus musculus
aactgagcaagccaacagacctggt

SEQ ID NO: 39359 - DNA, 25 bp, Mus musculus
aactgagcaagcgaacagacctggt

SEQ ID NO: 39360 - DNA, 25 bp, Mus musculus
aactgagcaagctcgtggaccagaa

SEQ ID NO: 39361 - DNA, 25 bp, Mus musculus
aactgagcaattagatgctgtctat

SEQ ID NO: 39362 - DNA, 25 bp, Mus musculus
aactgagcaatttgatgctgtctat

SEQ ID NO: 39363 - DNA, 25 bp, Mus musculus
aactgagcacacagagcactaggca

SEQ ID NO: 39364 - DNA, 25 bp, Mus musculus
aactgagcacactgagcactaggca

SEQ ID NO: 39365 - DNA, 25 bp, Mus musculus
aactgagcactgaacctgatgaact

SEQ ID NO: 39366 - DNA, 25 bp, Mus musculus
aactgagcactgtacctgatgaact

SEQ ID NO: 39367 - DNA, 25 bp, Mus musculus
aactgagccagtaggtagatttcct

SEQ ID NO: 39368 - DNA, 25 bp, Mus musculus
aactgagccagttggtagatttcct

SEQ ID NO: 39369 - DNA, 25 bp, Mus musculus
aactgagccataagtgcagcagcag

SEQ ID NO: 39370 - DNA, 25 bp, Mus musculus
aactgagccatatgtgcagcagcag

SEQ ID NO: 39371 - DNA, 25 bp, Mus musculus
aactgagccttcaccatgttttggt

SEQ ID NO: 39372 - DNA, 25 bp, Mus musculus
aactgagccttctccatgttttggt

SEQ ID NO: 39373 - DNA, 25 bp, Mus musculus
aactgagcgactaccggagtccagt

SEQ ID NO: 39374 - DNA, 25 bp, Mus musculus
aactgagcgacttccggagtccagt

SEQ ID NO: 39375 - DNA, 25 bp, Mus musculus
aactgagctaaaacttcaacaccga

SEQ ID NO: 39376 - DNA, 25 bp, Mus musculus
aactgagctaaatcttcaacaccga

SEQ ID NO: 39377 - DNA, 25 bp, Mus musculus
aactgagctacaatttcagcccagg

SEQ ID NO: 39378 - DNA, 25 bp, Mus musculus
aactgagctacattttcagcccagg

SEQ ID NO: 39379 - DNA, 25 bp, Mus musculus
aactgagctcccaaaattaatatgt

SEQ ID NO: 39380 - DNA, 25 bp, Mus musculus
aactgagctcccacaacaggaggaa

SEQ ID NO: 39381 - DNA, 25 bp, Mus musculus
aactgagctccctaaattaatatgt

SEQ ID NO: 39382 - DNA, 25 bp, Mus musculus
aactgagctccctcaacaggaggaa

SEQ ID NO: 39383 - DNA, 25 bp, Mus musculus
aactgagctgctatgtggaccacct

SEQ ID NO: 39384 - DNA, 25 bp, Mus musculus
aactgagctgctttgtggaccacct

SEQ ID NO: 39385 - DNA, 25 bp, Mus musculus
aactgagctgtcaggagatctctgg

SEQ ID NO: 39386 - DNA, 25 bp, Mus musculus
aactgagctgtctggagatctctgg

SEQ ID NO: 39387 - DNA, 25 bp, Mus musculus
aactgagcttatcttgcactgtgga

SEQ ID NO: 39388 - DNA, 25 bp, Mus musculus
aactgagcttatgttgcactgtgga

SEQ ID NO: 39389 - DNA, 25 bp, Mus musculus
aactgagcttccaagattacacata

SEQ ID NO: 39390 - DNA, 25 bp, Mus musculus
aactgagcttcctagattacacata

SEQ ID NO: 39391 - DNA, 25 bp, Mus musculus
aactgaggaacccagcatcgagctg

SEQ ID NO: 39392 - DNA, 25 bp, Mus musculus
aactgaggaaccgagcatcgagctg

SEQ ID NO: 39393 - DNA, 25 bp, Mus musculus
aactgaggaagcatcaagccatggt

SEQ ID NO: 39394 - DNA, 25 bp, Mus musculus
aactgaggaagcttcaagccatggt

SEQ ID NO: 39395 - DNA, 25 bp, Mus musculus
aactgaggacacaatccaagcccag

SEQ ID NO: 39396 - DNA, 25 bp, Mus musculus
aactgaggacactatccaagcccag

SEQ ID NO: 39397 - DNA, 25 bp, Mus musculus
aactgaggaccgatgctctagggaa

SEQ ID NO: 39398 - DNA, 25 bp, Mus musculus
aactgaggaccgttgctctagggaa

SEQ ID NO: 39399 - DNA, 25 bp, Mus musculus
aactgaggacctatctgtctgactg

SEQ ID NO: 39400 - DNA, 25 bp, Mus musculus
aactgaggacctttctgtctgactg

SEQ ID NO: 39401 - DNA, 25 bp, Mus musculus
aactgaggagagaccccatgttctt

SEQ ID NO: 39402 - DNA, 25 bp, Mus musculus
aactgaggagagtccccatgttctt

SEQ ID NO: 39403 - DNA, 25 bp, Mus musculus
aactgaggagatatgtattcttggt

SEQ ID NO: 39404 - DNA, 25 bp, Mus musculus
aactgaggagatttgtattcttggt

SEQ ID NO: 39405 - DNA, 25 bp, Mus musculus
aactgaggagcgctgcatagctgat

SEQ ID NO: 39406 - DNA, 25 bp, Mus musculus
aactgaggagcggtgcatagctgat

SEQ ID NO: 39407 - DNA, 25 bp, Mus musculus
aactgaggatttaggcacaggctga

SEQ ID NO: 39408 - DNA, 25 bp, Mus musculus
aactgaggattttggcacaggctga

SEQ ID NO: 39409 - DNA, 25 bp, Mus musculus
aactgaggcagcagaagggacctga

SEQ ID NO: 39410 - DNA, 25 bp, Mus musculus
aactgaggcagctgaagggacctga

SEQ ID NO: 39411 - DNA, 25 bp, Mus musculus
aactgaggcctacagtggccactag

SEQ ID NO: 39412 - DNA, 25 bp, Mus musculus
aactgaggcctagagtggccactag

SEQ ID NO: 39413 - DNA, 25 bp, Mus musculus
aactgaggctacacacctagatggg

SEQ ID NO: 39414 - DNA, 25 bp, Mus musculus
aactgaggctactcacctagatggg

SEQ ID NO: 39415 - DNA, 25 bp, Mus musculus
aactgaggctgacaatacgatcacc

SEQ ID NO: 39416 - DNA, 25 bp, Mus musculus
aactgaggctgagaatacgatcacc

SEQ ID NO: 39417 - DNA, 25 bp, Mus musculus
aactgaggctgtcgtaccgcacaaa

SEQ ID NO: 39418 - DNA, 25 bp, Mus musculus
aactgaggctgtggtaccgcacaaa

SEQ ID NO: 39419 - DNA, 25 bp, Mus musculus
aactgagggcctccgctgaaggaca

SEQ ID NO: 39420 - DNA, 25 bp, Mus musculus
aactgagggcctgcgctgaaggaca

SEQ ID NO: 39421 - DNA, 25 bp, Mus musculus
aactgagggttgagtaactctacca

SEQ ID NO: 39422 - DNA, 25 bp, Mus musculus
aactgagggttgtgtaactctacca

SEQ ID NO: 39423 - DNA, 25 bp, Mus musculus
aactgaggtagaacatgggttctga

SEQ ID NO: 39424 - DNA, 25 bp, Mus musculus
aactgaggtagatcatgggttctga

SEQ ID NO: 39425 - DNA, 25 bp, Mus musculus
aactgaggtctcactttgtaggaga

SEQ ID NO: 39426 - DNA, 25 bp, Mus musculus
aactgaggtctctctttgtaggaga

SEQ ID NO: 39427 - DNA, 25 bp, Mus musculus
aactgaggtgaacggcctgagaacc

SEQ ID NO: 39428 - DNA, 25 bp, Mus musculus
aactgaggtgaagggcctgagaacc

SEQ ID NO: 39429 - DNA, 25 bp, Mus musculus
aactgaggtgtgattctgtgtgaac

SEQ ID NO: 39430 - DNA, 25 bp, Mus musculus
aactgaggtgtgtttctgtgtgaac

SEQ ID NO: 39431 - DNA, 25 bp, Mus musculus
aactgaggtgttcgcattgtttcta

SEQ ID NO: 39432 - DNA, 25 bp, Mus musculus
aactgaggtgttggcattgtttcta

SEQ ID NO: 39433 - DNA, 25 bp, Mus musculus
aactgaggttgtcacttggtggcaa

SEQ ID NO: 39434 - DNA, 25 bp, Mus musculus
aactgaggttgtgacttggtggcaa

SEQ ID NO: 39435 - DNA, 25 bp, Mus musculus
aactgagtacagatctggtcgggag

SEQ ID NO: 39436 - DNA, 25 bp, Mus musculus
aactgagtacagttctggtcgggag

SEQ ID NO: 39437 - DNA, 25 bp, Mus musculus
aactgagtaggtacttcttggaaga

SEQ ID NO: 39438 - DNA, 25 bp, Mus musculus
aactgagtaggttcttcttggaaga

SEQ ID NO: 39439 - DNA, 25 bp, Mus musculus
aactgagtcaacataacaatcctga

SEQ ID NO: 39440 - DNA, 25 bp, Mus musculus
aactgagtcaacttaacaatcctga

SEQ ID NO: 39441 - DNA, 25 bp, Mus musculus
aactgagtcactatttatccttagg

SEQ ID NO: 39442 - DNA, 25 bp, Mus musculus
aactgagtcactttttatccttagg

SEQ ID NO: 39443 - DNA, 25 bp, Mus musculus
aactgagtcagacttggcaaggcct

SEQ ID NO: 39444 - DNA, 25 bp, Mus musculus
aactgagtcagagttggcaaggcct

SEQ ID NO: 39445 - DNA, 25 bp, Mus musculus
aactgagtcatacccctgagccctg

SEQ ID NO: 39446 - DNA, 25 bp, Mus musculus
aactgagtcatagccctgagccctg

SEQ ID NO: 39447 - DNA, 25 bp, Mus musculus
aactgagtcattaggagcctgtttg

SEQ ID NO: 39448 - DNA, 25 bp, Mus musculus
aactgagtcatttggagcctgtttg

SEQ ID NO: 39449 - DNA, 25 bp, Mus musculus
aactgagtccaaaacttgttccagg

(The sequence listing continues in the following parts.)

What is claimed is:

1. An array comprising a plurality of nucleic acid probes, wherein the plurality comprises each of the sequences listed in SEQ ID NOS 1-982,914, and wherein each probe in the plurality of nucleic acid probes consists of one of the sequence listed in SEQ ID NOS: 1-982,914.

2. The array of claim 1 further comprising at least one probe that is the perfect complement of one of the sequences listed in SEQ ID Nos. 1-982,914.

3. The array of claim 1 further comprising at least one probe that is the mismatch probe corresponding to one of the sequences listed in SEQ ID Nos. 1-982,914, wherein the mismatch position is the central position.

4. The array of claim 1 wherein said plurality of nucleic acid probes is attached to a solid support.

5. The array of claim 1 wherein the array comprises a plurality of beads wherein the probes are attached to the beads and the probes on a bead consist of one of the sequences listed in SEQ ID Nos. 1-982,914.

6. The array of claim 1 wherein the array consists of a single contiguous solid support.

* * * * *